United States Patent 10,724,096 (METHODS AND COMPOSITIONS FOR INHIBITING AND TREATING NEUROLOGICAL CONDITIONS) - sequence listing, part 28

SEQ ID NO: 280 - DNA, 1776225 bp, Homo sapiens
caagataaggatgataagtgtacatgaagtattacagataaacaggactctctggcctctcctgtgtttatttggtaacgaatagtagataatctctatgatgggaaacgctgaatgacacgtgataatttcattcattcaacaagcaaatattccttaactattaggtgctgaccatacagaaatgacagtgatatgatcccaaatatatattgcttttgttgatttagcgcccaatattttatgttatttgtgagttaaacaccaaaacttagtgaaattacagaacttcttaagtgtaaaataaagcagtgtggttaggcaggattttgtcatataggcactatatgtagaatagtggtttcagtagatttgtcttcctctaaattcactcatgacttgcaatggatggatttttttctttgctgagcctcgtctgacagctgcacacgtttcctctggcttctctcttttaatcaagggtttttttgcaggagccttcattctccacatcacaactgggtgccggggcccagcaggactctggattcggatgatcttggttgaggcaatgtaagacattttcactgtttgcactacagcattcattaaatttttggctgcttggatcagggatgtgacactgtccaactgtagggaaaaaagagaaaaaagagctattattccaggaggttttgttaattattgccaagcgtgggcatggtggcatgtgcccgttgccccagctactcaggaggctgaggagggaggatcacttgagcccaggaggcaaaggttgcagtgagccaagatggcgtcactgcaccgcagcctgggtgacagtgaaaccccatataaaaaaataaataaataataaaaataaaaataactgagcctgatagtctattaatgtcacaataagctgctcaatattgtctatgcccaaacataaatcaataagttctgcctcatttttttgtatctagatggataagtgattatgttcaattaactcttatgctaattatgtaatgtgttttgcaaataaccctaatacgccaatttaaatagaatcctgttaaatattatcctgtataaatcttacttttattatagtgtctcttctgtgctttgtggtattatatggtttcagtttaacaacggtacaaattggaccaattctacaaatgtttacggataaaggacttgctcttaaaaacatatcaatagccatttactacaaaaaggtggagtttagcaacaataaaatacattttctgtttcctcataaaatgttaacatttcgtccatgtaagtagtttgtatagaatacctggatcttttctcaaaaacactaaatacctataaatccttgacaactatgtcaatttggaatgtctgctagcaaacccttgccaaaaccctattgtaattagtgatagctaagaggaatattcaaaaagacatggtacatattccttctcttgcttttggaagtttctcacagagattgtgtcaaaacactagaatgctttctactcgtaggacactagtctaactccctatagtttggattcaagactgttaccagacatacgccttacatgaggattctaagcctacgtgaacctcacttccactggtgtggatctcactttcttgcacctggtctgtcacctgggaaagcagcttcccaatcacagggcagtgtgaactgccatgccaactgcttcttctgagactcctgctgagagaaaaacctgatgctgcttggaaagatatatggtctgtccagtaacctttttggtaaattggtaccaaatgtagcctatgatcttgagtctcaaggtgtacctgaattcaaagacccctgttggatgttggtcctgcacaaaagcaatttttgaaagacaaatgtcaagagtttggttccaagtgtcagaagagcttaaaataattgctaatatctattatatgctgtagtatgcagttgacataaagtaactcatagcaaccctatgaggtaagtactcttattatcttcattttatggatgaagaaacaaaggaactggaaggtctggtgacttgctcaaagtaacacagatattagatagtagggctggaactggaaccaagtaagtctggttctaccttgcgttttttctcattacataaacctgcctccaagaatatcctacttccaatatgtgattatttttcgatatcaaatagttaaataaattatactaaccttaacagagtgtctaaaattttaaagttgactagccagcaactctgcttttaagaagcttgctcttatttttgtaatgcatgttgctaccaggagcaatagagtatcttatttgccaatgcattttgttaggattgtggtttgaaaatttatatactaatttccaagttgtgtttctttggaagagcaaatagaagtactcagtcacccttataggccccaaaccatttaaagacatttagattaagactatttcataacaaaacatttttaaattttaaaacctgggtctcaatacacatatcaataaggcaaagaagaaccataaacaaatcacattataggttctaggacatggaagtacataacatttatctttaaatcttttaaatgtgtcagtataaatacaatcctgattaaccaaacttttttttcttattctccaataaaattaagtcaatttgtttgcttggttttgcaaaaataacaggatttgatcctaggactccagagtttcttctcaatgtagttatttttaaagttgtattcgttcatttacacactactacaaagatactacccgagactgggttatttataaaggaaagaggtttaattgactcacagttctgcatgtctggcagggaggcctcaggaaacttacaatcatggcagaaggggaagcagacacatcttacatggcaacaggagagagacagcaaacaaaagcagggaaaactgccttataaaaccatcgatctcatgagaactcactatcacgagaacagcatgggggaaactgcctccatgatccagtcacctccctccctcaatatgtggggaattacaggtcgctccctcacacttggggattacaattgaagatgagatttgggtggggacacaaagcctaaccatatcaaaagtaatcagttaaactatttggaaatgaagttagcataggcaatgtcaaagggcatatgtatatgtaatggcagattacaactgacagcataaactatttctaaaaagacttaaggatatttgtagtctttttaacttataggtgccatttgcacctcaagattgacctaatggtagtagttttatgccacagtaaatgcttaaatatattttctgtaaccaaaatgcattaacttattcaatgtttttatgatctactctgaatgtctcttttaagagctaattttatcccaatactggcttaatacattcttttgtttctgaacagatttttaaaagaacggttggcattgagagcattctcccttttcagatgcattcaaaaatgctaaacagccagggtggcttcacaggcaaatcagataaggagctttgttaaatccaggcaaagtggtgttgcatctccaaattgaaattgtcaagcttctaattaaattgagaaggtagttcattctttggatatgaagaatcattccaatgggccactgatataattggcacagtagatttgtcctttgtcaatgttccgttagaatgtgacaacaaaagacaacaacttaagttgaaaggggagaaatcaatgcatgaaataactaaaagaaaagtaaatgtaacactacagaaagggccatacataaaaggaaatatgacatttattcagttataatcttgtcctgtcaaaaagcatctataagatgctttttttcctaaagctaatttttttctgaaggagatactctaggccagaaacattttatatcccgtaaaaagaaataatcacaaacaatgccaattcaggtggctactcagaattccttttacttttatttaaaatgacctattataaaaatatacatattggtaataatcctaatatttagctatccttcaaccatgttgacttaaggcaaatgcttagctgaagaaccaattttccaaaatattacagccctaattaaacagattcagaaaaattagtatattctttcccatgtagagccagcaagagtgggttaggtatggcatggttctctcaacaccagtgtttcaaccttagcttcctcttctcagcaccatcaatcaggacactgagatctgccctctccatagcgggctgtataataatattaaaccctgcatcttgattatgcttcaggatctatgagctaagagtaacaaagcaccagcctccatccttgatcctacacttatgtctttcttgaccataagcaaggaacaactaggctgcgtgaaactaaaagaccaaatgacattagttttacaacccatgcagagcttccagaccacagatatttccacgtacctataattttcaactctttcaatctcgatcattctaccattttgataatatttggcaatatttaatatttcttagctcacttctctctctactacagatgtcttgcagaacaaaattatccatttccctaacactgagccaacaggtgactgtctaccatttttagagaatccccttgtattagtttgttctcacgctgctaataaagacatacctgagactgggtaatttataaaggaaagaggtttaattgactcacagtttcacagggctagggaggcctcacaatcatgtcttacatggcaatcaaggcaagaaggaacaaagtcatgtcttacatggtggcaggcaagagagtgtgtgcagaggaactgccctgttataaaaccatcagatcctgtgagacttattcaccatcatgagaacatcatgggaaaaacctgccccatgattcaattacctcccactgggtccctcccatgacacatggggattactacaattcaagatgagttttgggtagggacacaaagccaaaccacaacaccctcactgaacaaattagtttctagataaattaatggtccccaacctgaaactaacagaaaatgcatctgtgtgtttttagctaattcttgtatccattctacccaaacactagtctaaacttccactttcatcaaacctctagcccctcatattcccacttgttctgcagattacttcacttacaacaaatatgaaataagcaaacagacaacaacaataaaatcgaaacagtaaaaatgaaactgtccccaacttctatctttcattcttatccatttctattaaaatgaaaattatctggttctcttcctctctaccttcttgcagactttgcacatttaataacttctttcttctaatatatcttttcttttttttgagaaggggtctcgctctgttgtccagactggagtgcattggtgtgatctcagcttactgcaacttccacctcctgagttcaagcaattctcatgcctcagctccccaagtagctggcattacaggtgcatgccaccatgcctggctaatttttctgtttttagtagagacgggttttcaccatattggctaggtcagtccccaactcctgacctcaggtcatccgccttccttggcctcccaaagtgctgggattacaggcataagtcactgcacttggctcttcttgtaatatatctttattctattcctttctactgactttttcactgtagtatataagtgtttataaaaccatatcttaaaacatagccagacttattaaaaggttatctattatccctaaaactattttcctcacttatcacttcttaagccatctgattcctttcatataaatgcttcccctttatatatatgtatgtatacacataatatataaaatgacacatatatatcaaatatgtgataggatatataatcagacatcttatatattaatatgtaatgtatgctagatgtattatataatatataatagatactaaatatataatagattacatacatgttaaatatataacatatatgtgaaatttttcaattggtaacctgcataactgttttctttcaatcaaatcacatttataagatcaattatttctcattcttgaatgcttaattacatataaatatcacagtttatccattctactattaataggcttttaggtagtttggagctacttaaaatatataaatataaaataaataggaacttatgaatattctagtatgtgtcttttggtgaacaaatgtatacaattttatcaagtatgtacctgagagtgccactgtggaattatgaaaatgcatatattcagttttattggataattccagggatttccaaagtgcttctgcaaatttatatttctagcaacaatatatgagtgttccaatttttttttttttttttgagatggagtttcactcttgttgcccaggctggagtgcaatggttcaattttggctcactgcaacctctgcctcccgggttcaagcgattctcctgcctcagcctaccaagtagctgggattacaggcatgtgccaccacacctggctaattttgtatttttagtagagacagggtttctccatgttggtcaggctcgtcttgaactcccaaccttaggtgatccgcctgccttggcctcccaaagtgctgggattacaggcttgagtcttccaattgtcacacatcttcatctacattttttttcccatatttttcacattaggcatttttgcaagtatgtagagatattatattgaggtttaattggcatctcattaattactaatgaagctcagcatattctcctatggttacagctttgacttgcacatacagacattgttcaattcaatttttaataatccttatatatttttctatagtcttttagattttctatgtatgaaagcatatcatctatgaataaagacagttgtatctttactttttcattttttttaatttttgttctgtattattccactagacagaaatgccagtatacaagtgagcatacaaggtatttttgaatcatactctaactcagggagaatgatttcaatatgttttcactgattttttagttaactcacgtattaaacgagtctttaaaaatttttctagtaaatgaggacttactagtcttccttttactattgatttctaacctaaaatactattgtgattaaagaataagctctgaatgatttaaaacattttatatttgtggatgctttgtttatgacgtataatcaaatatcatatgctttaggtacactagaaaggaatgtgaattctagtattgttacatcagtgttctatttatgacaactggtttccttaagcctattatcagtcaagatccttcccaccccaggtatcaggcatccacagatctgctatagagcaccacagattagatgtatattttctatagttgtatataaatggaattctatggtatgtaattttttgtgtgatgtttcacatggcattacatgtgtaagcttcacgtatgttgctgcatgtaccagtagtttattttatttattgctgagaagtattacattttatacatatactgcaatttgttaattcattatctttgtgactggcatttggtttgtttatttcatttgctataataaataaagttgttatggcattattgtacaactattttgtattgtatgtttttatttctcttgggtaaataactagaagaaaaactatgttctgttgttaagtatgtttctaacttcataagaaattaacaaactgttgaccaaagttattttaccattttgaattccaccagcaatgtatgagcattatagttattctgcatcctcagtcacacttggtattttgatattttgattctttttacattttaggaattttgatgagcataaagagaaatgtcactgttttgttttattcatcttctatggttaataatttttgtcctagcaaaaaatggctactacaatgttaaacagattttcctttatgctttcttccagatatttgaagttagagatttatgtttatgattatgcttactttgtattaatttttgtatatggagtaatgtgcagtacatttttttcatatacagatattgttcaagcatcatttagtcaaaatgattttcttttctttttaaataatcttggaattgctgtcaaaaataaattgatcatttatgtttggctctatttctgcttcatttctatgtctatctttataccagcatcatactatgacgctaacatcactttctcagggaagagttccacaatactaagactagattggatcctcttttttatgttcttatagaaatctatacttcatttaacattagattcatcagaaggcaatatgatccatgtaggtggagacaatgttcttttttacccttttattacttgacacagtctacaggagatatctggcatatgaataagttactggaaatatttcttatataaattgtagaattattaagtgcagaaaccacatgcaaaatactgtcaaaggcagacatgaattcaattattctcttgtattctgcacaaactgttaatattttccagacatttcataccctcactccatctaccaggaggtttctggcctctaaacatggcacaaaaacccttgatcaaataatgtttctcattatttatgtttaaaactcagaatgcaaatctgttggaagtcatgcttgtcagaaagttccaaagtcccaaattcccacttttagattattatttctcttttttttattatactttaaagttttagggtacatgtgcacaacgtgcaggttagttacatatgtatacatgtgctatgttggtgtgctgaacccagcaactcgtcatttaacattaggtatatctccaaatgctatccctcccccctcccctcacccacaacaggccccagtgtgtgatgttccccttcctgtgtccatgtgttctcattgttcaattctctcctatgagtgagaacatgtggtgtttggttttttgtccttgcgatagtttactgagaatgatggtttctagcttcatccatgtccctgcaaaggacatgaactcatcattttttgtgtctgcatagttttccatggtgtatatgtgccacattttcttaatccagtctatcattgttggacatttattaaaaactaacttcttgagaaatatgtcttattggcccaagaataaaacatcagttttatagtcgacaacctgtgtttgagtcccaactctgccacattctaaatacaaagcctggggagaaatcaattagcatatcttgggctcagtttcctttcagcataattacaatacaaatacatttcagtattgtttattaagatttaatgtgataacagctaatcttagatttgtgtatacacatacccatgcacataaatgaagctatagcttttctttctttcttttttttttttttggagacagagtctccctctgtcacctaggctggagtacagtggcgcaatctcggctcactgcaacctccaccttccgggttcacgccattctcctgtctcagcctccctagtagctgggactacaggcacccgccaccacgccctgctaatttttgtatttttagtacagacagggtttcaccatattggtcaggctggtctcaaattcctgaccttgtgatctgcctgccttggcctcccaaagtgttaggatacaggtgtgagccaccgtgcctggccaaagctatagcttttataagtttataaggtgaactggaaaataatattacaccaaatttgaggattttggtggaataaagcttaggacaaattctacccacggttgaaaatccagaaacagcacaagaacatttcttgacaattagaggtgaaggggcaggtactgtgactctttcccattatccacaacacatttgtgtgcacatgcatgtgcacacacctgtacttacacacacataagtatgtacacacacttcacacacttttcaaaatagtgtgaggtcagctcggttaatcacaatccttttggtgagtgtatcagtcagagctcagtaaaaaaaaaaaaaaaaaaaaaaaaaaacagaaactactgtaggtgcttcaaacatggaatttaacacaagaaattaattatataggcaacggaaaaactaagaagccaaatgtaaagcaaccctcacttcaccatcagcccaagttgttaccatcctggtgctgaaggaaatggagaagatgaacccatgccaagtagataaactaacacaaataaatgattgcttgtcagcagtctgtcaattttctcccattggttaactctagctgaaaatcagtaagtagtcaaaacatcttgactaggaaaatgttctgagagtaaaagtaaccatgactagcaaaatggatttttagcctgagcatgcatatcccctcatttttagtatgtcgtgatttcattcttaaaatctcatagtagttaatttttttatttctgtgattataatattgagtatgcttaaaaaataaagttcacacattcatactctcattcaaagaaatgtttgtacaaaatcaacattttgtataaatgtcatcttctctacctccatcactagaaaaaaaatatgatagagggatgggctttagctctcagcccttttacatattcttgatccttaagatgctgtcaaatatgcctattcatctctatacaaattccagtattttgttgggaaaatagaggctgcaagagcaatgggatgcatagattaattgtaaattaatacttatacacataagtatatatactgtacatgtttatataaagaatatggttttctgatttttaaataaaacatcagcttctctatttttttgaaatacagctgaagttttgccacatgttgaaaatttccttcatgacccagatttttcagggtctttgaagattcaaccatggtttaacttgaccctataaactatgtcattggctctattactaaattaatagctgactttcacaattatctataaagtgagagctatactgaaaagatgactagctttagacaattgcaacaacaaaatcaatgataaaggtaccagttttcagggctcttgtgtgcttttgaaatacatatctttctcgtagtctcatttaactggtagatgtgggcactgccatagcgccttgcctgctaggaactacaaacattacaatatgtactatgtcagttgtttaaacataggttaagcagcagcagcattaactcataccattattgcttcatcaacacactggaagtaaagggaagcagataacaagacagtacggtgctttggaaattattccagagatgcctggagcaacaaggttgttatctcagatgtgaggcatagaatatgtcaggtgtaaaaatgcaccctgaggaaaacaattaaagtgactgtcttctatttatttgagactcacacactctgtacctaagtgaatatcagaggttggagaagtgtctgtgatcgggaaatattaaagagttctgttcctgaatttagtctctcttcaaatcagaagtctctctcttcctgcctagagtgtcttataaaacacaaacaatcttccagagtctttctatagatcagcacagctgtctcctagctgagaggacgaggttcaaacacatttcagagcagctggttgttggcttcccagctgcttaggaaacaggaaattttattggcagcaatccccaacctgaaagcagtaggcatctaaactaatccccaggcattggaattcagcaaccaggagaagcaagaagccatgtgtggtttttaatcactgtgatgttggtctttgtgtaaattcaaagaataaagttctcaaggttacgtggatgaccatgtaggtgagagggtgtgtgtaagctgaagggaggagggaagtagagctgaggggttaagaatagggactctggaggtaaactacacaaattcaaacaaattctttctctctctgagtctgttttctcctctgttaaatggaaaaccaacgacatctaccttatagggttgtcagaaggacagaacgtgaggatccagattaatgatatagcagaatgggatgtatatatcctgtttcattgtcattactatgattgtcaaggttttgaaaacaacaataacactcctttatcaattgttattgcaaaaactgaaagaatgcacaaagctgaatttgtaataatggctcccattttgtaaacttgtgtcaagaccatatgctttaaaatattatctataatcctagtaacagccttgtgatgtaggtattatttttcccacttattagataaggtatctaagaactatgactcagataatttcagtgccttgcccaaggtaacacagatagtaagaggtaaacttgggattaattccaaatcgccgtaactccaaagccctcattctctcaaccatcttgtgctgctacttttttgagaaaaggaaatattttgtagctcattgaaaagatctcttaattgggactgttttgtcctggctaaggtctcccaacacagtcttcttattctacctctgaatactttgtactaagatattcttcctctctagtttgggagtctttttaaaattttttaaaaatccttcatcattgaactttgtccccacttggtttttctgaatggtgctccccagcttctcttgtcctccagaaacatgtgccaaatgtgattgctcgctcattctactgcaccttaattgcaccatttcaaggggaagattgacttttgtgattaaaaactgcttgaatttctgggcaatcctcatatgaactgaccccaatttttgaatgctatatgcctaataatagactgaatggtgcgtgtatgtatgcgctttccactttagattccctgggttttgtcttctcttttaaatctaactgttcaatttgaatatccatagataaaaaaaatacaacaatataatgataatagcacaatggtcacaaagaaagaagagggttgtcctctagaagaaagcttttaacctaggggtccagacacattggtgcatttcaattatttgtgacatgtctcacaagagccataatttgatagtaataataatagttcaaatattgaaattagaaaatgatttactgttttctcacaaattggagtggcttcaaggttatccctctaattatgcccttttactcacttgcattctgatatacttcctggagcaggaaagaaaggggaagggctaaagctagtttcctaggaatcaagcttagaagcccaccttattaagacagtgttcagtgaaatgggcctactcataagaaatgtgttctgcatgtgaatgtgcatcatagcaaaaaaacgaaaagtaaacatttgagattgtcttctccaggaactagagattaggactaaacagattaattgcctttaagatcttcctcataacaccagtgtaaaaaaaaatggccatgttctaagatcccagattcaaggtctaaagtatttttaataacctgtcttacccatttaataagttttcaattcattttcattcatcttccacaatgtcttctgtggcagacactatttgcccatttttccttgataatgataacctgattttattcaggcaattaaaccagacctgaccttttacaactgattggtctagaggtgtttcatgtgacccagtcccgaccagctgggtaggaggaaatctgctggagtggttctggcacagattcttttttgcatgtcatataaagagaatgctcagtctcttacttcttaagtgatggtgtaaaaacatgaaatttagagctgctgtatccatattgaaattatgaggaaacacataacagtaagaaacaaatgatgatagaaggaaatgttaaataatctaggtttaatgacattattaaactttgtaataaccataatctggacttcttgttatgatttaagtcattgataataagatttgttacttgcaattaaaagtactccttttccaaatcccattttcatttctctatttccagcctaaaatagttcagatgaagacaacgtaatcagtctcttagatgaggttccacattctaaccatcttggtaacttcagctgcagctgtttctctccagcactagttgcttcacatcacacccatgttcaaaaatatgcagactctccttgctctggatattcatgctgtgggcactcggtgtagcactggcttatctaactcccaggtcataactttacttaagcatgactagtccatttgctgttgctcatctacaactagttgatcctgccttcataatttgaattctaaattattattttatcgatggaatcacactcaccccactcacatctattttgatctttaaaatccagagttttgaagcaaagtttttgttacttcaataaaaacagtgtttgtaggtatggatcaaatcaacatggtattgagatattgtttaacaattccctcagaaagaaatacaaaaatatgggcagagaggtcaatcaaaaaaggaggatgacacactgagagaatggctgcatggaggaaccaaaggaaagcccctttaataagtaaaagatcttgggcaccaggaggtcagagttttcatcctaggtaatcattgattgaggaccgatataagatggccattgattttagggagctctgtagccttttagagaaaatactggggcttagtagtgcagaactcaaaatctcatagcctaagagaaacacagtaacactgagtgaggagtcagccaagcaaagaagtagcagtgcccagtgtgtccatatgactgtcccctattcactcccatgagcagctgaaatgataagacatgtacaagccagtgcaatttgagttattcctgttcatataacatgatatgtataacacttggattgctaagctctagaaaatttttggctacaacagtagtccgttgtcctaagaaactatatttcaacgtatcttcaatcttttgaaaaatctaccattcaaaggaagaataaagaatttgttttgcaagaagatgctaaaatgtgttttcgtaggctcctattatttcaagattttcagagatggatctgccaatgtcatggagataatttgcactaacttggttttttttaatcttatcgttctgcttataatcatgccatgcttctgttttgttctcttttaaaatatctggttattatgccttgatttatttgaattaagcagaaacggtgacagaggcaacttgtcctgtgctagagttttggtgatttgaaaagactggtttttatttttacagaaatcttattgaaaatgttccagttaaggaaaacctgctctagaagtgatgcagacaatgcagtttaaatgatgagaaaatgtggtgaatgctaatgttttatagcttttaattattttgtcctttgggttcagcgaaatggttgtgtatcttagggtcacggagaacattcattttctaagtgtgtgtgtgtaatttttcttctttatttctttgttaattttttaaattgacagataatattttatgtttttatcaagcacaacatgcattctagcttatggaaaggcttttgcactgagtatagaaggctaggggtattttcagtgggtgaacttttatggataatgatatgaccaagctatagggcagcgtttatgaatgcatattttattggaactgataaagaagtgagatggtctgtggaatagacagtcaagagtttagatagtgaggtttttgcaacagcatggaaagaaaagtatcaatcttgcttctttgttcagatacctgatgtatcttggtttcaggcttttcaatttattgttcaaaatgctaccagggaagacaaatgactaactccagttgtcttgtaacaacagtaaagctttggttagggagtttacaattggacttagaagacagactgcgcaagttcttcaaatccaaatttaataatagataaatgttgattaggattctttattttcttaagttaacttttagtatctggtattaatgtagttaggtgcaaaagagttctatgaatttgcaagtaccacagtcaaataattgttttgaatatataaacaaccatgaaaccaaatatatttatgaaataatacagtagttgttgctttgtattaacgctataaaaggggtctagaagtagactcttgatggcatcaagctgtcttgaagtccctattactctcatttgggccaataaaattatacattatttgttggacagtgtctacaactccaatgaacattcatacgctgaagaattccacatcttcagctctgacatttgggttccattattatcatatttccaattgccttttggaaatttacacttagatgtgctataaggatctcaaatgcaagccaaactttctccccagcagtgtagcataatgattaaaagtgattaaaaacacagacttcagaagcaaatagtctatgttgaaaacttttctctgtcacttattaaacaagtgaccatggatgatttatttaacttttctgggcctcagttttcccatctgaaaaacaggcataataatcatatctacctaatgaagtagacatgacaattacataaattatacggttatatatttatttaaacatttgtaatagtgtctggcacatacatatattaaaaacaggcacaataatcatatctacctaataaacttgttgacatgacaattacataagttatataactatatatattatataaatataaacatttgttatagtctgccacatagtatgcactatatataaacttttaagtactattacagtagcctccaaatctgtgcctattccactcatagtcaccacaatgtatttattgtatctcctaaagctcttaaatgtaaacccccttctttgactttacatctgcctaattaatgcaaatcaatgtcctttttacatgaaccattgaaatagcctcccattggtctcatagagttgtttccctttctttaatttatccaggattatctttctaaaatatgatttggataattactttcctgttttacaaacttcaagcagcaatagtaaccatagaataagttcagagtattgagcatgttatagtctcaaactatgattttgccaatcttattttccaccaatacaacttactcaccgtttctttctcacagtatgaaatgaaagtcatgcttccatgagtagatgtttgcctttcttccaagagtttctttcttgaattcacactgttctttaagactcagcttgattatctaagtcattttccagggagatggtgatgatatccccaacaccattctcctctttcaagtagtgatcatgaccagtttctttgtgcaccctgttgtattttgcccatacactgtactcctattatagcacttaccaaagtgaactgctattgtcttgccctgatcttcactaggaaaatgaatataaaacaaaagatgtaggataagaaaaactctaattgtacttgattgttggctcacatttaagtagtgattacattttttaaaagattctggagaaatgactatttttttctttgattctgtgaatctaatagatcatgacactttgcaagcaggtttggcatgccagagtaagcaaaggaaggagtgagagaagaatgctaccttaatcaaaacaggttcagatggactgccctgtcctatatccaaaaaaactcaaaaaacaaacaaaaaccatgtattagttattctgatgttgtctttgataagaactaagaacattaaaaagagggaggctgctgattcaaatatcctgcaaagattttgaaggaaagcaatgatcaggggccatctcaatgagtatgttgaagctgaggggaaacagttatttctggagcaagtttagaaaatgaattgccctcagaattaggtagatattgtatcctggagtatttgattccgttgatactagaatcttaatgctttgtttcactttcctgattttgatacttaaacgtgcttcgtaaaccatctgaaaccaaagctacaggattgtctgaatttaacctaatgataccagggaaataacgcataattatttctgctctccttagcagaatttaaattctctctcttctgtcagaaagatgacaaaaaaaaatgactcatgtcaagaatcaatttgtcacatctataaccttgacactattgaaaataagtatatagtgagatgactggggactttaaggggttggaagaggcttgacagaaggaagtctgatttataacctttctcatctatgaactttccaaagactttcatctaatgttcttcctggatcccagccctgaatttagttaacctttgtggctgtgccaatttatccacacctttgagttctatctcactccagaatatgaaaccaatcttggccaaagacagaagcctataaggcatctttggcaggtggcataacagtttagcattgagttattctccttaccaacggtgtgtgttagtgagcctattcgatcccttataattgtgctctgaatgataagggatcaaataggcccactaacacagctgtcaagtaactggaagacagcatagactagtagaaagagttttcctttttttttttctcttttttcttttctttttagacggagtctcgctctgtcgcccaggctggaatgcagtggcgcgatctcggctcactgcaagctccgcctcccgggttcacgccattctcctgcctcagcctcccaagtagctgggactacaggtgcccgctaccatgcctggctaattttttttgtattttgtagtagagacggggtttcatcgtgttagccaggatggtctccatctcctgacctcgtgatccgctcgcctcggcctctcaaagtgctgggattacaggcgtaagccaccgcgccctgcctagaaagagcttttcagctgtaaattgagactaaatattcaatgtacattttggctaccgaataattttttcctagttacttaatgtttctgagctcaaatttctttgtgcagtatgcaggttggactgaatgacttataaagtcccaaccagttctacaattttaagattaataactgctactttttcctctaggtcctccacagaccctttaaaatcatgacagattatatcagtgactagatttctgtctttaaattcttatgtttagttccttgatacatgcaaactgttttcctacccatacataatgaatattctcttgatttaatgcagatttgggggacacattcctatattaatattttctcctatccttgacactttctataaactaagtacatcctagcttagtgtaattttttgagtctgtcctataacctatcactagcctctctttggtaactcttctaaactctcaatgagcaagaaaaacattaccaacttacgtacattatgcgctcaaactactattattgtactgcagtttttataatataaataatttgtatgattatttgatgaattatataatgataggttacttttggcattagcaagattatttataataaaatgcagtgtggtggtattttgggaaaaagtaacctgaacaccaaaacttttattcttgattaataaagaggataatatgaaatatcctggaagggaactgtatattatttatgacaaaataagtcaaatggaattgagcaatggatttctcttaatcaaatcaatgtatttgagcaccttccaactgaaaaagcaaggaattagttgaatatcccaacccaaaccaatctaataataatttatttcaattttctagaacccaatatttaccttaacacataaagagcatttctgaatctgtaagaaaggaaggccctaaacagtcattgtgttgcaaaaatccacatgatctgtactcttcaatgtggaatgtacttacctcttgtacttctaagccacaagaaattttaaagtactagtcaatattgtttcataacagttgggaatttggcagatagttattgagggacatttgatgacctctagccccagattagtttaaaacattgttaatctataaactacaggcatgttctgctctcacacttactccaacataacagaaaacaggaaaaacatatcactttattatgtgttttttatattaatggccactattcactctgatgttattatagattatgttgttcaacatatactgactctttcatatcactgagcagagactagatgatatttggtacaaatggaaaagtagtaaaatatttattcagaaagtatgtgagttcattttacttagagacctgtgattacacacatgtggttttagcaaaaacagaattgagatgcataggcctttatcccggcagtgaaacaatttttttttctgatttaaaaaattatactctaagcagttgagggattttcagattcccagttaaattttgggattatatcctgttcaaaaatcagtttgtgaaacttgcaatgccattcacaaaagaaaatgatatttcagatggtgatatgctttctcagcctgttcattgaacccttcttgtttaactcatgtttcatgtgaagtatttaagtcacagtaatccagaatgccacaataataattagtatttactgattcttgaccatgccaaaagtattatatccattatcacatttaatcctgaaaataaaccaaacaaatcttatggatatagataagaaaaagaagattacttatcctttccaagaccacaaatcttgtcaaaccttgcaagccaatatttacatagttcaaatgcacagtaagcagtgcttattatgtgctaggcattgttaaatagctttagatatatttaaatcatttgccatcagaagtctgtactgtaggtcttactattatcctcattttacagatgaagcacaaagatccatagtcacatattttgtaacaagagcaggatctgcagccaggcagtctgggtccatggtccatgttcttacccatggtgcaatactgactcttgaagtccagggtctactaagaatccaggtctacctgactccaaagccagtgcttattttactactcactgctgtcactctaacgacatgtagaacagcttatggaataagaaaatgcgttcaatatgccaagtcaagatgcctggaatatttaagctacccacgtgattcccatgcagaaaataaagccagagtctgcattttccccccaggctaaggaagaaaaattcagtttgctagaaacaatctcaaagacctgtactaggggtttgtatggggaaggaggccaggatttgtgcaagtataaactctggattcagttccaagttcagaatgttactctggttagttccactgactgctccctcccccatttcatatttagtatcttgattaaattgattctgatctttccttcccaaatatgactatggtcagtcttggaagatatcttccacctgttggaaacttaaccaaacacaaagagtcctgaaatcttttaaagatgtttacaatttgcaacaatggggagaaaaaaaaatggggtaaaagcagcattttgaaaagaattaacccttgtgtatgtcttatttctagaactggtgtttctggctcactccattttaacagagaatgttcaccttatataattgcctgccccaagccctcgtcacctgttttggttttttgtttgcttactgaaatggtatatttaaaatatatgtttcacaagggtgtttactcaaaggagtacattttactagatttcagagaagaactctatacttatctgttcatgtttcattaaagcaggtttatttaaaaatcattaaaataacatttagggttggatgcaaggtaggctctcttgtgatgtggggagcagttggagatgcattagaacttgggaatgattgcaagtagattgccaatggcagaggaattaaaacagaaggaagcatccaggaggctgagatgggcagatcaagaagtcaagagatcgagaccatcctggccaacatggtgaaaccctgtctctactaaaaatacaaaaattagccaggtgtggtggcaggtgcctatagtgtcccaactactcgggaggctgaggcaggagaatcgcttgaacccaggaggcagaggttgcagtgagtcaagatcgtgccactgcactccagtctggtgacagacagaaactccctctcaaaaacaacaacaacaacaacaaaagaagcatccattagcacatacaaatttattttcattgcctcttttctttctctttatcaatatatcttctgacctgaacttcttgcaaggagaagtgagaaatgggctttgggtaagagaataagaactgaaaaaatatttagcatagacaaattttgtattgctaagctaaaatcagtcatttatttatacttaaagaatctttacgtttgtgagacagtaaaatgctctggttaggagtacaggctctggaataaaaaaacctagatttaaatctggattccacaacatactcatggtagtacctcacggaccagttactcaagttttgcctcaggttttaatttgcaaagttgtggtaaaacaacagagattgctacaattattataaagattaaataaagtaaaatatataaagaacttaaaacattttccgatatataacaagcgctagtaaggattaatttttgttattgttgcttctgttgataatagttatgtctttttttctttttctttttttttttttgagacggagtctcgctctgtggcccaggctggagagcagtggcgtgatctcggctcactgcaagctccgcctcctgggctcacgccatccttctgcctcagcttcccaagtagctgggactacaggcgcccaccaccgtgcctggctaatttttttgtatttttagtagagacggagtttcaccatgttagccaggatggtctcgatctcctgacctcgtgatccacccacctcagcctcccaaagtgtagttatgtcgtttttaatatgcattgtgatccagatgctgggatgatagttttacacagaggatctatacaaagcacaactgtacatataacctcaaatattactgctaggattctctaaaagaagtaatattattttatgaagtgacataggacaaacaaaatcctcaatgacattacatcaaacctattcgctgcatgcaactagcagggtgaatggtagggcgtggacacaaatctttctgtcaatatttccatttactctggcttgtggacccatggacacagacaagatgggaaccctgaagggttcagccaccacaggtcactactttatgattcaatttcatctttagggcaggaacctctttacaaagtgtatgggtgagctttggagtcagtaagcagtgcaatcttcccccagttttatcttagaataggtatgtgaacatgagcaaattattaacctttcatgagacatagccccatcatttgtaaaatggagataaaagtatctacacattaggtaagtaacaactaaaggagatgttgtatataaaacatagcaccttacagatattgatttagcaagccagctattcttatattattatatttaatcttcaagttggaaaaccaggaacaaatttaccttttttagaacaactaatttatgtatgtatgcatttttatatgtaggcaaatacctcttctataaatgtccctaggaattgttgctaaagcaaaatcctttcttcttgagaaagcctttaaagtctgaaaggttggcaaaggaagattcttaagtcctcttgtatgaattagcagacaatttttctcggctttcaaatcacccttcccaaaacaaaccacaaatagtcccaatatttgcacagatccctcaaagagaaacaaactacagtttccctggagctcgtttgtcacttttccctttcttttagcatactccgaggcacttaatgccattaggcaaaattatgccatccatggcattgcacctggcatggctagtgttcccaggtggagaagcagatgtataatggggctattcgaaaatgctacattggaaaaacagctatacaaacaaaattagtgagacaacactgaagattgctcttccttctattccagcataatttatcttccagaaaaaagaattactgcatgaaccatggatgagcataattaagggggaaggcaaagtggaggagttttgtagccgcatcccgtgtacattgtgcagggagagagaagggaaaccaaagcattcactcatatgtccatgcatattaagccatttagctggcatatggaatgtttcaggttgttccagggatatagacaaggaactaaatattgactcagcaagagctcaaatgagaggtctaattaaattaaatggtacaaaggggaggcttgtttcatagactccagtaattgcttaaaacacaaaagagaccaaataatgctcaaagaagtatagtaacaaacaagaaaatatctgtctatctatctatctatctatctatctatctatctatctatctatcatctatctatcatctatttatcatctatctataaatatctacacactaggtaagtaacagctaaaggagatgatgtatataaaacatagcaccttacagagattgatttagcaagttagctattctaatattattatatttaatcttcaggttgaaaaaccaggcacaaatttaccttgtttagaacaactaatttatatatgtatgcatttttatatgtaggcaaatacctcttctataaatgtgtgtgtgtgtgtgtgtatatatatatatatagtgagagggagagaagacatgagcataaaagttaccaagagttcaaaggctatggttggctcaattgtgaaaaatggttggaatttgttatgacaatatataatcagtggtgcctttaagcagtctggcgatgacacatgcatcagcatgttagttttaattttacgttaatgactgcctatctgcagaaatgccttaggataatgtcctttctttggacaaacttgattgatacttcacgaattataggagcaatggttctgaactctaaaaatgctgtgctttaagtcctgcccaaggaaagagtgagggtgagggaccatgaagatgattctggtgtactagggttgtctatttcagaataatacattgagaatgttggacagcatttatagaaatagacagatttcatctctgacccaaaagcactattgctgagtgttgggcatgccagagcccatcttggataaaagggagatgcaggatggaactggggaatgaggagaaaagaggctctttttcttccttgtaccttagctctctgagccttagtctgtcatctataaaatcagaataataatgggaccttcttcattggtttgaagatttaaataacatatttaagggatgtaaaaccacttctggtcattatttagagctcaataaatgttagttgtcattgtggttaccattactcttaccgtaatactcacagaaatgaagaataagaaccctgtcctaaaagagtgtttcatctgctcaaagggaaagataggaaccctggatctgctcaattttacattttcactaaagcttccatgcccctctgctgggcaacttaacattaaatgtacatactttagaatgagggaactgggtttaagatatggctctgcctcttaatagctttgtgaccttggatagttgttagacctctttaagttgcaattttcatatctataagattgtaataataatagctattccatggaggattttttggtaagtataaaaaatgtcaatgcattttaaatatttagaacagtgcctagcattaataagcactcattttcatgtactatacaggcatatgcatatattacatatatagtttacaaatgtaaaccaaactgacatgcacacacacatattccacccttcattcttttagctttaaataaaattacaaacttttttagcatgatgaaacctagttatatcactgaatctctctgtctctgtctctgtttctctctctctcactcaatcacactctcaaatatacaagcatatgctagcaaagcgttagttattatctggatctctacttacactacttcctaatttaaacaaatcttttaaaatttattattaaaaacatcaccttgcattcttagaacatttatattttcaggtcagttacatagacattttctctctccatctaaccaaattctaattctttattatttagtgcaaattttctgtgaaattctttaggctattcaaatgaaagtactttatttcctgcaaatctttggcatctattgtccaaaacatttattaattctgtactgctcctaaacatttctgtaaatataatgggctgttgtaccctgccctacatcttaaaagtccttgctactagaagtgttaatcttgccaaaaaaatgacttctttgaatttctaggtagttaaagttctattctgtacagtaattgaatatttctgacatgtaaccttatataaacactctaatagcaaataaaaatgtctctatgtccattgttgaaatctcagggctaaatgtctccatttgtattaggaacaagtagattaaagtccaaccatccttctgaagagcttttcccttgtgctgaatacagttaatgacagcctaagtcttttgtttgttttttttttttttgtagaattcatccattactcatcagctatatctgaaacaaactctaatcttggtacagaagcagagaacattattcttcctcaaagcctatgccacgtgttgctgctaaaacaggaatggacaaaaaaacagtttcataataaatagagaaatgagcttactaaaggcacggcattttcttaccttttttctttacacataatttgaaataactcttacaacaattagatgaaatatatcagtgaataatatcactttagggtaaatttaacatttatccaatattagctaattccatgactactgccatgactactacgactattattaataataataatcacaaatatttaatgagcacctgctacatgctggacactaggctaagcaacttacgtgtagtagaatttccctcctggaaggtatttattgtccagtgagcaacctttctattcttccctttccttgtacataaatgatggaggcctcattagtgagattccagaaagtacataatccctggtccatgtgtaaaaatgtagagaaaagctccctaccaacctgtattaaacttaaacgcaagtgaaatttaaacttttgttgtgttgagtcactgagaattggtagctgtttgttaccacagcataacctagcctaaattgcctaattcagtgttattgactgaaacaaacctttcttacacgtttttcaatcatattcattccatgttatgtgaatgagagcctgaggctagcatatacataatttatctctgtgttgaagaggaatagacttgaactctacagctggttggaagtataagtgagggtcctaaaacttgcatgagacaaagtcaattttgtagtcagtgataagaaataccatgtgcgcggccaggcgcggtggcttacgcctgtaatcccagcactttgggaggccaaggtgggcggatcacgaggtcaggagatcgagatcatcctggctaacacggtgaaaccccgtctctactaaaaatatttttaaaaaattagctgggcgtggtggtgggcgcctgtagtcccagctactcgggagactgaggcaggagaatggcatgaccccgggaggcggagcttgcagtgagccgagatcatgccactgcactccagcctgggcaacagagcgagactccatctcaaaaaaaaaaaaaaaaaaagaaagaaagaaataccacgtaagcgcatgcatgcacaccccccccaacatagtaggtgctcaatgtctacacaatgtatgaatatatacatagaaagagtatagatcactttttaaaaaacactgaatgttgctagaaaactcaaccacgaattgcctgtgacccagggcttgaccaaagcttccttaagacatcaaatattgcaaagagacaacttaatgcacttattcccctatggttgtcagtgtttttttttgtgattagctagatcatcagaaagtaacatttccaggtcatattattaccacaaatccgtgctaaagagccttcactaagttgaaatttaatgtaacttcaggttttattgagggtcaatgaagaaatgtctatttgaacatttctgtcttttacagacccctaggttaggacattgttaccatttgttaccatttgttattcatgttaccatttgttattcaaataattaccatacacaataagtttctctttaaatttgaagcctgaaaaaatgttctgtcttaagaaatgtctatgctgtctatcaacaagtaatgacaactctaaactataattacttattaatttctagttaagtttactcatctagagtaactaattaatcccaaaagtctttatacttttgaaaattctttagagcttgtttctattttgagtttcaaatttttatatttttcttgatttctgaaactgttgtaatttttcagaagcaggtggaaacaaactctatttatgaaataaaacttcctgtaatttattattattttttgcttgtcttttctttctggctgcatttctagagaacaaagaccttgcttattcatctctgcggtgttgtttcagagcaggcaaaatgagaataaatatatgttagcatggaatgacacaaagagctctgaaaataaagcccaaattcacattttcgctccatcagttactaaccatgtgacatttggcaagttatgttcatttattagcctttcttttcttgtcaacaaaatatcataagtttacttgtagcactgttgggaggatagagaatatatataaatgtgtcaataagagtattcaccaaatcagcaaatactcctgtcaccttttctccacctataaagtgacagtaaaggacacaatgatgctactatttgtctcttgagtaggtacccacaaagagagcctgagagaaatttactcatgtgctttactgaaggtctgttctcagaaggggagggaagaaaaaagcatggggaggtagggcctggaactaataagaaaattattaatctaagtctgagactagctttacctgacctcagagcgggttgtgaaattgtacagcagagttggttccatcttgaagcaaggagcctgagctttatatccttctctcagtcagttattagcgattggttgtcagagcatgcaggggtggtggtgcataaccactcatacatagtgactcctgcttggctgacaacattatccagaagaaggagcagctgtgagatgttagcagccaacactcacagtagcaggaaaatgggcaaccaggtaaagggatggccactggcatcagagtgggtggagactggaaatgttgttaaacactctacaatgttcaaggaagccccccacaacaaagaattatccagcccccaaagtcaatagtgctgcagatgagaaactgtggaacagatgaaagcatgaaaaaaatcaatgtttaataattattactaggagttattgatttgctattaataacattcagacattagtaatcaaaagggaaaatatggaatttcattgattttgctagggaacacacacacacacacacacaaacaacctcacagtttttatcctgtgactttagtattctttcatattatgcaacaacaagcataaattcagcatgagtcagactgaaatgactacttttgcaaatatcatccatacagtcttgtgcctttttccacatctgctttcagttctgccttatacatgcctttatagattttgacgccagcactttactatcctagaatctacagctacttgatttttttttttgtcttctctccccttttcttctgtgtttttccctggctttcagctcaactcgtgaacatcaggatgtctgcatccagctctgtttttttccttcagctgcactttgcctaatggggaatttggcacattcctatagttgtcaaatacatcttgttcactttcatggcctctcatttcatctctggctttgaagttctatagttcaggttgtttagcacacaagagaaataattaatctcctccctcttttctaaggattgataacaaccaagctaattatttactccagaacagaaataattgtttatgctaagttttaaattcaggcaaaattccttttgaataatatggaactatttgacatatgaataagaatatagtaattattgtaaggagtacatttaacagtagagactctcacatcacatctatacttttttttatctccccccttcatttctttccttcccatatccaggtttgtgtgtgtgtgcttcatccagatttttttttctatctctgtaattgcacaaaagggatctaatttcacaaaacagatcactgccatttgtgagagagataccacagcagtctcagtaaaccatgtcaaatcaattctcaaatcataaacaatatattgtaccattttggtacacatgtacttttttctaggtttgcaattagcaggtaactcctgaaggagctgatctcattctcactgatgcagattgcttaagcaaaattggagaagcaccctcttaaaatcaatcaaaatgaaacaaaactgccttctgtagcataatataatttgtcagttggtactgagaagagtaatttggatagcaactgtgaagggaaaggtaaaacaaagaagaataagatcagagattctgatttggaaggaaccacgaggctcatttcatcccaaacttgatagatgaagaaatggacccaaagagattaatgtctagactataacaggtcttataatttggggtccagcagcttttctatagcctcatgttagcttctcattttgaggctgaagtgtctgttctgattagttcttcttaagaatccagaatcattaaatcatcactattattaatactgtgctctagtctgtgtttccccacatctttcaattaaaatcattccttagctcttgatgtatgtagcaaccatcctagcagggtatgctaataccacccactcctctcctacctcccacccctgtcatctcagcactaaagtcaccgagaggtcatagggcttcatttcagtagcaatgaagtaaagaacatgagacctagaatgaaataaagaacatgagattctaggtcaggcgcggtggcttacgcctgtaatcccagcactttgggaggccgaggtgagcggaccacgaggtcaggagatcgagaccatcctggctaacacggtgaaaccccgtctctactaaaaatacaaaaaaattagccgggcgtgatggcgggcacctgtagtcccagctacttaggaggctgagacaggagaatggcatgaacccgggaggcggagcttgcagtgagccgagatggcaccattgcactccagaccgggcgacagagcgaggctccgcctcaaaaaaaaaaaaaaaaaaaatccctcacctatttcattgtttataaaatgaatatgagatagatagctataacataaagagattatttctaaggtttcttcaagtaccattataactgaatgcattgcacaatcaaaaagaaaatccaattcattgtaatattagtttacctagatatcaaggaaatgccttagtccactttattacaatgcaatacaaaagaaaaaaaggaagaacagcacccccacatgcattttttgaagtatatcctttaaattactaaggtctgattacttccatgtacctcctgcttaagattaaaagaaacaaaaagcaacactcaatagggttgaatttactgaagcatcttctttcttctctttcctttttctttcttttattcctcctcttcttgcttctcctcctttccctttcttcatttcttttgcttctctcccttccacttcatacttcttcccgtctttctttctctataaatattccagttaattttccaatttttttttaattttccctgttttctttctgtctacaaatgattgcagtaggttcagaaagctcattaactattttccttaatgctttaacaaagcaaacacattaacctactgtcattctgtaagtacttgattgcctacattctgtaagccctcatggctcttttggtcaatagctgaattattgctgtttcctatctttcctaattgaatgaacatggccccttgatttctgttgaagctgagttgcagttgcttggcgaattttcagtctttctgatctttcccctttgactgattagttttatttatcatccagttttttaaattgtggctttggcacacctgcctcaggctaagagaacgtgattaaacacattaaaagaaatccacagaacagagtggttacataattaatcagtcttgagcagtaccaaaaaaatgctgacccaaaagcatgacatttggggaaagggtaattttaagagtttaaaaacattctaatgaattgatttttgttcctgaatttcctttttcatatatacaggctagaatataacaatagttatttctttatagcaagtctccttttacaaaatacaacagtttcccactaggcgtggtgtataggaatactaggtgaacagttgatgaagaatctgctccctgatgagaatgccttgaggtaagtcagatacattttaatcttcttagagttatattttttattctatttctaatttaggacattcatacatcaagatgactaggggaactgaactgcaacagtatgtattttccatagaaatttttatatactcacctcttttttttttagtgttttttcttttattatactttaagttctaggatacatgtgcacaatgtgcaggtttgttacatatgtatacatgtgccaagttggtgtgctgcacccattaactcatcatttacattaggtatatctcctaatgctatccctcccccctccacccaccccatgacaggccccggtgtgtgatgttccccaccctgtgtccaagtattctcattgttcaattcccacctatgagtaagaacatgcagtgtttggttttctgtccttgtgttagtttgctcagaatgatagttgcaagcttcatccatgtccctacaaaggtcacgaactcatccttttttatggctgcatagtattccatggtgtatatgtgccacattttcttaatccagtctatcattgatggacatttgggttggttccaagtctttgctattgtgaatagtgccacaataaacatatgtgtgcatgtgtctttatagcagcatgatttatactcctttgggtatatacccagtaatgggatggctgggtcaaatggtatttctagttctagatccttgaggaatcaccacactgtcttccacaatggttgaactagtttacagtcccaccaccagtgtaaaagtgttcctatttctccacatcctctccagcacctgttgtttcctgactttttaatgatcgccattctaactggtgtgagatggtatctcactgtggttttgatttgcatttctctgatcgtcagtgatgatgaatattttttcatgtgtctgttggctgcataaatgtcttcttttgagaaatgtctgttcatatccttcgcccactttttgatggggctgtttgattttttcttgtaaatttgtttaagttctttgtagattctggatattagacctttgtcagatgggtagattgcaaaaattttctcccattctgtaggttgcctgctcactctgatggtagtttcttttgctgtgcagaagctctttagtttaattagatcccattcatctattttggcttttgttgccactgcttttgttgttttagtcatgaagtccttgcccgtgcctatgtcctgaatggtattgcctaggttttcttctagagtttttacggttttaggtctaacatttaagtctttaatccatcttgacttaatttttgtataaggtgtaaggaagggatccagtttcagctttctacatataactagccagttttcccagcaccatttattaaatagggaatcatttccccatttcttgtttttgtcagaattgtcaaagatcagatggttgtagatgtgtggtagtatttctgagggctctgttctgttccattggtctatatctctgttttggtaccagtaccatgctgtttggttactgtagccttgtagcatagtttgaagtcaggtagcatgatgcctccagctttgttcttttggcttaggattttcatggcaatgtgggctcttttttgattccatatgagctttaaagtattttttttccaattctgtgaaggaagtcattggtatcttgatgcagatggcattgaatctataaattatcttgggcagtatgaccattttcacaatattgattcttcctatccatgagcatggaatgttcttccatttgtttgtgtcctcttttatttcattgagcagtggtttgtagatctccttgaagaggtccttcacatcccttgtaagttggacttctaggtattttattctctttgaagcaattgtgaatgggagttcactcatgatttggctctctgtttgtctgttattggcgtataggaatgcttgtgatttttgcacattgaatttgtatcctgagacattgctgaagttgcctatcagcttaaggagattttgggttgagacgatggggttttctaactatacaatcatgtcatctgcaaacagggacaatttgacttcctcttttcctaattgaataccctttattttcttctcctgcctgattgccctggccagaacttccaacactatgttgaataggagtggtgagagaaggcatccctgtcttgcgccagttttcaaagggaatgcttccagttgttgcccattcagtatgatattggctgagggtttgtcataaatagctcttattattttgagatatggcccatcaatacctagtttattgagagtttttagcatgaagtgctgttgaattttgtcaaaggccttttctgcatctattgagacaatcatgtagtttttgccattggttctgtttgtgtgatggattacgtttattgatttgcatatgttgaaccagcgtttcatcccagggatgaagcctacttgatcatggtggataagctttttgatgtgccgctggattcagtttgccagtattttactgaggattttggcatcaatgttcatcagggatattggtctaaaattctctttttttgttgtgtctctgccaggctttggtatcaggatgatgctggcctcataaaatgagttagggaggatttcgtctttttccattgattggaatagtttcagaaggaatggaactggctcctctttgtgcctctgggagaatttggctgtgaatccttctggtcctggactttttttggttggtatgctattaattattgcctcaatttcagagactgttattggtctattcagggattcaacttcttcctggtttagtcttgggagggtgtatgtgtccagcaatttattcatttcttctagattgtctagtttatttgtgtagaggtgtttatagtattctctgatggtagtttgtacttctgtgggataagtggtgagatcccctttatcattttttattgcatctatttgattattctctcttttcttctttattagtctttctagcggtctatcaattttgttgatcttttcaaaaaaccagctcctggattcattgaatttttgaagggttttttgtgtctctgtttccttcagttctgctctgatcttagttattcttgccttctgctagattttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctgccttcattttgttatatacccagtagtcatccaggagcaggttgctcagtatccatgtggttgagtggttttgagtgagtttcttaatcctgagtcctagtttgattgcactgtggtctgagagacagtttgctataatttctgttcttttacatttgctgaggagtgctttacttccaactatgttgtcaattttggaataagtgcgacgttgtgctgagaagaatgtatattctattgatttggggtggagagttctgtagatgtctattaggtctgcttggtgcagagctgagttcaagtcctggatatccttgttaactttctgtcccgttgatgtgtctaatgttgacagtggggtgttaaaatctcccattattattgtgtgggagtctaagtctctttgtaggtctctaaggacttgctttatgagtctgggtgcttctgtattgggtgcatatatatttaggacagttatctcttcttgttgaattgatccctttaccattatgtaatggccttctttgtgtctttttatctttgtttggtttcaagtctgttttatcagagactaggattgcaacccctgcctttttttgttttccatttgcttggcagatcttcctccatccctttattttgagcctatgtgtgtctctgcacgtgagatgggtctcctgaatacagcatgctgatgagtcttgactctttatccaatttgccagtctgtgtcttttaattggagcatttagcccatttgcatttaaggttaatattgttatgtgtgaatttgatcctgtcattatgatgttagctggttattttgcttgttagttgatgcagtttctttctagcctcgatggtctttacaatttagcatgtttttgcagtggctggtaccggttgttcctttccatgtttagtgcttccttcaggagctcttgtaaggcaggcctggtggtgacaaaatatctcagcatttgcttgtctgtaaaggattttatacctccttcacttatgaagcttagtttggctggatatcaaattctgggttgaatattcttttctttaagaatgttgaatattggccctctcttctggcttgtagagtttctgccgagagatctgctgttagtctgatgggcttccctctgtgggtaacccgacctttctctctggttgcccttaattttttccttcatttcaactttggtgaatctgacaattatgtgtcttggaactgttcttcttgaggagtatctttgtggtgttctctgtatttcctgaatttgaatgttggcctgccttgctaggttggggaagttcacctggataataccctgaagagtgttttccagcttggttctattctccccgtcactttcaggtacaccaatcagatgtagatttggtcttttcacatagtcccatatttcttggaggctttatttgtttctttttactcttttttctctaaacttctcttctcacttcatttcattcatttgatcttcaatcactgataccctttcttccacttgattgaaccagctgctgaagcttgtgcatgtgccatgtagttctcgtgccatggttttcagctccatcaggtcatttaaggtcttctctatgctgtttattctagttagccattcgtcaaattttttttcaaggtttttagcttctttgcaatgggttcaaacatcctcctttagcttggagaagtttgttattaccgatcatctgaagccttcttctctcaactcgtcaaagtcattccccgtccagctttgttccattgctggtgaggcgctgcgttcctttgtaggagaagagatgctctgatttttagaattttcagcttttctgctgtggtttctccccatctttgtggttttatctacctttggtctttgatgatggtgacgtacagatggggttttggtgtggatgtcctttctgtttgttagttttccttctaccagtcaggatgctaagctgcaggtgtgttggagtttgctggaggtccactccagacccagtttgcctggatatcaccagaggaggctgcagaacagcaaatattgcagaacggcaagtgctgctgcctgatccctcctctggaagctttgtctcagaggggcaaccaggcgtatgaggtgtcagtcagcccctactgggaggtgtctcccagttaggctactcagggttcagagacccacttgaggaggcagtctgtccgttctcagatctcaaactccatgctgggaaaaccattgctctcttgaaagctatcagacagggacgtttaagtctgcagaagtttctgctgccttttgttcagctatgccctgcccccagaggtgaagtctacagaggcaggcaggcttccttgagctgcggtgggctccacccagtttgagcttcctggctgctttgtttacctactcaagcctcagcaatggcagacgcccctcccacagccttgctgccaccttgcagttcaatctcagactgctgtgccagcagtgagtgaggctctgtgggagtgggaccctccgagccaggtgtgggatataatctcctggtgcgccatttgctaagaccattggaaaagcacagtattagggtgggagtgtcccaattttccagttaccatctgtcacatcttcccttggctaggaaagggaattccccgaccccttgtgcttcctgggtgaggcaatgcccctccctgcttcagctaacactccatgggctgtacccactgtccaacaagccccagtgagatgaacccagtacctcagttggaaatgcagaaatcacccatcttctgtatcgctcatgctgggagctgtggactggagctgtttctatttggccatcttggaacctcctcccttttttagtgttttgagacaaggtctggctctatcacccagggtggaatgcagtggcatgatctcagctcactgcaacctccacctcctgggttcaggtcatcctctcacctcagcttcccgagtagctgggactacaggcatacaccaccacacctggctaatatttgtagaaatgggatttgccatgttgcccatggttggtcttgaactcataagctcaagcaatccacctgcctcagcctccccaagtgctgggattacagccctgagccaccgtacctggcaactcccctctttatttgataaaggatagcaggtggaaggccaaactggcttcatttccatgtgaactgaagctgcatcaggttccaagatccagacaatgtcctggagcttggctctggtaaaaaatgtctatcatatgctatctctgttcatgatctcaaaaacttgctgtgaacttagcttattttctcttctaagcagtgttgagaaaagtgattgagatgtggacatccttattttgttctattgctaaaatgaaacttgaatagagtgctcatatcttaattttaacagaaaactactctttccattttaccaaacatgggatttatcagcaagaaattcttcaacctttcattcatttctataaatgtgattctatctttttttaagttagactaaatcaattttttatttatttttaagattcagggggtacggctgggtgcagcggctcacacctgtaatcccagcactttgggaggccgaggtgggtggatcacaaggtcaggaggtcgagaccacggtgaaaccccgtctctactaaaaaatacaaaaaattagccaggcgccgtggggggcacctgtagtcccacctactcggtaggctgaggcaggagaatggcatgaacccaggaggcggagcttgcagtgagccgagatcacgccactgcactccagcctgggtgacagagcgagactccgtctcaacaacaaaaaaaaagattcagggggtacatgtgcagttttgttacaagggtatatagcatgatgctgaggtctgggcttctattaatttcatctctcaaatagtgaacatagtacccaacaggaattttttcagctcttacccctctccctcttaccttttagagactccagtatctactgttcccatctttatgtccctgtgtaattaatgttcacctcccacttgtaagtgaggacatgtggtatttgattttctgttttagcattaatttgcttaggataatggtctccagctgcattcatgtggatgtgaaggacataattaaattcttttatatgactgcatagtatgccatggtgtatatgtaccacattttctttatttaataaatgtgattatatcttaattcaacttcatcctggctgagaagaagagctcttttttctttttttccaaacctaatctttctacccgttctaacatcacattctctcatttgcttgactttattccatcagttgtagtcttaatttttcacaggttcattctcttctggtcgcttttttttctttacctaaacatttctcaattactgccactttaggcagtatataaataaaaatgttaacaaacaaaaatgcttttggtgactctgtctgctctgaccctcaagtatctctttctttctttctctctcttttattcctttcaacttcaaacttttggaaaattgagtctgtgccaccatattttatctgtcattgcatactcagtactcaactgatcatgatacaatttttgccttcaccataatactgatactgcttttaaaaagatataaaaacaccttctaaatgcaaaacccaatgtgtacttttaaggctaagccaacctgcataattttgccggttgcatcctttatagtcgttggccactgcaccataaatcatgtaaaaatattcaaggactttatagtctagaggggaatatgtgcaaaaatatgactatgatatgtgtactgctgtgattttggtaatcatagagggaatatgatagaaactgttagctgccacccaatatccattctctttttcatagaaacagaactctgattacactggggaaagcaatgtgcaggattaacacacaaacaaacatacaaaatttatattttgtagcataccttgcagtgaaatataacagtatgactaagctctagcgaatagtttgtaaaaaaaaaaaattagtatttgaaagggaccttctggaaggtccctttcaaagtgtaaggaatgtttgcttcagtttctctttattcttactgcctggaatatacaagtcattgttagagccgtataagccatatttttgaccttgataataacgagagccggaagccaagaaaagtgaagctgaaagacaaaagtgcctgattccctggtgactttgtgaagctgtcgtaacagttctagaccgcccattcgcagactcactttatggagatggtaaactcccagtttgttttaactgccacagtcaagtctcagaatctataaaggtacattggaatcactttgtgaaaaaagttgtttctggatcactgtctcagctatttttaaaaaaatggcatccaacatattttcactggatggtcccatatacttctctttcatacctctttcctaagttccagaaccaaagacccaacttctcctaaacctttctccttggatgccccttggtcacttaaattcaacaagcaaaacctgaatgagtttccatactcaccgtaacatggtcttccttctatatacactgtttagttaacgatgccattgttgactaagtaaactatttaacctcaaaacctttaggaaattcttaattctttcttctttttcacccttaacacccaatggataattgcttctaaacatattttcctcagaattgttccttgtatagatacactcctttccattctcatcaatattgccctaagtaagttctcactgtttctctcttagactaattttttttttattatactttaagttctgggttacatgtgcagaacatgcagttttgttacatagatatacacgtgccctggtggtttgctgcacccatcaacccatcacctacattaggtattcctcctaatgtgatccctcccctagccccccaccccccgacaggccccagtgagtgatgttcccctccctgtgtccatgtgttctcattgttcaactcccacttacgagtgagaacatgtggtgttcggttttctgttcttgtgttagtttgctgagaatgatggtttccagcttcatccatgtcccagcaaaggacattaactcatccttttatgtggctgcatagtattccatggtgtatatgtgccacattttcttaatccagtctatcattgatggacatttgggttggttccaagtctttgctattgtgactagtgctgcaataaacatcttagactaatttttaaaagtcattcctaaataggtctcaatcctttagtcccttatctttctaatctatcactgctgtgtctaaaaaatgttaactttgaaatacatagatttactattgccatctcaaactaagaaattgttcattactctcaattgcctacagggtaaaattaaattataaatgatcctttcaaaacattcccagtttcctttacaagcttttgctctacttgcccacccacccttattccacaaaacacacaccaaaagtaccaaggaaagttgatttcagtcaaatcagactgcccaccatgtccataacattccatgtcttccctatctctgttttatttcagttgtcccctctatctcaaatcctttccctctcctcctcctacaagtacacatttgttttctacttattaaccaaggcccaaaacaggtttgcgccacttatgaagctttctcttgcctgctctgcacatcaaataaattatttcctcacttgctatacatgtacatttttacatgccaatgttgtatggtttattacagtgttctggaatcttttttgtatattcaggtacattttatgtttcttaattttttatgcatttcaatatcttaaggaaattatcatataatcatctttacatccctcagatgtactactatgccttgcacagtgaggggctcaattcatagtaatggatttgaatgaactacatatattttgtctctatacaggtaaaacatgcaacttcaagatgagtgcttgcaatatagatgtaagaatgattgtggaataattttaattaaatggtgtattataagaatatctctcaggttattttattttattaattcatcttctttatcctaaaccttcacacctcagacccagaacagaacatactgcccattcactttagaaatgcattccgttcacacctacttatttttaacccactatatttggtaaggcaatgtttcatgaacctaatcttgggatgccagctttatttagtaaactttgaatagtctgtagttttgaataccaaatttctgtaatttttagtgtctctctgctttggaatcatgcttgccatttttcaagagatcttatagaaaaatgatagattagatcttctgaatttaaagaataggaacaagacaagaactcagggtcactgagagattaaagtaagtgtgctttggcacacgtaaatgtaatgtatttagaaagctttctaggatctacctgcaaacagatggcagtaagatatgcaaaagggggcatgctctcctttttcagatttattttttttctaatggggaatagtgagtgagatgatgacagatagttttggatttgcaatgctcttcctcattttatataatgactcagcttttaaattgtaaatcatggattctaaatagctcctgcctaatttatctgtaatatatgtaaagttcatgaatttgaatcattataccaaacaggaatgaatttctatatatagaaaggaaattgtattttggaaggataattaacaccaatatattttaacagctatgcagaggctgaacttctaccacagattttttgaaagcttagcgtcatacaacatgaaactgtatatttgaaaaataaaatttatatgaaatttagaccttacaaagcacgattagtgtgtgaaaatgacaaaagtaaatggaagagtttatcctccaaataaacatacttttttacatatttaaggcagtataatgttaaatgagaaaatgaagactggatgtttaataagccaaaaggaatatacagtagttaaaaatatgtatacatattaatacatatgcatctatacacacatacatgctgtgtgtatctatataaatgtatatatacatacatgtatgcatatgtgtctatacacacgcatgttcctatttgcatggcttgtgactaaacaaaatgcatttttctctgaaaagtgacagggcactagtaatgcactcactgtgtttatgtgggatttttgataaaatttgaatatcaaagacactatttttccccctctaacaaccactggaataaaaagctagaatgcaataccatcttataatttccaaattattcactttcgacttgtgtttttcactttcatcacaaattcagtgttgtctctctgaacagaggaatcatagacctttgaaggtaaactcaactctgacatttactagtatgacattgggaaagctatataagaaaacagaacaaataaataagtgatccatctggcatgttattgtgaagattaacataaaatataggcaagacatagacagtcactatttgtttcctcccctctactttttttttttttttttttttttttttttgagatggagtcttgcattgtcgcccaggctggagtgcagtggcacgatctcggctaactgaaacttccacctcctgggttcaagtaattcttgtgcctcagactactgagtagctgagattacaggcatgcgccaccacacccagctaatttttgtatttttagtagagacagggtttcaccatgttggccaggttggtcttgaactcctgacctcaagtgatctggacaccaaagcgctgggattataggtctgaaacaccgcaactggctcctgcccactacttttgatggtgatcctttgtttgtgtttttgtaattacatcctctttcagaacattaactcattgagggactgtcgaatgccaggatagagaggccctatatgttacagacatataaatatactagtgtaattaaaaaaaattttctcagaaatataaattcccagaatatttatattgtttcatttaaacttaaatttataatcttagtccatgtccttctcaaagtcactgataactgaatccaatatagatatcaaatattattttattaccatttcttctccagagaaatgatctactgctattaaaagatgagtagaaaaggtatacattagttctaccatggtaatttatagcagcttaaaactcagggccaccaaagaatttatgaaaattcctctaaatctattaagttttatcatactccatttctgaaaatatatatggaaatgaaaaatctcaagacatgaacatctatgttataaaaagaaatagggggaaaatgaatatcaattaatagcagcgaagcaatcattttattaatttgcaattccacatgcatttattttagaaaaattataggattcattccggagttccatctgtacacattctgaagtcatgctctaaattaacatgcatttcttatccaattggcttataaaacttgatttactctttaatctctgaagtaaataaaaacaacatttttaacctttctttaagaaatctgctagtttaagatttcttgctagtttaaatacatgtacttttaataaaaactccaatttagtttttctaaactaattttacctaaaagatttggtcatgtaaacaagggtgtagttactctgtttcaagcatcttccacctgtgatcatgtaagtgctaggcagtactcacagctgacatgatgagctctcctcccaggttctggatctcagctttaacttgactgcagattttcagttggtgggagtagaacttaatctgttccaggtaggccaacaagtcctgtttacaagatggatctgggcactaaatatgaatcaaagataaaaatagatacagcagaataaataatagttagatcaaggtgagtaaatacagtattcacatggcaggtaccttataaagcagcaattttattttcatacaggaccaagtagcttctgatatgcttctaccatttacaatagttcattcattttgcaaccttagttacttcagcttagccaaaaggaacgttaaaataattatttttttgagatggagtctcgctctgttgcccaggctggagtgcagtggcaagatcttggctcactgcaacctctgcctcccgggttcaagtgattctcctgtctcagcctcccgggtagctgtgactacaggcatgcgccaccacacctggctaattttttgtatttttagtagagacagggtttcaccgtgttatctaggatggtcttgatctcctgacctcatgatctgcctgccttggcatcccacagtgctgggattacaggcgtgagccaccacacctggccaagaaacgttaaaataatttttagacataaaaaggtatataaaatagctgcctttaatttatgacaaaggttagaagccttcagattatatttttggtaaatctatagaaatatttaaaatgtaattatttctttcacctagaattactattagaaggctcctagaattactattagaatgctgcttgagactcatggtctctacactgtctgtcctgtgctactcaaatgggcataaacaacatggagcaacataatatgttctactactttcagcattcaatgtacttagctgttacagacaaaggaaattatttctaccttagataacagctgtgaatacaactgaagccaagaaacagacaggacacatgttttagaatattaaatttccttatgaaaaccagcctcctacatcattttatcttttcgaaggaacttcctggaggacagctttgagctttatcataccatggtaaatagctttggttaagatttaatctttgtgttctttctcctatgcaattataataaatttataaaaattccttctaatttaattccacttttagtaaatttttataagaacaaggaaatgtggacagtgatttatatgcaaagatcttcattgtagcattatgtataataacaaaatttggaaataacctaaatgtcccaaaataatggaaagactaaataagaatgaatatcaatataatgtagcattactcagtatcaagaaaatagagtttcaaaggatgtggaaaaatgtttttggaagttaaaaaaatcaatatgtaaatattgcaatcaaattctattaaaaattgtgtgtatttaaaacatgctgaatgccagacgcagtggctcatgcctataatcccagcaatttgggaagctgaaacaggaaaatcctttgagcctaggaatttgagaccagcctggggaacatagggagacactatctctacaaaaaataaaaataaattagccaggtgtggtcccagctattcaggaggctgaggtgggaggattgcctgagcccgagaagttaatgctgcagtgagccatgattgcaacactgcactccagcctggtcaacagagtgggaccttgtgtcaaaaaataaataaataaaaataaaaaataaaataataaaacctgctgagacagcctgagctgtccatccttcctaggcatagatcatggtgcatcaggactctctttgctccatacccaggcagatctccaggcactcagagtaccagcttgcctaaatcatcaggctgagcttccctaccctttctgtgcatagattgtggtgtagcaggccctctccactccacgcttgggcagatttccaggtattcaaagtacatgtttgctcagattgacagcctgagccaccccacactttctctgcagggatccaggtatgtagaggagcctctctgcttcatgcctaggcagatcacccagcatctggagtacccagtcccctggattaggagtttaggccaccccaaatctgtgtgtagagaatttgaggacaagaaagcttcccagctccatatctaggcacacctcttggtgtttggtacccactcactggattatgcttcagcaccggtgctcatgcctgcccttagggaattataggcaaacctgccagtctggacctgcccatcttgctcccaacacctctagggctgaggagggagctcagagcattttgcactacaagaataagcccattgcctgaggcaagaaagagcttctgctagtaaacaaggatgaagtatacacccatcggtattggtcatacacaccatctacaggcttgtaggtggaactgaaccgcccaatatgaaacctgctgacagaaaggtgtaggagtacacaagttaagccaaaagaccttacccagcattctctaaagtcacactccctagggaaaaatagatgggaaagggaaagggaaagaaaaaaaaatcaatagtattatagggaaagaaaagaaaaattatatctgcacaaatataattacaaaaatttgaagtatcaatgcttcaagatgagaaagaaccagtgtaagaattctagcaccatgaaaattcaaaatgtagtgataccatcaacataccatactagttctccagctatggtccccagcaaagtggaaacttggaaatgacagataaagaatttgaagtgtggattgcaaggaagctcaataagatccaagatgaggttgaaaattaacacaaagaaactttttaaagcaatccagagaatgaaggaagagataaacatctttaaaatatcaatcagagattctggaattaaaaaactaatttaatttcaaaacacaactggaagcttcaccaataaactggactaagtagaggaaagaatttcagatcttgaagaccagtcttttgaattgacccagtcggaaaaaaataaagaaaaagtaatttttataaaataaacaaagtctttgagagatatgggattatgtaaagtggccaaacctaaaaattagtgacattcctgagactgagaaaaagataacaacctagaaaaaatacttgaagtgataaatcaagaaaatgtttcaaattttgctagagaggtagacatctagatataagaaatccagagaacacttgagagatactatacaaaaaggaacgtcaccaaggcatataatcaccagactatccaaggtcaatactaaagaaaaaatctcaaaggcagctagagaaaaaggtcagaagacacacaaaggaaatcccaaaaggttaaaagcagacttctctacataaaccttatttataagccgagacagattggaggcctattttcagaattcttgaagcaaagaaatttcaacaaaaagttcatatcccaccaggctaagctttatcactgaaagagaaataaaaatattttccagacaaacaagcactaaaaaaattaattaccattaggccagttgtgtcagagacctttaagagaattctaaacatggggaaaatatagagctgatacctgctaccacaaaaacacaagtacagagcccacagatctatagcgcaatcaaaccatagaaaatataaagcaaccagcttacaacttcatgataggatcaaaatcttgcatattaatattatccttgaatgtgaatagcctaaaccccccacttaaaaggcacagagtggcaagttggatagaataacaacatccattcatctgctgttttcaagatacccatctcacacataatggcatcaataagctcaaagtaaagggttgaagaaatatctatcttgcagattaaactacaacaaaaaagaggagcggctattatattagataaaatatatgtactttaaaatatatttaaaatataatatatataacatattaggtaaaatatatgtattttaaaatatattaaaatataatatataatagataaaaaagactttaaaccaacaacagtaataaaggacaaagaagggtattacatgatgataaagggttgaattcaacaaaaagtcttaactatcctaaatatgtatgtacccaacactgaagcatctgaattcataaaacaagtacttctagatctacaaaaaggcttagatagccacacgataatgttgaggaacttcaacaactcactaaaagtgttagacatgtgaaatgttagtcaattaaacctctctttttttttttttaataaattagctagtctcagtatcttcatagcaatgtgaaaatggactaataaatttacttttgggtaaacaatgaaattaaggcagtaaccaaaaaattctttgaaataaataaaaataatagacacaacatataaaaatctctaggatgtagcaaaagtgctgttaagaggaaagtttatagcagtaaactcctacctcaaaaagttagaaagatctcaaattaatgatttcacatcatgcctagaggagcaagaaaaacaagaataaaccaacccaaaagttagcagaggaaaagaaaaaattaaaattagatggaactgaaagaatttgagacctaaaaattcataggaagaatcaatgaagaccaaagttgtgttttttttttttttgaaaaaataaacaggatcggtagactgctagctagattaacaaagaaaaaaagagagaggattcaaataagcacagtcagaagttataaaagtgacattgcaaccaatatcatagaaatacaaaagagcctcagaaactattgggaacacatctgtgcatacaaactagaaaatctagaggaaaagataaatttctgaaacacacaatcctccaagaatgaattagaaagaaactgaaaccctgaacagaccaaaatcgagttcctaaattgaatcagtaataaaacacccaccaccaacaacaacaaaaagagccccagccaaattctaccaaacatacatagaagagctgataccaatcctactgaaactattccaaaaaatggagaaggagagactcctctttagctcattcaacaaaaccagcatcatcctgataggaaaacctggtaaagatacaatgaaaaaaatctctgataccaatatctctgataaacatagatgcaaaaatcctcaacaaaatattggcaaactgaatttagtggcacatcaaaaagttaattcactatgatcaagtagacttaattcttggaatgtaaggttggtttaatatagacaaatcaataaatatgactcaccatataaacagaattaataacaaaaatcatatgattatttcaacagatgtgggaaaagcttttgataaaatacaacatcccttcatgataaaaaccttcaagaaactatgcatcaaaggaacatatctgaaaataataagagccatctaagagaaaccacagccaacattatacttgaatggacaaaagctgaaaccaatctctacttgaatgggctaaagctgaaaccaatctccttgaaaactgttacaaggatgcccactctcacctctcttattcaacatagtactgaaagtcccagccacagcaatcaggcaaaataaataagtaaaaggtatccatctagacaaataaaaagtcaacctatatttctttgctgttgatatgattttatacccagaaaacataaaatactttactaaaaggctcctggaactgagacacgacttcagtaattttttaggatacaaaatcattgtataaaaatcaatagcatttctatacaccaataacattcaagttgagaaccaaatcaagaactcaactccatttacaatagctgcaaataaataaataaataaaacacctaggcatgcatctaaccaaggaagtgaaagatctctacaaggagaactatacaacactgctgaaagaaatcatagatgacacaaacaaatggaaaaatcatttcaatttcatcaactggaagaatgaatatcgttaaaatggccatgctgctcaaagcaatctacagattcaatgctattcctatcaagcaaccaacgtcatttttcacagaactagaaaaagaactattctaaaattcatatgaaaccaagaaatatcttgaatagacaagcaatcctaagggggaaaaaaaaaaaaaaaaaagaagccagaggcatcatattacttgacttcaaactacactataaggctacagtaacacacacagcatgatactggcacaaaaacagatacacaggctgatgggacagaatagagaacacagaaataaagctgcacaactaaaaccatctgatctttgacaaagttgacaaaaataagcagtgactccctattcagtatctggtgctgtgacagctggctagccaaaggcagaagaattaaactggacccctatttttcatcatctagaaaaattaactcaacatgaattaaagatttaaatataagacctccacaataagaatccttgaagaaaaacctaggcaacatcattctggacatcagtcttgggaaagacattataactaaattctcaaaagcaattgcaacagaaacaaaaattgacaagtggaatctctaattaaagagcttctgcatagcaacaaactatcaacagagtacatagacaacccacacaatggaagaaaatatttgcaaactatgaatctaacatagttttactatccaggatctataaggaacttaaacaactgagcaagcaaaaagcaatcccattaaaaatgggtaaatggtacgagttaggtcattcttgaattgctacaaaaaaatacttcagactgggtaatttataaagaaaagaagtttaattggctcgtggttctgcaggatatacaagcattgcgttggcatccacttggctttggggtgggggctcagggaatatttactcacagtaggagatgaagtgggaacaggtgcacgacgtggggagaacaggagcaagagggaagtgggaggtgccacacacttttaaatgaccagatcttctgataatgcactatcctgaggacagctcatcatgaggaatctgcccctattacccaaacacctcccaccaggccccacctccaacattggggattgcatttcaacatgagatttgggaaggacaaatgccaaaaccacatcaaaacatgaatggacacttctcaaaagaagacatacaagtggccaaccaatgtgaaaaaatgctcaacatcatgaataatcatagaaatgcaaatcaaaccaaaataagatactatctcacaccagtcagaatggctattattaaaaagtcaaatacaacagatgctggtgaggctgtggagaaaagggaacactttataaactattggtggggatgtaaattagttcagccactgtagaaggcagtttggagatttctcaaagaacttaaaacataactaacatttgactcactcatcccgttactatgtacatattcaaaagaaaataaattgttctacccaaaaagacacttgcattcatatgttcattgcagcactattcacaaagcaaggacacggaatcaacctaggtatccaccaatggtggattgaataaataaaatggggtacatatacaccatggaataacagccataaaaaggaatgaatgaaattatgtctcttgcagcaatgtggatgcagctggaggccattatcccaagtgaattaatgcaggaacaaaaactcaaataccatatgttcttacatacaagtaggaggtaaagaatgggtaatgatggacataaagatggccacaatagaaactgaggattactagacaggggagggaggaagggagtaaaggcttgagaaactaattattgggtactatgctcactacctgggtgattgcatcaattgtacttcaaacctcagtatcatgcaatatacccactgaatctaaataaaagttgaaattattttttagatgcattaaagataaatacattctggactctgggttaaaaaaaattaaaagatgctgggaaagaaatatatgacaatcatcaataaatgtgatataatcaatacttttattttattcaaattttgtatatcttaaatatatatttcttctataactataaaatgttattttttaaagcttttattctaatgacctaaactgcaaattaaaaagtaggatgaacaaccagaaaacctttcatgcatttctgcttttattcagtaattaataacttaagctggagtgtttttggaaaatttgtgaggtacttatcgtcttatattttttaaataggctgtgtagctccagagtgtgtgcacaagatgagaacacattaccctgagtcaaagtcgataataatcaacaaaggtagcaaagaattcaactcttctgcagaaatactatcaatctgcaagataggcatggacatatgcatgaatagatacaggatagccagacagagacacaatcagacaagaatatagaaattaagggtgtttctcaagttttcagtaagcaaatgagggttatccctcaaatctcctcaaaaggattatattgtagctaattaagaagaagattggaaaggagaaagatatggagaaagaaaagaaaaagaaagagggaaaggaagaagaggagaaggcagagacagaggaggaagaacaatagttaattttcatttagctcttactatgtgccacatgctatggaaactaatttaggcatatcttctcactcaatcattaaaactgtaagacgcaaatattttccccaatttacagatgtgaaattacctaaaacgatgaaaaacaagtcatctctttgttttctcttgacaggcagctgatctttattaggtacttcgtctgtgccaggtactatgccaaggcctttacatgcataactttagtactcaaagcaccattttaattagatctattattttcattttgtagatttgcaaagtaagtttcagagagagtaaatgatttgaatttagttttctctgtttcattcacatgcatacacaataatctcttctatagggcattctttcaaatcattttttgttattattgctttcactgagtaactttcttatctattcttcattcttaagtatggacacaatgataatacctgacatgtaaagtgttttatctgtcatctataattctagatgttttgtctctactaattgttttaataatcacacaacacccacagtttcatgaggtaagtggaatcattatcctcatttagtgaaggagaatattgacaaacagagaggttaactcacttgccaataaatggtattagtggtagagctcgtgttcaaacataatctggctacacctccttacctccatgttctaggaacagtatcagtcttcttgccaattttatcttttttgtaaatattaaattgtcattctgatttgtaagttggtttcttattgataatcttatttgtcaattataaactcgattaatgtggatttgttccttgaagaccagcaccactatacaactctgataaaatcaaactgtcaaactagtaatcagattcttgaccaataaccaattgcaatcactcaagtttaagcaaaacatgctgtctctatcaagagactcttccaaggccacagtagaaaagcctataattccattaaggaaagaatgagtcaaatgagtagaaagtgtgaaaatgatcttttgaaattcaaagttgcttgacctaaatttacctttcattttcagaactgatgggaatatcttggttataacagaagcagtcagttttataaccaaagtaaaacaaaatactatgtggtaaattcttatacttataaaagttattaaagccttctttcccattgacatgcagaaagcctttctgagtcagttttgctcacttagaagcagaatcaggagaatgcctcattcctactttaagaatattctactatttttcaaatctcctttgggccacttttatgtattcaggtcttttcccattttttaatcaggttacttggattttttttctattgagttctgcatgtttcttatacactctagatattaattccttatcagatctatggtttgcaaatattttctttcaaaccataggttgtcttttaattttgttgattattacattgtatatcttaagtccttaaatatgtacaatttttacaaaaaaaattaaatttaaaaacatcgaacaatgcttttcccaccttttaaatttttacgtgaaagtgacagaaaaacttcggtctctaggttggtagaacattcttgccctttactgttgtttctcaagtaacatttgctttaaaataacttttaaaagaatactattagggacttttccagaacatctacttagttccttaatgcatgatttttttttaaatctaagttttataatcacagggactcacaacatgtaagcagatggcatttcagcctatgtggttttctcactttaagccagttttcacgtttctaccaagacgcttggagccaatatggaatacatcatttagtaatgaggaaaaatgtaaaaaaaattcattacgttttagtttaaatttcaggggtgaattagcaaaacgaacacttttcaagacttttattccataatcttagtatttttttgctcatattggagcctaaactttaagaaatttaaaatgacttttgcagccaggtgcggtggctcacgcctataatcccagcattttgggaggctgaggcaggcagatgacctgaggtcaggagttcgagaccagcctggtcaacatggtgaaacctcatctctactcaaaatatgaaatattagccgggcatggtgactcgtacctatagtcccagctacttgggtggctgagacacgagaatcgcttgaacctgggaggcggaggtgcagtgagctgacatcgtgccactacactccagcctgggtgacagagagactccgtctcaaaaattaaaaaaataataaataaataaataaataaataaaacgaattttgcaattacagacaatagcctacattttgctaagctggaaaagtttgttaatgaaaagtactaggtgtcactgtgaatttcaaaaataggaatttaaagcgatcagtggtagcaaaagcacttggtgttcatgacttttcccatcccacagggctcatttcttcacctgtaatgccttgtttcatcttgctcaggatcacagatcatcaatgatctcatcttttcctctacttttaatgcctttttttttctgattcctgactctatcaagtccctcaaagcaaaaccctgacttctataatcccatgtctccttttttgtttatgaatatgcctactaaaatgtttcaatgcagattcctcctttccttatcattctaagaactgttttcaactcctccagtccgcagaattttatcttactgagatcactaatggacttataattgccgcattcattatatatgttgcagttcctcccttatatcacctctctggagcttttagatctttattgattttcataaatattaattctcatgaatgtttcctcttagattttctcctagttttacaccagccttcccagactgtattgtaagcatttttttttttccttgcacgtgttgttgttctcagcttttgttcctgagcaatttttttttttttaactttcattctcttcttggacaacagtagacagtgctctggcttcatctgtcacttacacaacacaaactacaaaattctaacatccagctctgtcatcaggcgatccatgtaactactgtgttagtccatgccatttcagcatctcatcaacatttcacacttaacacatttatctctcagctatttcactatcttgcctactcacctattcaactattttttctctttgtattaactatctcaatgaagaatgccttgttcctcttttccatctcttaaatctggtcagccattagtttgtgcttattctacacctagaaacctcaatatattttaagtatttttttctttgctatgcctatgacagctgctgtttagcaaattcaggtttctgaaacacagaacagagaaggtacctatagaagtatgattaaaaatacactggaactctgttataatgtcagtggtagaggataacattgtctcatatggtatgttcaagactggacatgttgatttatgagagttataattgggaaagtatggtgcatggcatatctcaatgaataaaggttgtttttaccagaagttatatatgctgttaaaatcctgtcatattttgtccatatttaggctgaaattgtcttgagtttaagaattgtttcaaattcctttttattttcaacttggtttgcacatacagctattgagaaagtgacatgtactttgaacacaatacaaattaaagacaagatgttttccttattcaacaaagctcctttactttagtagatgtaaagttatgactcaagctacttttcagctttatgttacttccatgagagattctcagaagaaatgagtgtcctatgtaatagaccataactcaaaagtgtcaccctctccctcatgcctgaaatttgtcattcaaagaattacttcgactgaaacaaactcatacaagtgcattatcctgtacataaaataaggatgtggaaaagatggtggaaaggtaactcagacaaattctggttatttggaatttttgattaaagatagccagccaactacaagaagaaactttgctcatccttcctcttctccacttatacaagatagctccttccacctagaccctaaaacactttattttttggttacatagttttgtaactatacatgaagtgaacctgaatagataatcaccctaggagcatttaaaacactgtttcagtgaaaaaatgtcagacattacataaaggggaaaagagtaaagcagcatctcttagaacaggagattcactattacttgaaagacgcaaatagatcaaatatttcagtatacatttagtcctatttaaatcttgagaactttctgtgcatttatttttataaagtaggagttcattaatctggagaactaatctaggcatcaacatttctgccagagaagaaaataaataacaaagatctgagcagaataaaatgaaattgaaaccaaccaacacacaaaatacaaaaaataaatgaaatataaagctggttctttgaaaaaataaataaaatcgatagatcattagtgagattaacgaagaaaagaagacagaaggtccagataaattaaattagaacgaaatgggagatattactactgataccacagaaatacaaaagattattcaaggctactatgaacacctttacatacataaactagaaaacctagaggagatgaataaattcctggaaatatataaccctcttagattaaaccaggaagacatagaaactctgaacaggtcaataatatgcagcgagattgaaacggtaatttaaaaattgccaacaacaacaacaaaaaagtccaggaccagacaaattcacagctgaattctatcagatattcaaagaggaattgataccaatccgattgacattattccacaggatagagaaagaggaaatcctccttaaatcattttatgaagccagtataactctagtaacaaaaccagggaaggacataacaaaaaaaaaaaagaaaagaaaactatagacaaatatccctaatgaaaatagatgcaaaaatccccaacaaaattctagctaactaaattcaacagcatatgtaaaaaaaaataaactgccataatcacgtggggttcataccagggatgaagggattattcaacatctgcaagtcaataaatgtgacacaccacataaaaaaattttaaaaatattacatgatcatctcaatagacacagaaaaagcatttgacaaaatccagcatccctttatgattaaagccctcagcaaaatcagcatagaaatgacataccttaaggtaataaaagccatctatgacaaacccacagccaatattatactgaacggggaaaagttgaaagcatttcacctgataactgggacaagacaaggatgaccactttcaccgtttgtattcaacaggactctggaagtcctagccattgcaatcagacaagagaaagaaatcaagggcatccaaatcggtaaagaggaagtcaaactgttgctgtttgctgatgatatgatcatatatccagaaaaccctaaagactcatccaagaatctcctagaactggtaaattaattcagcaaagtttcaggataaaacattaatgcattcaaatcagtggctctgctatataccaacagtgaccaagctgagaattaaatcaagaactcaaccgtttttttacaaaatctgcaaaaagaaaaataaaatacttaggaatatacctaaccaaggaggtgaaagacttctacaaggaaaaccacaaaacactgctgaaagaaataacaggcgacagaaacaaatggaaacactcccatgttcatggatgagtagaatcaatattgtaaaaatgaccagacttccaaaagcattccacgaattcaatgcaattcccatcaaaatgccaccatcattgtttacagagttagaaaaaacaatcctaagattcatatagaaccaaaaaagagcccgtatagccaaatcaatactaagcaaaaagaagaaatctggaggcatcacattacttgacttcaaactatattataaggccatagtcaccaaaacagcatagtactggtataaaaataggcacacagaccaatggaacagaatagagaacccagaaataaagccaaatgcttacagtgaaatgatctttgcaaagtaaacaaaaacattaagtgaagaaaggacaccctatatgacaaatggtgctgggataattggctagccagatgtagaagaatgaaactgggttctcatctctcaccctataaaaaaatcaactcaaggtgaatgaaagaattaaatctaagacctaaaaccataaaaattctagaagataatatctgaaaaacccttctagacactggtttcggcaaagactctgtgaccaagaacccaacagcaaatgcaacaaaaacaaggataaatagatggtacttaattaaaatggaaagcttctgcacagaaaaagaaataatcagcagagttaatagaaaacccaccgaatgggagaaagatcatcacaatctacacatctgacaaaagactcatattcagaatctccaaataactcaaacaaatcagcaagaaaaaaaatcccatcaaaaagtgggctaaggacatgaatagacgattctcaaaaaaaaaaagatatacaaatggccaacaagcatatgaaaaaaatgttcaactcactaattatcggggaaatgcaaatcaaaaccacaacgagataccaccttactcttgtaagaatggccatgatcagaaaaaacaaaacaacaaaaaaaggtgttggcatggatacagtgaaaagggaacacctttacactgttattgggaatgtaaactagtacaaccagtatggaaaatagtgtggagattccttaaagaactgaaagtagaactatcatctgatctagtaaccccactactagatatctacccagaggaaaaaaaggcattatacgaaaaagatacttgcacacacgtttatagcagcacaatttgcaattgcataaatatggaatcagcccaaatgcccatcaatcaatgaatgataaagaaaatgttatatatacatatatatatataaatgtggtatatatgtgtgtgtgtatgtatatatatatgtgtgtgtgtgtgtgtatatatatatattcatgtaaccaaacaccatctgctccccaaaaacctcttgaaaaaaaaaattaaaaaatttctgctggaaataaatttcagataggtaatacctttaaaatacgcatattgtcacaaggtgtatctaggaattatatccttaggagttgtgtaatcatgatataatgaaggctccagaagcttctcagtagtatagtttcattgaaataatttttttgcctcttataatatcaacatgaaacaattcaaatgaggccagcctccaagaatattttgtaaaatattaatacaaattatacttgtaggttgttttgttcataatggagtgcattttgtgtgatttggtttatatttctttactttggtttttaaacatcatcttttcttgaattagaattagctgccaatgtatttaacactaaaagttcgttttaattttgttcagttacaattaggtgggaatgtccagttattagccttaatatctttgctttggcaaaattacaaggaggaagtaattaggctgcttaaagatcaccgagggatcagaaagtctaacactgttctctcctggtgcaaaacacttttagcagatgctaattttattttggctcctattgtctccttcctatctaggttatactgcttctataactatttgaaatctttttgtgcattatccttaccttatgagatgttactttatctaatttagaatatctgctaatatgattaattacaatgtagagtacagaaatagaaaaaaatatgtactgaaagcctgaaatcttggattcatattttacttctccaacttattctgtttaattcacaagcaaaatttttaagaattgttataggtaagaatagctataacaatcttgttttatacaaggatactgtctaaaggagacaaaatttgtgctaaaattctacaagacttaaatatatctttgatggcatacttaagccttttttgagaccgccattttgagacaattctgaagtctaaaaaatgttgaatgactgggaaaattaaacagaaggttttagttcttctctttctaactagctaatgccaatgccagagtagtgaattgtgtgtggcatacacacaataaatattctctcaaggaagcaatgaaggaaggaaaagtgaaaaataaaaatgaaaaggccaagcaagcagaatgagaagcatcaactaatctaattgtttcattctttctacatgtgaactttaactctgaaactttacagaatgtaactaaattggtctaataatatatgtaatagatgatatatatataaacatgcatttaaataatttaaatatatatataatttcaaatctaatgttagttggaatggatattactgtttgaccttctgacacaccagcaaaaactaaagctagaatgtattatttttgaaatattaaattgatcaaaagagaaagcaaccaatgttccagcagatttttttcataatatacatagacactgaaaatcacattgcttacattactcaatttattccataatcaatttcagatattattttctgcctaaaatgtcttaatctatccaataataatgtcagaagcacattcaaagacaacctccctagatggtcactgtaataactgagtcagtttcttcattctcagttttgattacttagaactatatttcttcagaacaaaagtaattcatctgaaactattttatgtatgaaatggaaaaggccaaaaagagtcatctataattctttattagtcagtgactacttctctaagcttctcttaaaatgtcaaagctatacagaagtaagatgatacttttgctttctcccataccatttgaataatgctaaaaacaatgacataatttgataaagccatgttatagaagtacctacttcaaggcaacctgatccaattaaagaagattatcaatataagaaaaaaaaccttcaatgtgacacaattatgtcaactttgaaaactgggtgtttcaaaataaacagaaaaaaatgggaggaagcattcagtatttaaaaagttattaatacatgtaaatatgtgtcatgtactatgtttcacttatttcactaagatttagtgtctctcataaaagtgaatgcaataagattctaaaataaagaaaactgtgggcatatataggcttcagtcacataatcaaactcagaaattttgacttatttaggatatagtttgttttagctgtaaatactaaatactaaaaaaaaggattaataaaattttataataattaaagtaacacggaaaagacatatgttctttattattaggaatgttattaaacagtttattataattagtctttatttgtttcttattccttatatccacaaatacaatatttaataggagagagttcttcattttccaagagagtataaacatagtgaacaatagtaatcattataaaaagaagcccaaaaacctttccctaatactatttaagcaagaaataatatgaaacagttgcaaaaatcctcatttttttccaaaaggaaataaatatgtactatgaagttgaacataatataaaagccatgaaataatattatacctcagtctgaaatattaattgaatatctcaacacattaatgaaagcaacagatttttcagttaaagtgtaaagtatttctaaggatgcagcagctgcttagaaatactgaaataaacatgagaaatctaaaaaaaggaaactaaaatgtttatgaacaccagtctctatattaattatgtattttatgcattttatatctttagtattatctttagtattctactaaatactacttttctttgaattttaaatattatattagaatatattgttgacacagaaaacctaacattataacattttaaaatgtattaatttttgaagagcaaaaataaggaaacaattgacagactttcctgtaagatctgaaacaagacaaggctgcctactgtcaccatttttattcaacatagaactgaatggcctagccagaaccattagctaagagaaagaaatatagagtatccaaattggaaaggaggaagtctaattgtcctagtttatagataacatggtcttatattaagaaaaacctttctttgtgttacaaacaatccagttataacttttagttatttttaaacatataataaattacttttggctatagttgccctgttttgctatcaaatactagatcttatttattctatctaactatatttctgtactcattaaatatattcttatcccatttgtctttactgattgattcatgaaaatgtcaaaagtgtaataaaacattgctattactaattaaactactaagtgaaaattaaaatttctttttgtttattttgtctctggatagttgactctgagtgtgaatcctgtaccttatttaccctgttgtgattattacacattgtatgcctgtatcaaaatatttcctgtaccccatacatatatagactaccatgtgctcacaaaaatgaaaaataaaaatatatatacaaaaaaaagaaaaacctaaaggctctaccaaaaaaaaaaaactcttagatttgataaaaaaattcaataaagttgaaggatatcaaatcaacctgcaaaaatcaacagcatttttacacacaaatagtgaacaatctaaaaaagaaatcaggcaagcaatcctatttctcatagctacaaaaaacaaaacacctagaaatcaatataactaaagaggtgaaaaatccctactattaaactataaaatattgataaaagaaattgaagaggagacaaaaaaagatatcctctgttcatgtatggaaagaattaatattgttaaaatgtccatactgcccagagcaatatacagattcagtgtaacccatagaaaaataccaatgacattttttacatagatagaaaaaaaaaatcctaaaatttacatagaaccacaaaagaccctgaatagccaaagcaatcctgagaaaaacagcaaagctggaaacatcacacgacctggcttcaaaatatgttacaaagatatagtaactaaaactgcatggtactggcattaaaaaaaaaaaccacatagaccactggaacagaatggagaacccaaaaataaattcacatatttatagccaactgattttgaacaagtgtcaagaacacacattgagaaaaggatagtcaataaacagtagtgggaaaattggatatctattgcagaaaaatgaaactaggcccctacctttcaccatatggaaaaatccaatcaaaataaaggcctagcataaaatccaaaactataaaactagtagaagaaaacacggggcttcaggacattgattttggcaaagatttgatggctaacacctcaaaagcacaggcaacaaaagcaaaaataaacacatgggattatatcaaactaaaaaggttttgcacagcaaagaaaacaattaacagagtgacaagacaacctacagaatgatagaagatattttcatactatttgacaagggattaaaatacagaatacataagacatatcaacagaagaataaaacaaatttaaaaatgggcaaatgatctgaatagtcatctctcaaaagaagacatacaaatggccaacaggtatatgaaaaaatgttccacatcattaattgacaggaaaatgcaaatcaaaagcacaataagatatcatcttaccccaattaaaattgctataattgaaagaacaaaaaataaattctgtcaagaatgtagagaaaaggggactcataccctgttggtaggaatgtaaattagtacagccattatggaaaataggagttttctttaaaaactactactaataaactaataatagaactaccatatgatccagcaatccattactgggtatttatttaaagaaaaggaagtcagtatgtcaaagagatagctgcactcctatgcttactgcagcactgttcacaacctgtcaatcagttagttagaatcaatctaactgtccaccaatgaatggatggataaacaaaatgtggtatacaagcacaatggaatattcaggcacaaagaaaaatgaaatcctgtcatttgtggcaacatgaccaagactggaggacattatgttaagtgaaataagtcaggtacagaaagacaagtaccacatattctcatatgtgagagttttaaaagttgatgacacagaattaatgaatagaataatggttatcaggggcagggaagagtagcggagaggggaagataaaaataagttggttaaaggtacaaaaatacagttatataggaggaataaattgtagtcttctgtaacataggctgactatagttaataatttattgtgtatttaaaaatagctatatgagaagattttgaatgtgttcaaaacaaagaaatgatagatgtttgaggaatagtatatgctcattacctaatttgatcaatacacagtgtatacatgtatagaaatatatgtactctacaaaggcaattattatatgtcaattaaaaataaaacataatgaaaataaatgttaaaaatacacaaccaaaaaagaaagaaagaaatataatgtatcaacaacaacaaaactcggttttgtaattacaattgattaaaattaattgagtatatttgatgctgaagagctgatactagaaataatttgagtatgttttaagctaaaaatatctgccctaagaaataattaagcttccttataatcgtccattacctagtgtattaatagagctattagaaattcaattataatttagaaaaaatggttgaagagagtaaaaatttaactttgcctaaatcaatgttctaatggcaaagagcaattagcatgaacttttatgatgtccacttgtaagtaactcacctgattagcaatctgccgagcaaggacatccatccttgatcctgattctgatatcattttcgctgcatagatcacatcagttgtatgctttagtggtcctttgcccctggaaaaaaatttatatatgttagctgtggtgttcatgagaaaatatatgttagctacgatggttcatgaaaaaatgtattaatctatgcgtccatccatccgcatatgtaaaatattcgcatcccaaagaacggctattgtttttgtgattgtttgttttgagactgagtctcactctgtcgccaagcttgagtgcagtggtgcagtctcggctcactgcaacctccgcttctcgggttcaagcgattctccagtcttagccccccgaagagctgggactgcaggcgcgcgccaccatgcccggctaatttttgtatttttagtagagatggggtttcaccatgttggccaggatggtcacgatttattgacctcgtgatccacccgcctcggcctcccaaagtgctgggattacaggcgtgagccgccgtgccctgccagctgttggttttaatattttgattttgaaaagagcacaatcagactccagtattattattattattttttaatgccagcctattgtgttaagtcaagaaatactgcagagaagatgaagacctttttgatcttcattcccaggtgtttattatagtaaaactcagcctagagatacccttcatagacctagatacctcaaggcaaaggtattttcctgattttagagagaatcataatattttggatattatatgtatctaacgatttattttttatcagcaggcctacttttagtatttcacattttttctgttgctatattttagttactttaaaaaaatttattgatggtaaaattcattttttatggggtacatgtattattttgctatttgtacatacatagaatgtgtaatgattaagtaatgttatttagggtatctgtcacgtcagtcaagtattatttctatttgttgaaaatatttgaagtcttctcttctagctattttgaaatattcaatacattgtttttaactatagtcatcctactcaactattgaatatttgaattgttctttctaactgtatgtttgctcccattaaccaacctctcttatccccccaatccccaacaaacaccatgccaagcctcagataactatgattctactttccacctccatgagagcaaagtttttagctctcacatatggaggagaaagtgatatttgtctaacttatttcacttagcataacatcctccaggctcatccaagttgctgtaaatgttaggatttaattcttttttaatggctgtgtttcattttgtgtgtagtgtgtgtgtgtgtgtgtgtatacacacacacacaccacattttatttatccatttatccaacacttaggttgatttcacatctttgctattgtgaataatactacaataaaaataggggtgcaggtatccttttgatatgctgatttccttttctttggataaatacttaggagtgagattgctagatcatacgttagtactacttttaattttttgagaaatatccatattgttttccataatggctgtactagtttacattctcatcaacagtgtataagagttcccttttcaacatacctttgccagcatctgtttttttttttttccttttaataatagtcattctaactggggtaaaatgatatattattgtagttttggtttgagttttcaagctaattagtgatgttgagcatgttttcatatacctattggtcatttgtcttcttttgagaaatgtctgttcatgtcctttgcccgctttttgatgggattattattattttctcctgttgagttgttttagttccatgtattctctgaactttaggcccttattagagaaacagtttgcaaatatttttaaatattaaatatttaaataatttaaatattaaatattttctactatttaacaggctctttactctgttgattatttcttttgatgtgcagaagctttttagtttaatatagtcccatttgcctatttttatcttgcctgtgcttttgaagtcttagccataaaatcttcgtctagaccaatgacctgaagcatttccccaatgttttcttcaagcagttttataattttggatcttacatttaggttttagctgatcttgatttgatttttgtatatggtgagagataggtggctagtttcattcttctgagtatgattatcctgttttcccagcaccatttattgaagagccatcctttccccagtgcctgttcttcccacctttgtcgaaaaccagttggttataaatgtgtggatttatttctgggttctttattggttcatgtgtctatttttacgctcatacaatgcttttttggttactacagccttataatatgtcttgaagccaggtagtatgatgtgttgtgtcctttttcctgttcttttcctcagtattgctttggctatttggggacttttgtggttctattaatatgtaacatttaggattgtttcttctgtttctgtgaagaatgtcactgatattttgatataattccactgaaaatgtagatttcttttggtagtatggatattttgacaatattaattcttctgatctatgggcatgaaatatattttttattttttgtgtcttgttcaatttcttccaccagtgttttatagttttgtttgtagaggttggttcttgtttggttaaaattattcctaggctttttttttgtagctattttaaatgggattgcctcttgatttcttttgcacatttttcagactggtgtataaaatgctattgatttttgtatgttgatttagtactctgcaactttccttaatttttcaaatctaagagtgttttggtggagtctttaggtttttcttaatataagataatttcattgcaaagaaggacaatttggcctcccattttccaatttggatgacttttctttctttttcctgattgctctggctgataaccttcagtactagaatcctgaaggggagttataaaagtgggcatcctcatcttgttccggatcttgatagaaaggctttcagctttgttccaatcagtatgatgttagctgtgagtttgtaatatgtggcctttattatgttggggtatattccttctaaatctactttcttgagagttttcatcatgaaaagatcttgaattttatcagatgcttttactgagcctattgagatgatcacattttttaatctttcattcttttgatatgatgtatcacgtttattgatttgtgtatgttgaatcatccttgcatcccaaggataaatcccacttgattaacatgtgttatctttttggtgtgctgtttgattaattttgctagtattttgttgagggtttttgtgtctcattcatcatggatattgacctgtagttttctttctttcttgtgttcttgtctggttttggtatgagggtaatactgcctcataaaataaaatagggagaattccctcctcttcagttttgtggaatgccttgaggaaaatcaatgttagttattctttgtaagtttggtagaattcagcaataaaggaaccaattctgggcttctctttttcgggagtctttttgttactgattcaatctactgtgcattattgttctgttcagattttctattttttccacacttgatcttcgtaggttttgtgattccaggaatttattcatttcccctatgtcttccagtttgtaaatgttaactgttaataatagtgtctgatgaccttttgtatttctgtgatgtcaattgtaatgcctccttttacatttataattttgtttatttgggtattctctcttttcttggttagtcttgctagcaggttatttaattttttatcttttcacaaaaccaatttgttgctttgttgatctttcgtatttttttagtctctgtatcatttagttctgttcttatctttattacttattttcttctactaattctggatttagcttgttcttgcttttctaattccttgatgtgcatcattagattgtttatttgaaaactttctagttttttatagtaggaatttattgctatgaacttccctcttagcactgcttttgctctatcctataggttttggtatattgtgtttttattttctttctttttcagaaacttgtttgatttcctacttaatttcttcattgacttgatgcttgtctaggagattgttgtttaatttctacgtatttgtacagcttccaaaattcctctttttactcatttctagttttatttgattgtggcataggaggacacttggtatgctattaacttttaaaaaatttgttaagatttgttttgttgcctgacatatggtcaatcctacaggatgtctatgtggttatgggaaaaatgtatattctacaactgttcaataaaatgttctgtagattggcctcttaggccaatgtggtctaaagtgcagtttaaatacaatgtttctttttaaattttctgtctagatgatctttctaatgctaagagttgagtgttgaagtctccaactattattgcattggagtacatctctcccttttgatgtaataatatttgcttcatatatctggatgatttcatattgggtacatatgtatttataatttttatattctcttgctggatttgtccttttatctttaatataatgaccttcattgtctcttttttactgtttttgacttaaaaatgtttttatcagatataagtagagatacttatgctcacttttggtttctgtttgcaccaaatatctttttcaatcctttactttcattctatatgtctttacaagtgaagtgagtttcttagaggcagcagatagttgggtcatgtggtccttgcttttggttttggtttttgttttcaaatccattcagccagtctttctctctatatatattttttagatggagtcttgctctgttgcctgggctgcagtacagtggcacaatctcagctcactgcaacctccacctcctgggttcagcctattctcctgcctcagcctcctgagtagctgggattacaggcatgtgccaccatgcctggttcattttcgtatttttagcagagacagggtttcaccatgttggccagactggtcttgaactcctgacctcgcgatctgcccacctcagcctcccaaagtgctgagattaaaggtctgagtcaccaagctatatcttttaagagcaaaatttaatccatttaccttcaaagttattatttatgtgtgaggatttatttctgtcattttgtaaattgttttctggatgttttgtgtatacttcgttcctttctttcttattgtttatcattatggtttggtgtttttctgtagttgtaccatttgagtagtttctacatttgtatgtttaccagtaagttttatactttcctgtgttttcatgataatagatatcatctttgcactttcagatataagaaccctttaaaggagtcacgaaaacaaaggaaagtaataaatttcctcagtttttgcttatctgggaaagagtttatttcttttttatagctgaaggatcaattttgctgggtatagtgttctggattgacattttttttttttggtttttctcctcccagctctctgaatgtatcatctcattctctcctgatctgtaatttttctgctgaaaaatctgctgttagttttaataaggtttcctttatatttgacttaacatcattctcttcctgtctttagaaatcctttctttgtatttgactttcaacaatttgactataacttgcctttaacaagaactttttgagttgaatctatttggggctctttaagctttctgaatctggatgttcatatctctcctaagacttttaagtttccaggcatcattttactaaatagattttctatggctttggaattctcttcaacttctggactatccagaatttgaaactttggttactttatggagccccatttgttacacaggatttgtacaatctttttttattatttattctattttgcctgaccaagttatttaaaaaatcctttattcctgctataaaattatttcttgtgcataataaaatctgttgttgaagctctcacatgaattttgtatttcattcattgaattcttagttccagaatttttgtttcttttttatgatgcttatcacattggtaaatttctcattatgttcttaattgtcttttctgatttttttttgtattctttatctgtgttctattgtatctcactgagcttctttaatattattactctgaactcttttttcatcatttcattaatttcttttttattgtaatatcttgctggacaattattatgtttctttagatgtggcatatttccttgacatttaatgtttcttttttcctttcattgatatctttgcatatggtgtaagtcacttctttatttttttggattgtcttttgtaggggaaggtcctaaagatctatctgtagtgttggtttcacaggacactttagtttgattctgggtgcatgcagtaatgtagcctccatgtgatttatttgtctataaatagcctcagtggtatctgtgatttcctctgtcaattaggctgtggctgttagtgcaggctgtggtaaggctttgtaggggatgagaactgcaggtgggttggtcctcaggcctcggtggtgggccaagcatgcctgtctttgggcccacaggcagcgtgcatgggcacgaatgtaattaggtctaagaaggctaattcttggacctccaggtggctttcttgggttctggcagtggcagtattgggccatgtggttcattaagttcctgggtagcatgcatggcatgagcaatggccatatctgtgacaggacaaccccatgggctcacagataaaacatgtttctgttagtggtggctgtgatgagctgggtgggcctgcgcttaagcacctgaaatacttgcactgataccagtggtagtgggtggggcaagatgatccccaggtccctagacaatgtgcccaggcatgggtgatgttgccaggccagacaagcctgtcattaggcctcctccattgtgcacacaggtacaggctgtgatcggcaggccagggtgaaacctaggctcccctggtaaagtgctgggtggtggcagcaatgacagcaatgagcagggagaatccatcctcaaggcacgtgcaagtacactgtgggcctgtttctgggaattggggttattttcagtgacagcagccacagccagttggctctcaggctcttggaagtatacgcttcagtgtccagaattggtggaagcagcagccatggggagagccagtcttcagagcatgtgcaagttgaggattgctgaggaggcagagttgctatcagtgggagcagccccaggcaggcaagtttcaagttctggggagcacatgctttggctccctttgtcccaggggcaccttgctttgcctgctacaccacccataacctggggtgcaagttgctgtgtgttctatagtgctgaggaccctgctgttctgctgagtctaatcactctcatgccactgcagtcctgtaagggatgtagggagatgtcagtggggttctagggatgtaggaatgcaggggctgctgagccccagggagaaatgcagtctggtttgggccacattctcataatgacactgtgctacaactgcttaggactcagggtgtttgtgggacccagcataagctacctatctggagcgacgccattacacactatccaggctgcttcctgtggtagccttatggtctgcaggggtcaaggaactctccagtgactaggattgcaggagcccatcatgggaatgtggactgctggggcatataccattttcccacactggggtgactctccaagctcccaggtgatcctgaccaagctggcagctttacttccctgttttttttcttgcttcaggtgtttcatgacactcctctgttgaattccagtgttctgtcttagatgctgtattcaaagaatgattatgtacttgctattttagtttttctttgtggaggaggcaattgctgaatgcctctagtcagccatcttggagtcctgttccaatctttattttttaaatctgtttttacagtctttccattaattgtgttttttttaatcccattatctattctccacagttgattcaaacatggaaagtccaagcctaagaaatgtgtaatctaaggccttcaacatgaaaacatgaattaaatttatcttctcgtttgtctcatagtggttctcccactttcaaagaggagttaccccaagacttacctaagtaaatccattaattctagcattcacttaaaaggaaaatgttgagagtattgctgagatgagtgaaaaagaaatccagaaaaaaatgaattaggcctgaggacaattaataagaagtactgaaatgacgtgatatctgttgatctaaaataatccagccaaattttggtgaaatataaaatctggtgctgcacactggtcaatcggtataccatcttgggttagccaacagaatactacagttggaggtggagagcggtggcctgggtccctttacatgatcttacccctcccaccctttgatctgatcttgtttgcccattactaagttatgtcacttaaacatcatgatttaagcatgagagaaagaaagaaattgtcctataggaaaaggatggaaagtctaaactcagagagtaccggaaagtcaatgaggcctataagaacaccattcatgtattcttccttacatggtttatttttgtccctctcagttctccctcaatctgtttacttgctgttaagtaaaagaaaaacgtccgggagcagtggcttctgcctgtaatcccagcactttgggaggccgagatgggtggatcacctgaggtcgggagttcaagactagcctgagcaacatggagaaaccccatctgtactaaaaataccaaattagctgggcatgtggtacatgctggtaatcccagctacctgggaggctgaggcaggagaatcgctcgaactcaggaggcagaggttgcggcgagccaagatcatgccattgcactcctgcctgggcaacaaggtgaaactctgtctcaaaaaaaacaaaaaagaactatatcataatagttgagtataatataaagctggagtcatgttatcttggttcctaatgccacagaataaaagttgcattgatttcaggattctacaaggtaggaaaaaagcaagaagtgtgcttttaatttttggagaagttttccatttgtttccggagtgagtgaccattttgatacaagaacagcatttctgtgagaaaaatgcatactgtttttgacacattactgtgaaagggagccaaacacctatataattggatcctttcaccaagagctcctttctttaaagatgtacaactggactgaaatatgataaggggacatttttctatcttcccttttttgaaaaaaaataaacgaatgattatctgaatgaatgtagctgttccatccatttacaaccacttctgtccatatttcctaactctctactgagtcttaccacactgaatttctcggttttaattattagatttctgttccttgtccctagcagagaatagcgccctgaagaaacagctcactaaagcaattgttttgatgcttcaagggaaagagggatagtgaggaggggaaaaaggaataaactagttagagtgagaaaagaaaaattctgagaggccaaaatacagttgcttaagaaaagacagggagtgaaaacaatcttggtgcatgtcttatttatgccttgaactgaccttgagaatagacaccctaatattaaatccaataagatgtgttattagaagaaagtctttgttcactaagaagaatagcactatgtagtgataaaagacagaggggattcatgcaaagctaaatgatcaaagaactctatacctgaaaacctgaacctaaaatacttgtgccctgtaagccaagaaaggccctttcattgccctttttcccatggtgcttctcaaaatcattattagcaagtttccctgtaaaaatgaaacagcatgtctaacaacaatgaaaacctggtctcatagatggttatcatcacacattttctctgaatctgctgacaaagattgctttgtaataaaaaaatcaacattaatcattataatatttgagttgctcttatcaaatttacacatcaggcaggactagatgttacgtacatggttatgttcaagtaaggcattgcatttcattatttcaatgcatctctagagaaagttcaacttaaataaagctgtctaagctcctgaaaggcaatgcatcaatttttcaagtcttaaacaatggacaaagattgtttctaaggagagcagctaaggctctcatcttttaaatgatagacagtgttatatctaaggagcagctaaagtacccttcccctcaaaatactatgtttcccagtttaaaaaccctgggctgatgaaagggaaattacctctagttttaaatgcataccttgttaggagaccactatcttaagcacatgtagaacctaaaagtaatgataatacactatgccaaaccacaattattctcttcctcatgtttttaattaaatgtattgcctggcaagcttcctactgaatgccaaacaaaatacacattttacaaatgagtctatatcatgccaaacttcaagaggattctacaattactgaaactatgataaatttttaaaattctcagcctgaaatgtactatgtaatgaaggctttttaaattgggaaatatattcaaacgttgtttgctgccttcatttccataatgggttcttgggatctcctgtcagcaaatagcatcttaaattattgcattggatcctacagaaaaagacctagagaagaaagggttagagattgaaaatattttaaagaaaccagaggccagaagtctttaataaacagtggttacaataataatcaaaaaaaaaaaaaagcagatcagactctgaagtagagggcctgccactagctgaggtagtgcataagttaattagccattccatttttatacatacttcaaaacattatctcgtacacaataaatatatacattttgtcaattaaagaaagtaaaatgtaataaagataattttaaaacattatgggttagaaagtataatgaaaaaggctataataacccagtgatggtaataccatggacattttattcagataagtgaaaggaatatctttgaaaatttattggcttggcacaaacctgccagtcatttctgacactgcctcatccttgactctctttcctatccctgacctcatctcatttctggcattcattctccttcctcctttctcttttgattaaaacgagaaagaagaagatggtacaggtgatcagaaacaggtcaattaactagggctatggcttaaaaacaaaaaataccaaatgttttcatagagtcattttgtctttttaaggacagtgaatatctatgaaatgatttggtagtttctgctattgtgtgaaaacaaaacagaaagtttaattatattatttatatttttattccctaaatcgttgaaaacataatagtattaaagatcaaaaacttcctccttaatcctttttttctttgatgtttatatagaataagtcccataacatagcggttgattttatagatgaaaacaataatagcatatattttcttctgtaattaagagttagcacattcagcattttctgtttgccagacactatactatacacacactaattttatcagtataataatcattaagtttatagcactcttgtgcttgttttgcagatgagcaaactgacgaacagacaagttaaacgtagcttgaccaagtttcacaggtagtaaatattggagatgggatttgaactcagggaatgtggctacagagtccacttttaacaactatgctatgttgcctcccataaaacatatcgagttaaaaattaaaatattagaagatcaccttagccattgatgggcattaccatgaatgcaacagattgaagaccagggttaaatataggtgatgggtagttgggaggcccaccaacagtgacttcatcacacatagcagcctcaaggaatacagcctaaatctctgtcccagtaaaataaaaaatatatatatatactacattgcatagatttcgggggtcatgacaagtgattgaaatggccccagtagcctacagtcctggggtttctttcttgagatattattacttctttctgtctcttattcccattacccttcctccctctctccttctccctggcttctgaacgctacactgaaactcagccattccatgtgccatgctacatgggagattgcactttgatgttttcttttttataatatagcaaatggaacttttatctgagagtcttagctttagatataatcattttatttctaacattcaaatttagtgctgtgataaagtagattgaaatgaatacagacttgaaaaataagttttgtctgcatcccaggactgccactgattagccatgtagtcttcactagttgactttgctgatctgagcttattttctcttaattaaaataaaactgtggcatttgtcacatggtaaggaatagaaaatcaaatgttttacacaacatttgacacatagcagatgttcatcaaatgtcattttttctttccttctccttttacaaataattatattttataaaaatctaccttttcattttatttacttattttttactgttcttaaggtgcatcagcaccttttcacttttttaaattccaaaattacaatacttgccagataacatcaactgaatggattatattgagttccttcttacacctgctgacagtagtactttgcaagtcttgtccatatattcttttagtgagaaaaaaggaatataaaatatatacacacataaactctctctgtgtgtagttgttatcgtttaaagttgttatttaactcctaatacagaatttatttactcttagtgacagatatttgtggtagtataacttcctaggattatataaattagctctacaagaatagagctgaattacaagagtaggggaattctactaccagaattcccttacttataattctgtattagataaaaaagaaaaaaagtagttatcatggaagcaaccaaaaatgataagttgaaaagagatatagactcaagcaaggacacactgttcttctactattcaaacatgaaactttaatttggcaaatttctccctctgggtgttactttctcttgtaaagtgtcattccaaagttttgaggaccctataaaagtccttggaaaatcagctaatgaatactcagctagcaatcatcttgagtaattagtatcctgaagaacttttgggattcaagtctgaaaaaggaattgctccatgaaagagggaaaatgtttgtctggcattgtatatattagtctcctttctatttctcttgttccatattattcagagtagcctaactgctattataatatcaaaatgtcttagtagcttaacacaataaatttcattccactctcacatgatagtccaggcgaattgtgggtggtgggctatgtaccacatagttgttcaaggacctaggtaccctcgatctacaagatatcctgtcccctaaggctccagaaccctctgcacaagtcattgcatccagatatccaacaacagaaaggaatgagaatagatctcataggagacttctggggtcaggacagaaattgacacacttcactcccacccatattccagaaatgagatacaaaggctcatgtaactgcaaagaaagctgggaaatgtattctattccgttcgggaaagaaaagaaaacaaggttttgtgaactcacagcattgcctttgcacatgatcccaggggtgctaaaatcctatattttattttattttcatttcagcaacaaaaggctgtgttccttgtgaaaggaaattttgtatgtcatcaagtagatgggaaaaattgagaaagaactgaggcacttcactaatacagctgtaattacatgacatatactctgcctgggcacaagaccaattttatttcctattttgaaattgtcaccatctagaggatctattattaaaaacaaaaattacatgaattctactttgtgcacaataatagtgtttcatattcaatgttgcatttgcttatgaaacaaggatagagtgtattttcaagatattttaggagatcaacctgggagaatactttattactattgccattgctgctggtggcggtggtggtggtggtggtggtgtgtgtgtgtgtgtgtggagagagagagaagaaattcccttcctcaaattcactactacttttctaaagaaatcctaggcacaattttattttctgttcttcggtcctcaaatacctcaatttaccctttacctgttagtgttgtaacaaatcctagacagattatagaattcatagaagaatttcatggagggggaaaaatcccaagaaaaaacacaaaacccataggtgaaatcaaaggtagaattagaatgaagaatttctttggcaaagtttgttttttgttatattgtgggcaaaatagagatcagtaaaccaaataattttgatttttgtctttagtaaaacagactattttctccaggactttataagtctgaagatttaatatttttttgtgtgattttgtactgaaaacataacataataacaaacattattgtgttattatgtgcttacaacgttccaggcactgctgcaattgcttacttttcttactcacttctcatacccagcactgctgcatagaactgcacaccttttgcactacacacatttaagggcagccattcacagcatggacatgcccataattgcgcacatcacatcatatgctgcttcgcatgcccactctgttcctaaaatctattatctttgtcctataaacaagaaaacagaattttagacgctcaacactccttaacttttctccaacatataagaatacaggtcagtttcaaatgaatagcaaggagtttaaatccatgttttcagagctaattaaaaataaatcttgcagtgaaagcatcatcataggttttatgtcagtatgcatcttaaagcactgaaattcgacgggtacctcagaatcagtggaatgttttatatattgcaaagaaatatacagaaacaagatattcccagccgttgttctaagtgggtctgattaaaacattattctctgtctacctgaaccaatcccaaggattataaaataaatagccccttctttggttgaatttctttcatcagaaatctggcatgtatctttttcttttcctttttttcccatctacttgggtctgaaaagagatagatctaagggggggaattactatggttttctcccccagttggacttttggttcatagagacatgtaacctagttgtgggggtccatgatcgaccatccgatgttccctagaaccaacaaaagtagccattaatgttagctgagaaactttaccctagtgaaaattgtggtttctaggtagaagttcttctaaggacttcagcctattttgtgactaagtttgttttctataacatctaaagagcacagctgtctaagaaacactgccactcttctctgctctttcttccaatggcaatgaaattcttgcatcaccctaaggagaaaactagagttggtagttgaatgcattttaattcttacagttccctctgtaactcatgactggcatcactcctgtattacttgttccactaatttttcttcatgcaattcttgcattagtttcttatcgctgctgtaacaaatattaaccaatttgttgacaatacacatttattattttatatttctggaactgggaagtccaaagtaagtttcactaggctaaagggaaggtgtcagcagggctggttccttctggaggctctgagaggagaatccattctctcaccattttcagcttctagaagctgcctgtattccttggcttgtggatttttctttcatctccaaaggatatcactaaaaggtatgcttctgttatcacacttatgtccttctcctttctgttctcctgtgctcttgaaaagactcctataatatcattggaccaacacagatgatttacaataatctctcctcacaggttttgggaatttgaaggtggacatcgtggagagccattatttagcctacacagccctcaggagtcactaccaagtagtcagaatcagctcctatgatgaagctattgattttcctgcatttaaatcaaagcagtcagttgggataaattgacggtgttatggtgattatttctctagattgccagttattttttaacatgacctatattattccaacttccagtgaaagggtcaggttcttggttcttaattatttgctagctgtatgctcctttacttacaattcatatcgaaggtgggtggcctggaaaaatttggagacctgagagaaccagaattacctgggaagacactttatgtgtctggtgctactctccttccccgatacactacatattaagtttaacctgccttttccctctcctggtgttacacattatataaatactccttgaaagcacataaggctctggcgtggggcaaaaggaagaaggaaacctcttctagggtagatgagaacatttttttttcaggtgattattatatatactaatttcctctttgacacccatggaccttgaaaaccctagtacatgttttcataagacattcaaatactatataaatactgcatacttaaaggcatcacttagggatgacattatagttaaaactacttagtaatcccctttattgaaactgtgagatgtggtataaacttctcagtggtgcctttccagactcatatgagtagtaagaatgcacaaggaaagcctttttttttttttttttttccgagagggagtcttgctctgttgcccaggctggagagcagtggcacgatctcggctcagtgcaagctctgcctcctgggttcacaccattctcctgcctcagcctcccaagtagctgggactacaggcacccaccaccgtgcccggctaatttttttgtatttttagtagagacggggcttcacagtgttagccaggatagtctcgatctcctgacctcgtgatccgcccgcctcggcctcccaaagtgctgggattacaggtgtgagccactgcaccatgctgcaaagccatttttatcttcccttgtacatgggaaagttacccctgcaatgtcctcctcaccaacacccccccacacccaacaaaccaaaagactaaaagtcattattcgttgacaccctctctggacacaatgggaaatctgtactcagcaccaacatttgaaaacaggtcttttcttgccttccacacattacttctctgagtgtgcacattaatcaaagccaatgtactgtaaataccatcacactctctgactgtgagagtccctctttttcctgttggcagtggcctcagcattaatcatgcacatgattcttacagagcctgggcattttttccagcttcgctttaaaccaccgtgatatactggctgcccctgctcctttcatatcagaccaacttttataagctcagaaaataatcgcattcaatttaggaaaataatataatttagccattattagttagcatctgaccttcttaaagcctactgactcacttcttattctggtcatggcataatattattctaaggtccagatgaagaaacacacaaaggtgaaagagccactaacttagtcaagaccaatcacagctaatagattcagtacagagttagttcaagggtctgccttgccaccagtctcaggccttgttgttgtttctgagatgacaagacctttggcagctgatctttggcatgccccccgcacccccaccattctagtctagtacagctataggtcattaaattttaggacaccgtaaagcttactattttcaatcagcttattcagactgagtatgacttgagacatactgagttatgcagctagttttcatgttaatgtgtcatttttgctgctctcaattgatttacatgctttattgaattacgatattgtgcagtgacccaaagtcaatttttaaagggtacaatttaaaaatttgaaataatcagccttagttcagacgtatacattatttaaaattttttttctctccatcagattatttgatcacacaggtattaagcctagtacccattagttatttttcctgatcctcttcctcctcccaccatccacccttcatgaggcctaacatcccattatttatctattgcaaaatgatacaacataatgcctcttcaattaacaaatgttaaagcaaaatcaccataatacggtagttattcggcatcatgtgcagctgtgagtgatcctccttctcatgtggatgtgtccttgccttaaaaaaatttgtgcctcaggaaaaaatagactaacaccatacttaaatatttggacctggctttatattaggtagctccatctggagggtctcatattggtgtcattctgaaaggagtataagccaggcttttagatcctccctccctccctccctccctttcttcctccctaccttcctttccccctccctccctccctctcttccttcctttcctcccttcctcccttccttcctccctcgctccctccctttcttccttcctttcctcctccctccctcccttccttcctacttcccctccttccttcctggaaggtgtgcgtgctgtgctgctgccccagcagtgtgccttaagtcacagtgccaggatgtattaggccacagcctttttctacaacagatctatttcatttaaggtctgccagttgtctttctgaaaataggcctcaacgttttccccaaatactcttgaaaaccatctgatgacatttgagcatattgaaccgggctgagaaggctgcctttctctactgcctagaactgctccccaaactctagtgtttcttttttgaagacaatcactgaaacatgagatactgggtctcaattaagtggggttatttaggaagaaaagaatagaaaatgagaaaccaacagccacgtgacagggaggttactctgaatataattcaaatcctttgcagctttcaggaggaaactcatagaatatattttggtggcttacacactggtgctgaataacttctttgccacttaattggaaaaaaatatgacattttcccagaagactgaaatcattaagactgtgcctgttccatgggatcagttccaagaagtctaatatgtttacgccaggagctggcatccgaaaggcgtccctcttcacattgagcttttggtgtcttaaatggcaaaacattgatagcttcagccaaataggttgctttggggcttctattttattctctgtccagaatagagcctttacatgctttatcttcattctctatacgtctatgtttctttatgttatacctgcattatcatgctactaagttatgtataagatgtatacagaaatatacattttaaagagatcaagtaaagataaaagaaactattttaaatatcttgctaatgataatgtcattaaaaacaatctcaagatgcaatattccctcaggagaaatttgtgaatgagtattagaggatgcaaatctgtacttcaggccgggtgcggtggctcacacctgtaatcccagcactttgtcaggctgaggtgggtggatcatgaggtcaggagttcaagaccagcctgaccaacatggtgaaaccccatctccactaaaaatacaaaaattatccgtatgtagtggcacgcacctgtaatcccagctactcaggaggctgaggcaggagaatcacttgaaccctggaggcggaggttgctgtgagccgagatggtgccactgcactccagcctgggtgacagagtgagactcaatctcagaaaaaaaaaaaattctgtacttcacgtagtcttcttgataactaattttactggcctagttcttttcagttttgactggataatcactgattttattttgcaatgttgctgaccatcatctctactaagattaagagaagtgccaattctgacatcttgttctgtttgggcttcccttttaattatccttaatccatagtttattttataaaaaaattaaaacaatgggtcgcacttaaggagggttataaatccaggtatctttgattgtgataatgttgaaagctacagaacaagtgacagcaccacagacaaccctttaataaagctctcttgtctgggatatacactaaaggagagtgtcaatgccaatcatacattaaatcctgggaaggctacaatgtttacgttttagataacaaatttaaagaaactttctaatattttcttttcactctcgaaaagaacatcttatagccattttgaagactaatatttaaagccataactccaatgttattttttccagattatatttcctgttgcccaaagcagggtagaaacctttgatttctctcaacatatctctcatcttacccatacctcttttgagattgtcacccctttctacctcatggttatgtatatagatatcttagttcttgaacaagattgtaagcatgttgaaggcatggtccatggctgactcatgctcggttttcccagagaatctggagacacaacagtagagagactagccatggtcttacatatcacagttcttccaaaaatatacgtgtcgagagatgaattaatcaattcctttatctgagttgcaaataagcttcatggttttgagttttattttgtatgcttggttctattaggtatttccaaacaaaagattatgagaaagcatgtagagaaaagatggaaggaagaaaaaggtattcatttttttgaaggttcaaaataaaggtgacattcataatggataatcatttttgaaaccaaaataggcagtgaatgattatccgaaaacattgttcattctaaaattgttagcatgcatctactttcaacatgttactatcatctacgatgtagcctcctttcccttggctaaatcagttccaaatagaaactgtcaatgaccataaggacatatttttattgctcctcatttcagatgctggatattagagaaggaagtagtatgtaagttaaagaataactaaaaagtagtttattcctgtgagcacagatgctatagtaaagacaaaaagaattatttttaggggctttttagaccaacaaaaaacaaaaggagaaagaggaattcaaattgaaaactggaaaacattgttacaaataatgataataataaaagatctaaagaacaaaagagcagcttattttcaaacatagctattattttagaaacatggaaaataatagctgaagggctgggaattgtaggttctactctgtcttctaagagctgagtttgggcatcttttatagcaaccaattttccatacactcagatggctcccaaggatcactgaattgagatgtatgatttaattttcctttcaaagattatgttcagattattatgccacgcacatgataactaattgtagggaaagtgtgtcaggccaggcttggtgaaaactgcagaggtttcagctgtgacacactgtacaaaatgtaagcattcagtcaagtcatatgcattgcaaggccaccactaccagaaggtggtcttctactagagtttgggtcttgaaaactagaatgcatgtcaaccaactaagaagagattcttagtaggcataagcctatgttcttgctgcggtttctactttagcaatgaataggttaatgtcaccctgtctctggcatttgtagtcacccatttccatgggatgacacctcattctggctaatcttgtgttgatttgaaacacagaatcctacctcatccctcacttgacctagtctattgctttgaaatgaatgaagtcttaatttagagatttcagcctatctgtggtcaccatagatgccactcgcaattcccctccaatgcaattatttctcttttgtgggttctactcccttttctcttcctccctcttggccacattctcctcctgtgacctcatcttgtatattttatcttctctttctctttcttttctcactcttgtttcttttttattctttgtctcttctctttctcttctcccttactcccttctattctcctgctagttaaaaccagagacacttgttactcttacatgtgaattggagaggtttctgctcctgggtttcacagaagttttaatgctacccatactggtaagttttaattgtatggcattttacaacctaaacaaatttcccacatatattgcattttttatatacatagcaagtctggagtataggaatggcagagattattagccccaattacaaaaaaaaattgatgtgcatgcaagattgtgccttgaccaagttcatactgtcagaaatgtgtagagtaggggtcaatcaagcctggcacttctaattcttgtcccatatttatactattccagtttgccagtttcatttattctcttaagggccaaaaatcgacacacagcaactctctttctcttgttttaattgtaaaagagtctagtttaccaagacactttagaaaaagtgatatcacttccatgaagggttttaattcacccatacaattaacagttgttaatttgttatgcgtgtggcactttgctatgctgtatgatggataaaaacaagaataaggctggggccctgctgtctgcaacatagaatgactggatgaaaatgacaccccagtggaaagaccattttgggaacagactcttttccctattagatcttaagcttcatggatgcaaaataaaatgtggcttattcacccacgtatttgtttattaatttattcattaaatttatttatagtgcacttttaccatagaccaggagttttcctaggcatttgtatccataaggcttgaaatcaaatagggaaaagagtaaagttaaaaaaacaaatgaacatgtaaacaaataaatagtaataaggtagtttcagatgctaatagatgtaaggtgaaaataaaactgggtcatatgataaaatacttgttggtgtggggagaatattagttgaaggaaagaataatgtctgaatcaagcttggaattgaaagaagaagttatgtactaacagtaagtgaacatgaatgacaaaaaagacaactgttacatttaaagtccagttggggttttaaaaatctgacccacagagatttcccaaaggagctaatttctctcttcaataagtaccataaaccatacataattatattaaaagataaaactaagtaaaatgagacaactgcataaaaaatacataatcatagataatcagagtgggcatgaatcatgatatttcacaatcacaaatgcctttgacctataccattatagaaactaatagttgaatggaaacttgatggtcaattagtctggggtctctcaactgtggaaataatttctacaaactccatgactaatagctgtctaatttcgcactgcatatttccacattaggggcccataactccatgggatagttttctttttgctagattgacagctttaactatcagctatttctttaaattcaacaaaaatctgctgaattcctcaaattggtcctagatctattctctggaacaacacagaatccactggctacagtgcatcatatatcagctcttgtcacccaggctggagtgcaatgggaccatcttggctcactgcaacctgtgcctccctggttcaagcgattctccttcctcagcctccctagtagctgggattacaggcatgtgccatgacacctggctaatttttgtatttttagtggagacagtgttttgccatgttggccaggctggtcttgaactcctgaccttgggtgatccacctgccttgggttcccaaagtgctaggattataggtgtgagccaccgtgcctggcctcaatgtttctttttatatactgtgcatgtatattattttcatgaaatacaatcctaaaggaaagagagtatattaatttaaatagtttagcatattatatcaaccattgtattgagtggaccagaactgaaaatatgccttttgtcaaaaactataagtctatataagttacatatgagtatcaaataaaattatatgtatggacctgaactatggcaaatttttaaatagtggatcttagagcatgtgcatgatctagacctgcactgttccacgcaggagcccctagtaataacatgtgtatattttgtacacacatacacacatcacacactagtattttgctaacgcgcttttaactgataatttcaaatgtttctgcaagaggctttgatgtcaatgaaaaccttttagtcatttgaagtaaaaatatttttctattgatataaattatttcagcattgaattttattaaaacaagtatgataaaggttgtaaagtttaatttaggcaccacattgtcaaaaaatacgaccaagttttttagattttgtgttagctgtgttcctagaacatctgttatgctattatgacaggtgtttattaatatggatgtctaatcaaatctcttggttgctaatagcttggcaattcaacatctaaatattgtcaaaatccttgattatatgttgaaaactgtggataattgattcaaagctgtttgccttgactagattaaaaaattaaaacctgtcaagtgtattaatactttcctttaaaacctcaacattctcctgaaatttctaaaatgtttcagtaataacaacttgtgaaggaataaaagtcttctacaggccaacatctgtcctgatccaagtttccttagacctttcattatacgcataattttttttttttatttttatcatgggctaggaatgaatgcacagaaggggagtaacaaaatgaaagtcctacgctacatacaaagaatgccctacagaaacgtgttttgggtgcatttaagctcagatttttaaaattaaacttttttgaaagtatttaataatttctgaatagtagaagcctgcaagaagcaatttggtggccttcagcaatgtggttgagtagcttcaatgggtgccatttgcagctcagttactgagctggaatttccttttgaatgtacaaaggcattacataaatctctaggaaggttctgtggtaatagcattcaatggaaatctttaaaattcttaaataacgattatagatttgaaaagttcccaatttatttccctctgacagagtagttctctcacttctatgagatagtctgccttttagtaaatgctttaatgactataaatgtgtttttggtctagtataagtactgtccaataacacttttgacaataatggacatgttttccatgtttccactgtgataaccgctaggccaatgtagctactgagtacttgaaatactttttacaactaagaaaaaaaagtttacattgtatttaactttaattaatttgtacttaaaaagccacatttggctaggggctactgcatggaacaatgcagttctagatcacgctatataactttttgatttgccaggtgcggtggctcaatgcctgtaatcccagcactgtgggaggctgaggcgggtggatcacgaggtcaagagagcgagaccatcctggccaacatggtgaaaccccgtctctactaaaaatacaaaaattagctgggcatggtggcgcacgcctgtagtcccagctactcaggaggctgaagcaggagaattgcttgaacctgggaggcagaggttgcagtgagccgagatcacaccactgcacttcagcatggtgacagagcgagactctgtctcaaaaaataataataataataataaaataaaataaaataaactttttgatttaataaaatttactttattggagttcaaaatgatgctaaatgatttttaaaaatacatacttgagctagaattccttgattctatcaggagaatattaaccatatcaacacctaatagactagtctttctaggcattgtttgctgtggtagaaatgaaaccactatagcaacagatagttcattaaaatagggatatattcagaatattgtccacatgacctaggagtgacaaactgtaacttccaagctaagttaggacaccacttgcttttgtgaataaaactttattggaacacagccacattccccacactccttcatttatgtattgtcaataagtgcttctgtgttacaatagcagaattaagtaactgtgactgagattgctgggttgcaaagcctaaattatatactggtctttccatagaaaaagtttgccaactttttcgttacctacataaatagcagaattaagtaactgtgactgagattgctgggttgcaaagcctaaattatacactggcctttccatagaaaaagtttgccaactttttcattacctacataaatgcttatgtgtaaatattaggataaagtcccttttatggagaagcacattcttctcagttcattcaccatacttaacacatataacacacattgctaattcctgtatcttttcatatatatgtaccatataacatgtaatatgttagatatgaaattatatgtacatatatatgaaaatatgcagcaatttagcaagtatgatactaaatatatatgttaaatatttagcaaataaacctctatgtgctttcactcagatcacgggaatttaatgcacaaacaatgatttatagcatctgttttctaatttaagttaaaggtgtgagctaacatgtctctccctagatcttgataatcagatagtatcagagctagagtggaacatgaaagtgcattccaaactcattttagagacaatagttgggagatgcctaaggacacaaagagataataaccagttaatcaactatttaatagctcatttattgagacacacctatttatgtaaccagccagaaggcctagtagttgttttgtaccattcagaaagacagtgccttaagagcccaggctgcagactgggagcaaaaccctttgtgttgtcacagtggctgtgctatgaatgacatatgcccttacttcaatccaacagggaagaaagacgattcttccctggaacacttatggtctatcatttagtgaaagaagcagttggcaaaactcaccaataatctatctatcccagagaagagtctctatctgctccattaagcacctgtattttaggctttattatttatttttacagtaattttgaattgttttgaagactgtctccaaaatagaaataaccccacttggattactgtctaaagagtgagtctaattccattgggattctttttaaaaattctattcattgataggaaaaaaaatctttaacttaaaagctactttctgacctcagtagaactagtccctatttttccttctttatacaggcaacatatcataaaagagatgtgcttctattctcatctaaaatattaagttttaaggtaaaatatgacagtattattttcataagatattttcattaaaatcatcatagatttctgggtgtcaaaaatagaaattacaattgaaattaaagtataatgacagaaatgtaaatttcaaattctgcattagtataacctctaacctttaccagaataatctcacttatcagatacttaaataaaaactaatatctcaacttagtatatttttctctcccttttttcaatctaacaatatggaacttgagtttataatacaataaagttcaccatataatctgaactacataaatgcctggactatattgccttttcttcagcaacatgtgtcgatttagacctttgattggattgtggaatgcagtaacagaacaaactaatcattacaattacattatatcatacaaccaagaataatttataatatgcttcttgtactttttggaatcattgttctcataccagtgtggtgccttattaatcctatgaagtcagtcatatggtgataaaacagatacaaaagacttgccttaatatgttattattattgacttagctctgaccacaccacctgatggacaggttccaagtaaagacctagatagtcaaagtgagtactattagtagacttgaaacatttaatttctgttggaagagatgactaaagctctccatgaattctttatttatatcacaatctgaaatattattaatattattgaatgaattttatttgaactggaagaaaaaggtaaaaataaagtcactatagtgctatagctgtgaaaatttggctgacttacaaaatggcagtgagttggtgaattaggacaagtggcttccagagactaaagaacctctaaacttttatcatcaacaggcacatttaggatggatcatcctaaatatcacttaatcatgtggccaaacagaactattgttaaccgacaaaatgctatgcattgaatttctggtttaacaaatgagaaaatgggttttgtttacagtggcagttcagaattacatacttataaatattgaggttagggtctattaatgggctgtttggttctaatcatctgaagaataattcattttctcacagagatacacatgatttgctttcatatcctatacggcctcctttatgtttattcaattttgttatcatagtgaggtatatgaaagcccatgagctcggaaggtactatctttgcatcatcttaatcctttggccataaaagaaaatgattggtcctatagaggtctcctcaacttcgtccagaaacaagtgtgacatgatcgaatctctgtcatattatatacaacttacaaaagatatacatacccatagccatgaggcgcaagtgcatatctagttctatatgaggatacagctcaaatacacacacacacacacacacacacacacacactattttattggctgacaaagaataagtgcagaagtatcgagtatataaaatcactaattatgaatcaggagaactgtttgtattcactgctttttagtttagttttattcagtaaagcattgtactacttaacttgtttttgaagtttgcatacaaacttcgtgacatacaaacaatgtgaaagcattgtaaattttttcttaatatacatgcagtattattttgagaaaaataatgtcaccctcagataaacatccagatggttttacaagcacaattatgacatctattttaccagtcattctttataagcactcacaattcaggtagagcaattatattgcaatattacttacttattacataatcaacacttctgtttgtatgaaatgtcacattacatctaaagccctgaaatgcaatgacctacagagaataatcaattgtttctcaaaccgttcactctataaaatatattaaattttgaaaagaggaattatcttttctatctgtaaaatgagagggtggagcaagaaaaacttgcaagactttttagttgttagatatcataatttgaagcctttttctttttcaataaatgattcctcagaattacatagactacatctttgaaggaaaaaaaataggaagtgatagatgatcaatcacattcacgtttatggtgggatatatttattttctattttagttataaagaaaacttgtttccattttcagctatctgaaaccagttagagagacagttacacagatgatcaaccatatggcattaataaatgtataaccaagacagatatgaagcattttatattttaaccaaatggctaaactaactcatgaaaatgtcatatgttatctatttagctgagagctttattgcagagaaattgtgtcataattaacaattaccacaggaccagccatttcattttataattacttctcaaacaaattaaggaagatgaggttttacccacattcagttacagctacattcaatttcataggtaggaatatgtaaatgtctatgttttataaaaacaactcagccagctctatcagtagtatttacatagaagattcaatgggaaataaaatcactgtaattaagtatacataatttttaaatagatcagtgttgtcaacctatctttcgcttgccttcatgttgaaggatatagaatagaaatgggaatcagatcccccccaaaagtgggggatcccacttctcctactgtagcattcccaagttcgtcttcttttgcctatatttgtataatggggttatgcctaaagttttgatttttaaaatgattccaatgcttctgacataaaaaaatctgttgctgaaatacttgaatactataatatattaaatgatctaagtaaacataggactacagaaaaaagaatatgagaaaaggatcaaaaggaagtaactgataaaagtcaaggagaaatcaaaatttaaataaaagaaatgggcaaaaaaaatagttaaaaaattgcttagtgtagtttgatgttcctgcagcttcaaagtctataaaatgaattacagtgaagtaggaatgttaactttttttgttttctgtctacttagaaatggaaatatttagcataattagtccattagtgtttcctctattttatcgctgcagtattataattaacacaatattacattcagtatagatatgagaccaacttatttacctcagaggaattacaatggaaatagattgagttctccaatgctacctgatttttaagcatttaaaacttaataaaatacatgtatttcaaaacttattctttccttcatcacaaaatactcatcatcaaaaaccatagttgaatgtaattttctgtatttcaattgtgtcaataaaaatggcaaataacagcaaaacaaattccattatcattttaaagcttataagatcaattttaatttgggataaaggcatcccttgcatgcatctatcccaggaagctaagtgcaaaagtgcaggagggtagacttgagctgaagaaagtggaaggtttggccaaatagacaggagggagtggctggcacatatgagttcctgggaagagactgcttttgcactctgggaaaagactgctgattttatcagaacagagaccagaggggtgatggacaaaaagttggagagtagagacctggaaagcctgcaaggctgacatgtttagggcacctgtattctcaacactcttcaaccaacactgaacattcctgcagaggaaggcaactggaaaatatttaagcaggattaatttatcttacattctggctggtaaactttctgatgctcagggagccctagttagcctcagagataatttgccaattgattggaatatttcacatgcttgaagcctaaacacttgctgatgatctgaatttttttttttttttttgagatggagtctcactctgtcgtccaggctggagtgcaatggcacgatctctgctcactcactgcaagctctgcctcccaggttcacgccattctcccacctcagcctcccgagtagctgggactacaggcacctgccaccatacccagctaattttttttgtatttttagtagagatggggtttcaccgtgttagccaggatggtctcgatctcctgacctcatgatccgccctccttggcctcccaaattgctgggattacacacgtgagccactgcatccggccgatgatctgaattttattcatggttgatcactgactctttcttgatcactgactctttcttgatcttttgcttaaccacccacagctcataagtatctctgttctctgcccacttagagtaatcgtcacttttgtaaacgtctgtgatctctatttgtcacggacatgacttaaagacagaacgtctggtctacatattgtttgcacaccccgaaacatcgaatataagaattgtaggtgctaaaatgctgttaatacttagactgactatatcaaacctactaaattaggaacttaagaggctgaatttatccaatctttttttaaatggcagaagaatcagtgatactgaagagcaatccacatcctcatgtcttataggaggattgccaaactggaggaaattgtaactactatcaggggatttgtgtttgtcgttattctttgttatttaaaatgtgaattattgctgtcggtacttataataatactttgcaaagaatttacattaaaaataacgaggtatttgtaaatagcaatatgttgaaaacaagcagtgaactttggcagcattcttactgcttcattcatatttgcattatttataagatgctaattgggctctactctaaaggagaactctaaatatggtactccacaagagttctaatttagttaagcccaaacaacaaatattcatagagctctcagattctgaatattccatgttgggcaaaccacagtattagtgtccaaactgagacagaaaaacaaaacaatactaaacttagaatatttttagcttgattgaatgaatacttcaagtaacatatcttttttccccagaataatctggaaattccatatacaggatcttggcttttttttttttttttagatagatagggtctcgccctgtcacccaggctggagtacaattgtacgaccgcagctcattgtagccttgacttcccaggctcaagagatgctctgccctcagatcccaaggagctgggactacaggtatgtgccaccacccctggcctattattttatttttatttgtgtagaggtggggtcttgctatgctgccaaggctgttctcaaacttttgggctcaaacaatcttcctgtctcagcctccaaaagtgctgagattacaggcttgagccaccatgcccagcctcgaagatgtctttcataaacgtaaggatttgatttttgactttgaatttccttggactagttgatgacatgttcaaccttcatatgctgagttctcctcactttcaaattacttctcaaataaatagcaaaatctccagtagctttaaacaaaagttatatttcaaaaatgaatgatgtatagttatcttcaacctatgcgcaaagtacaaggttgagaaggacttcatttttgctttgatgaaaggcaattccattcatgattctctttaaattcttcagtattaacatctaccaagaaaagaattcactgttccatgacctgagatgcattaaaaattacatgtcaaatctactttacaggcaaaggggaaagaggaactgcatgtgtcctatatacacttgctttaccagtagcatgacacccaggatatgcacatgacacacacacacacacacacacacacacacacacatacacacacacaccaaaagcaaccaagcttccttagcaagagatacacaattgcttaccatctgggttccagatatctaagcatatcctcccatactaaacacttcttaccacacaaacctttgatgctactatttggacaactttactcctatatccccttgtggtctcatctttattatttagctgtttccatttccttagcctataatcgttatccttgcttctccacctagttaattccaatttatcctatgccattcattgtttaatttccacctcttctctaaaaaatgtgaggacttccctaaaataatcagttgctccctcattgttttcccatatcacttggagtagaacactgatatcaacccatatccagttattttattgttgttttaaatagtgtgtttgcttccttgctagaattcgaacacctcacggaccaagtcaaagtttttaaaccaaccatctctagtacttagaacaaaacatatcatgaactttgtacataataaatgtttttagaaagcctttcactacctattttccatgtttgcttaaaatactaacccagtcaaagaattataaaataaatattaaaaatggttttaagtagttcgtggaattgcaatgtttacttatgttgcaacagaggaatcagtcacaactttgcatttagtaaacatttttggaaaatgtagaaagttttgaacttgttacttatctgttaacatacatacctcatgagttttaagtggcaaacagagagagggagagagagagacagagagatacagtattgaagcagaatgttgactcatatttacatcagcaaattttaacttagcacctggtctctctatttccagtaatgaaaaatatggaggtgaaatacattgctctcttactaaagaaatatagatattagataaattaaagtatgcctatgaatgttacaacaaattatactttaaaagtaccagcacaaatgtgttcagtgatgaaatgttgcttgaataaagggatttgagttctccctagacgtattgtgaaattgcttcttgaagtcttgctgagtctcacttcctcacccataaaatgagaagatggtctacagaaacttttaggccttttaaatatttgaaacataactcttgataaataaagtaatttacacaaaagctgaattgctagtgcactgtcgcagttccccaagtctccttttagaaaaaaaattacaagcttttatataacggagaaaaatttctacacccatatgaaactcgttctacgatattttaaccaatacaaagtttatggtgactattcagaaacatttcttctcacaaataaactagagtcagatagcttcttgttagaacaatttggtttagtgtgagtcaaaagtatgtagctcctctagttatcacagaaacttataccatacacattttttttttttttttttttttgagacggagtctcgctctgtcgcccaggctggagtgcagcggcacaatctgggctcaccgcaagctccgcctcccgggttcatgccattctcctacgccagcctctcaagtagctgggactacaggcgaccgccaccacgcccagctaactttttgtatttttagtagagacggggtttcaccgtgttagtcaggatggtctcgatctcctgacctcgtgatccgcccacctcggcttcccaaagtgctgggattacaggcgtgagccaccacgcccgaccccatgcaaaacttttaaaaaatcaaaatttacccaaagtcgttgatacagtttcatagattgataatggtttgaaaatgtccatactttgttgtatgaccgtttaacaaaatgtaaccattctctgtaaagatgtgtactgatctttacacatacagttcagaaaaatcaacatattgacatacactttcatgaccagtcaaattaagaaacaatcactgaactctttttcctaggtaacatatgaggtcaagactaaactgtttgataatgtaaacaatggctggattaagaaatggaacataggctttcagagatgagtggcagacctggggaactaattaaacagagtcaaatgatgaaactaatctatgacaagcctgaaataggctaaaacaagttgcacgagtaaataaaagtattgcaagtcaagagacttaagaatcagtgatacagagagcagaaagctagatcctctgcagtcagcacccagcttgataatgcatcacagctggaagaaaggggctgctgattatttacagatcatgatttctaagccatagtacatgaaaacattcccaacatgaatagcaatatcttttatgtttttaaatactaaatctagcagtgacagctttgcatctatttgaatgctttggttaacagtaattagttaagaggcaatattggcttctgcaagaatgcttattttaaaataaaaattctgccaatggccattatgttacatactctatttgcatttgtccaccattgcagacatctcacatactccagagtgaactggagaagctctctcagttggttagagcattgggttaatgaggacaaggtcacagatttaatcccatacagcccagttaacttggcagagaaaaactttgctgcacaagctctagctgctatttcagcaaaacccaattgtaaattcatattgtggatcacaggggaagcttgggaaacagtggaggtgatgaaaacaacccacccatcctgtttcctggaaaacaatgtcaaacacccatgggtcaagtcagcaattgctcattttatttaaataataccacttttttcctgaatattgcctagccctgaatactgttggaagatataaattcagataaatgtgttttacatcattgaatgtgtttttgctcatcatctactatcttcctcacatctatgctttgttcacctgtatcaaaggagtaattcatacaccctaagcagcaagttcaacttgcatcaggcagaaatggtgatttccaagggtataattatgtaaaatggagtacattttctgagcctcagatttagaggaaatttttcagcaatgagatatatcaagccctactaaaaacagacattttgctccctaagcattacaaataagagacatcctatttcataaaagactcataatttaaaaatgtgtctatgtgatagattagtgaattagctgcaacaaaatatcctacatgaccaggccaaatattagaagcagcacatatgctgtacagtatgaacatacacacacactcacatgtgcacacacgcacactcaagctaaaaatcaaaatgtgagtgccattgtctaatattagtttgttttacatctcccccttcagtcacctgttttgaatttttgagagcgtatcattaaagatcctaaagaaccagaggaacaaaataaagttgctttaatgaagttagatgaactagctccttctgatttctagctctgtcactgaatgtctgtgtcatcctgctttatatgtgctttagatgaaagactgtggcatctgcttcgtataggagaaaatagagttaaagggttggctcaagatgccagtcattataataattcccatatttaatcctctatgttcctaaaaggctttttatattaatgtttactttgattaaggtatttaatcaatgttttcattgaactgagttccatcactcctaaagtttttatccctttcttccggtttagtctcgattgttctctaaagcacagaaaagggaagatatatttaaaacttctatcaaaacaaagtgaaagagtagaatcattagattttttcaggaacatctgcagaacaacaagggccaaaaatgacttcaaatgacacataaaaatgtctcagtctaaaatattggcattctgctaggccctatttgactgataagtattatgcattttcctctgtctctttcacctacaaggctgagcaacaaactgtgtctagagtttcttcattttaatattcttgttgttccatctgggtcatttattaacaaatcccacaaaagtgtatttgagtcatcttattggtcatcttattggtgttattgacacaagattttgaagtcgcacaataaatgagaagataaatcagtttaaaaaatcacccatggttgagctctaatataatcagatttaaatactactgtatgaaaatggtgcttctaagtaatattgtaaagtttaaacaacagtagtaaataaatattagcatttctaggggttattttttctcttaagttcagatttgttttttattataaacactgaaataagtcaaataagttaaatagataaaataaaacaaatggatataaagtctagggatttaaaaaatcatcttattaattttttagctgtggttttatttcataaggtattataaagaaaataattgcaatgtgaaaaatcagttctgagtttgctatggctctagtttttgtggttgtgtgacattaggcaaattacttatgttcttgcagtttcaatttccaaacttgcaaattggaagataaaaattatactaaatattataattaacacataagatagtcacacatactaggggctcaaaagtttagtgatcattttattaaggtgaatatattaataattgtgttttatgcatatttaacaattagtcttattgttgttagtaacactaggtccaaaatgaagtaatcatcatcaacaacaactaaaagcttaaatgtctgtctctccctgtgctcaccctatgtgctcccatgaaataaggtcattgaataggctatgccagaaatgtgctctctactggtaatttttcatcttgtgaatgcttccttattaattagatctcctcataattgtccctttcttagggaaatattcttgacctccctaagtcatcttgttttatttttaaaacaaaaataagagcacttaccactttgtaatcttgtatttacttatggttcacagtaaaggaagactcaatttaggattacagacacaggctccagactcagcaacactagtcatagcaaaaatgaggctaatatttggtttataaatagtcaacgccaccccactccaatttccctcctttatcttggctcaaaaaatactgacagccaaaatttatctctcaagccaaaaggcagaaatttcttctttgaagaaatatggaaagcatattctaagaattctctaactgcttacacaaatgttgacaatgacagattaaagcatttagagtcctccagtttaaaggacagattcatcctactcattctttgtcaagtgagacagacaaaacctgcataagtatataggcccccaagtctgcctttcttttacttatacttaaatatgaacagcgatccaagcattaccatacatttgaagacagccttcaacatggaaaaatcagttttttaaaaaagggaaaatggactgtaaactagtgcaaccatcgtggaagtcagtgtgggaattcctcagggatctagaactagaaataccatttgacccagccatccccattactgggtatatacccaaaggattataaatcatgctgctataaagacacatgcacacatatgtttattgtagcactattcacaatagcagacttggaaccaacccaaatgtccaacaatgatagactggattaagaaaatgtggcacatatgcaccatggaatactatgcagccataaaaaatgatgagttcatgtcctttgtaaggacatagatgaagctggaaaccatcattctcagcaaactatcgcaaggacaaaaaaccaaacaccgcatgttctcactcataggtgggaattgaacaatgaggacacatggacacaggaaggggaacatcacacaccagggcctgttgtggggtgggggaaggggggagggatagcattaggagatatacctaatgtaaatgatgagttgatgggtgcagcaaaccaacatggcacatgtatacatatgtaactaacctgcacattgtgcatgtgtactctaaaacttaaagtataatttaaaaaaaagggaaaatgactattggggaagcagagattactcaaagaaaaggaatagaagttaaactaaacccaaataaaattctccataccaatattgctaagatgatttatttatgaagacagtgtatccataatacaggtatagggtgcagtggggaaaaaaacaaacagtgaaagaacaacaaaaaatgaaactaaaaggtactttcagtggaagaattggaagataaaatgaagaataggaggtgaaacttttgagaaaaaaagctaagagacatatagaatcaatacaaaagatccaacatataactcaagaaagatagaacatttaaaaagagatagaaatttcaaggaaataaaagacatggaattcccagtgttgaaggacacatcacaattttcctgcattcttacatagcttctaattggcctttttacttggatatttgcttcttacatttatttatcaatataggagtaaccctttaaaaaatgtaatacagagcagtaaacatctttgctcaacccccgaaatgctcccctgaaatagaggaaaagtgagagtcctcactggatctgtccccaccccaatccccagccccaatcacatctctgacctcatcttttaacactttcacctttgcttactccagtctcaaagatcaggtacacttcccaggtaggatttcctcctctaattctgccttctgcttcaaactctatttctctagatatctgtgtactgaacttccttatgtacctcaaatattgtttaaatgaagtctaactgatcacactacttaaaattataacctacaaccagcaagaatggtcttcctcaccctgctttatgttttcatttccccatagctttcttaaatgtgatgtaatttatttacttactgtgcccaatccttattatttgtctctgttcaatgggatataagcttcaggaggtcaggaacatttgtagttttcactcattattttattccatgagcttggaacagtgcctgatacatagaaggtgccctgtaactatttattgaatgagtagataaacatacaaataaatgaagaagttcttcatgagtggcacacaactttgaagtactggaattataaaaaagaaaatgtaatctttgcacaccactcattgtaatgagcaatgttcatagtccaaataataattatggtattacagacttttcaaattatagaatcaggcaattgaacaaagcatgaatgacataattacagctatacaaggaggtgaaagatctctacaagaactataaaatactgttgaaagaaaccacagatgacacaaacaaatggaaaaacattccatgctcatgggtagggagaatcaatatcataaaatggccatactgcccaaagcaatctacagattcaacattattcctattgaaccactaatgtcatttttcacagaattacaaaaaaactgttctaaaatttgtatggaatcaaaagagagcctgaatagccaaagcaatcctaagcaaaaagaacaaagcagaaaacatcacattactaaactttatactacaaggctacagtaaccaaagcagcatgctactggtacaaaaacagacacaattgaaacaatagagaagccagaaataaaggtgagcatctacaaccatttgaacatcaaaaaaattgacaaaaataagcaatggggaaaggattccctattcaataaatggtgctgggataactgtctatccgtatacagaagaatgaaactggattcctagccatcaccatatacaaaaattaactcaagatggattaacaacttaaatgtaagacctaaacctatgaaaatcctagaagaaacctaggaaatacctttctgaatgttagccttggcaaataatttatgactaagtcctcaaaagcacttgcaacaaaaataaaaatggtcaagtggaatctaattaaatgaaagaggttctgcacagcaaaataaattaccaacagataacctacagaatggagtaaaatattcaaaaattatgcatccaacaaaggtctaatatctagaatttctaaggaacttgaacaattgaacaagtggagaacaaccccattaaaatgcgggcaaaggacatgaagagaaacttctcaaaagaagatagtcaagcaaaaacatacatatgaaaaaaatgctcaacatcactaatcgtcagagaaatgcaaattaaaaccacaataaaataccatctcacataactttattatgtgtctcacatgactttattaaaaagtcgaaaactgatagatggtggtgaggatgtagagaaaagggaacacttgaatactgttgaagaggatgtaaattagtacagccaatatggaaactcgattggagattcctcagagaactaaaaatagaactataatttgacccagcaatcctattattgggtacatgcccaaaggaaaataaatcctaccaaaaagacatgtgcactcatatgttcatcgcagcactattcacaatagcaaagacattgaattaacctaaatgccaataaacaatggattggatgaagaacatatggttcatatatacatcatggaatattatgtagccataaaaaagaatgaaatcatatcttttgcagcaacgtagatgcagctggaggctattatcctaagctaattaacacagtaacagaaaaccaataccacatgctttcacttataagtgggagccaggcacactggggacacatggacataaagatggggaaaatagacactggagcctccaaagttggggagggagggagagagggagtaaagggttgaaaaactatctactgggtaccatactaactacctgggtgatgggatcagtcatactctgaacttcagcatcacctagtatatgcatgtaacatatctgcacatgtcctgaacctaaaagttgaaattttaaaacatgtataattatgattataaaataaccttgcagagtaaaaatcaaggtacacttgtaagatttggaaggtagaaagtggtcagaaaaggattaaaaatggcaagacagctaccaggtcctaccacacaaattaggagtccagatgaatcctgttctcatagaaagctgatggttaacaaaatggttactaaagtattatttttaaagttatagaagtagctggtaaaggaactgaaaaacattggtataaatttatggggagtcaaaaggcaatgactgcagatgaaaaattatgaaatagaaagatatttagttaaatctaggtaactaagagaacagctaaacataaaagtagctaaagtagtcatatcttggaatttagacagggacagggaaggtgtgagtgggagaggacatttttaaaaaatatatccttacatattattagatttttctttagtgcacaatatttctttgatttttttaaaaaaattatttgaaaagtaaatggcttagagaatgcttaataattactaacctaactaacaaacattgtttttcttttgcatgtgaaaaaaccctttgattaaattattttatgaattatgtagaggtatttttaggtgaattataataaattataactatgaaattaaaacacaaaaataatgttaaatttagaatgcttgctactagtcatttatcctgagatgaaagcaagcatgacagatttaaataatactgcagatttttttttccacagtccagtggttgaagctacggtctccttaaggcagggcaatgacagacatggaaaaactgtagcttgacatttattcatttttataattcatttattaatttattcaccaaatgtatgttgtatgccagatattttccaggcactgtgcaacattttatgagagaactcacacaaccatgttctcatttctaagtaatttatcacatctaaagccataggtcaggaatttaaaaagaaatagctactgcatataatcatttgtttcatgaaatataaacatgaagatactattaataatacattaatttatataccgttttatagttgataaggcatattcatgtatattatttttcttcacaatggcctggtgtagttggtggtattcaatttctaatttacaggagaggaaatggactcagagaagtcaagggacttgcccaaggtcaccatgtttggtagaagcaaaacaaatagccacattcattgtactttccacaacacttcagctacttttgtttcattctgatgcttgggctcgacatgttcatctcatcctggttattctgtaggcctagttcaagtgctcctccctggaagttacactgattcagctcaggctgtaataatttttttttctttttttcttttttttttttttgagacgagtctcgctctgtcacccaggctggagtgcagtggcgctatctcggctcactgcaacctccacatgctgggttcacgccattctcctgcctcagcctcccaagtagctgggactacaggcgcccaccaccacgcccggctaattttgttttttgtatttttagtagagacagggtttcaccatgttagccgggatgatctcgatctcctgacctcgtggtctgcccgcctcagcctcccgaagtgctgggattacaggcgtgagccactgtgcccggcataattgtttgtttaatctggattctaaaccttttttttaaaatgcatataagtcttctaaatcttgtgtgcatgtatgcatacatgtatgcacatgtgctcatgtgtatgtgtgtgtgtgtatacaatagcactcattcagtttcagtgtgcttatgcactttcctggactgaaagccccccgagatcagggactggaaagactcaatcagtgatgctctttagcttgtatgttcccttatgaagctatgtttattatataggcttggaatggaagaactctggcttctaattctgactgattgaaaccttaaggctggattttctataacttcagacccaaccagatgacatttttttctatacctctacacgtcatagagagatatgtattaggaatcacagacttatataatgtcttcgctcctacttccttccctgcaatatgttggcaaagcctaggggcagttctggagcccggctgctcgcattcaaattccatctctggcatttaccacttgtgaggccttcagttatgaagatattttctccatgcctcaatgcctgcatctgtaaaatattaacagtatatacctcataggatttacttaaatgagttaagaaaagaatttagaacaggctttgaaatgatatgacaataaataaattataactatttttatcttcctcacaggtgatctagatatttgaattagatagtgtgagtgaacgtgaattgaaagtactcatactatttatattaattatattatattatattatataacaacaattgaaatttaaagttagaaagtgctaaatgacttcatgggaagcattacctgaaaatatttaaatgttatgcagtagagactgactgatactgtgaagttctcggcatacttctctattcaattttcatccatatctgattcattctactagagaattctgagaatgaaaacaaggaaaaatttgctgttgaatttctggagcttctgaacatttctcattatacagtctccagttcaattcttcaccattttcacctaacttcaacagcagcagcagcagcagccctgtgctcagtgacaggaaaatagcatgtttatttagatgattcaaaagctagcttctattccttacctttatttgtataatttctaacttcacactattttgaccattaactagttttagatcatttataaaactctaatttatgcactgtgagtattccagagaactcctttaatagccacttacattcaatttcctgtggcctagacattagctacctgaatgagaagggatcagttttagccaattaaagctcatgaagggaaaacagacaccacccgtaagcaaaacaagaactgtggattaaaaatagaaaatgaatggtgtacctgcaaatcagtaagtgttgtgctttccataaacatttaattatatgtttaaaaagtacattttactaaataagttactaattttaaattttaaaatagttaataactgtaactattttatatcactctcttttgttaaacagcttagagttaaatttatactccacatttgaccagcgtgcagtgtttggggcattcatttttatgtttgaatctcagtgctatttaataaccaaatatttttccttcctttgcctggcagtcctcacctatttcaaatttaaagaaaatctgtttaccagcatatctttgtagtccaaattatatatttcaaaataagcagggagggtaattagatggataaatagaaggtgagtgcatttctgaggagtttgtgaagccgaaaagggtacaggtagggaatgaaatgagcattccagggaatagtagtatacagacatggggggtctaagaaagcacttttcctctcacctccatcctcctttgggtggtattttggcagcctaagaatttagaataaccaaataactaaacaaaagttaacagtattatggtagaagcaaataatttaaataaacaaatacatatatacctacataaaagattgggaagaaataggtcaatattccacaaaagaggaagagggaatagtaggaatagagggaatgagggtattttttttttttgccgctggctttataataaatgtattatattctcagtagatactttgatacttaaatctttttaggtgaagtatttggggatgagtttaccttacacaaatttctttatctgtttatagataaaggattttcttttactttgggggggtttcttggcaacatttgagggtagtgaccatgtgtcacttatattcccatagcctagcataaggcctggcttatagtgagaagtctagaaagaattttgtgtaaaaggctaaagatggagtagaaatgaaagatgggcttattgtgaatgttaatttttaaggattacttaaaaactatcaacagaagttttctaaggagaaatataaatttatgaggtatcaaaaagaatacaacagatcctatacttttctttatcttttactttatatatacccatttactcttatcccacatacccactcaccccacaccatatttgtaacttagaagctcagtgaaaactaacttcaaatggtagaaggaatacatttagagtcaaaaataaatatctctttcacctctgcctgacccccagttctctagagaaaaacacctaaagatgttttatacatctaccagcatatggatttgtaacattactatcttctccagttaatagtgaataatattaatcatgcagtttaacctagtattttctcaaacagctcacggcagaatcaactggaaggcataaaatattctcaaatgctatactttgacattcaacctcagtaagtctctagacggcgaaaaccatgcatgtttaaaaggaccaccaggttttttttgtttttgtttttgttttctttttgagatggagtttcactcttgttgcccaggctggagtctcatggtgcaatctcggctcactgcagcctctgtctcctgggttcaagtgattcttgttgcttcagcttcccgagtagctgggattacaggcatgtaccaccacgccctgctaattttttgtatttttagtagagatggggttttgccgtattggccaggctggactcaaactcctggcctcaggtgatccacccacctcagcctcccaatgtgttaggattacaggggtgagccaccacgtccagcttgccaggcattcctgattacagtttgagaacaaccgtttttactaactccttggtttacttttattaaaactatccacatatacaaagttgaatttacttagcagttgttaaaagagaattatttggcctggactatattacagagacttatcatagaaatgcataaaatttatatagtagttccaattttttttttttttttttttttttttttgagactgagtctcgccctgtcgcccaggctggagtgcagtggcgcgatctcagctcactgcaagctccgcttcgtgggttcacgccattctcctgcctcagcctcccgagtagctgggactacaggcacccgccaccatgcccggctaattttttgtgtatttagtagagatggggtttcaccatgttagccaggatggtcttgatctcctgacctcgtgatccgcccatctcggcctcccaaagtgctgggattacaggcatgagccaccgtgcctggccagtagttccaaatttaaaatgacacagatatgaatgatataagaaaaattctagatttttatagaaaattactgctttagagcattttgcccttcagggtcagaatagttcaggactaaatttggttaaaagaataaacactagttaatataagcaacattcagattaattctgatctcttacattgaatccaagattttaagctgccaaatataatttgacaagtctctttaattagtttatgaagttaagctgttgccaagcttctcataggaatcataattcagcccattctctctcatttttctactgaaaaaataaataagcaattcatggaattaagcctcaccttaaccataaaatttaaatctaaacacagctttcataataatgaggatgaatgagaattaaacttatttaaagactttgccagtgcactacctggaaatacagagtaaaccatgatatgatacattctcatagcaaagtggattccagtacggtcaagaaaagttaatccatggtgaagtatcctgccttgcccttgtgttcatccctcatttgaaatgaaaataaatgccgttcaggaaaggcccttgttatcatcaacctctcccgtgttgttactgctgctagaaaagctatttctctagttttcagctggactaggaaaacatagagtttttttttcttttataccaaccatttgtaattgctatttttattgtgtatcaatttattagaaatgacacaacacaggaacagcccaaatggaaaggatgcataaagcgaaggggagggacagaccacaaagctcccatgcagctctacgtgttcaccagcccagaagctctacgcattgctttaaaaataacatcattgtctgtaatacaactccacaggaatacaagacaaatgtgcaacaaatataaagagatcaatagactgattctagaagtcactagtacagtttcatgtctatatgtaacccatgtataaaacatggtatggaaaacattatatgtatatgaaatatttgcttattaaggtgaattctgagcccatggatatctttcttacttgaagtgtgttccttctgatggtgatggcaactttctctgtaggagtaactgaacaacatgcattccagtggcaaggagtctcaggcagaggatgctttctatgaggatcagcctctctaacctcttttatgtttggaagacagtagcttcgtggctgcattgctgatacctacagtagaccccagcagactgactgccagaccaggagcctatgctgtctcattgtgaaaaaaaaatttgagcatttaaataacctatggtcagtaggatatacatttgagcaatggctttttcagtactgttacttgaaaattatggaaaataggacctgctgagtcaatttcagaggattttcataagaattaaattaagtaatgaatgtgtgagagctttcaaaattatagcacactttaaaaaaatgcaaattatcattattgttggaagaccacttgatggaggcatgaaaggatgagaagtttccctggatacctcaaaataataagagccatcatggcaaacccacagccaacatcataatgaatggacaaaagctagaagcattcccccttgaaaactagcacaagaaaagaatgttctctgtcatcactcctattcaacatagaattgaaaatcttagtcagagctatcaggcaagagaaagaaataaagggcatccgaatagaaagagaggaagtcaaactatccctgtttgcagaccacatgattctatatctagaaaatcccatagtctcaaccccaaagctcattaagctgataaacaactttgggaaagtttcagcatataaaatcaatgtacaaaaatcactagcattcttacacaccaacaacatccaagctgagagccaaatcaggaatgcaatctcattcacaattgccacagaatgaataaaagacctaggaatacaggcagccagggaggtgaaagatatctacaaggagaactacgaaatgctgctcaaagaaatcacagatgacacaaacaaatagaaaaacattcctactaggaagaatcaatattgttaaagtagccatactggccgaagcaatttatagattcaatgctattcctatcaaactaccaaggatattcttcacagatgagaaaaaactattttgaaattcatatgaaaccaaagaatagcccaggaaatcctaagcaaaaagagcaaagctggaggcatagactacccaacttcaaactatactatggggctacagaaaccaaaacagcatggtaatggtacaaaacagatatttagaccaacttaatagaatagagagtccagaaataagactgcccacacacctacaaccatctgatcttggacaaagctgacaaaaacaggcagtgcagaaaggactccttattcaaaaaatggtgctgggataactggctagccatgtgcagaagattgaaactggacaccttccttacaccatacacaaaaattaactcaagatggatcaaagacttaaagaaaaaaccccagactataaaaaccctggaagaaaacctaggcaataccattttggacatatgaacgggcaaagatttcatgataaagacatcaaaagcaattgcgacaaaagcaaatgggatctaactaaactaaacagcatctgcatagcaaaacaaactaagaacagaataaacagataacctacagaaggggagaaaatttttccaaactctgcatctgactaagctctaatatccaccatctacaaggaacttaagcaaatctacaagaaaaaataaaacaaacaaccccatataaaaataggcaaaggacatgaacagacacttttccaaacaagacatacatgtagccaacacacttatttaaaaaagcttaacatcactgattattagagaaatgaaaatcaaaaccccaacgagatactgtcttgcaccagtcagaatagctattattaaaaactcaaaaaataacaggtgctgctgaggttgaggagaaaaagaaatgcttatacactattgggtgggagtgtaaattagtgcaagtattatggaaagcagtgtgacaattcctcaaagaagtaagaggagaactgtcattcaactcagcaattccattactgggtaaatactcaaaggaatataaattgttctattgtaaagatagatgcacgtgtatgttcattgcaacactattcacaatagcaaagacatggaatcaacctaaatgcccatcaatggtatactagataaagtaactatggtacatatacaccatggaatactatgcagccataaaaagaatgagataatttcctttgcaagaacatggatggggctagaggccattatccttagcaaactcattcagaaacagaaagccaaatccagcatgttctcacttacaagtggaagttaaatgaggagaacacatggacttatagaggggcacaacagacactggcgcctactggagggtggaggttgggaggagggtgaggaccaggaaaaatagttaatgggtactaggcttagtacctgggtgacaaggaatctgtacaacaaatctccatgacacaagtttatctataataacaaatctgtacatgtatccctgaacttaaaagtttaaaaaaatctaccaatggatgtccaaattagtatgcgaaagtttgaggagaaacaaaataatttcatagtctcaaaatatctccttcaagatatttactaattataaaaggaaaaagtgtaactttacaggggagaaagccagcagacaccaccttaaccaaatgatcaaggttaattatcaccagtaataagacatactgacatgatgtactccctgatatataggctgagaaggttatatcactgtagcatgcctgccaaaaatgcataacttcaatccaataatgagaaaacatcaatccaaccccaactggcagttattctgcaatataactgactagtattctttaaaagtggcaaggtcatgaaagacaagaaaagactgagggaatgtcatagattggaggagccaaaggagatatggcagctaaatataaggtgagatccaattagtaaaagaactggtgaagttccaattaggcctgtttaatagtaattaatagcagtaataataacattaatagcacaaatgttaatttcatggttttgatcactgtactatggttatgtaagatgttaccttaacattcagggaagccaagcaatgtgtagatgagtgctctctgcatgttttttctaactcttctgtaagtcaaaatttgtatcaaaataaaaagtcaaaaactaacaaaacaaacaaataaaatgaaggatgagcaggttctttgctgtgttctctctcttcgatgttgacaataccttgcatctcatcactaaatatagattcctggaatcagcctctctctcactccccacatcaactagcatttgcatttgttcctttttttttctaaataattcttgaatctgtactttctggtctttctctattgtcatcctgatccagattctcataaaatagcttacaactgggatacctaactccattcttatatccctgaaatctgtcctgtctaaatagctgaaagaatatataataaaaatgaataattgtggccatttccttcttcaatgcatttcagtttcctgctcatgtcacgcttctcagcataacaaataacatcctctacagtgtgacccttccctgttctcaagctcctttgtcacattctctgtcttccacttatgctctggcaatacctaactacttcttcatctctaccatgacatgctattttgtatctctgagtctttttgtcacgctgtctcactgacctagagagcactttccatcacctcctccgtcaattcttagaggtagtaaacatcatccaggtagtttttcttgatgacatccgctctcaacccatttcacattctccagggcttctataaaactgcaggtttatttatattcatgaactttctatatttttaaaaatttattaatttatgtgtctatctcttctagatggggaagttcttgaaagcaaggtctatgtcatagtatgttcctatatgccagacacatagaaaaactcaataaatacttataaagcatgagaaagaaagtggtgggaaaagggatatgataaaccttatataaatgtaaagaaaaagaaatgactgagagatggaagaagcaagtaatttgtaaaatgaggttaaaatgaagggaaaggataattgatgagatttagataaagagggtcatatctaaaagataaatgttgaatggagaaatagaagtagtattaaaaaaaaatgagaatacagccaggcgcagcagctcatgcctctaatcccagcactttgggaggccgaggcgggtggatcacttgacgtcaggagttcgagaccagcctgcccaatatggtgaaatcttgtctctagtagaaataaaaaaattagccaggtgtggtggtgcatgcctgtaatcacagttacatggcaggctgaggcaagagaattgcttgaacccaggaggcggaggttgcagtgagccgagatcgctctattgtactccagcctgggtgactgagcgagactctgtctcaaaaaaaaaaaaaaaaaaaaaaaaaaaaaagaaaataaaaataatgagaataagtggattggagaacaggactattagagaataagataagaggagtagactatggaaataaaaggatgaaattgaccatctaattacattgaggccagagaagtagaagaaaataaaacagaaggtgtgttgacaagtaatctccatggaaagcagtaaacataaggtagctatccgggtaatgaaaaaaaaaaaaaaaaaaaagagagagagagaagagaaatctcagagtagttacaaaaagataaatgatttaatggcaatgctaagaaaaggacatgtgggggaaaaacacgaaaaagaaagtacaaaaatgtgacttggaagtatattggaagattgtcttaaatattgaacgctttgaaataatggatgcacattgaaccccaaattagcaattccactggcaatgtagtcattaagagagcactgtggagttactcatgtctttttttaggttaattttattatactttgtagctatattaaatgagttttgcccttatccagagcaattgcaattcagtatctgtcttttgctataacaaatgagccagatttgaaatatatactgtccttttctgtcaatgcactttaaaagactaccagtccccactgacctcttacagtgtatgattatacgaagagaaaaaatggaagaaaagcaccatgggcaaatgtcctgaatgctgtcagagcaggtgacacttatgtgatatgactcaacttgacatctctcagtattccattacaaatctgagagattatgttttcacctgtggaccgcagttgcctcaggtgcccagatactatccctgttcttcagcagaggtcagccaatactcactgttaaacaccagtcaaacacatggcagccagctggcaaactgacgctcctgaaatcttgaatctgccttttctaatattattttgtaggaggcatacctcaagggacatcaagatgttagttaattagggtgtgcctaaaaatgtaataggactatgctgtgtgtgtgtgtgtgtgtgtgtgtgtgtgtgtgtgtgtttgtgtgtgtctgtgtttgagatggagtctcactatgtcacccaagctagagtgcagtggtgcgatattggctcactgcaacctcccctcccaggttcaagcgattctactgactcagcctcccaagtagttgggactataggtgcatgccaccatgcccggctaattgcatctttagtacagacggagtttcgccatgtttgccaggctggcctcaaacttgtgaccttaggtgatctaccgccttggcctcccaaggtgctgggattacaggcatgagccactgtgcccggccttccattttttatccagaaaaatcaaaagcaaaccaaacaaatgtttatatttatccagaaaaatcaaaagcaaatcaaacaaatgcttatatttatttaaaacaacaccctttaatgtttgtttatcttgatttttttttttttagaaatttcttctcatttctggcaatgcagaatataatctcctcctctccgtacatgacccacatcactgaaactgcactttgccttttggctctcttctaatattatcccgccatgaattagctatctatgatgactattctatgctgtttttttggccaaaatgtttttatcctttttctgtcatcagctgttgactataaactttttcatcgtccagctatggcattatgtgggtttgccccatattctaagttttgtgggattctgtaaagaattttaaattccacaccagctctgcgctatggtttttctcctgtctgtttacattctgttttagagaatttgaagtaatttgaaaataacaatcaccatttattgtgtcgtcactctgtaccatacattttatatgcattattatataatcatcacagcaaacctatcatggatcttctttcctcattttaataatgacaaaattggaattgagaaagagtaattgatttgtccataccacagttagcctctaatgacaatctcaggattcaatagtggtgtgtgttggattccaaagccaacactcaatgagaaacactagaaaaacaaacagtagcactctggcattttccactatgcatggtacttttatatatgccagggaagattcaatgacagagataatctgatgggaggagaaacaacaacaactacaaatattacacacttagagttgctggggacattgttcatcacaattagagcagattttagagagcatcctatttactctgaacctaaagaaacaactcaaaaaccaaactactctatactgggaggaaatgacatttgcttccaatagacactcctgccacagtgctaggttttatctacctaaaccttaaaatattgtgtctcttttgctttctgttcaaataacataccctgaaaacttattgtgagactacatcctctgccccttaattgtccttaaaatgtagaacataggtgaaaacagactaaacaaaaatgttactgattgttataacattaaaatattctatgtagaaatatatttatttactttgattttggtatctctagtggcatcctaatggaaacttctttttaataatagaaggtgctctaactcctgcttaaaagtggaataaaaaaagaaagtgttcattgctttaaccctgttgctactatgtatttccaccctagagcagataagaatattgtggtagaaattcaaagctaaatttcctttttggttatattgaagaactactgaaaatatgagtattcctttttttcttctaggctactaagctctaatctggaaacaaaaccaaccaaccaaacaaataaaactgaggaaactacagctgtattcttcatagataagggatttcatggaacacctatacaatattctcattgccaggcctataatgatgatgttttatcttttattaagtttatctaagaggtatgtgtaatgtacaagaaagttttaaagagggagtggccaagatggccgactagatgcagctggtgtgcatggctgtcagggagaagaatgaaaggggtgagtaatacaatgccctcaactgaaacatccagttactcactggatgattacaactaatcaaggaaacaacttgacccacagagaacaaagaagggcaagacaggacaactgcccacctgggaacaacacagagcaaggagaacctcccccacccagagaagtggtgagtgaatgagctgccccaggaaaccatgcttctgcacagatctttgtaaccttcaggtcaggagatctccttgtgaacccattgtaccagggccttcagtctgacagacagagacacttggagtcttggaagagcagctgctcagccatatgtggagaccctggagccttagatacttgggctttccagcaaaagtagctgcaggtccagcaaagtgggaggttagacccccatacatacaatataccagaatctctgagacacagctaaggaagtgttaagagggaaattcatagcactaaatggccacatcaaaatttagaaaaatcttaaattaacaacctaatctcacaactgaaaaaattagagaagcaaaaacagataaaccccaaagctagcagaagataagaaataactaatatcagaagttaaatgaaggaaatcaagacacgcaaaaaattcaaaagatcaatgaatacaggaattggttttttgaaaaaaataataagatagataggctattatacctagacaaataaggaagaaaagagagaatatccaaataaacacaactataagtgataaggtaatgttattattggccccacagaaataaaaagaaccaaaaagaaccatcagaaactactacaaacatctctaggcacacaaactagaaaatctagaagagatgggtaaattcttggacacatacaccctcccaagactgacccagaaagaaattgattacctgaacaggtcaacaaggagctacaaaattaactcggtaataaatagcctaccaaccaaaaaaagcccaggacctgatggaaacacagccgaattctactagatgtacaaagaagagctggtaccattcctactgaaactattctataaaatggaggaggagggactcttccctaactccttctataaggccagcatcatcttgacaccaaatcctggcagagacccacacacaaaagaaaacttcaggccaatgtccttgatgaacattgatgaaaaaatcctcaacaaaatacttgcaaactcagttcagcagcatgtcgaaagactaatccactatgattaagtaggcttcatccctgggatgcaaggttggttcaacacacacaaatcaataaatgtgattcatcacataaacggaactaaaaacaaaaaccacatgaatatctcaatagatgaagaaaaggcttttgataaaattcaacaccctttcatgttaaaaactctccataaaccagatattgaaggaacctacctcaaaataataagagccatctatgacaaatccatagccaacattttactaaatgggcaaaagctggaagcattccccttgaaaaccagcacaagacaaatatgccctctctcatctcttctattcaaaatagtattgaaagtcatacccagagctatctggcaagagagacaaataaagggcacccaaataggaagagaggaagtcaaactatttctatttgtagactacatgattctatatctagaaaaccccaaagtgtcagcccaaaatctcctccagctgataccttcggcaaagttgcagtatataaaatcaatgtacaaaaatcgctagcattcctatacacccacaatagccaaaccgagacccaaatcagcaaggcaatctcattcacaattgccacaaaaagaataaaatacctaggaatacagctaaccagggaggtgaaagatctctacaaggagaattacaaaagctgcttaaagaaatcagagaagacacaacaaatggaaaaacatcccatgcttgtggacagaaagaatcaacattattaaaatggttataccatccaaggcaatttacagattcaatgctgttcctattaaactaccaagcacattcttcacagaactagaaaaaaaactattttaaaatttatatggaaccaaaaagagtctgaatagccaaggcaatcctaagcaaaaagagcaaagctggaggcatgatgttacctgacttcaaactatactacaaggctacattaatcaaaaatgcatggtactggtacagaaaccgacaaatagaccaatggaccagaatagagagcccagaaataaagctgcacatctacaaccatctgatctttgacaaagctgacaaaaataagcaatgggggaatgactccctattcaatgaatggtgctgtgataacaggctagccaggttcagaagattgaagccggacctcttccttataccacatacaaaaatcaactcaaggctcagcgcggtggctcacgcctataatcccagcactttgggaggctgagacgggcggatcacgaggtcaggagatcaagaccatcctggctaacacggcgaaaccccatctctactaaaaatacaaaaaaattagccaggcgtgctggtgggtgcctgtagtcccagctactcgggaggctgaagcaggagaatggcatgaacctgggaggcagagcttgcagtgagccaagatcgtgccactgcactccagtctgggcggcagagcgagactccatctcaaaaaaaacagaaaacaaaaatcaactcaagatggattaaagacttaaatgtaaaacccaaaaattataaaaaccctggaagaaaacctaggcaataccattctggacatacaaacaggcaaagatttcatgatgaagacaccaaaagcaattgcaacaaaagcaaaaattgacaagtgggaactaattaaaattaagatattctacacagcaaaaaaaaactcttaacagggtaaacaaacaacctaaagaatggcagaaaacttttgcaaactatacatctgacaaaggtccaatatccagcatctataaggaacttaaacaaatttacaagagaaaaacaacctcattaaaaagtgggcaaaagatatgaacagacacttctcaaaagaagacacatatctggccaataagcatatgaaaacaagtacaacatcactgatcattagagaaatgcaaattgaaaccacaatgagatacaatctcataccagttagaatagctattattaaaaagtcaaaaaataacagatgcttgcaaggttgcagaaaaaagggaacacttatacacagttagtgggagtgtaaattagttcaaccattgtggaaagcagtatggcaattcctccaagagctaaaagcaaaactaccattcggctcagcaatcctattactgggtaaatacccagaggaatagaaatcattctatcataaagacacatgcacacaaatgttcattgcagcactatttacagtcgcaaagacatggcatggaatcaacctaaatgcccatcagtgacagactggatagagaaaatgtggtacatacataatacgtcatactatgaagcaataaaaaagaatgagagcatgtcttttatgggaacatggatggagctggaggttattatccttagcaaactgatgcagaaacagaaaaccaaataccacatgttcttacttataagtgggagttaaatggtaagaacttttgagcacaaagaagaaaacaaaatacattagcatctacttgagggggaagggtgggaggaggagaggagcagaaaagataactattgggtactgggcttaatacctgggtgatgaaataatacgtacaacaaacccgtgtaaatgtatttgcctatgtaacaaaccttcacttttacacccaaacttaaaataaaagatttttaaggccaaaaaagtgtataggaaccacacacacaaaaaagagagaaatgtttaacaatttatgaatggccaaattagtatttggtattacaatatattatatttcaaaataaagactaatatctaacctgtagattcattttcttctcttttcacatagcctaccctgagaagctctttggctctcaaagctttaataattatgcctctgagaataattcccaaatttggatgtataatgaatattctcctgaaccctagctgctcttttcaacaggaagtcagatattttcacatgctcatttttttctgaaatccaaaatatctgattttgaactctctatcatcctcagaattatctttttcctttaattcacatttcagtaaaaaaaaaaatagcaccaatatttttctcgattatccatgcacaacacattagagtcattttaaaatacttgacatcctcatgcattttttttttttcctttagcaagagagggagtcttgctctgctgcccaggctggagtgcagtggtagatcatagcttactttagcctcaagctcctgggcttgatcaagtgatcatcctgcctcagcctcttcactagctgggacgacaggctagggccactatgtccggctccttagatttttataatattaagttttgattccaatcctttcatgatgtgttcccaattcacaccatgttatctcctgcttcttttcttctaactgtgccctacattccatattccttctctggggaatgctgcttccactttcccacctaggaagctactcatcctatcagattgagctcaaatagttcttcctttatgaattcttcattaatccacaggacataggctgctcacttcttttctgggttcccatttcttactttttttttttaagagatggggtcttgttctttcgcccagatgggagtacagtggtggaattagagctcactgcagcctggaacttctgggctcaagtgatcctctcgcctaagcctcctgagtagctaggactacaggtgtgggctaccatgcccagctaatatttcctttttatttttgtggtgggagggaaaagtgagggtgtggggtctctctttgttgcccagactggtcttgagcccttggcctcaagcatcctcccatcttagcctcccaaagtgctgagaatagaggcctgagccactgcacccaacctggattcttatttattacatttattattcctctaatttctgtaagtcctcaaggacagaaattgagtccaaattcagattttgttttttacgtgaagaccataatcctgtgtataatacatgatcatgaaatattttttaaatgcatgcatgaatgaatgagcacatgaatgaacaaataagtgaatgaatctttgacttctttattcagtttcctggacttcgttccactgccttttgtttttccttcaacctacttacttgcaaaataattccccaggtaattttagtatctgcttaaactgaaaagccaaggctttcatgaaatatcttgtatgaaataattcagcttatttttctagttcacaatatgttggcaaacttcaaaaacatttagtgatttccaaacagttacattaagctatctgaagatagttttgaatgaattctctacaagtgaggataaattgtaataaacaaaaatacttttaatgttcaaaggacaaaatattatatttagtgttctcattcctacaaatcacttgtttccacttttattcctatttttcttgcagactatcaattctatcagttcagaaacatgatagaaccctttcctaacatcttaggtctcccttgtgggatataagaaatattctcctgcagataataattagattgataggtttcagggtgttttcctaagggaaactcagaagttatttcttctaaaacatttaacagcccaaaatatctaattcaaaattcttaatgttttggccccacaataatgaaattgtgagtctttctttttttgttattatagatagaaaaaaatttgaagccagtaaaaattccataaattggcacatgatatgaatgctatattgatgggaaagtctagataagtaaatataatgatttgaaagcacagagtaagctcccatggagaaagtatactaaagggccattttgccattatatgaacaaacagaaggcattcttacattttaagtgccatgataattacaatgagaatgataactaatatttgtatagttgcacccaattgaccagtgaaatcatgcagaaaggacctggctaatgagcctgtaacagccaaggtataggcactgagataaattcttatccataattaggaaatgtggtcacaaaatacaaatatcaaagattgcctttgaggtgagtacttacttgaaatgaaggatggggaaggcagaggaaaatatctgtactcaaggtaaagcattcgaggtcaaagacttagagaaagtaaaagaaatgtttactagagagggtcaagttctctctcagtgtgtgcatgttgtacgttgtttaaattaaaagtgtcttaagcaattacatttcagagtagcaaaaatttactgtctctgtttctctgaggatccctccctctataacatttcctagtacaaatacctgagcactagcgaaaaatgggtgagttccacaatctgaagaccaaacaaaggacaaaaaaagtctgtggtaggattgaggcagggttgagattttgtgtcatatggacatgagagacggagagatcaaaattttcatgagagagtagttaaaatatgggcaaagcattctttctgaataagaaaataaataaagaattaagtatctaaataagtttggagagaatgacaaaatctaaaatgagacatgacgaggttgaggataaggtattacaattttttttggagagagacagaagttgaaatttaaaatttcatttctgaaaaaaattctatgcatagaatatattcattaaagtactgtagaagaccaaataaatccaaactactctaactaagagttcttgaaacagacagcgagaataaggctgacaaaaatagttatattcacaaaggtgcatccattgaactatcttactgtgtttttttaaaccaggtacttttaaactcattggactattggtttagaatacacattatcagagatcacctttttctataaaaataactattttatttttgtttttaaatatcagattaattcaatattgtttttataactacctaccaatcaccatctcaaagaaatgatattcagttaaatttcttttcttaggatgtttttcacacatttttacatttttaattttattttttaaactttgttttgtttatttttaaattttgtgggtacatagtagatgtgtatatttatggcatacatgacatattttcatatgggcatgcgatgtgaaataaacgcatcatggagcatggggtatccatcctttgagttacaaacaatccaattatactcttcattttaaaatgtacaattaagttattattgactatagtcaccctattgtgctatcaaatagtaggtcttattcattctttctatttttgtacccattaaccatctccaactcccttaatttttaattattatgaatacataatagttgtacacattatgaggtacatgtgatattttgatacaagcatataacatataatgattaaataagggtggctgtggtatctaatatttatcttttttgtgttaggaatattttaattctactcctttagttattttgaaatgtacaataaattattgtttactatagtttccctattgtgctaccaaatgccagatcttattccttttacccaactatatgtttgtacccattaaccacatctcatttttctcttaactttcatggtttattattattattgttatcgttgttgccacctattaatgagaacatgtgatatttgtctttctgtgcctggcttatttcacttaacgtaatatcttacatttctatccatgttgttgcaaatgacaggatttcattctttttattgttgaataatattccattgtgtatatgtaccacaatttctttatccatttatcctttgatggatacataattttattccatttcttggctattgtgaataatgctgcaataaaagtgggagtgcaaatatctccttgatatgctgatttccttccctttggatgtatatccagcagtgggattgatggatcacatggaagttctaattttagattttgagtaacctctatactgttctccacagtggctgcactaatttgtattcacgccaatagtgtacaagagtttccctttttccacattctcatcagcatttgttactgcttgtcttttggataaaagccattttaactggggtgaggtgacctcaaggtagttttaatttgcatttctctgataattagtgatatggagcatcttttcatataccagtttgccatttgtatgtatccttttgagaaatgtctatgcagatcttttgtacatttttgattggattgttcttttcctattgagttgttcaagctgcttataaattctggctattaatctcttgtcagatgggtcattggcaaatatttttttccatcccgtgggttggcttttcactttgttgatgatttcctttgctgtgcagaagaagctttttactttgatgtgatcccatttgtccatttattttctttggttgcctgtgcttttgaggtcttactcaagaaatctttactcagaccaatgtcctgaagtttttccccaatgttttcttctagtagtttcacagtttgcagtcttagctttaagtctttaattcatttaggtttttgtatatagtgagagatagaggtctagtttcattcttctgcaaatggatatccagctttcccagcaccatttattgaagatactctccttttcccaatgtattttcttggcatttttatccaaaatgagttgactataaatgagtgggtttatttctgggttctctattcttttccattggtctgtgtgtctgtttttatgccagtatcatgctgtttggggtactatagctttgtagtataaatttaagtcaggtaatgtgacgtctccagcttcagtctttttctcaggattgctttggctattatgggtcttttgtggttccatatacattttaggattactttttctgtttctgtgaagaatgtcattggtattttgacacagattgcatggaatttgtagactgctttgggtagtatgaacattttaacaatattgattcttctcatccatgaacatgaaatatatggccatttttgtgtccccttcaatttctttcatcaatgttttacagttttattgtacagatatttcacttctttggttaattcctgggtattttattttatttgtggctattgtaatgggattactttcttggtttctttttttcagactgcttgctgttgttatatagaaatgctactggtttttatacattaattttgtagcctgaaactttactgaatttatcagatccagtaacttttgggatagtctttagtttttttaagataaaaaatcggccgggcgtgatggcttacgcctgtaataccagcacttcgggaggccgaggcaggcagatcatgaggtcaggagtttgagaccagcctgactaacatggtgaaaccccatctctactaaaaatacagaaattagctgggtatggtggtatgcacctgtaatcccagttactcaggaggctgaagcaggagaatcgcttgaacctgggagacagaggttgtagtgagccaaggtcacaccactgcactccagcctgggcgacagagcgagactccatctcaaaaaaaaaaaaaaaaaaaaaagatataaaatcatatcatctgcaagcaaggataatttgactcatttcttttcaatttgaatgacttttatttctttctcttgtctaattgctctggctaggacttctagtattatgttcaataaaagtggtgaaagtgggaatccttgtcttatttcagctgttaaaggagaggctttcaggttttccccattcagtgtgatgctagctgtgggtttgttatatatagcgtttatcttattgagatatttttcattttgaggacaaatacatacttgttgagggtttttaccatgaagggatgttgaatgttatcagattttttttaagaatcttttgaaataattgtatggtttgcatccttcattctgttggtatgatgtatcacacttattgatttgcatatgttgaaccactgttgcatttctggaatgaatccctctcaatgatgatgaatgtactttttaatgtgttgtgaattctgtttgctagtattttgttgagtattttttttatcatgttcatcagaggtattggcctgtcattttcctcttctgctgtcttttcatctggttttggtattaggataatactagcctcatagaatgagttaggaagtactccctcctcctcacattttagaaataatttcagtaggattgacattatttatttttaaattgtttggtagaacccaacagtgaagccatcagcttttagccatttcttttatgggagacttctgttaatatctcaatacttgttatttgtctattcaggttttggatttcttcagcattcaatcttggtacttgcatatggttaggaactcctccatttcttctaggttttccactttgttggcagagagattaaatgtataaatgaacaatggccagaatttatatgacagtagagctttgaccataacctctgcagcaaccagtcctggaaattaaaccacagcttatgtagcaatagacccagaatggacatgatttggtcaatgacagccaacttacctatatttgccaaagctttcaattcagtaagaatcagagaaagccaaatatacccctcaaacccatctcataaaatgtcctgctcctatttagtctacctgaaacttctctacctcaacagtatcccatcagaaaatactagaaatctcctttttaaagctttccttttccctgcctgtttttgagactctgcccaaagcaagtgatggtagctgattcctctgtaaggtctgaatagtaaagtctggatgagcagtccctgtatgttctcattctgtttattcccacatttttgtattaatataatttaactataacacctaaaatctctgaagattcacacgatacagaaccggtctgccacttaggaactaaaatagccatttcactaaattttctgacaaatttactacagagtttagaaattgaaattgagatttcaggtaaaagcatttatgccttcccagttaattttaataaacaattactaagatcttatttaagctgaatgtttgctcattacttatcatgattagcaatcatcctgtacatttttatcatgtaaaagtaactgacagataaaatcagtctcctttatattaaagcatttctcatcagcattactaaatagtttctagtgattcaagactacataaagtaaaataaatggattatttacagggagaatatttatgggaaaggcaatgattattgcttataattactctaacacactatccaataggaaaaaaagtaagccatcattctggagcacagcaaaaaataatttttccttccagatataattatttcaaacatataatgaatgttttcttaaaagtataagctgaaaagccaggcatgtttttcaaaattgtaaataatcctcttatcccatattttatatttcaattatttgttagatatttgtgtatatttaccacacatatgagaaagagaattcagtagtcttatcaagtaatgtaaaaaatggacttctctgcctttacagtttaaatcataagacatagactgtttctaaatggggaaaacataaaacttaccaatatttctaattccctttgctgtgtgtgctacaatatttaaattgctattgtcattaacacattatattagaatataaatgtttcacctcagaaagcaaaacgagtcatgtgcaaagagatttcttatttaatgaacaaaaagatatgagccatagaacatacagatttcacatactccaactatgctttcagaaagatttaattctgaaaccctagcagaagtgaggccaggtgagtttcctccctccctcgcttcattttctattccatctctcagggttgtatcttagaaaagacagcgggggcagaaatgctttgtaaatgcaagcttgtttccagtgggaagtatgcacagggtacaaaataagttcaaccccacctcccaacctagttcttcatccaccatccctctgaagctgtgcatcccaaggattctttttgatgatgaatgcaacattatttctacatggctatttttgagtgttgctttggtttcccttctgtttgacagattttaaaacatctcccccattgtccagtcagatcttaggctctcctggacatgaggaaagctgagagctcagtgcttccaaacaaaccctatttgatccacatattcctccatgtttttggttaattcttgagtgcaacaggccatgcttaaaatggacagagtaagaaaacacctggctcacttgcagacaagttggcttagttagctggctcatcaaaattctgagaccatgtttagggatattatagaaacataataccagaaggattactggctgtgatattaagtaacaggatgaggtcaggccagcctttttagaaaatgcagcatacatgctttctcttgggtaactaatcaaaactttttagaaagttgtcttcttcccatgtttattatacatatggttagacttgtgttataattgacctttcaagttgtgatgtttcaggggcacctgaataaccttgtgattgaccacatttgtccccagaaggttggcccattaccagacaaatgatgtctattaacaaagaggttttcagctgtataaattatcataccataatttattttttcttactggtaaatattgatcttcatattttcagaggggggagtatcaggaaggaattagccccattttggtaaggaaaattggcatctcatttggctgacaaataacccgttttctgtagctatttctgtccaaagttctcttcagaacatcattctcataaatacagaattgtgtcattgaataaaattaaaatgaagacagctggataatgaaggtcctttccgttcttttattgtctgttcaacaaactaatagacttcattcaacacctgccagagtctcagatgcctgagtataagtagactcaggtataaaaaccttgaaaatctttactttccctatttatatctcagctcctagcaacattctgcattcctttcagagatgaatttctgcaccagctcgtctgctcctaactgttatctttcctttatatctttttctttccctgtctgctttgctgcccatctccttgttctcctcaattcttcttccatgctatcttatgttgctctggctctaaattctccactgtgttcactgtatgtccttaataccaaggacaaggacagtacctaatattcagcagattctcagtgaatgagccaatggaaattctagaaaaatctgtataaatttagtaaaattagtacatatttttcaagtaaaaacacatcacattgtatcttgaaatatacaatttcatgaggatagggatgtcactttggcatatctttgaataaatagttttaagcatgttggtgcttagagcagctttactttcttttaggtattttcaattttattactttaataatattcacactaaaggtggtacactcttaacagtcattatttttgcaaagataatatactggtttgtattatttattcaaggaagagttatgttttgccttttaccccataatttttctgcaacttttaaggaaatgcatcctaggtgatcatagaagatataattaaatatctggaagttatacctagagcctgtcttctgctcacatcagggaaggaatgaaatgggtctcaagtgttatgaaagtcacaaaatgtgggaactgtttaagttcacagtcaagattccgcgtggacagaatttacctaagagggagagcaaaaaacggggccataatttatgaaaaaaataatatctaatctaatatctaactctcataaagagaaaactttcacaaccttaataaaaactaatgggcttccaggttaagatggcaaactgacacatgtatctaattttgctccttttcaagtctcactaaaactatatatgagttatttttgtttatttctaaagacttaaacacactagcacggagagaatggaatggaagataaaataacagcaagaaatattaacaaactcaaaagcagatgacaagtactaaatgacatagccaatcggagaaagtcagagttcaaaccagcaacagggaaaattaagaatcaagtgattttatgcagaaagacttaggtatgattaaacttggggatgaagagagggactgaaaaaggcagtttgatcccatctcctatttcacaccactgaatatctacccccacctcagcccagcataattccagatattattctctgaagaggataaaatggtctttgcattgtgggtctttagacttattttaggggtggggtacattttatgaacaacagggtgattaaatgaatgtgtgaatactcaatgctaagtgtcaaggtcccagtcaccccatcctctaccactctgctcctagttccttaccttctaggaagaaatttgaaagatgtttttctgggaaagaaagtgattagtacaagaagaaatacttgctttcctctagaaagttttaaatcctttactctgattctagaaaataccagaagatgtataaaaggaatgctgggttgttagaagatgccaccttctcaatgttaacaatgtaacacagtttatgtgactgtaggaatggcccttcaccaaggagaaatcatgttttcaaatcataaagcctgacttctctgcccttgaataaggctatcacaaggggaacagagatgccttgctgcatttgtaactgtgcacaaatgactagagtagaacttgctccacatcttcagtttaggctggaaggtcaaggttcatgtgccaatactcagaaatggctacatcaagttttatgtaagtaattttttcacactgctgatacagtactttctatgagtttattgtgtttgaattagtctataccagactttctccaaagcgcatctaattatgagtctccaactgtggccggatccatatgggtggtctctgctacagtgccacgcataaatgcctgtccctcttctcacttatcatttccattatgcccctaccatgatcataatccttcagttgttacgtatctcctacttcataaaaagaaaaactgtcaattttctaaggccttttataacctatcactttcttcatgcccatcttaatttccttctttttcatattttttttcttagagcccctaaatggacgtgactcattcctacctgctggcctccattctcatgaactttctcacatacatcatcaccttccatgactcaaccccacacctcattcaaaatcgaatacaaatttcatttgttcatactttttcttctgtgcttattctccacaaactctctctcttccaaaatcctaacagattgaacatttaacagtttaacaacacataacataattattgttatctctgatgtgtcaatttgtttcttccttgaggaaagaactgattgggtcttatcctgtgtttagcacagggtaaagtcttgttgtacaatgggtaggtgcccaaattctgaagtcggaccaacctccattcaaaattaactttgcttgtgtgtccttgggcaatttatctgacctctatttctttattaataaaatggagggtataataatcaatcaaactgtctagaggataaacaagaaaacatgtttttctcaagatacagtacacagtaagcactcatcaaagtttagctatcattatgtcttttattaataaaataatatttgaataaaatgagaaaacagcattttgtggcacttcagaagatataaagcatgagctattttttcttttattatttttaaactatagagctatttaaaatctatatggaggacttcaagtgtactactactaccaccaaatgggggactactagctgataaatactgcactgccagctgtgaccctcactctcacaggtcccactacaaacaagcgaaaaacctgcaatgaaagaaatgtgacaaaggtggaaccaaggaatagcctatatataaaactgctaagtttaaccctcagaaaaacattacggtgtctgagaagaaactcttgaaacagaattgggaataaaatagaagtaaagaacagatttcattcattttaaaacaattggagatttatcacagtttatatgaactgaaatttaggtgactctggattcagttcaagcacaagagattatcagagtctaaaattcaattttactacccttcctttattgcagttcaaacacacaatattcctgttctgtggatgcctttgctagtgatggctatagactgagagaatgttgggctgcttagcttttgtaaaacatgaaatgtgtctattttcaaatgatttgtcactctatggagttatgaatccccttctaacaccccagctacagattaggataccctcaaagccactgatttgtcagaatccttttacaacttgattcagagtatgccaacagtaagatattaattcctttaggagggagacatgtacagagcaggaaaaaatactacaaggaggtctgtaacctcaccatctgtcaagtgacatgctgttatttttccactttggctctactccccaatatcagttcctttctttcccagtgtagacccagtcatttcaatatatccttcttagtagtttcagttctgctcctttccagccaatgactggatacatgtatatatatatatatatatagatatagatatagatagatagatagatagatagatagatctatatatagatttatatatccagttggatatgtatgtataaatctctctctctatatatatatataatatatatatatattcctagtcgattaccttttatatatcaagatctgcttctctatcaaagttgtcactccatgtttgtcttctgaaggcttctcatattccacagatggcattaccccacaaatagaagctgttaggtatttacttctgaaatttctttcactttttttacacattcctttactcttttagagagagatttcttcctctttcccatggttcctagatcaaaagattcctatacgccactatgttaaatgacagatttttaaataattttatttttaaaaaactagtaagcttactaaatctaaatattagaaatactgatattattggtatgatttataatgctattgcttttttatatttaccctaaattttcattttattctcattttctaacttatcttctctacattaattttgtctactgatatggaacatttattctatttaattctattttcattattgtaaagatgtcttggaaatttaaaatgcatataatgcatataattttctatgtagcaaagtatgttaatactttaaacttcttcctgaatataagaatagtaggccatttaactctgatcttcaacccttacacttctcctatgtagtgtggtcacttcaaatagtctttttttgttgtcattgattgtattagtctattttcacactactataaagaattgcccgagactgggtaatttataagaggaagaggtttaattgactcacagttccgcatggctggggagccctcaggaaacttacaatcatgtcagtaggcaaaggagaagcaaggcaccttctttacaaggcgcaggaaagaaaagtgccaagtgaaggcggaagagccccttatgaaaccatcagatctcctgataactcgctcactatcacgtgaacagcatgggggaaactgacgccatgattcaattgccttcacctggtctctcccttgacatgtgggaattatgaggatgataattcaagataagatccggatggggacacaaagcctaaccatattattgatggtgttttaccaagccttctttgaatgtgtcaacaccttttctaatttccttggtgatcattcttttttgcatcttaatttctctttcatggtggcatttctgattatgcaatttgaaattcatcagtttaataggtcacacacttgggatctctatttcttaaagatggcctttatttaaataagaccccccagggaaaagcattcaccgttgatgctccatcaagctggtgtgtgaaaatatctctggttccccttttaaaggtagggctataagcttttctaagagtcttagtcccaggtctccggactatgtgtctcctccaaatgccataagggcattaaaattaaaatcttagtatcaacatttaggatctatatatgggctaacaagcaagcaaagagagtgactttcaagactttcacaaagtaagcttatgcttacttccctgctttttgttcaaattttgtgtttttttgtttattcctggttccttctgaattaaagtagtattttaaaaatctaattaattcagctactacatattaaatatatactaagcatatatacacatgctgttataaattctgggtataaaaaaaggcaaatttcatacattcatacaacttatactctgttatggaaatagaggcaggaaatatgggaaaaaatgaattatttaaaccaaaaagtgataactgctaaaaggaaagtaatatagagtgataatgaaactgatgtacagactagttggggaaagtctttaccctgggtggccaaaaaaggctaatctgattctcagctcattcattcaagctgtgaccagaaggaacagccatgtaaacttatgttggtttaaatggtttttttttgttttgttttgttttgttttcccttctcactaaccatttatctcatttttggctatagctttttattccccttttacaatttcattctgtccctccccatttcctctttcccttcagcctaaaatatattcaaacatccagaagtctcaaaaatcttgtcatgatcattagtctcttttaagttactaccttgagtctctttgttttttgatctgctattctcttacctatctttttaaataaggtttttttccattcaccatttcgtaaagcaaaagtcaacaacaaattgattaaatctactaattgccaaactagtatctttttaatcattatcttcaagtaagaccattgattactcactgaaattctctgcccagcatcctcctttgtatgttacttttcttattaacacttgaatgctctttctttatcagattctattttctctgcccacttcttcaaagcttctgttcctcatggctttacccttcattgttgtcccttctagctctaaatcctgtctataaatacacccacttgaattatttatactattttatggtgagaaagcttaagagtcttctcagtgccacttaccaagttattattattattattttatttatttttatttttttgagacagagtttcgctcttgttgcccaggctgatatgcaatggtgcaatctcggctcaccacaatctccgcatcctgggttcaagtgattctcctgcctcagcttcctgagtagttgggattacaggtgcatgccaccacacacagctaattttgtatttttagtagagacagggtttctctatgttggtcaggctggtctcgaactcccaacctctggtgacctgtccaccttggcctcccaaagtgctgggattacaggcgtgagccaccgcacctagccaccaagatgatattataatataactattatagttcaggtttctttccatatgttgtttttcatataaatgtattgatactttaaatcagcaacaaattatagaaggttaaaagttgtaattaaattatccaaaatccaactactaaaacataatcattatttaaacccatgaaagtttagttttgttcctatacaggcatatacatgtctatgttatatatgtttgtattatataatgcttgtgattatatgtgtggagaaagagagagaaacagagacagagagaaagagagaagcagagacatatacaaacagatttctccgaatctttgcctgcagaaattgaaccatgggccaaaactgaattactttctatatgaagaggaataagaagacatttagaagctatggactagagttggaaaaatggcaagagttaagtgcaaaaaatagaaatagacatttaaagaggtatttttatgaaattccatgtataatacacaataaatttaattttctcactttccaatgaaatcttcactgcacataatctttggaaagtggatttctttcagaagaatacaaagtagaactgaattatattgtaaagagtaagtttggtataaaacaaaacaaagacaaaaatatgcatatgagaatatctatgcatccatatacataatagattataaaatttagactactttcatactatttaaaaaacttgactttattttctatagactcttttcatgtggcaggcaaccatttgtttaatcatcccaatttttctattattttaaataattctatagttatcctgttggggctcagaaaaaaaaaatatacgccaaaatgaaggacttagaagcagcttcagaagcaaaagtttttctctgatttttttctgttctcctgttgctcagttccattttcccctgaggctagtcataaatactagaatccttctccaaggcaggtcacagaagccagaaccccttttccccaaagctagtgataaaacataaaaatattattctaaaacgatctccatctctctgtgtaattgtactagtcatacaataattttcctacctaccttgtttgactataggtcataagacccatattccagcgagggtcttgccccatatccagaaggtagaaatacatgttcagagaagccaagaaaaatctagacagacaggccttgctgggtaccccactcagtctattaacataagatcataccttatttgtcccatcatatttctacatgattgtccatactttattgaacttaagcataaaaataaacaatttatcctgtgtctttgggtcttcattctgaaggctaccatatatacttggtaaataaatttatatgttttttcacctattaatctgccttttgtgagttgatttttcagtaaactttcagaggccaagggtttcctttattcaaaaaagtttggccaggtgcggtgactcatgcctgtaatcccagcactttgggaggctgaggcgggcggatcacgaggtcaggagtttgagaccagccacaccaatatggtgaaactccgtctctactaaaaatacaaaaattagctgggtgtggtgttgtgcgcctgtagtcccagctactcgggaggctgaggcagaagaatcgtttgaaccccaaaggcagaggttgcagtgagccgagatcgtgccactgcactccagcctggatgacagagcgagactccatctcaaaaaaaaataaaaagtttatcactttatattatttcctttggataggttccctgaagtatagtacagatatggatacagatgatgcacgtatgaaaagtttataaagattttcattttacgcatattcccaaattactataaggcttatgtcattagattttcaacacgatgctctgtaccaagcctattttaaaagttttggcaaatttgatagatttaaaatacatcttattctaactattttatttttaatatttttcaaatatttgtctgccataacttttataaggagaaagtggttaataatataaccatattctttgtccattcttccactacaatattaattttttatgtctgcaagtattctttatatataaatgggatcaaatttttgtttatccagttatccatttacatttcaatattgcttaggacattctattgatgtacattttttgaagttcaatttaacaatcctttctttgtaaattattttgtatgtaattttcataaactgtttctcaattttaatatcactgaaagattcatgtacattttctccattaattatgattttaaaattaacagttatttcattactccacctgaaagttattttggggtataaatgaatgtaccaacggtacacagcaccatatacatgaatactacatggtaatacaaatgaaagattttctaagtgtactaggtcagcttcagtgtatccttctgtactgtggcttttataactacaccacgactgaattattttagttgttatagtttgtgtacattagttactagtagggcagccactatatattttattgctttttgactaactctataaaatgacattttaagacaataacaaacatttttattacttctgcaatatgcccacaatgtacatttttttcatggctatcattaagtgattataatttcaaatatatctagttctcatctcagaagcaaaagataccactatcctgattatgctataaatcactataactaaaattacacagctatgaaactcaaccattcagatagctccaataccagcgaatcacttggtttaccaaattctttgtagaagtcacatgctagtatgatacacagagcagatgcctggggaaggggaaggtgagagagtataagtggtgtccaaaccaattccacagaagtttctgagaaacttgccatatttatttatcgatcgaaacctctagaattgtacacctacaactttctaatactatatttgcttttcccctaccacctgatttttggcacttgacactcagagaatcttgaggtttcactaatatgactaatattttcagccattatgaatattacacatcgttttccacataattacctagtgaagtctgtcatctccatcatgatcatacacatgttcttggccagaacaatgatgtcgttgcttgtatcatcccatatctcaatctcagcatccagcttactctttactttcttgaaatcagcaacttgctcagcaatcttttctttttctgcctcaggcagttgagtcatcttagcctaaaacatgtgataattagagttaaaatcattccactatgtcaaaagcattttaggaataagtagatattataggatactcataaaacttgttcatttaaaatcagaggcacaatatagttaaattcattcaattaaaactttccaggcttaatatttcatataaaaatctattaaattataatagtttgctctagaactataatgttacatttagaataacactgtagaacttggtgtccaacatacttaaatccattttataaaataaatgtgggactttgcaaatttctaatacgcttcaaattttaaattaacatcaatttagtgtaatgcatcacctttgttagaaaagtgcgtataaaaaggtggatgtataacataatttaacttgaaatgagactatgtctacctatgtgtatatatgcaattacaggatgaattagtcatgcctcaactttaacataataaagaaaaaacaatgatgcttttagtttgaattttctgtaaatatctcagcataatgcttgacacatattgaatgttccataaatggtagctatttcttattcaataaaattatcaaaatattttcatatgtctaataaattttttcattttgtttgtattttttctatgaagaatcaaattaagctacacaagactaagtttttaactgacacaagtgctatttcttagcctctgaaagtagtttgtagtttcttttctgaggaaatgtgtcctatgtgaggttgtaagagaggagcaacttttactactgctggcatatggcaaagcacgtaaatgaagacacagctcactacttctgaaatgaaaagtaatatgcaagcacgttaagtaaattataagccaccaacccattaaactgactcacgaatagaaatgggttttctccatcttgactaccggtcattatcattctctccattctcataaaaggtgtttaaatgttcaaattacaatagctccagataggttcaactggtgcttctctttacattctgtatctcagaggtcataaatctgtgattctatttattagaataaatagtgctgaatatacactggtatattatggaaaattatttactgttctcataataaagctattcaagagctgaactggttaagtgtattccaagttcagttacttggaatgccactgatttccaatatgaccttgaggaagttacctaaccctcctgtctaagtttccctagacacaaaatgacagtaattgcaactgctatccacctgccatgcagggaacagagtcaattattggataagattgcgactgaccctgttgtggacagggagctcattggttgcacttcatctccttaataacatctcaactcaaatggtgaattacaacagacatttacctctgacaagataagagccaaaagttgggcaatagtttgcaaaattaaaagttctagagaattctggtcctttttctcagggggaacaatagcagcaacaaaacattaagttactgacacctttgcagaaggttttaagtgcttctatgatttattatatgtcatcgatcaatttcaaccacgctgaaaattccaaaggaagacttaagagaatacttgatgtttggaaagtctaggtgaaaaattctttattgaattattttgttcaagttaaacaaagaaactgaggtacaaagcttaagaaaaattaagtaagtagaatatctctgatatatatcgccaggtggctatgtgtttaggtttctgcttacatctatagagcagaactctgatagaaataactgtcaaaggctttttcaatcactgccatctgaataagattatattgtgtaactattgatcttggaatgtgttaccaaacacaagaaacatttaaacttcatagcagccctatgaggaattattattatcccaattttgtaagtgaggaaatcgagtctctctgaaacattaagtgatttatcaagattatagtgtcagtcaatggtagaatcaggatgtaaatcagaaaatatagctctagagtttttgttctatcactaagccaacaaacacgaataatattgcccacaatataccaatatatacacattctccatgatggtatttctctatcgctgtctacctttgaaagcaattgttctccaaagaatagtcacattgtttagaacctaagtttccaaatctttaaattatataccatgatctttacctgacaggctgttttggacatcaaatgatatgcaagaacacactttttgagtaaagtgatgttaactgtcaaccattacttacacaaatagattcagttctttactctctgcagtgaatctcagaactctatttataatattatccattatttttcaatgaaaagctgtgttatcccaattgcctattaggcatttttaagcatagatttcatttactaatttaactctaaaagagaggtcggcagaatttttctataaaggacaagatagtgatatatgctttgcagctcacaccatatcactccgttactcaactggcagagttgttactctgttatattgcaagagcagtcatgaatactacataaacaaatcagtgtgtctctgttccaataacaccttattatagacattgaaatttgaattttacataattttcacatgccacaaatattattctgatcacatctgattacatctattctgaattttttcaaccacttaaaaatgtaaaggccattcttagctcatgtacaaaagcaggcagcaggccagatttgacctgttgactacaatttgccaacacctgctataaaactttcctatgaccagggaacacagatttttattgtttttctctgtcttcattatccttactttgtttgtaactcctgaaagtgctgaccaagtgatgcctgaaacattttcttgtttttgttttgttttgttttaaggcagagtcttgctctgtcacccaggctggagtgcagtggcatgatctcagctcactgccacctctacctcctagattcaagcaattctcccacctcagcctcccaagtagctgggactataggcgcccactactgtgcccagctaatttttgtatatttagtagagacggggtttcaccattttggacaggctggtcttgaactcctgacctcgtgatccactctcttggtttttgccttccccttacatccaactgccccttctcagagtcctccatctccccttatctgccaaacgcgcatctcccaaagaatctgtgctgacccttttaactttcttcattatcttctcccttagcacactcatctactttcttttcttttttacattgggaaataaaattgtaagtacttactatgcaccacattatgttctgaagtgtatataccttgtggaatacataatggaatactattcagccataaaaaagaatgaaatcctgtcatttgtgacaacagggaatctggaggaaattatgttaagtgaaataaccagacactgaatgatgagtaccacatgacctcactcatatgcagaatctaaaaacggtatcacaaaaggagagaatagagtaggggttaccaggagctggggtagtgggggagggggtttgagaagatgttggtcagaggataaaaaatttcatttagacaggaggaataagttcaagaaatctattatacaacatggtgactacagtgaatagtaaattgtattcttgaaacatgctgagtgagtgtaaagtgttctcaccacaaagatgataactgtgtgaggtaatgcatgtgttaattagccaatatagttcttctacagtgtacatataggtcagctacgctactttcatgacttcagccatcactgctatgaagattacttccaaacaacctcttcagtcctgttctcctttccaatactgtgatcagtacattcactgctgttaggaatacctcatcacagaaggatgaaaaacacactcagccaaaccatttatcctcttgattttcatgtttctcagtgatacttcctgccttccagtcttgaagttttatattttagaaaattatcctcttttctttagcctattctgtcagttgtccattttatcctttatcacatccatttccctctatatattaatattaccattcctgctgtcttctggtcttaatattctcctttgttttaaatcttcttgctttgctactgcttgattcaatctttctgaatatgatggaattgtgcaatccttcatctaatctccttatctttacatcaccttatcaaataaagggtatcaattcctcaaacaccaccattatatttgtttgattaaaatagaaaattcatataaaatgcctaaatcataaatgtacagttggaacgattttcacaaacagagcaaatccatgcacctacactcatatcaagaaaccttaaaaagattacagacactcggaagcctccttctatcttctgctagtcactatctcctaagggtaatcactaacttcatttctaaaactgtagatttgcccatgttttaatcttataaaggtgtggaataatagcacatgaattcttgtgtctggctttttgtattcagcacttaagtgcttgaaatgcatctattctgttgcatgtagttatattttgtttattctcattgctctatacagatattattccactctacaaatatatatatatatatttctataaatttattcatgtttttctataaacaatattttgaaaactattccgtttttggctatgataaataatgagtattcttggacttttctttaggtgcacatatgggtgtatttctcttgagtatgtatctaggaatggaattagtacatcacagggatcatcataacctttgtttctaccagcttttcaatctcatcccatcttacttccttcaacacactgtaccctcaagctaagctaagctatttgttgctgcaggtaaatatcttgagatattgcccattaattatttttgctcatcttcccttcccccaatttgttggtccaaatttaatcatatttccaggccagactcatatagtatatgcccctttctccattcttcaagtgtgtgtaattattctctcaaaatttttagaacatgttgtcagttcttccccctagatgttcatattgttctctcttgtagtctaatcttgtgaacacaactatcttatctcacttactagagatgttgttgaaaacaatatcatctttcagaataataattatgacattacacataatttttcatttgtactttttagatgtatttttttctccttcccctagaaaataagtcctcttaaagtaggaacatattgcatgataaatgtttgtttgtgattgttaacagaaatactcaagagctaaaaaaaactcaagacttttgagctcaaaattttatatcactgatcttgtattttcattgtcaaccacatttacacaaatgccaagcttttgcctctacacagatcttagattcatttctcttatgcacttttcctagtatttttcaaactcaggtccttattattcctccaagactgtattaatagcacaattgatcgtttttcatcttcatatctgcttattaattgtactatgctcattactactgcatcaaatattgatatgcttacattatttatctgcttaaaaaatttaaatgactataattaccccttaaaagagacaaaaggaaaagaaaggaaaaaagtgacataataggaaaaatgcagaaattgttgtcatacagaccaccattcaaattccactttggccaagtattagttatacagcaattaacaatcctaaaccccagtttcatatgttaaatgataataaatttataggagttgtgtgagaattagttatgactataaacaattgtacctggaatatattagggactcagtaaatggtgcatatataaataatgtatataaatgtatcatcttggcctccaagactttccacaaaatggaaaagaaggataactaaaatattcatgtagcctacctcacagagcctaggcaagaaccaaatgaaatattttgagtaagtgctttccataagcaataaatgccatagaaatatagcgccattataattatcttattctcagaagccccagaatccacatcacttattttgcagataagaaaattgtcccagaaaggggaaatgacttaaaagaactctccagctggctagtgacagatgtgatgtttcagtccatgtgtcttcattagtagctttccctttccacaattttttttttggctttccttaactataactttttttcatggaaattaaattcttaggtaaatcatataactttgctaatttctctatccatgaaactggatgaaacatagaaatattattttgttaataaataatccacaattatgatttttttaattttataaatattagagaatttctaattaattcatatcactcatatgaatgggtagctagaactcaacattcaaaataaaatgtttgataaactttaaaaatatacacatggtatatatacatattggaaaaatagttctctaatgataactcatgttcttaccttcagcgtgtctcaaatttaatagtgacatgtacgtgttttcttaaaataagcctagaggcatttgggaaatagatgtatttttaatacatcaaaagtataaatagcatagaacactttgatggaattttagaaaatataaagtgcttttggcaaaaattcaacctaattaaaattttgagaacaaatttatttaagcaagatttatgcattggtatcctaagcatactaaattgtgatctcaaatatattcctgagaattcattaagagcaattttctgtaatattttaaaattaacatttaggaattggagttggactttaagaagtggtatacatttctacatttttatgtatagacctctaaatcagacttaaaatatatatttgctttaattagctctcagtttcctcatccatcaaaaaacacccctcttaacacccagtgggttactttcactgttataaaactgtctcattttattataaaactttataggcttcagggactgggtcgaaacagagtaaattatcaggtatatttgactgattatctatgtcttaaatataataatgatagtgattgacatttgttcacacttccagtatgccagtcactctattgagcacttttgaaaaaattatgccatttaaataataatatgatgaggtagatattaatgtccatttgtcacaatcatggaaatgagttccttagggaacatttgcagatctcctataatgaaaccctctccaatgttttatttctttttcataagaaatagttatattttatctgtgaatctagtttctctccttgttctagagataaataaaggttgtaaagggcatttgggagatggacgaaggaatctgtgtataaactgagtattaaggaaaattaagaagtgattgttaattttgttcagtgttgtgatcatattgtggttatataagagaatgttcattattttgggatattcctgctgaaatatttagatataaaatgctatgatgtttcaaattactttgatgtagtttaagaaaaacccaaatatggctctggaactatggttaaactgttatttctaggtaatgggaatatgagtctgtattgtactagtgattaaacatttctgtgcatttaatttttcacaataaaaaatgaaacacaaataacattttctacaattttttgtggaggcatgagagatcttacaggatatataatatcttatttcaaaatatcattccatctataacatttgtgaccaataatgctttcaccacttttcggactttcctgaaagtccaatgctggattctctgggcctgagaaataaagcagtccatgcacattttaccaataaaaattaaaacataataaatgagactcatgacctccagaagtaatcttcacatagataaatttcattcaggatcttggcatgtatcataatgacagaaatttacacttaagtgtggctgtagcataaacctttctccaaaaagaaaagttgtttcaaaggtggtgatctgtatggagcccctaaaacaagatgctgatgtgagcaggtatcaagaaagctgacgtgaatatcctcatccttttgacagatgtgatcctagcacggccatatagttattgcaatatatattttatccagaaggtgaagatccaagcctttatactctttcctctaaaattatatgtatatataattatatattgaagggttggtaaatttgtttagcaagagtcaatctttaaaagcctggttgatttgtttaggggcatcaacactaaagagtttctattcccaacagtgaggaccaaccccaggacttcagtgacctcatcactgaggagattctacttgagctgttaaccctttttccacttgatatcttacttttgtcttccaacaacaggcaagtacttccttctgaggcactgaattacatttttagacagaggtagttattagaaaatctttatctttcctctctatgtctacatattagcctgaattcagacctctagaacctaaaggagtatatgtaatctattttccacaagatgatcttgcagttatgtgaaaaataatcatcagatgctattaactgtcatcttcccattctctcattcattccttcacctattccttttctgtagaactcttcaattccagacacttcaagaacttgttatccagaagatcagaatcaaggttttcctttggggatatttcagtatatcatcgtctctttcataaaatgacttccagacagaattgcaaattctagatgaattctgaccagtcaagaaaacaataatggtctttgttcaggacactatattcgcactctacaaagaccaaagttgtaatagaaattttgtaacattcatgtaaattatttactcatacttaacactcaactgaaatgcccattacaaaaataaactataactaagccatatcaaaactgtcctgtatttttatttttaaatataaatattgcaaagatttacactaaatttaatttatttaattgcattgtgttttctttggttcctcgttccagaatgctgatatactttttgtcttttgatgctgccaaaactgacaatatagaaatcctcaaacagttcaataaataaatattataaaggctgtgaggaaatcaaacaatgctctctaaaagtctattttattcacaagaatgcctttaagatgctattcagtgcccagaaacttatactttgcttataatttgaataagtttggttacctgaattccatgacccagtttacagtaaattggaagtagacagaaggtgtattagtctgaccacaaagatggaaaagaaaatctatcaaaaaagagacagactactcagtcagataatgaggcccttcaagttataaataagctttcctgcttatatcaggacaccttcatcctattattgtattatagcatagtacaattatatttggtcacaatactgacaatgagtcatccacagcatcatcacccagcatttattgatgtctactgtaaagtagagttggatggcaccatttctgctctcaaacagtttaaaagatccctgtgcagaaaaagacgtatttagaacattttggttggtaaggtaaagatgcatataatacaattagaaaaccaattctagtgacttttaaaaaagttaaatcttattatatgaattttataatgacaaattatatgaatagtataacaactaaagtaagatttgagaaagaattatatacctcctagttttatatgtattttcttttaatcatatttttgcatgaatataattttattactatgtatgtattaaatgtgtaattgaatataattaccagatttccctccaaattgtttatggaaatttgaaaatttcattctatctttctaacaacaattttcttgataaaataacaatttgaggaatattgtatagaattctaaatatggcatttgcttgtccataaattatgcttacatatgtctatattattatgattcaatatgaccaagactaatgatccatataaatatgctaattatagctccttccattgaaaaccagatgcaacacctgtagtgacacagtcgtggcaaagaaaatataaaatctattctcattatattattaacaactgaatatagattatgtaatgcacaaagaaaaataagctgttatatttcacataatattaatctattgcctatttactaggtttttaaaaaggtaaaataaaatagtttatatcaatttgagtaatatactactattatttctttctgactccattactgggtaatcattcatgattcggatcgcttgaagtcagtttagtttatgacctaaacccaaagttagcagaagtttccatattctgaaatataaataaaacagtcatgcttcttctcatacattctttgagagtctcaagtttactcaagaacttcataaattactgagggcttatattcccataggccacttttcttctctgcatttctgatctcgatctactgcattcatttgagagtgatcttgtataactattcccttcttactccattatagtaacccaacattgtaaaattcttcaaaatcactcttatatatatacaagagagtgatcttgtataactattcccttcttactccattatagtaacccaacattgtaaaattcttcaaaatcacttatatatgtcatttgtgtacatgtgaaggtttgtgaaaatgtttagggacaacatgagaattttacaaagtaaaatgacttaacattgcaatatctctgatttttacttaaagatgtagaatatgggtaaaaaagtatcgcttccacatttacatcaacaaccaaagccaaaactctgcaagtccatgacttttcctaaagccaatcatagttgtcaaataataatttcactgactgagttaaacagccaaggaaaattttattcaatactgctgcaatggaggcagagatggaactcaactctgctgaagcgaagtgaaggagagtttttaagcactggggtgagctagtagaaaagtactggaggacattagtggagatggtcaatgtcattagaccatctgtgtttgctaaatggtacttactgaataggcttctaccctcctacagagagtaggaaatagaggctttacctttcttgataactacatttcagagatggttcacagatgcttaagaaagatattatattttgttaaattggcaagaaactgggacaagatgtacatcacaaagggacagagaaagaatttacaatgggaagttctctaaagtagatgctttaagaaaagggaggccaggggcctgtactcagaaggaatcccatcaagacaaggagaaatttaaggctttcttggtcagaagtcagaagtcaaccaatgaacctgagatctagggcaataagcgccttctgaaagagatatgatgtaagtgtttgcttgccttgggtagatgccacctgacactggcaagtagaattcagctagaagagttgacaaattagttgagtatgaatcatcctatggtggcaaaaagtaagtaattgctcaaaaaagaaggacctgttaaaaagaaacaggatgtccaggcctggtggctcatggctgtaattccaatactttcaggggctaaggcagggggactgcttgaagccaggagttcaagaccagactggccaacatagcaagaccccatctgtaataataatcatgaaataggaaaaaagtaaaatttaaaaaaagaaaaaaactttcaataccaaaaaaacacaaaaaaaactttctatatcaaaggttggacaatttggtcagtgaaataaggttaaactccatagactacaataaatatccatgagttcatagtgatataaataaataattgaatgaataactaaatgtgggagaagggacagctcttccttaaaactccaactaataaatatagaagaagtgagcaaagtagaaaatcatgggttaggcaaacaccacagtaattattctttggcaaggttcattgatggagattaaaatttataggtgaacatttgagaaggaacaaaattgaatagtcttaaagcactgcactttggctgggtgcagtggctcacgcctgtaatcccagcactttgggaggctgcggtgggcggatcacttgaggtcaggaattcgagatcagcctgaccagcatggtgaaaccccatctctactaaaaatacaaaaaattagctgggcatggtggtgggtgcctgtaatcccagctactctggaggctgaggcaggagaatcgcttgaacccgggaggctgaggtggcagtgagccaagatctcgctattgcactccagcctgggcaacagagcaaaactctggcaaaaaaataaaaataaaaataaacataaaaactggcactgcacccaagatattaactacaaagaaaaaaaaaaaacttagtttttcagtggaaaaagccagcaaccaacaccaaatgacaaaaaccaacatcaccagaaataagatctattaatatcttgaacctcctgatttgatggactgagaaggacatgttagttttgtgatatttcctccaaaaatgcataaccttaaaataatgaggaaaacataagacaaattcaaattatatgagattctataaaatacttcatctgtattcttcaaaaatatcaagatcatgaaacataagggaagattcaggaaataccatactctagaggggactaggagatgtaacaactaaataaaatgttgaatcctagaacagaaaaagaatataggtggaaaaattgatgaaatttgaataaaatctgtggtttaattagtagtataataccaatggtcatttcttcattttgacaaatgaaccctgggtatgcaagttgttaacattaggggaaattaggtgaaaggcctataggatctctgtacttttttcagctttctgtaattataaaattacttcaaaataaaaaattaaaaacaatgtaaaatatgcacctgaattgtcatatgtatgtcagcaaatacagaataatttacttcatggtggctaccattttcagtcattggcatcctgtcttcttagatgggccccatctgtccttttctcatctttcctgtgtgttctcctgcagcaaaatactgcatattttctaagcacactttttaagtattgtcatatatatattcatccatcagagtctcatctcccaacacggtgcagcatattttcctgaagaaaaagagtcccttccctaaaggaaagtctaaaactatttttttttctctttgctagagatcttcttagtgaggagtaaaaagaagtgagggcttaagtaaacaagaaaacattatcctatgatcacagatactcaccaaagccaatttgaatgttattaatagcttataaactgagatgctataaaaactcacctaattttggataaccacatagcttgtcaattaaagctctacccaatcttaatactagaataacatcattaaataacatgcaacttgtaatttaggatgtttaaatggatcctgatgtctcaataaaatattcttgctaagacaaactccacaggggtaacgcaactggaccaagcagcctatgctagtcttctccagattcacctcccacttgagtatttcttcctaattatcattgccacaacctccttggtttcacgtgagggtcaaaggaccgccacacactttctacctaacatcttgcctatgaaaaaataaaatttctcttaactatctttgatcagctagcataagcctggactatatataaaaatattagacaagatattaaagattttgaaaggcagacagatgcagagtgatatggtcttggtaaagaggcaactaaggtctggcttattcttctacgctagttatgacccatcctatgtattgtggaaaccatcgtatatccattactgatcacccaggtacacaaacaggatattgtgtcccaaatataagtataggtagccaagtcctacagaggccagggttttcttattatggctttctgagcactcacttctccaagtgatttacattagaaatgatagtgagttggctgggtgtggtggctcatgcctgtaatcccagcactttgggaggccgaggcaggtggattacctaaggttgggaattcgagaccagcctgaccaacatggagaaaccccatctctactaaaaatacaaaattagccaggtgtggtggtgcatgcctgtaatcctagctattcgggaggctgagacaggagaatcacttgaacccagtaggcagaggttgcggtgagccaagattgggccattgcactccagcatgggtaacaacagcgaaacttcatctcaaaaaaaaaaaagaaaaaaaaagaaaaagaaaaaaagaaaaggaaagaaaaaaagaaatgatagtgagtttgcagaagagaccaaactttcaaaatgtagttctgcaggctctgaaagtatggcccatcagaatgctacagaaaagtacttaaagcaccacaaaatatttgactattctgttgcatgccattatcaaaataattcatgtactccataaatacatacacctatcatgtatccacaaaaattaaaaactaaaaaaaaagagaatgggtcttccattacagtggtattagttttggaacttcaagcaatttgtaataccttgaaatctaccagaaattgaagatgatttctaaaattctagattacttacaaaaatgtaggcagtacctaaaatagatgtttactaaataatgttttttctaaagagaatttttggaattagaaaaaaaattcttagaaaaaggactcatcttgattagttgaaaatgttttatctgtatacacactgaatttttctattttctctaagcctccttcagctaaagattcatttaataaatccccaagtgagttatgaattatttccccagaggtgggacacaataatcaaaaaataaaattgttcgggtcaatttgtaaaatagaagtttcaatggcacgtttcaatgttatatatctatcatctatctatgtatttatatatttatttgtgtatttttttatttaaggtgatatgtaacaaacttgagatcttataggataggagaacactaggacactaattaggaactggtcccaggaacaaagaccttctggactcatctgacaagataagaatcatcaagcattcttccagcagaaagtgacaaagccctccttgagctgctcatgagaattcacaaagtaaggcaatatgtgaagaattaagatagaagagcttgcaaagaatcccttgtctctattagattccaagattgagccttagaatatttcaaaatgataaaaaaagagagtttaaaagatttgtagaagaagaatgaaataatatattcattttgaaacaatatattttcattcaggattattaataaaatgctcatgttagtgatacatgattcactaaggaaaataaacaaggaagagaagatggataaagtgataggaggaggaaacatgacacaattgagaaggcactgaggtagaaagagaattggtgtttgttggtataatttaaccagttttcattcaatcacctggaccacagaaattctcaaagtacaattcacatgcaactgtaatagattacatcttgtctgtataataagttaatgtgcaagattttgaatattttcttatatatagaatagtattattttttctagtttcttttttgatttatttttctttcataatcaagaaaaaaataaatgaaagagaatatgggagaatgtcaccagagagtcacaatgttggcatgttattctgacaattcaaaaaattctcaaagaatctaagttttaagtgctaaaaactgccagatcattttttatatttattcttctgattacagtgcctacagcattcgtaattctccaaacaaaatcatgaggcttaattgttttgaaatatacttctgtgttacattgtcagatctcaattaaaggaatcttccttctatatgcaatggaagtaattcaatccctttttatgtagtaccataatttatgttaaaatatggcacaatcactgcctaagattcaaaacatgtaaaacacccctttgctgctgcaagaatcaaaacacagggttgatggtaacacctatcctacatcagtagcactaacaatacaatcagtttgtacaagctaaatccatctggtcagaacacacaccaacattaaataaacaaaacataattcttcttgtcttctgaatgtgaatttggagggggaacatctggattagaaaggcccatagcaatagacaaggcttttccaagtaaaattccattcaggcactagaaataagaccctctgctcaagaggcagcagctgacacacgagcctatcttagtactgagacaggatatagatgaagccatgtctataaatgagcacaaaaggaaattaaaagtaaggcttcaattagttaagctttcaaaggtaaaactctagggtgtttggaggaatctttcaggaagatatattccagttttactgcagactcaacacaaatggctctcagacaagtcacatctatagtaattggaaacattttcaaagtaaaagatgagagaccatggtttttgccaaaggttcttaagcatgggctttcatgggcatgcgaattttttttaaaaagtagcagaataaacatatgtttgcaaattattttattttaccaagtaagggcaataaaacacacacgtttaaaacaaaaaatttaaaaaggaagaaaaaattaccacaaaaaacttaccatccactatcactattcttttcttaaaaagaatattttaacctcaaaattaggaaggactcagtagaaaagaacgatctttcctaagaaagaatggctgttcctttggttgattttacctctccccgactccgcaatcacaacctcattgttacttggcaatctcttggaagattattgttagtcacaagtgatgtgagaggtgtgcgctactggtgatagagtagtaagaaattatttaggcagttagtgagggtgaaagagttcttggtagaattttcttttaataaaaagcagcccccaaatcatttcttttctaataaaaagcagcctgaaaaatcaagttacaagcatagataagcaagatggaaatttgcatagataaatggcatcagctgtacctggaagctaggtacatccaacatggtgattccttcttccttttccttgtcgccacatgtgcaggtgtcatggcaccagccaggtaaaaccttatctacataataaaagatttgtgggctatgtaaatagcacacctggtcaaaccaatcccctgggcccaatttaaatcaaacaccatctcctcaagcccctctataaagtggacctcatctcaccccaaacccagaaacatacttggggaccccctttctctgcatgaggaagctctctcttctttcttttgcctattaaactttccgctcttaaacccactccgtgtgtatgtgtcagcatctttgttcctcttatcgcgagacaacaaactttggctgtttccccagacaatgatggtgcttcattggcatctactgggtagagaccagagatgctgctaaacaccctacaatgcacagggcagctactacaacaaagaattgtctggtccaaaatgtcaacagtacacggtagagaaactcctccctacactgacattttagctaaggaccagtggacattttggctcagactgaccctcatgtaagctaaccagtttacggagccagtgatctctggagtgcttggttgactcttttgttttcagtcatttttaacaataatcatcagcaacagaactgcagtggtggaattctactcaatcaattagaactagcctgaaaaattgtcactaaaatctattctgcaattctatcactttgacatcaatcccactggcatattagtttgtatctgaacttcagggcattagacttagtctagaggtagtgctactgtttggaaatgaaagaatatttagccagtttgagacaagaattagtagcctctatcaaaagatagagaacaaaaatttcgtcttacagtgggctttaataatgtatgcttcattaaatattcagtaagagtatatatactttctattaatgtaactttttaaagattaagaaaatcaaatggattaacaaccacggctcattctagatagtaaacttatagatagctattttttccttatgtttatttgaaacattttggtctataaaattatgcacaaactctcagtagtatggtaggcttctttttccctctgtactttcatacagaatacctttattttcataaaatattgtttcatataccaaagattttgaaagcaatattttaagactattcttgtaggctacatatatatgtgtcattattttacaaattatattgcaaaatgagatcatattatgtatactgttttgttccttattttttaacattataaagtagaccagtgtctgtataatatagatttgtcacattttataactcttatttcatgatttagatctggtatcatttatctacatgttattaatggttatcagttgtttcatatttatgtagataggtaggtgttttgtgtgtgtgtgtgtgtgtgtgtgtgtgtgtgtgtgtgtgtgtgtgtatactgagtggtgaatatctttctgcagttctccaaatgtatctgggcaaacattctagaagacaaagagaatgcacttttataaaggttttcaatgcttacttcccagttttcctgcagacagcttaccctaattggtatctccacaaagtgtttgagtatcaattttccataaaaactttctgacaatggatattaacaatcttttcatgtcttcttcaaatgttatccgaatatagtatttcattgttgttttcatttgcatttttgtaatctctgatgagatgggacaacaattaacatacttactataaatgtacatgtattctttatgaataccttgtaatagggcctatgcccagttttctgttggccaggcgtggaaagtggggtgaggagtcatttcttcttattaatttgtgaaaatctatttctatgaatatataaacattttcttatataatttgtgattattatctcctcaaatggatgtttgtctttattttgtgttttgtttgcttgggtttaccttttttattttgtattctcagcagtaaagttcgcgccccttttcttttgtttttggtctttggtatcacatttggaacatcctttaccatcctaaagtcacaaaaataaatatttactcctttttatctagtacatatagggccctttgttgttgttgtttatgttgctggaactcaggagctgaggattgcattagtcatattcttcagttcattgcacactattactcttggtaaatagagagtcttcctgccccaacccaaacctctcctctctttctttctccctcccttcctttgctcccttccttccttccatccttccttctttccttccttactcccttccttccttcctttcttccttccttctatatacttttgtttattcctattccttgtgcctttttttctattccctccctgcaaattaaaacataaactgtttttttaaatctactctggttcgcctttaccttaggtaacttatatttaattcactgcacaatatgaatcccttatgatttgaagttactgttctttataaacactatattttaatagaacagaccatgtgttaggcatctactttgtttttatcactacacaaggtcctttatatgcattatttctaattataatattacaaggtaggtattctctgagttgaaatataaggaaccagtatctcagagaaatatatatatatatattactaaatgtcatactgtcactaataaaaagagccaagattaatcttagggatggtgaccctaagacccaggcactcttggtgcttcttacaaaaacaatagcaaacaaaaccaagcgagttctgcatatttttagaaactatatttgaaaatgaaatcctttttccttataacaccattttatattattttaggaaattttagtaacagtagtttctaatttcatcatttcaaagaacaacatgaatctaatgctacattcgtgactacataattgcaagcaaacggatttaggcatctggtgtgataacagccctgacaacacagcacttcttttcttctgagctgcagtttgaaactggaccagggtaggcatgtggctcaagagctacccatctataaattaactagaaattcatgaaagaatcccatgtaaaggactttgtacataggaggaaatttatttagcttggccaatcaggctggctctccccagaaacccttctgaaaaatctgaagagaactaattagcaaggtgaatgttgccaagctgcaaaaatagcagagatgtcataaatgtgaatccactcaacaaataatgatgacaaccgtgatagtggtggtggtggtaatgattatgatgatgacagatattttttatcacttaatgatacatcattccttataaatattaactcctagaagcctcacaataaccctatgatgtatgtccattttaaaaataagtaagcaaaacacagaaatgttcagtaacttgctcaatgacagcagttagtaagtggcaaagtctgattcaaacataggagtctagctccagaaattgtgctctcctttaaaatggtcttagcatcagaaacgaagagacatgtttggaggctgactttttctaaaagctctgtttcttacaagtacatgactattacatagctgatgactttacactcaaggaaatgcttctattatatgtctgttcatatttacatgggattttagccaagctttagatgtttagagtgctatatagcctaaacaacttatatattagaaatacatgttcacatttctaaaaaataaatgtaagttagaagttactcactgattaaaaatatgaatataaaaatactatttcggttatggtactttcaccgtacaaaggtaatttttagaatattagaaagcacgtaaaagaaggtgttgcatttggcttctttttctgctaccttacctattactacacacttattgtctttagtaggaaaagatgtaagtatatttttgttaaccagggactaataattcaacaatatgtatacatgttcaattttcaacataaatgaaataggactttttcaatgatgacaatttaaggcagaaaaagcagagacatacttgctagccagatgtctaccacaaacacctttaaacctacaaagagaaagaatcacctgagtactttagcctcaacatttttccaaatgcccattgtctaagtaattatctactaaaatactattttggaaatataggagctaccctatttattctgtagctacattataattggttggattcaagtgctgtatctgaaacaaccccaccacccccaaattttctgcacaggtctcttttcccaaagcacatatatggttaacactgtttatttattgactcaataaatatttaaagcacatttactagccagacactgttctaagtgtgggggaatacatcatgggaaaaaaaagaacattaaaactgttgccttcattgaatttgctatctaatagggagactaaacaaacaagcaaatatgtaatacatcagagagtgaaggtaatgttatggaaaaaagtaaagaaaaaatggaaagaggttataagagagttggaaatggagtcacagttttaagtcagtggttagtggtggcattactaaaaaggtgctattcaagagaacaagtatgtcagaaaagaggagatttgttgggggatgaagtctgaaatttgaaggaaaacagacctaaagccaattccttgaggaaaaaaaaatggtcaccaagtaatacataaaacttcactgtaagtttagaaggttgcaaaataataatataaagctatgcatataagataatttccagtctagctgacatctttgcttggtttttcaactgacttttagtctagtcacagtcaaaattaatttctgctctttcaccatctccagactgctcaattcagtctcctctgtatcaatataaatagtaagcccatcttcccagttctgaagccaaaaccttgagttgtccctgactcctgtctctctcattcccaatatccaatcttttagcaaatttagttagttttacctctcaccatatatacacaatcaacaacgttcaacctccccatttctaaaatcctggtctctgtctccaccatttttcaccaaaataatagcaatggtttttaactttctgcttcttcctgaatcacttctcagactattttcaacacagcattcagaaagactcctttaaaacatgtcatatcatgattcttctggcttcaaacccctccaatggcttctcattctactcaaagtaaaaggcaaatgtcttatgatggtttatacatcatctggaccaggcctcccttttagtttcagacttctattactgctcacttcaccaacattcacctccaaaaacattttcttctcagaacttctctgcttgctatttcttccactgtaaatgcatcgatgagtagaaaactctgtttaaagaatggatggcaggctaggttcactaagtagcaagtaagtcacatatatcacaatataccacttaaattcatgccttggtggcattataaactactaaagatatagaactttggtttttttgtccatgttataaggtggaaaacgggcatttttgaataccaacgttctactctataaatcaatggaagaggagagagatttaggcttaaatcacagaagttctaattgttgcaaaaatatacttgatgcctataccttccctcactctaaaatatacttcatcattggtgataagaaaattttgacaacggaaaaactaaattaagaaaaactataataaaaaagatatctttttaatttttaaaaattatatactaagcaattcagattagctattgaatattaatttttacatagaacttcccagtaaccaaagcaggatgaaaatgtacatattttaatgaagctccactgtctgataagtaagagcatattaagatatttggtaaaaatctttcccagattgaaatttcaagaagcatttattaactcgtatataagaagttttggatactataatatacagtgttttaaactttaatttttctctgtctagatttttatacagtgacttataaaattaaagaaatgacactaaatttaaattcaagtaaagaacttaaagatcaaactgctcaagtacactactttacaatggatagagatagagcctagtgcacttgacatgtaaaaatccaaaaggagtgagtaaactgtcctttagacagcttttcagcagaagtttttgttttattaaatcaataggggctaaagtataaagaaagctttatgagaataaagggagttgggctcatctagaagaacttttgaaaggaagtaaaaaagacaaaactagaccattctgacatggaaaaatcagaaatataggctcagggaaaatcctaactctctgtcagaaacacaaggatcattgtagcaaataaaaaggattgaggttctatatcccttatatggccaggaataaaatggcgtagtgaaggacttcggcaaacaagcagatcaattaatatttacactagctggtactaaattgaatatttcagtgtagtgtctaagaatttatagtaagatttatctggcacaaggagttacaactgttggaagaaaaaagataaagaaataaattcatgtaataccctaggctcaatatattagcctagggtgtgcttttggggcaagatatcttacaaaataaagcctctccttatgttctttcctatatgacgtgattcacatatgaatctcctctgtactaagtagtgtcctacgttctgcaaatgtagtgctaaaagaagacaacatgtcccctgctgtaatggagtttagaatttagcagggagaaaaatccattatataggaaattatacagacacaatgaatatcaaaatgtgagaatccacatgtaatggaagattattggagggaaactatctcagacttgcgtatcagagaaggctgggctaatctggaatcctaatgatgagcagatactagtaaagggaaagagggggcagcgtaggaattgtgtttctcagagataatgaaatggtgtgagggtgagcctgatggttgtaagacctgagatttctgcacgaggaggtagcattgaagagaaaccggcaaaatataatgcaaatgagagcagaccctgaagttcctttacagagggcattaggagattggatttcatgctaagggcaaggggtgacactaagacctaaaagggcttttatgtatgatgatagatgacagatttttcactttggaaatatcacaggagcttaagtatggacaatggaagtttacaaaactgatggcaggagacaagttaggaacatgctgcagaaatctaggtgagaggtgccggtgcctaaactaaaggagggaccaagatggcatgaatgttcccctccgcttgaaaacggctttctccaagttgtaaaaccatctcctgttataaagaaaacatttatgagaagttttacgatttctttggttaaaggcaattagcaaatttgatggactataatccctctcaccatatctctgacaaatctttgtttcagcagagttgagctcagaatgaattctagcctttgttccattgcaaaagccttgaataaagtcttcctctcttatttaactttggtgcaattcttctttgacagtggtgatagtggagatggtgaaaaatggacaagttcagaaaatacttagaagagagtaaaaccagaacatgttgtatgattagctatgggaagactcaaaaactattcctgagtttagatttgtgcaactgaatgtacagaggtgccttaaggaatgtaagagtttgagtagattagtggattaaggtggtgcatttaggtttggaaacagtgggatctacagatgcctgtgattatttcaaggagaggaaatttgtaggcctcccaatatatgtagtcagagctgaaaagacaggactaggctagaatcacatgcctacatatgatatttgaaatcttgggattatgtgacaatgtctaagaaaagtaggaagagctggaggactatagggcttatatgagaactctaataaaccctaatgtttaaaaatagatagaggaaaaggaaaccatgaaaaatatgaaaaagatcacccagaaagataggagagcagagttactgccaaacataaaattgaaatgatagtaaccaatgatgagaaaatgtattgcctgctgtgttgctgctgattaatgaaattttatctatattgattaaaactgttttttataataagccaaattagatcatgaagatggtaatgaggtcatgtgtcccaatattctgtaaggtaattccgtacaaatttgagttattgagagtatatactgataataattatggcctgttaaaatgtttttaatttttagagtaaaccactcatccatggaattgtttttctatttcatagtgaaggatattcaggtaactgcatgtaaacaagcaaaagtgaggcagtttttcctatcaccaacataaagtttacatggcattttttttacactaagaaccatcgcaagtattttaagatttgatatgctccagttcatctgttgctattgacgttttgaggttgtgtccagtaacctaggcaactgttcttatttctgtcctaaattacttctatttatagaccttatatagattcaatggccccagagattttctctaaggcagggcaggttgacaaactatatgctcttaagtgaatataatgttaaacacatgacagaccttagtcatcaagcaaagactgcatattacaatttctgtaatttggggtcatcagtatatatgacaaataatgtatctttaaaaatgtagtataacctggtcacaatgaaatatgaaatgactatcgttgaaattataatatttaaatgtcttgtttttaatgttctattcattaaactcaattccagcaattagaactagcagattcaaatatccttaaataaaaatcttacccagtctaattcagtgctaacaaattccttttctcaccactcacctacaagacactataatcaaagtttaagttgtgtgagacagaacaaaacctttgatttagtatttagaccttattggatttcaagttgtacaggcggaggaaagaatgactgtagaatatgttcttcttgggcaggggcaaagaaagaagaggtaattataaatgactacttgcagaactatctccaacatgcatccaataaatatcagaatgagatgtatttttttctctttttttaaaaaatcattatacatctagaaaaattaaatgttgtttttttcttttttctttcttttcttttctttctttttttttttttttaggcagtctctcactctgtcacccaggctggagtgcagtggacacaatctccgctcactgctacctccacctcctgggttcaagcaatcctcccaccttacccttcctagtagctgggattacaggcatgcattgccatgcccagctaatttctgtatttttagtagagatggtgtttcaccatgttggccaggctggtcttgaactcctggcctcaagtgatccacccacctcagcctcccaaagtgctgggattagaggtgtgagtcactgcgcctggcagaaaaattaaaaattgaaaagtttaagtcctatgcaactttatgagaactgacagagacagaaactaatggattaccaagctaccaaagttccacaaggaagaaaaactcccagtgcagagccaggcattttactaaatggtgagggaaataagaacttgacaactattgggtcaacttttcggtgatgttgcattaacaagagttgcttttttggatatctatttcagttctagcttacttttgtgaatacagatttacataaacttgctggcatcattaagaatcacaatgccttcttccttttaatctcttaaagcatttcttcattagtccccttcttgaggcaaaaaataatttcaaaagacttctggtagtaaagtgtccatgatgtcaaaaatacttagtaccatgaaacaggaaaccaagtagtcccatatcaggagtcagagagatttgtatttacaaagctccctgagctactcaataaaaagtcaaagcacatcaggagcacacaaagatctgcatttttcatgagattcattttataaaaatcaaaatttattgttcacttcctatgtgccagaaaccaaacaagaattttcacatatctaattgaatcttcaaaaacacctataaaatagatattattattatcatcatcatgattttacagataagaaaattgaaagttagaaatgtaactttatgaaggtcatatggacagtaattggtggaactgagatttgagtcaaggtttatgtgactccaaagtccattctcttgacttatacattacagtagttctataaaaggcaagtcatttgctcacctattctattccccaaactctctttcaatcaattttatgaagagcctttttaaacccacagttattactcaggtaagtttgaggaacgttcagctgccaccctgctgcaacttaaataatttcctaagtctctactacgactgctgcccctattgcagaaaataaaacaggaaaaacttctagaaattagaattctcgttttattgaaacatcacacaggccaatgtgatgagacaatgactaaggagcaactgcctttgctcttctggattccgtggtgggaactaactttggatcctcaccctgcaggatcccctgctatatgaccctacttgcccaatactccacttcatcaaggtgaagtgacccaccaagagagactttcagggtctgggcattaccaggtagtttctaaatggtaatcaacaagccaattttgctattgatagaagattgtaggatggggacgtgtagaaatttgcaaggtttaaatacatctaattttaaggtttgtggtcttcagtttaacaaaccatctttctagtacagcaatttataatattgactctataatgctggctgttgcaatagtagatcaatgacaatattaagggatgatgagactattccagtttacaagtgtgctgtactggaaagagaacatgtttgaggccaaaagacctgcgatttggtcccagttaatatggcttgcataaactacttaaattttttgtttcatttcctaattagtaaaaccaaacggaaaagataacaaaaaataagctccagggctttttataaataagctaccaatttgaaaatgttctgtaaactatgatgtgttaaacagtatcaggcactgctctgtttaaatagaaaatatgatttagtctgtatgtcatataacattttaggaagcttttaggacttacaaacatcttattaataagtttagaaattttattctcttttaaaaggtgtattttcatgtctcttttgaatttgagtttttcagataaaagatgcctattttattctggctgaaagcatgaacagaataaacaatgagctctgtgaagaatgttctatgaacccgaatcaaactcaaactcctgtgtcactccggtacgcctgatcactggatataaccacgtattggtccagtgagtattcatgtttaacaattaagataattactgatttccactgctatttccattgtcacttcgtaagtcatgcattattggtcttttaatattttgttctcattgaccacagactctaaatcattatatgttagttacagacctttacaatgcctactggcatttgccactggtgacaacaataataaatgatgttgagctgaagctagtaggaatgaatacagaaagtaaaatgataataaataactgtcactccattactaaacagtgcctggttctagcgcatgtgcaatacagcagagtctgcatgatccaagaactaaaaaggcatttactctttagaaacagcaacaacaaaaaagaaatccatttactcatcttgtgctgtgaccccaaattccacactgagcatggcatgagtatttaaagacttctcaacagaatctccttcaatatcttatagtatcttctcaaagtgagagtgtgtgtgaaatgtgccaaaagttacactcagtgcaatggatatgaaattacagcaattacagctagaatgtgacaataatgtctcagatggataagagattgaagatataaatgtcattttattattataaggagtatggaacacagatattagtataaagaatatgggactcaagaatacgagatgtctggtagatattgtaaaacctatctaaatataatgttggttcttgttgggtgatttgggtggggaccaaatctgagctatccttttccttggccatctgtctcataaacttaacttatgagagtagaatctgttgtaataaactcacaaggcagatataatgtaaggggtgttattggtaccaaattatctacaatataaaataatttctcttcaaaatttaaaggaaaatttgtgtcttccccttgtcagacagctgtgacatcctttgctctgtcctctttctcattccattaatgatacatcaggtttattgctctggtggtggtctatctgtttgttttttagtaaaggacttatcataactttatttcctaagtaaactgacatgtggcaatcacagaaggtctgagtctgaagacataatcctcttactacacaagttacataaatttgagccttagtgatcttattagtaaaactggaataatattaatatagcaaatttaatgtaaaaattaagtaaataatatatatggagtaattttcttttattattttcttccaataagcagagtctgagattggaaggtagtttgttttggaaatagatattagtaaacggaactgggagcctgggaagaacgaatcaggaaagaaaggagagccagtctaaagacacagtatcaacatggttactacttgatcctactggggaccctttcaggttctgtggaaaatgcatttccaaattgtccatcttagaaacagaatagggttattggtcaagagttgctctatgtggggttcgtgcctcatataaggttgtatatgtattatcatgactgagcagttatcagagggattccacatagtagttgctagggagccccaatgcaggaagtgaataaaatccaattatttgggatttatgcagaggatatttataagagcagagagtagccaggttgaatataatgttgccaccagtagatttcgtggtcagggatctatcttgtcactaaacagtggtgaggttttcacccagcggcattccgaatgaactggattgtctgagaactgtacgcagcagaacactaatgcaagatgcagagcagtttcagggtagtttccacaacattagaagcagtggcttctatgaaaaattcttaagattcagaatcatagagatcatcaagtttgtaacctataatgggcagccagtcatctagctggcctggcctatactttggaccaagaacaaaaatacaaatgaaaatagtagtaataagaagtttaccatcgtatataatgtggaaatttttgaaacacttccatatgcattatcttatttgaagttaccagtgatgctgtgagaaactatggtattattcatctcatttttcaaatgaataaatttggttttctaaccaagtcttcatcgtctacaagtgctaagccagaataaaaactgaggtgtgtttatcctaattccagcattctaaaaagagccttaattttaacaaaatttcctttggtcaattactttgcaagccttgacacctacactttaccttcagtggcatcagcctgagtgaaccacgcacccacttccctgaaagcaagagcaaagcttacttttagcaaaatgtatttccaattcaatttccactcataagatgtgatctctaccaatgatgccaactagatttgaaggaaactaaatccagatgctgtgtgaccctagacagttttcaacacaaattggctagtagagggctgacaaataacccaaataatctgtaagaaatggaaactcaagaaagtagcatttcccaatatattaccaaatactatctgtctggctatgtgataatggtgtctactcaaagaacattttttctccactgaaatgaaatattcctattaccaaaatttgagataagcaatgtttctgataaaacacaggttttattttcttggctgatatatattatttctaggcaatctgaatgtctgaaaacatggaactttcccaaatttatcttttcccatattatgttttaccatattttctgtattttatagtaaatgagaaaatacttagcgcactgtaaaaacaaatatgtagatgcaagatattattgttaataaaaagatatagttaagctctaatgagatagctttttaaacattcatttcacatatgtcaaagtagataaacaaacaaaatattttacataatatgttgtgggattttaaaaaggcaatcaaaaagaatagtagaaacagaatgtgactctctgcatctgtttaaaattagatatttttcagtgtatttatcttatattacattcttagggaatagaaatccaaaggattctaggtaaaatttggtaaggactaaagttgttttttcttcttcaaatcagtttccacaagccatagattacaatagaatatcaaaacatgtgaggaatatcaacattttttttaaggaaatgtgcactaacactcattgtgacatggagttaaccaaacgggtctttgcttgaaatgtttctgcagagcttgtataacaatatgtctacaaaaacagagtatgcgccagcctttcaatataagtgcttcaacatcagatacaaccataagaggccagaaaacagagggaaaggttaggaatttgcttccatctccaaattttatgtcaccgaatttaactaacttaataataatattaataatgatgatcatgataatcctactattgttgctgctgctattactactatgaatgatagtaactaacagttattgagaagttactatgaactaggcactatataagtggtctgttagttgactcagttaattcccacagtaatcctcatatgaaggatactattagtatctctgctttacaaatgagggaactgaggtacagagaagctaattgactttcccaagtaacactccagaaggaggtggcagatgcacatgcattcccaggaaggcttaggcactgtgctgtactacgtgggtttcagatccaaggtttgttgtctggtctgtagttgcaagcgataagtggctaggatgccaaactttcacagatacccaggcactgggtgggagtaaagtgaagtacaatatctcagagtaattcagaaattagaataacatatttggagttgtgtggtggtggtggcagtggtggtggtggtggtggggtgtgtgtgtgtgtgtttgggggcaggcacaggagaagttattgtagagaaagaaaagtagattattgactcagacgagttttcttctccactagaattcccgagtatatttacaacttcttcgtttcttttttctagtctaagcaaacatgtacatatttcacttttatattcccatgactcctataaagatcaaaagcagtatggagtgattcactacatgacctgaaatggacttactgtgagctctcaagatagaggaaaataattcccctcatgtggtttcccttaatgctaaggcttttctccatgtgcttcacagaactagctccagatccaggagtcccacccattagaggctgcctagattgacaaagggagggcacagccttcagtgacacagtacatggttctcccaccagttgaagtgacataccctatcagttttcccttcggtctgaatgctggtgtgactgcggacctcgtgttcctcttcaaggtcagaaacatcctccagttcctctggggtctataaaaagaaagcaaaacattgctagtgggaatgtaaaagcatttcttctttggaaaacaacgcggcagtaccttaaaagggtaatcataaagttaccatatgacccagcaatttcactcccagttatatactcaagagaaaggaaggcatatgtccacacaaatacgtatacacaaatgttcacaggagcatcagtcatgatagctaacaaatggaaaccaaatgtatgcttactgatgaatggataaacaaaatgtggtgcatgtgtacaatggaatataatttggccataaaaaggagcaaaatactgatacacaccacaacacaggtgaaccttgaaaacatcatcctaagtgaagggagccagccacaaaaggccacatattgtatgatcctgtttacatgaaatgtctgcaattggcaaatctatagcaatagagatttaattagtgtttgctaggtgctaggggaaaggggaaatgggcaatgacagctgatgggtatgtggtttctctttgagatgataacaatgttctgcagttagatagtaggaatgatcacaaacccttctgaatatactaaaaaacactgagtttcatacttcaaaatggtgagttttatggtatatgaattatatcccaataaattgtgagagaaaaagaaagcaaaaaaatgatcacagggaaaattttatttcagtgaatagcaatttggctacccactatgtggttactgcaaaccaagatgcttacagttgataaatgcattagataatcatcattaaaatcatatatcatcaaaatgccaccagaaattatcaagaaattaaaattttagggacttaataaataattcaacttgaaattcagtgtctattataaagagttagctaacttccattccttctttcaatttcagcttaaatgcctctttctcagggaggtgtcttgctcaggaatcctctagactgggctggattccctgccaagtgtttcctagccccctctactttatctgccataatgatcattatactttaatatatcatcgctgaattaggcagctaattgttgaattgtctattctgtgaggcagggacatgtcttccttgtcatttttgcaaatacatgtcaaagtgcttaacaagaattagcctagtatttgttttagtgcacaaggtctcaacttaatatattttttttatttcaatagctttggggatacaagtgggttttggttacacagatgaaatgcatgaatgtgaagtctgagattttagtgagctcttcatccaagtagtacacattgtgcccaatatgtagcttttcattcctaatctctctcccatcctccctgcttctgagtctccaatgtccattattccactctgtatgattcctttgctacaaaatcctggtgacaaacccagaaaataagtatttaggtttcatagaaaacaaccaaaaacgaagtagaagatgtccttgggcctgcatctttcatgcacatatggctgctgaagactggaaatgggcagagcccatctccttagactagctctggtttgccttaaacgttgctttacacacagacattctgtttattgtcagggctgccaatagcctttcatcccttgggagcactccagagatggggacatttgatgattagctcatattatatagcaaaactaccaatttcctattcattaatggcttcagattctttctcatctcatagatctttaaacagcactttctttgttctcacacacttgcactgagcaatacccatccctttgcagaagagcattttgcatttatttcaaccaattcctatcagatattaacatcccccctctcgccaaagccttcaatgtgctattttttatctccgtgttgatctctttgcaatccttctttgctgcaactacatgcagctattatctcaggacaatttattctttcttcttaggtattaatagcacaagttcattacgatgtaatttctatacaatcatatatcgcattattagcctttttgtgcattcttgtcacagtattcttgagaaagcatctttgcaatttccctccttgttatatcaccaggccctataacatttgaacaaattcagttaatcaaattctctttcttgtgccctgttgttttgcaactgaaggctgtctggtgtccctactgtgatctattccttataaatgtctgctgtttattacttgggttatatcctatcatgcaatgacaaataacttcatcatccactcctatagtttattcaacccccaaataaagtaacaaactaagaacaattgctgctatcagaagtcacaagtgccatttttgttggggatgctgtacgaagagataagcctaccatttacacccacatacttctgtgtttttctttgtgtttaacacaggattaatagttttcttgcaaagctacaaaaactgacctcttcttttcatgaacaaaatcagtggggaagtgttcaaaacacttgctggcagcatttcacattctgtaaggcatggtgttggatggtattgtgaaaataaatagttaaatacaaaatgctacagtttaagtggaaactaagaaagagaaaggagtactctaataattttgagggcaatacattaactccttcagcactaaacacaaataatagaaacagcaaatatcccagcactttgggaggccaaggcgggtggatcacctgagtcagatgttcgagaccagcctgaccaacatggagaaaccccgtctctactaaaaatacaaaattagctgggcgtggtggcacatgcctgtaaccccagctgctcgggaggctgaggcaggagaattgcttgaatccaggcggcggaggttgcagcgagccgagatcgcgccattgcactccagcctgggcaacaagagtgaaactccatctcaaaaaaaaaaaaagaaaaaaaaatggggtgggaaaggagggatgatagagtaccctagatcatgccttcttaaaattgtctgcttctacctatctggtaaacatctggaagttttgtgtgtgtgtgtgtttgtgtgtgtgtgtgtgtgtgtgtgtgtgtgtgtgtgtgtgtttctaatcaatttcattctgtgaaagattaactatcttagaggcagtgttatatattagaaaggccctataatattgagtaatgcagacctgaatttgagttctggtcctctaatgagtgattatgggcaatatgtgttctcttttaaagtttgtttccctcagaataaaattcggataataatacctaatcccaaaagttgttgtgaggctcagttacactaagatgctttgggtaagagcttagcccacagacctagctggattgtggcaaaagtttatttctgtttgttgcttttcctcttctttctccactaccttatacctcatcccaatatacacctttatatttttattaaacatttatgtaaatttatccaaattttaatcacctttattccaaatttaataattttaatccagtataatccaaatttatttttgatttggaactttggataagccaccaatgtttctgtcctttagattctacacagacattattttgggttgacatggtacatttactagttgcctctagttacagttacctgagtttgattatctaatgtcattgtgctaaacagggtttaatataattacccatgcactgcttccttctaaaatccatgtaagagatctcttttaattggactttaatcatgtctaacagcgaaattatctcttaaactggcctcagcaaagattcactctagcatgattctcagggatgatggaaataatttgtcttctttaagctgggctgtctctaaaccagacaaagatgaagagagcccattttttcagaaaaagtgttaatcaatgcagacattaacgttatttctcatatcagaattgtggagatatatttcatattttcctattttacctctggcttattatggtgtcttccttaggcagcccaaaagtgatttggaataggcttagtttcttcacctgtaaaatagcacaaatactacctaatttttagggttattgtaaagataaaacaagatgacggactagaacattattcggtgactgggaaatactgaattattaatattgtttatgaatattatagattatcattactgttgctatctcacttgattcaagcaaaagaagccaaaaacaaatatagaagttgaagctgaaaacattcaggctgaggtgtttacatagaagccaggacagcaatgacatagtagtaatacattaagacttcagggtcacaatacatttcatatatatatcctttttcccacaaggagttcaatcctttctatagacattatctcactaatcctttcaggatccctaatgaaacaggtggcattattacaattaaaaattcacttgcgcagactttataaatatttaatattaaaatacaaaaaagaaatttgtggttgctaaattttaaagaagagagaaaaaaacacaggaagaaaataaaaaagaaataaaaagtattaaaaatactgtggaaaacaagagtcatgcttggcttcttctcagaattatgtttgaattctaaaccatacacatgacttattaaaaatataattcactggctagctttcactgacttactaaaatcaaataaccaccacagtaatgtcaggagtggtctcgcactcagagaagctcttaggaaacatgctatgaatgtccatcccaagcaggagactaacgtcacatgttcaatgatttcattccagctgaggtagtaacgtaggatgattttgcaatgtcaaaatggagagatcacaattaaaatacatttaaaaaataaaaatatatcaatgacacaatgccaaaataaagaaaattaagacatggcccttgtttaacacacacacacaaacaaacactgaagttcctgccccacacctttgaccatgagactggcactctaccttataaatattcaagaaatcagtgacatttctgttacactgaccccttttctcctcctcaaacatgtcccacttgtcagcactttccacttaagactctttgtgtctttctatttaccccttcttgcagactggatccttctcggcatgggagctcagatgctctctactcagagaagtctcccctggccagtctaactaaagttaacccttttccccatttcatttatttcttatattagtgtatatattttctttaggtcctttttcatgattttcacctaaaattatattttctcttcatttttttcctttttttggcaggtgggttacattttttattttatccctactagaacttaacttacatgaaaatagggatgttgtttgtcttgttttccactcatgaaatggcacatagtatgtctcaatttttctatttcttagctgaataaaggagcaaacaatttaattactgacaagcttttgttattgatcaatttcacaagaaaatcatgggaacatttttgagctgtggagaatgtataatcctttgccttctgtcttttaataagtattgaatcaataattccttgcctaaagaaaagtatatgcaaatattcttgaattttaaaaaaatcctatggaaactagagatgagattttgtgtagagaaaggttttccataagctcagaagagattctcagatgtggaggactaaaaagtttatgattccataatcagtactaacttgccctactccttgacaatccaatatggataaaaaagacttcagagaaaatgtcatccagtaagcccagaacagtgtttcaaatcttaccatagccccgtgccacaaacttgtcatggaaacagtggtagacctgaaagggttacatgggctgggacaatggatgtctcattggcaaccagtgtgggtaaatgacagggtcggtgagactccctgacatcttgatgcagcccaagcctccagagacagacttagcctcaagagaagtgtttctcagtcttagcattgttgacgtcttgatctgaataattccagttgtgagaatctgttttgtgtattgtaagaagtttagcaccaaccctagcttctatctaccacacacatttggaccctctcaagtcatgagatataattaaatatgtttccagacattaccgaatatcccctggaaatttggaggcttaggaatcacccacttgagaaccattgctcaagaattttggctcacttggcccaacataggtagcaggagtaagggaaggcccaagaatgactatatttaaatttcccatgagccaagttaaaaataaatttacttgcaaataagtatgtaaactgaaagtcatatcccatataataacattatgtttacaagacaaaagagagaagacattttagtcttaaccagactactggaagaagatatcagaaaatgtatgaaaatgagttaataggtgcagcacaccaacatggcacatgtatacatatgtaacaaacctacacgttgtgcacatgtaacctaaaacttaaagtacaaaaaaaaaaaactacaaacttgcttgcagccttttttaaaatttgttttttaaatttttaattgataattgtatatattatatatttatgtagcatactgtgatgtttacaacagtatatattaacattatgaaatgattaaattctaattaacaaatctatctcttcactcatgtatcatttttttgtggtgaaaacaatattcaaaagggtctgggcacagtggctcatgcctgtaatcccagaactttgggaggcaaaggagggtggatcacctgaggtcaagagttcaagaccagcctggccaacatggtgaaaccccgtctctactaaaaatacaaaaaattagacgggtgtggtggcgtgtgcctgtaatcccagctactagggaggctgaggcaagggaatcatttgaacctgggaggtggaggttgcagtgagccaatatcatgccactgcactgcagcctgggtgacagaatgagactctgtctaaaaaaaaaaaaaaaaaaaaaattcaaatcaatatgcctaagagatatctgcacttccatgttcacaatagctaagagatggaagcaacctaggtgtctttcattggatgaatgaataaagaaactgtgagctctccctctctctatatatacacacacaaacatatacactcagtgaaatactatttagcctttaaaaaaaggaaattctatcatttgtttgtcatcttaataccagaatttaataagctgctttcattctgctgatcttgtttttatcttttattcataatgagattatctaaagatatccagtgctaatctaagtttgcttgattatataatcaactcaagttaactcaactaacatattcgattgtcttacatatacagtcatgttgcttaacaatcaggacacatcctgagaaatgtgtcattatatgaatttgtcactgtgcaagtatcatagagtatatttaaacaaacctagatggtataacctactacacacctaggctgtatggtataacccattgctcctaggctacaaacctgtatggcatgttactgtactgaatactataggcaactgtaacacagtggtaaatatttgtgtatctaaacatatttaaacatagaaaaggtaaggtgttgtgtcacgatgttaagatggctatggcatctaatatggtttggatttgtgctccggacaaaatctcatgtcgaattgttatccacagtgctgagggagggacctggtaggaggtgattggatcacgggggcagatttcctccttgctcttctcatgatagtgagtgagtttccatgagatctatttaaaagtgtgcagcatctcctccttggctcttttcttccacctcctgccctgtagatgtgcctgcttccccttcaccttctgccatgattgtaagtttcctgaggcccctccagccatgcttcctgtacagcctgtggaactgtgtgccaattaagtctcttttatttataaattacccagtcttaggtagtgctttataggaatgtgagaacaaataatacaatgtcattaggtgataggaatttttcagttccattatagccttcttaggggaccattatcctatatgcagtccatcactgaatgaaacattgtcatgcacggcatggccgtatgtagacaggaacaattatgctagatactgggaatcttgaaggaaataaaacacaatccttgccctcaagagagataaagggtaagaatattagatggagatgaaagatattccatagagttatatgatttgagactgaagttgagtggttagagatgaaaaaatttcctgggatgtgtcaggcagaagagaggaacgagtgtaaagcacctgaggaaaaactgggaagatatttcttatatcgccagaaagctggtaggcttgtgttacggtgggatattaatggaacttgaagttaggatacttgggtgtcctaactaaactagttgttttttgttaggccaatctcagacttttcctatgcttaaattccttgacctttaaaatgaagatgagaagtaagtaaaactgataatttttgtaaatcctttgaattttcagtttttatgaattgatgcttaaactgaaaacataataaggctgtgacaaacattaggctggatcaaacacctcctcaacactgagagatctcaacgctagtgaagattcggtaaatctgttgagttcagttgattgaaacatagtccactctaattcatcacatcaattcaaaatagggttaatctcctgaatacacatatctttctgttatagccaccagagggagaaggcatctagtattattctcagttttataacccaagtgtctaacggtgcctggcacacagtcagtactcagtaaatacatattttattgagttaatgcaacagaagaataaatgaagatgcaaataagatgtatgtctctatttgtcaaaatcaagaattggtgacttttcttcttacaatcttttaaaatataattcaaaactgcctccaggaaccattagcatccctctattttgttattatttttctttacactattattatcagtattgtattaacatttaatatgaaatctacccttaacaaatttttaagtgaataacatagtattgccaattataggtacaatgctgtatatatagtaggatctttatttatttatcttgcataattgaaatttcataactttggagcagcaactcctcatttcccctcccctcagcttgacaactaccattctgctcatggtttctaggagtgtaaaaacattagttacctcatataaggcaaatcatgcagtatttgcctttctgctaatggcttacttcacttagaataatgtccccaaggttcacacttgtcgttgcatatgactgatctcctttttttttaaggttgaattgtattccatcttacaagtttatcacattttagttaccctttcatctgtcaatgaacacttagattgttttcacatcttggctatcgtgaataatgccgaaataaacatgggagtccagatatctctttgagatcctgatttcaattctttgggacatataaccagaagtaggattgctggatcatatagtagttctgtttttaattttgagaaacctccatactattttttaaagcagttgtaccattctacattcccaccaacagagtactagggctccaatttcttcatatactcaccaacacttatcttttctgtggctgttgataataggtatcctaagaagtgtgaagtgatatctcattgtattttttttttcatgtccatgatgattagtggtactctggctctaagttatactaagcttgagatgaattcaattttcacctatagcatgcatagaagtgtgtcagtggacctgcaagatgttcctaagttattcttttttctttaattgtttgaattaagctctacgaataagcacacctactaaacatgctctgagacagagctgtgagtttatatcctatttccaaattaggaacagaaaatctatggtaagtgacttgcaaaacttcttacaacataaggctggaactatggtagaacataatatctaggattgactatccagattcaaggtcaaacgctgcccttaatatcttgtgacctaaaacaagaacttaacttgttgagaacacagcttcctcagtggtacatgaaaagattggactaattatttataaaatttcagtcatttttattaactttagaattttatgataggtttagcaaggtatcaggaaagataatgaatatctatttcagaaaactttgtattgtcagcatatcctttattcaacatgctgaatacaattttagatcacaaatctcttatagattgttaacttctcaggaaattagaaacagctttttaaacttcctttatgcaggactatgtaggatgatgtgagggttcttcacgcacagcaattgctgatgccattgacaattgtggcaataccattactcttcttgatctatggggggaggtggttgaaaccatgcaataataataagagcagtagtggggggaatgctaaaaatggtggtggcagcagtagtagcaacagtagcagcagatggctagaaacacaccctgaccttcaactcttatgtctgaatgtcggatcaaaaatcagaacaccggtgccatgaatatcagacctattccaatttattttagtgaggaaaatctcacctttttcatcaaactctatagccaaataaactctacatatgtgattttttttatcttatccttagactagacagtaaaagggagtctaacttaaaatttgttcatttttcttttccaaaaatgctattctatagatattaaaataagagtttcagagaatgtctaatagcagagaaaatgcacttgaaatattgttaactgaatatctgtatatatatgtgtgtgtgtgtatatatgtgtgtatatatgtatatgtgtatatatgtatatttgtgtatattcgtatgtatatatgtgtatatatgtatatatgtgtatatatgtgcgtatatgtatatatgtgtatatatgtgtgcatatatgtatatatatatagtctaattatttaaaactcatattgtccgtgtatgtgtgtgagaaagaggaaaataaaatgaaaaatatatatatatcggttgggtacagtggctcacatctgtaatcccagcactttgggaggcggaagcaggcagatcacgaggtcaagagatcgagaccatcctggccaccatggtgaaaccccgtctctactaaaaatacaaaaattagttgggcgtggtggcacgtgcctgtaatcccagcttctcgggaggctgaagcaggagaatcacttgaacccaggaggcagaggttgccatgagccaagatcaccccactgcactccagcctcagcgacagagtgaggctccatctcaaaaaaaaaaagaaaaagaaaaagtaaaagaaaatatatcaacatattttattaattatcatctatgggttgtagaatattataagtgacttttcctcttttagttgatttgtctctaagttgttacaaaacatttttctatcttttatcataaggaaaaaaaacaagcaatgagtgttataggaaaatctgcttaaggttgaacgtaccatttcaaggacgtgtcagcaatacaaaaaggacaagattgcaaaatctgcagtggggtagtatagctggccttgtcaccttgcaataggtctatcaacgttgcatgatatttgaagctgatgtggacacagaaaaaatctttcgattgacaagaggaaaattgcagtgtatgtctttattatcagagcaaacattaaagggggtggtgacagcagatacagagaagtgtcccttaccaggtcccatgctatttccctgttttgtatggtcttttttgttctgtggatgcgtaaaagctgttacttcattattttaggtattacattttcagtgtcttggaaagtggttttacaaaagttttccataacaaagattttgagggaaagagatgttgtggtttgacttcccaatggggaatatagatagatagatagatgatagatagatagatagatagatagatagatagatagatagatagacagatagatgatagatagatagagatagagatagagatagagatagagatagagatagagatagagatataaactgacacgatgtcttttactttcagaaatcgttaagctgccaggtatagtatcaacaatcctaaccaaattcatctggttacatttgcaaagtaatcctaggcacagtaataaagcaaaaaactgcctgctgtgttccagccacggatgttaagtaaggataagcaggacggccaaaactgacactcctatttcactggtcaaaaaaaaatatgaaagaaattacacattactgtaggggggtgttgctccataagacagtaattcagatctatattagacttttggacatattattcaaggttactggattgaagtttgctttatgggacataagaattccctacactgctaaattaaagtagcttaagttggcagcttatatataaaatagaaaactagaatgcgacaaaacaaatatttggacaacacctaaggaagaattatgctctgtatttaaagagatttttaagttccaaaactaaaaggcctatttgtagaggcaagtgaatacatcattgtataagatgtagtcagatataagtggctgtgaaactagctcatggcaaatgcattgtgctgtttctacacagacttgtcctgaccaaaggaattaggacaaatgaggaaacaaacttaatgtggagaattgttttttttaaaatgtccatgtatttcttaacatattaaatattaaatatatacacaccatagaatctagtcattctacttgttagtatttaccaaagaggaatagaaacacatattcacacagacttgtatacaaatatttatagcagatttatttgtaatatcccagtagtgagaacaactcaaatcttaatcaacagatgaattatttaacaaatggtatgcccatttaatgaaatatgattcagtaataaaaaggaataaatttgattaaagcaacaatatttatggatctaaaaataattatactgagtaaaagaagctaaataaaaacacatactgtatgtattagtctgctctcacactgctatgaagaactacctgagactgggtaatttatgaagaaaagatgtttaatcgactcacaattccacaggctgtgtaagaggcatggctggggaggcctcaggaaccttacaatcatggtggaaggtaaaggggaagcaagcacatcttcacatggagcaggagagacagagccaagggggaagcgctgcacacttttaaacaaccagatctggtgagaactcattcactatcacgagaacagcaagggggaagtccgcacacacgattcaatcaccacccccccaggcccctcctccaacacatgtggattacaattcaacatgaaatttgggtggggatacagagccaaaccatatcactgcatgattccatttatataacattctaaaacttgccagtcaatctgtagtggcagaaatcagatctgtggttatttgagagttggtgggaggagtgaacagattgtgaaggggtatgagtaagcttttgggtttgatatatgggttccttatcttgattatggtgatagccttggggttttatacataagccaataaaacatattaaattgtatattttaaatgtgcattttattaaatgttatgcctcaatgctgtcaaaaatgtgaaatgcctatatgaactcttattacatagtgtaacattgtttggcaaaatactatattatatatgctactaatataatatagtatagctgaagttctgttgaataaatacataaaagaagtagtaatgctacaagatcatttttaatcaattaatatacacacttattttctattttaaaaaatgaacttgattttgcagcaggggaccacatattttgttgttgagtaatgaaagatgagcttcagttgagagacaccttgttcatgagtcctctcaccagaggaacttagagatcaagaaacattgcagcttttagtaagcatgctaccaaatgtaggcttttctatatggatgtgaatgtgaaaggaccactaataaggctggcaatatggcagcaaatgtgattctcctatcactttatagtgtttatgaaatatcaaagcaagtttcatttaagtcaatggttttcaaaagtaatttaagtagtaaaaccatttttaataaaattatagaatgccaatattattgacaactatataagagtactatggagctatcctaagtaagccataacaccacggagctggtgtgtgtggatatacagtgtgaagtctggatcatcaggccactggccctgcccgccttctaaagcagcccaagagagagaccacagctgagggaccaccatgctgtgtaacctgggagagttaccgtcagatgtttgattatgtctgactgaattggcatggaccaacttttagttaaacatggaggatttaagaaaattatgcacctatacttcctcttatatacgactaatttgactatagtttatttaaaaatataccagagttaagtaataataaagcaattacaaataatcattgtaataagtacaggtggcatctactggatttcatcagctttccttatgtctttgctttgtcctatttttttttaggaacctccctctctgttactactccctttggatttatccagtagtcttagacgtcaccagggccaagccatgcatatatagattgaaatgttgttttcaaaacctactcaagctatctcttgatgaacaagattagtaccatctgattacaaccctgaaggtatatgctaaagaaaactaataataacatatactattcttaaaatcaatcattctttttacaacatgaccgaaataagtcccaggcactctttagctatgctctgtcctctcttttggaataatcttttcttcccttctaaccgtcaccttatattcttatctttccacctattcaaagtaatttagtatgtcaacaatgttttttctaacattgttctgtcttagaactttttctccctgcagatctcatccactatgcagaaaccagtaataatcatttgtctctgtaaaggtgactttgttttaaaattagttttacaatgagagagctgatctactttggaaaaggatcactgttatcaatgtggcaagatgaaaaagcatgccatattctatctacttggtttaattgaaccaagcatcagcttggtttaattgaattaaccgcaatgactgtgtttgtgtgtcacactattctttttatatttatatttattattactattttttaagagagacagggtctccctatgttgctcaggctgacctcgaactcctgggctcaagcaatcctgcctctgtctctcaaaatgctgggattacaggggtgagccaccatgcccagccacactattctttttaaatttaaagatataaaacattgatttttattaaattttaaaacagagaacttttaaatagatacagattacattcagcaggtattcatggattacctactatgtatgaagtacagtatgctaggtatggtgggactgtcataaattagatgaggataccaccattatgaagctaatgtaacattgcccaagttctgtgtactgttttattcaaaacttcatgaatattgaaacagtgttcacatttttctatcaacatacagtattatttgtaagatgaaattgttaaatttaattacaaagtgttcagtttggtttgttttgctagacaccctacaagctgttcctattactctctctcactctaatgtttacaaattgttatagcttagtgctaaagtgaacagcagagtactcttcaagattttctaggatcttgcagacaaatgtatacatatattttttactcctcatgctgttttatcactttttgatccctcctaggggattaggctgtgtaattgtaaagcttttttaggctttaactatggattatttgtataatgaaaaaataagataacttatattatatattgaactgagtaaggggtaaattcagtcattcttaggtaaaaagacaggataattaggttctcattcttgtttttcattcgttcatgtattcaatcaattttttttattaaataagcactcattaatatgccagatactgtggtagttgctgatgaggaaccaataaagagcccatgtggtatcaaagggctttcctgtctaatatttatttattctgttactctggaaaacttatttggcatctggtttcatatattgaaaaataaagatagctgtctctgccttctttatgttctatattttacctctttctcattgtaaactttgtatggtcaatggagaaggatgtggattcaactctgaatatacactatgtaaggcacacttttcattctcgtgtgaaactagttttataactcagctcagagcacacagtaggttctcactaaaaattttatcttccttctcttttttcttttctaagatggtagtgtagaagataagttgataccatgcacattcaaataattaattttaaattatgataaaccatggataagaagttgtgtagcattaatcatattaaattccttcaattgtgatgtacctatcttatagggttgttgtgaggaatatatgacagtaatgtaaagtactgaatatagtgccaagaacacaataaatgctcagtaaatattagctatcatgtcattctgacttatgtcaataaatattaagtatactgtctagttaatactgttagaattacattaaataaataatgtagaaaatttgtcctggtccagttatctactgactaggtgaccttaattatgtctttttttgttaacttttagagtctagattccttattctgcaaaatggatttattgtatctcaaggcactgtgaagtttgcagtagtaagttatatgaaaatttttaaagcattatgattataaataatatgattataaattggagaacagctgctaacacaattaagaaatttaaaaatattattgcttttttactttcactcacattttgttttgttagataattgaaaacactaagaagtaacttttagagaagctaggttgtacccagacagtgaaagtttaaataagttttaaaaactgaaaactattttctctttaaaaggcatgtataggcaaaaaggaaagtccaaagagaggaaaagaaagcaggagagatctgaaatgacacaagaagtgactcagaatgggaagattgtgcactccttgttgtcccctaatgcacatggaagtatgcaacagaagctgtgaaaataacccaggtgcgaaggccaatggttttcatacatttcaagcttctctccgtgatgtccttttccatgtaaaatctaaatcaggtgtcctatatacataacatgaaatggagatgtaatgcaactgaagctaggaaacaaaaatcttgcctactagccttctctcaaaccagtgatcagaaccctgagttatttctttgagagactaagtacaacacagaagctcaagcatagaaattaagagttaaaattatgtcaagtttcttcactgaaaaagatccctattagcctttgacctaattttgttaatttataatggaagttaacaatcactaaatgttattgcttataaatctctttacctaatttaaaacactgctagttgtagctagaaataggtatttctttatttcttttagctatgtattccttcaaaagaagctccagacttttaaaattgcaccacctcagtatttcctcagtttctttttttaatacaacatacatacacacacacacacactatcttatatatactagcttaataaatcacatggtattttagaacagatcaaaacttggaataatcatgtgggaaaaaagttgtagccaggtgcagtggttcatgcctgtaatctcagcactttgggatgccaaggcaagtgaattgcttgaggtgaagagttcaagagcagcctgggcaacatggtgaaacccctctctacaaaaaattagcaaggcatggtggcacatgcctgtggtcccaactacttgtgaggctgagttggatagatcgcttgagccctggaaaaagaggttgcagtaagaccacaccactgcactccacctgtccagcctgggtgacagagtgagaccctgtctcaaaaaaaaagttgctgaggtttaccaactttttaaaatatttgctcttagacaaccagtaaaattgtttctggtacaaaagatgttcatggtttccttccaattacaaattaaaacatattgctatggttttgttataaatacttaatcacataaatgacaacttcccacacaaccagattgaaacatgacaccagtgttatacttatcaggcagagaatttaaaatactactcttaataaaggctagaatggaaaaacagataacaaacaaaaggtagtgggtaatataaatagagagatgaaaactctaagaaaaaaatcaaaaggaaatataaaaattcaaaatcactgtaacaaaaatgaagagtgcctttgataggcacatcagtagactagacacagctgagaagagaatcagtgagcttgaaatttgtcattacctacttcccaaattgaaatgtgaagagaaaaaaaattacttaataaagagcatccaaggagtgtggaacaattagaaaaggtgtaacatacattacatgtaatagaagaaagaaaaaagaaaatgaagcaaaagaaacattgaaatgataatggctgatcgttttcagcaattcatgatgtataacaaactatagatagatgaacctcagagaagaccaaacgggataaataccaagaaagtacagccaagcatattatattcaactacagaaaaccaaagacatcttgaagaagtcagtgaaaaaaggataagaatgataggatacttataatcagaaaccatgtgtaaaccattttcatactgctgataaagacataccaaagactgggcaatttacaaaagaaagatgtttaatggacttacagttccacatggctaggaatgcctcacaatcatagcagaaggcaatgagaagcaagtcacatcttacatggatggcagcagacaaagagagagcttgtgcagggagaactcctctttttaaaaccatcagatcttgtgagactcatttactatcatgagaacagtgcaggaaaaacctggccccataattcaatcaactctcaccaggttcctcccatgacatgtgggaattgaggagttaaaattcaagacgagatttggttggggacacagccaaaccatataattccaccccagcccctcccaaatctcagtcctcacatttaaaaaccaatcatgccttcccagcagtccacaaaagtcttaactcatttcagcatgactcaaaagtccacagtccaacatctcatctgagacaaggcaatttccttctgcttatgatcctgtaaaatcaaaggcaagttagttacttcctagaaacaatggaggttcaggcattgggtaaatacagcaattccaaatgggagaaattggccaaaacgaaggggctacaggcaccatgcaagcgtgaaatccagcagggaagtcaaaccttaaagctccaaaatgatctcctttgactccatgtctcgcatccgggtcatgctgatgcaagaggtgggttcccatggtcttgggcagctccgtccctgtggctttgcagggtacaggctccctctcgactgcttttatgggctggcattgagtgtggcttttctaggcacagggtgtaaactgtcagtggatctaccattctggggtctggaggatggtggccctcttctcacagatccactagacagtgccccagtagggactctgtataggggctctgaccccacatttcccttctgcactgtcctagcagaggttctccatgggatccccaccctgcaataaatttctgcctggacagccaggcatttccatatatcctctgaaatctaggtggaggtacccaaacccaaattcttgacctctgtgcactggcaggctcaacatcatgtggaagctgacaaggcttgaggcttgcaacctctgaagccatggcccaagctcgacatttgcccctttattcatggctggagcagctgggaggcagggcaccaagttcctaggctgcatacagcacagggaccctgggcctggcccacgaaaccactttgtcctcctaggcctccaggcctgtgatagaaggggctcccatgaagacctctgacataccctggagacattatccccattgtcttggtgcttaacatttggctcctcattacttacgcaaatttctgcagctggcttgcatttctcctcagaaaatgggattttcttttctatcgcattgtcaggctacacattttctgaacttttatgctctgcttctcttatataactgaatgcctttaacagcacccaagtcacatcttgaatgctttgctgcttagaaatttcttctgccagataccctaaattatgtctctaaagttcaaagttccacaaatctctctagggcaggggcaaaatgctgccagtctctttgctaaaacataacaagagtcacctttgctccagttcccaacaagttcctcatctccatctgagaccacctcagcctggatttcattgtccatatcattatcagcattttggtaaaagccattcaacaagtctatagggtgttctaaacttttccacactttcctgtcttcttctgagccctccaaaccatttcaacctcttcctgttacccagttccaaagtcacttccacattttcaggtatcttttcagcagcaccccactgtactggtaccaatttactgtattagtctgttttcacactgctgatgaagaaatacttgagatggggcaatttacaaaagaaagaggtttaatggacttacaattccacatggctggggaggcctcacaatcatgaaggaaggcaaggaagagcacgtcacatcttacatggatggaggcaggcaaagagagacagcttgtgcagggaaactcctctttttaaaaccatcagatctcatgagactcattcactatcacaagaacagcacagaaaagacccaccctcttaattccatcacctcccactaggttcctccgatgacacatgggaattgtgagagttacaatttaatatgagattttggaggggacacagccaaaccatatcaccaaataagagagtagagtaaattttttgaattgtcaattaggaaaaagaactctacatttctacacacagcaaaattattcttcaaaaacgaagaagaaataaaaactttctcagacaaacaaatcttggaaaattcatcaccagcacatctgcccttcaagaaacattaaaagaagttcttcagtgagaagggaaatgatgtgttagaaacttagatctaaaaaaagaacatcagagaagcactaaatgaaggtaaaattaaatctttttttcttatttttaattgatctaatatgtaacatttgttcaaaataatactagtaacaatatattgtatgattgtagcattgaggtaaattaaatgaatgatagcaatattataaagagttgaggggaggaattgagaatactgtattgaaagatgaccctactacccagaaagcagttttatgaaagtggacctaattgtaaatgtatattgcaaactctagggcaagtactcagttttttaagaaaagtataagttatatgctgacaataaaaaacaaaatagaaaccatatgcaatgattaaaactagagaaggtagaaaagaaaaaagaaatgaaaacaacagaggtaattcatagaaaacagaaatactaataatcactttaaatgtgaaaggtctgcagcatcatttaaaagacagagatgttcatgcttagaatggagtattcttcataaatataaagaaatgaactatcaagctatgagaacacctggatgaactttaaatgcttatagctgggtgaaagaatcccacctgaaaaggctacagactatatgatcccaattgaacagtatgttgaaaagaacaaaactagaggaacagtaaaacaatgagagactgccaatgattcaaggcgagaggaggaggattgaataggtgaagcgcaggccttttttgactggtaaatcaattttgtatatattaatggtggatacatgacatacctttgtcaaaagccatagaaatttacagcacaaagagtaaacctcaattatgtaagttttgaaaaaatcatttaggagggctaggatcctaggaaagaatgcaaagtttgacaacattatttacacatgttctgattgtaacaaataatctcactgtatggggtatggagagggaaaagttgctgatctaataaactttgaaaattaatgtaatccataagactgaagtcaaaaggaattaccagtaagcaatatgctgcacttgataaagctactttccataagggtacaggttaatgattctcataatgttatactagtgtactgaaattaaacagttaggtaaacaaatgatggtgatgggagtcaggtttttcattgttagaatagaagtttatagatgaacaagggaagaaggctagaatataaattcatgtttagctaaatatagatacagatgtagaaacatttatggacatgtggatttaccttagttagtatgcacacatatattcccttgctctgtcagctgtcacctaaaagaaatgacaccttagcagcaacaagcatggctgacactcagattttggtttctgataccattcaccaataaaggggccagggctccttagagaaatgctaattctacgactgggaaggaaatatatagaaagaacctgaagtattagatactgccaaaaaataaggaagaactaaaaaatttaaatctgcaagtacacactgaaagagttgtcaatagccatatctggaataatttgagcagtaaaataaacaaagcaatatggaattctaacccaatgtataaactaaatatccataagtccatagtgatagaaataaatgactgaatatataaataaattgaagaacatatacaaatataccctgaaaagcaattccaagtaaattccaaataattccaaagtattatatagcctgccctcaaggagcggaaaataacttccactccttaactgtgggctacatagtgacttctgtccagggtagagtgtagaaaagggggaaaatggccgggcgcggtggctcacacctgtaatcccagcactttgggaggccgaggtggatggatcacgaggtcaggagatagagaccatcctgctggctaacacggtgaaaccccgtctctaccaaaaatacaaaaaaattagccaggcttggtggcgggcgcctgtagtcccagctacttgagaagctgaggcaggagactggcgtgaacccaggaggcggagcttgcagtgagctgagatcgcgccactgcactccagcctgggcgacagagcaagactctgtctcaaaaaaaaaaaaaaaaaaaaaagggaaataaactttatagtgtagatactacaacctcagccaggtcatcaatgtcaacatcaacagcaatacctaatatcaatacttgaaatgatatgataaaaatggtactttttctcactggtcttcctcccaaaaccacatattcccagactaatcataaggacaaactcacaaattccaataaagtgacatcctacaaaatctcttatctgtattcctgaaaactgtcaagttcgcaaaaacaaggaaagtctaagaactgtcacagccaagaaaagactaaggaggcatgactattaaacgcaatgtaatatcctagatagagggctaggaaaggaaaaggacatgagataaatactaaagaagtctgaataaatcatgaacttaatattacaatgtgcacttattaatttttaacaaaagtactatatgaatgaagatgttaataataagggtataagccatatgggaacgctatgttctatcttctcaattattctgtaaaactagaactgttttgcctgtaattccagtactttgggaggccgaggcgggcgaatcacgaggtcaggagtttgagaccagcctggccaacatggtgaaaccccatctctaataaaaatacaattagctgggcgtagtggcagacgcctgtaatcccagctacttgggaggctgaggcaggagaatcgcttgaaactgggaggcagaggttgcagtgagctgagatcacaccactgtcctctagcctgggtgacacagcaagactccatctcaaaaaaagaaaagaaaaacagttagaactgttttataagataaagtattttcttaattcaggaactaacaaggtagaacattaacatacaaaagttactaatcttcatatacacaaacaataatcacttagtcaatatagagaaaagaaaataatctgtttacaaatgcaatagaaataacaacttatttaaaaataaatttggaaaaaatgagctaaatttctctgagaaaaactttcaaatatgccaggtccacataaaaacctgcacatatatttatagcagctttattcataactgccaaaaattggaaggaaccaagatctcctttggtaggtgaataaatagatatactgtggtacatccagacaatagatattattcagtgacacaagcatgaaaaaaaagctgccaagccagaaaaagacatggaagaaacttaaatgcatattaccaagtgaaaaaaaaagccagtcggaaaaggctacatactgtatgattccaactatatgacattctggaagaggcaaattatggagacaataaagatcaacagttgccagggcttagagggaggggatgtataggcagaacacagaaggcttttagggcagttaaactactttcattacattatgatggtgtttaatgtccaaactcataaattatacaaccaagaatacaccctgatgtaaggtacagattttgggcaaaaattatgtgtcaatgtaggttcaccaattgaaacaaatgtacccactctggtggaggatgttgataacgggaaaggctgtgtgagtttgtgtgtgtgtgtgtgttgtggaggctatctctgtaacttttattcaattctgctgtgaacctaaaaaatagtctgtttaaaaaaaaaacaaaaaacaaaaaaaaaacttggctgggcgcagtggctcatgcctgaaatcccagcactttgggaggccgaggaggacagatcacctgaggtcggaagttcaagatcagcctgaccaacatagagaaacaccatttctactaaaaatacaaaattagctgggcgtggtggcatatgcctgtaatcccagctactcgggaggctgaggcaggagaattgcttgaacctgggaggtggaggttgcagtgagccgagattgtgccattgcactccagcctgggcaataagagtgaaactctgtctcaaaaaacaaaaacaaacaaaaaacttctattaaggtacaggcaagcagcaagctactctcacattgggcctctggaatactggcaggatgaaattcctcaaccaccatggcattggagttgccagggaaagctgcttagagaagtggtaggatcagaactccagccagggtggagcccagagggtttggtgtgggattgtctgtagtgcagcatggccagggacacccatcaccttaagctcgacttgcttccataggagactttagccataggagaactgttgaacgtgaactctgcagggcggtcttgcctctgagatggggttgattagacctgggcaaccctcagtctactggcctcttctggggccccagcctggccgtgcctgcttgcagtgcagcccccaggtacctgtgggtgtctgcatcatagctcctgctcttgtggactgcacctgataagcagagtgctcctgcagagtggcccccaagacacacaccaggccatctgtgtcctcccctcactgcagcctcccccagccactgtgcctgcatgaacacaccataggcacccccccacatcacttagccagtgcctatgtgtgcccttgggttggatcttgcttttacttccccgacagtgcacatgaaccctgcactatgccatgccactactgcctgcatgagggtaccccaccacccttctccccaccacaccaccattgtcctaggagcattggcaggcatgaaacctgcctgcttcacctctgccagcatcctgcccctgtgccaacactgccatcagtgctaaactaggcacacagaacagtgacctgcccccagccctgagcggccaccatgccagcatgaacacatgcagagggcacacatagtcctgcacccaccacaaacatacaacacaccataatctctgggacatagctaaagcagtggtaagagggaaatttgtagcactaaatgcctacatcaaaaagttagaaagatctccagctcacaacctaacattacaattaaaggaactagaaaagcaagagaaaacccaccccaaagctagcagaagacaagaaataactaaagtgagagctgaactgaagactgagacacgaaaaaccattcaaaacatcaacaaaatcaggatctgttttttttttttggaaaaattaataagataaactgctagctagactaatgaaaagaaaagacagaagatccaagcaaacacgatcagaaacagaaaggggaatattactactgactccatagaaatacaaagaatcggccgggcactgtggctcacgcctgtaatcccagcactttaggaagctaaggcaggaggatcgtgaggtctcgagttcgagaccatcctggccaacatggtgaaaccctgtctctactaaaaatacaaaaaacgagccaaaaaatgagcctggcatggtggcacgcacctgtagtcccagctactcaggaggctgaggcaggagtattgcttgaacccgggaggtggaggttgcagtaagcccagatcgcaccactgcactccagcctggtgacacagcaagactccgtctcaaaaacaaacaaaaaaaaaaaaaaaagaaagaaatacagagaatcatcggagactattatgaacaactctatgcaaacaaactagaaaatctaaaagaaatggataaattcctggacacagacaaccttctaagactgaaccatgaagaaactgaatccctaaacagaccaataatgagctctataattgaatcagtaataaattgcctaccaaaaaaaaaaaaaaaagaagaagaagaaaagccctggaccagacggattcatagctgaattctaccagacacacaaagaagagctggtgcctttcctactgaaacttttccaaaaaattgtggaggaggtgccccctcttcaactcaatctatgaggccagcatcatcctgaaccaaaacctggcagagacacaacaaaaaggaagacttccggccaatatccttcataagcattgatgcaaaaatcctcaacaaaataccagcaaaaatccagcaacacgtcaaaaaactaacccaccacaatcaagaatgctttattcctgagatgcaaggttggttcaacatatgcagatcaataaatgtgaactaatgaagaaaacattccatgctcaatgatcacactgcacaaagtaataatttgtagactcaatgttatttctatcaaactaccaatgacatttttcagagaactagaaaaactattttaaaattcatatggaaccaaaaaaaggcctgaatagccaaggcaattataaacaaaaagaacaaagctggaggcatcacattacctgacttcaaactatactacaggactatggtaacaaaaacagcatgatactggtacaaaaacagacacacagaccaatggaatagagaatagagagcccagaaataaggccgcacatctacaatcatctgatcttcgacaaagttgacaaaaacaagcaatggggaaaggactccctattcaataaaaggtgctgggataacaggctaggcatgtgcagaagactgaaactggaccccttccttacacagtatacaaatatcaactcaaaatagattaaagacttaaatgtaatacctaaaattataaaaaccttggaagaaacctaggcaataccattcaggacgtgggaaggggcaaagatttcatgacgaagacactgaaggcaattgcaacaaaagcaaaaattgacaaataagatctacttaaactaagagcttctgcacagcagaagaaattatcaacagagtaaacagacaacctacagaattgaggaatatatttgcaaattatgcaaatattttctgacaaaagtctaatagtcagcatctataaggaacttatacaaatctataagacaaaagcaaacaatcccattgaaaagtggacatgaacagacacttttcaaaagaagacatacatgcgtccaatgagcataggaaaaaaagctcaatatcactgatcattagagaagtgcatatcaaaaccacaatgagataccatctcacaccagtcaaaatggctattaataaaaagtcaaaaaataacaggtgctggcaaggtagtggagaaaaaggaaagcttatacactgttggtgggagtgtaaattattagttcaaccattgtggaagatctgattcctcaaagatctcaaaacagaactaccattcaacccagcaatcccattactggatatatacccaaagaactataaatcattctgccataaaggcatatgcatgcatatgtttattgtagcagtattcacaatagcaaagacatagaatcaaactaaatgctcatcaatgacagatttaataaagaaaatgcagtacatatacaccatggaatactatgcagccatataaaagaatgagatcatgtcttttacagaaacatgaatggagctggaggacactatccttagcaaactaatgcaggaaccaaaaaccaaataccacatgttctcacttataggtgggagctaaatgatgagaactcatggacacaaagaggggaacgacagacactggggactaccaaagggtggacggtggcaggagggagaggatcaggaaaaataactgttggttacttgtcttagtacctgggtgatgaaataatctgtacagcaaacccccgtgacacaggtttacctatataacaacctgtacaagtaccccagcacctaaaataacatttttttaaaactccagaacatacaaaatgtacttgaaaaaaaatagaaaggcaccccatgatctacaaataaacatcacaaatatgtaaattctcctatgttaatatagttgaatcctatcctaataaaaatactacaagatacttttctggaataaaacttgtgggaaaaatatctagccatgtgcagtggctaatgcctgtaatcccagcactttgggaggccaagacaggtggattacttgaggtcaggagttcgaaaccagcctggccaacatggcgaaaccccatctccactaaaaatacaaaaattagccaggcgtggtggcagccgcctgtcatcccagctatgggggaggctgagacatgagaattgtttgaatgggggttggaggttgcagtgagccgagatcacgccattgcactacagcctggtcgacagagtgagagtctgtcttaaaaaaaaaaacaaaaaacaaaaaacaaaaaaaacagaagaaagagagaaataaagcgagaaagcatctaagaatatcctggaaaaaaaaaaagtcgatgaagcgggattagcccaattagaaatgaaaatatacactaggtgatctgaaatcagtctatactggttctcatatccacagcacaatgtaacaataaaagaaagtctagaaataaatctatatttggcaggtaataaggatgaaatctcaaaaatgtttgaaaaaggtagacttttttaaatgaatgaggttaggaaaactgtatactcattaggcttgacataaaatggatgtgaacaacatactctatagcagaataaacttcacatgaatttttaaaaatctaacttaatagaaaagtaacatacagaaatagaagaacatctggataaattatttacatcctcatttgggtaaactctagcaaagactcaaaatgcaatgcaatgaaataaaagattgataaattcaactacaggcatattaaacattaattgaatgacaaaaacaccacagtcaaaatcaaactataaataattagaagaaaatatcgacaacatgcaactccgataaaaagctaatatctctaaatgtataaaaaactcataaaaaccaagaaaaaagaacattaaagtgatcttcattttaaataagaggtattaagactccacaaatatgtcatttccaccctgttagactagcaaaaaatttaaaatcttaataatacactctgttggtgtggctgtggagaaatagcactttcatgcactggtggttagattgtaacagttattttttctaagatacaaatcaatctttggcaatttctataaaaaatctgtatgagaagttcattatttgtagatattatagaaaatattaaaaacaaattacatggtttactatgtagtactaaaaataagatgaggaagatttgtatgagataattagaagtgatattcaagatgttcaattaagtgggaaaaacaagtataagaatatataggtatcagaagcattttctgtatgaaagaaggaaatttaagaatatttgctttcaaacagaaacatagggtagataattagtcattaaccaaaatggttaactacaagatgcaggtgtgaatggatgaaagaattaagaatgggtatcagacttgtgcaagcatgcgtttgtatctgtggtgattttttattcatataaaggtcaaaatgtcacaaaataaatacacatttttaagacagcaaaccataaattaaatataaaaataagaattgatcctaatagttattaacagagaaaaacaaagatttaagtcaaggaaattttgatcacagtactctgtacactcttggttggaaatattataacaaaagaatcttgaactttacatggtaatggtactggtaaaatgattctgaaaatattttgtgtgattgtagatagagtgaatgtttaaagatattgttgtattggagaactagaattcttaatgtaagaagagatactgaactggaatgaaaaatgataagaaaatattcttgatcttatatttgaataagaggtattatttttcataatgcaatatttcttagctagtaacagtaaaagaatgacacctcaattgcaacaaaaacacataacaccgaggttttgatgactaaatataattcttcactacaaggaactagaactgtttggagatatggttctttctggctaaggtaatgtgtgcaatgaacgttgaatattttgttgggcgagaaggcaaaaaaactgccccaaacctagagatcatgactaaaaacacagagaagctagtttaaaagttctcccctaaaaatgtttgggacaaattagctaaaaaaattaatgatttcagtagtgttaatgtattaaatcatttcatcaatcccatctgtaacagtgagagagaaattgaaacagcttttctttgtagaaaaatcacagctaaaacatatagaaagaataaaataaaatcactattttgctaccagtaatgtactaattgattaaagcaagaatcatcaatggatgctaaattcattaggtaaaagtgttgttgaacaacaaggatgttactatgatctctaagtatcctcaagcagataattaagaacaaaagaaaaagtgtttcttcacaatgcggagatattgcagacaccgcctttactaagtaaaacctatctatcattactgaaacaaaatagcttgcatgcactggtgttctgctaaatgtttaacaattgactctaaaacacatgcatataaaaagggcaaaatgcttatataatatttacaaatattaatagaaacgatatgtaacacaattttttttttttttttgagatggagtcttgctctgtcgcgcaggctggagtgcagtggtgcgatctcagctcactgcaagctccacctcctgtgttcatgccattctgcagcctcaacctcccaagtagctgggactacaggcgcccaccaccacgcctggctaattttttgtatttttagtagagacgggggtttcaccatgttagccaggatggtctcgatctcctgaccttgtgatccgtccttctcggccttccaaagtgctgggattacaggcgtgagccaccgcgccaggccacgtaacacaatttacaaataacatataatactctttattgtaaactgcatataataaatcaattctcaaagaatattttcagttttattgccaaattgtcttcaattcatgttttggttgttaagtgatgaataagtgtagttctaacatggatgttggttaatatgtttgtttaccttaatgagtaagaccaacaaaaaacaataaagatgtatgccagaacttaatcatggcataagctactttttactaaattggataatagttttcaaacactaaatagtaatttcttcactttttttttttggtgttacaaggtaattgttatacacacagcaaaatataagtttagtctacattattaacacttttctccatcactttctgacaatcagtatcataaaccatgttctgatgtgtagcatttgccaattcttgcaatgtaattactgcacaatggcctacttccagctattaatgtgacatcactgaaagcggagtttagaagagagcattgtgttgtattatctccatgacagatgtaaatttggtaaaataattaagaaggaatgaaattttagtatctattacatttgcttaatacttattatttgtgagttcacataattttttttttttgagatagagtctcactgtcgcccaggctgaagggcagtggcatgatctcagctcactgcaacctccacctcgtgggttcaagcaattctcctgactcagcctcctgagtacctgggattacaggtgcgtgccaccatgcccagctatttttgtatttttttagtagacatgggtttcaccatgttggctaggctgttctcaaactcctaacctcaagcgatctgcccacctcagcctcccaaagtggcttgagccaccgcgcccagcctagttcacataatttaatgtttaataatgaccatgtttaacaactagctcagagacttcttgagacttttttttagcaatcagcttccagcaaaccactgctttgacgtgactcctgtgcaacgcaatgaggatacaatatcagcttcatagcacttctacaaaagatatttaatcttttaattataaggaaacaatcaggaaaatccagaatgttagatattcaaaaagccctctagcttggaatcttcaaaattataaatgtcatggaataccaaatgtaaaaaaacaaagtaggaggactgttctggattaaagaaaaccaagaggcatgacaagaaaacccaatgcatgaatctcaattacatacaatggcagggggcagggacagaaaaaaatttaaaactaaaaacaatacttagagaaatttgaatatgaaccatatattaaataatacaatatcaacattaaatctgttaagtataataatattgaggttatactggagaatgccattgattttatgagatacgcggaacagcaaaaataagtttgtggactgggtttggtgcctcatgccttaaccccagcagtttgggaggctgaggtgggtggataacctgaggtcaggagttcaggattagcctgggcaacatggcaaaatcccgactcaacaaaaaatttacaaaaaagtaagtgggcatggtggcacgtccctgtggtcccagctactctggaggctaatgtcgggggatggcttgagtccaggaggtggaggttgcagtgagccaagattatgtcattgtactccagcatgggcaacagagccacatcctgtcttgaaaataacaacaaaattttgtgcatagatatataaataacaataaatgatatatatctatatagagaaaaaacaaagaaaataaaatagtaaaacttattaaatctaagtaaaagaacaaaattactccaaagaaaaaataaaagcccgcagtctttgaaaagtatatgaaagaaataataataaacccaaatatatgtatatatgtatgcattaaatttaaaatttgcattttcaaagacaaagtttgaaactttctccttgaatccagaacaattattttagttgctatttattgagcaacaggtgtggatcaagaatctggcaatttactttatctatattatctcaatgcctccaaccacatgatgacatagtaattcttattgttacagataacaaactttgaatactgactatctttgggcaatgatatcatgctatataaccaacaatccataatggtcaaagaaaaattgtttctatatggccttgtattttgttgaggcaaagaaaacaatagtaggcttattcatgataattctttatgtattttgctcatttgatgataaaaatccttatttaaaagacgaattgggctgggcgcagtggctcacacctataattccagcactttgggaggccgaggtgggcagatcacctgccatcaggagtttgagaccagcctggccagcatggtgaaacccggttggtttcacttctaaaaatacaaaatacaaaaatattaaaaatacagaaatcagccaggtgtggtggcatgcacctgtaatcacaattacttgggaggctgaagcagaagaatcgcttgaacccaggaggtggaggttgcagtgagctgagattgcaccactgcattccagcctgggaacaaagggagactgtttcaaaatgaaatgaaatgaaataaaaataaaagatggattgacaatgatcaaacatctggacctttacacatcactctctctaaataagagtaatttaacattggtcttcatttcttcacaatttcaaatttctgcactatatgaccaggaaagccaaagtttcccccaggctttctggtcatgttgtttgcctctgccctgtgtgatttttctcctgactcaatgaagggaattctaaaatctgacagattagcaatgaaatcttttacaccatttcctaagattcctcttagatttatggctgcacgcttagggatatcatgatgccgaaatgttaggcgagaaataaaactatattttcccctttcttacttcagtggagcacaatttccatttattcacactgtatttcctcacacaatatgttcttcccacccaaggctataaatttgaaaatatttataggcaagattacccctgatgccatttataccttgatggctttgtgtttcagctcctaagagccactcatatgtcatatgaatggcttacaaccatgtactgccttggatttttccctgtcaaatgcaaggcccttctttgactacaatactcttgattcaatttattattaataacacaccctgctaatgacttcaaagaaagcctctttatgtgtgttcagaggtttcccaactcttgctttctaggttttacaagtcacttttagattttgagagtgagggttgtgttccccccttttctcctatatgtatttttataaaaatattcaaattatgacatttctcacactacaatagaccatcataattgtccctctcattgtgtcatatttttcaagtgaaggacatggacagacactgcaagcattatacagctctgggcgggaatcaggcagacaggcctgtagtttgtacatagaaatccagcctcagtcatcctgagatgatgtttaggtcaaacaagaagggaatatcctgggttgaactccaataaagagactttgccttcgtccggttctcccttttcctgatgattttgtaaagggactaggaggatcaactgggtatgtggcaatgggggcttttgtggttttgaaggtggcctcattagtgaatatgagtatcttgtaactgcacgctccatgtctggcatgttgcatagcaatcattaaagcagctataaaactttcagatatgttgagattttgagcagctccatttatgcacagagtagggaccaaaattctaactaactaatcgccacataacatgaagagagcttagaaatcctaaagagagaaaacctattagttgttcctcatccttcaaatttttgcaccaaaagcagagaaccagaggaaatgcaatttaacttaatagtaaacccccttcaaggagattaattaatccctcctcctttcaattctttccagatgaatgttgttaagtaccaatgtaatcgtatctggtatctttgaggtatagtgaactctgaggaaggtaatgttaagatgcatttcaagagtataaacaatccacgagcaaagtagagaaaaaatttagtctcctgacattttataatacaattaacctgaagaacagagatctatgttacgatttctctaattttatctttctaatgatttaagccctattcataatgtcgttaggtattggggtttccatttgtctttatgtatttgttctctcctagcaataaaatgacctattgtttattggtcactgttgaacaacatacctgaataactctttaggaacattctgtcctattctgcaaatcccacattgcatggctaaaaaggaaatgcagccaactcatttgtaaaagacctatgtgaggaagtgccagttgttatttttaaacaatttgttataacagaagtagttctgacttttcttcttaattgcttggatagttcatggagagtatcttctctcttactttagtctatgcttctttatgtttttatttaagagattttgtcattgttgttgctgttggttgtgatgatacttgaggagaagcagggtttaagaaacatcataatctaagaacatttcaatagaaaattttctgagtctgggtacactggctcacgcctataatcgcagcactttgggaggccgaggcgggaggatcacctgagctcaggagttcaggaccagcctgggcaacatggtgaaactccaacactactaaaaaaacaaaaattagcctggcatggtggtgcatgcctgtaatcccagctgctcaggaggctgaagcatgagaattgcttgagcccaggaggtggaagttgcagtgagcttagatcatgccacttgactctagcctggcaatagagtgagaagactctgtctcagattaaaaaaaaaaaaagaaagaaagaaagaaaaatttctgagaaaatgtttaattgcagtatagtttgcttaacagtaattagtttaatatttaaaatttcaagaatgtttgaggttaaaatttacattaaagaatattgttatttataccaaaaaaaagcaaagagatgactccccagaatttaggattgaatgaagatatcctcaaacagttaaacaattgttaaactgtaaaatcaacatataatttgccaagatcagagacataaaaattctccaattatggagaaaatctccatcctaagacagatgtatcttaacttgcctcaacatatttaagtgagatttggagggatgaggtacagataaatatagattaaagttttattgtttttgtcatactccagtgaattgattttatataaacgataaataatttattcatctgatagtgacaaaatatccccaaaataacagcacatataagagaggttgacttaaaattgtacttagagagtcactgaaaacagtaaaacaagcaaaacactgtctattcgaattcaagcattgccaacaaattgatgataatgtgtattctgaggcagatgtttccttatagagaagatggatagcccaggttattaaagatatatcccatatgtctttcgcaattattgtctccatgtctgtggattctctttttattctcttgaaagtgtctttcacagagcagaaagcttacattttaataaagtccagcttatcaatgctttctttcatggatcgtggctttggtgttgtacctaaaacgtctttgccaaagctgtttacctagatttttctcctaccttttagaaatgttataggtttgtatatttatttaggtctttatccatttttagttagtgtttgtaaagcatataaagtctgtgtctaaattcttttcatttgtttgttacatgtagatatccagttgctccaaaaccatttgttgaaaagactatcttttcaccattgttttgccttgactctttcatcagtggtcagctggctttatttagttgggtctatttctgggctctgtattctattccattgatttatttgtctattatttgaccagtatgacactgtcttgattatggaagctttatggtaagtcttgaactcaatgttggtcctccaacttttttcttttctttaaatattgtcttgtctattccaggtcttttaactctacatatatactttcaagtcattttgtcaataaaataactttctgagattttgattgggattacactgaatgtgtagatcaagttggaaataatagagccagttttgaaacaggatttaaacaagatctgttcagctccaacattaaccttttgctatgacactgtgacagcaattaaacaaccataaatcacaggttaaaactgatatatttcaaagacattttaagaattagagacctcaccacaatgcataatacttgtttttgggtagttttcttcagtgaattctaatgctataggtattactggcagaaattttctaggaaaagagcagagtataaaaataataaataagacaagcatatggaaagaaaaagtcagttgcagaggaagaaaagttaaaaggattgtgtctttttaaggcggtgaataatacttagtagatcatctcaaatgtttctgatttctggctctgcttccagaatagcaatccattttaagcagttaaatacactaaatttctgacagtgtaatatacaatactttatgtattttattggaaaaatattttaatatatctggtctcatatatttcctaatagaatataccaccaccattattatggaactcaattataaaaatatgaaccatttgacagaaattggctatcctgaaaaattggaatacatatgcattattgatcaaaatatgcttacagtaccaaaaaagcatagagttagttcagtgtttttaaagcttgatattatgataccaagcaatagccgctgaaatagaaaggagtatactttataaaattaaaatcaggtttttaaaaaattttcttcagagggctaactggtccataattgtttttaagtttcttgctgaaaaattgaaataggtcccaggagaacttatggcactgataaagtaaaactgtcactttccagtttggtcgtcaaatatatcatccctctgtctattacacacagcagttctgccacaaatcttgtttctactcacaattaattaagcaaaactaaaatgtttaaagctaccacaaatcaaatttaatttaaatggctacaataacttaaacagagataaatgaaatgactttcttatgcttcattacttcctctaattccttttaaaacatttctgtagaagaagttctgaggatgaggagacaggggtggaccaatgagatttcaattaaactaccaaagtaataccttaaccgcaggtggtcccaggaccagttatttccacttattccattccctttgccacacagacactttaatgtgaattttaaagatatatatgttacaattttcagagtctgatttatcttaaaactttaaaccatatgacatttctaatgtaaaaatgtaatcttgatttaggtgcttaattaaaaggatggctgctttattaataactcaattataagtttaaaatatgtcatagtataatctaatgattgtactgttttcccccatgggacctttaaatacacacaaaataattctatgccctgatagaattctattttttgttgttgctaagacaatttatttttgttatttcgtgacttcactgcattttattgcatttctgtgatttctttttttactgcagcatctctaaaatctcttcttacagtttgggcatagaattgagagcaaaatggaatttatcgcaactacctcatgcattttttcttaaattgaaatcagattacacaaatacttatgttttgtttccatggttatgcaagaaaatagtttttcagtcacttatacaaatctatgcagaatttatacatgtattgcttattttattttatctttttatcaaacttagcatgttaggaaacattactaaattctgaaaatgttaggaatttaattaataatgtatttgtagcctcgaccatcttaagaaaaatatatggtgttggctggttaatttatatttatttatttatttttttttttgagacagagtttcgctcgtgttgcccaggctggagtgcaatgacataatctccgctcactgcaacctctgcttcccgggttcaagtgattctcctgcttcagcctcctgagtagctgagattacagggaccagccaccacacctagctaattttgtattttttagtagagacggggtttctccatgttggtcaggctggtctcaaactcccagcctcagatcatccacccgcattggcctcccaaagtgctgggattacaggcgtgagccatgacacccagccttctatttaattttttaataggcaggcattaatgtcagttaatgctatataaaatgacatatatggagaagtctcaataccaaaattgccttctattccagtatccactccccttccacatatgcatacttttagggaactctataactagtttatttatttcagtatttctcttaggaaaatgtaatgaaatgcatatttgtatacccctacttttgtataaaaagtagcttctatattatgcatatacactattctctcccttgctttctttaataatatttccttatgaacaactcatatcagtatatagacatcttcattcataaaggagaccctacaaactactaagtatttattactagttaccaggaatcaaaagaatagccttttagccatcctttgaagtatatccatatgccgttcaagactctaaaacctgtaagggctactccacagctctagcacatggctttcctttccaaggcccttctccacacaaagacaaaggggaatgtacattagcaccatatcatgtacaggtaaactagagtggaatagagaaagcctacagatatggaagtagcagagaggcccatgaagctgtccttatgccccagagaggtttgctttgccccagtgggcatagttgctttaaatatatcattgaaaggactccaggaaagagttcctgacacccaaatatctctatatatcatttatagagaaagtggggaagggtttctctactctaaatgactatgtaaaaataggtccttcttggtgaagaaaatggtcttgtggaaagaggtaaccactggttctcaatgcctgataacagcagtcattttcattgcactaacttggacctgctgagccagcttattgcaaagcaagtaacagggaagggaatgagcctccagggtcatctgggtttgtttctcttcattaagtgttttttattttttttcataagcattgctgcttattcatagatacacatagagatgcagaatcaaaatgagacatgaatgctggttatcagctgcactcactcactaagtggctttccttctttttcttttgagatggagtcttgctctgctgccaggctggagtgcagtggcatgatctaggctcactgcaacttctatctccccggttcaagcgattctcctgcctcagcctcccgagtagctgggactataggcacgcgccaccaagccctgctaatgtttgtgtttttagtagagacagggttttaccatgttggccaggatggtcttgatctcttgaccttgtgatccacctgctttggcctcccaaagtgctgggattacaggcatgagccaccgtgcccggccgaagtggcttttttatatctcagctttatactatgaggtgaaaatttgagtcttagtaaaattcaaaatactggcccttccaggtcattttcagatggctgaagctagtcaaaccaggagtagcaactgcctctactgaataaaatacaacagtgtaaatctaatataataaaaagaactagacctgcctcagtagaatatgatctggtttacactgagtaatagatactttatttaacaggagttactccaaactttcatgcaagtattcattagacctctcccactctctggacaccacataggatctaaaggaatatgagttggggtccagcataaagacaattacagacaataggataagacaaatggcactctgttaataaagcatgtattctgtttgtttggttggttggttttttgagccacagtttcactctcgtaactcaggctgcaatgcagtggcatgatctcaggtcactgcaacctctgcctcctgggctcaagtgatccacccaccttggcctcctgagtatctggaactacaagcctgcaccaccatgcccagctaatttttgtattttttgtagatacagcatttcaccatgatgctcaggccagtctcaaactcctgagctcaagcaattcacgcgcctcagcttcccaaagtattgggattacaggcatgagccaccacacctggtatttttaaccagggaaaatattagtacttaggagatctgatagaggcagaagcagtaaagggcagtttgttgaaataatatgaaaagttttcctgtagaatatgcaaattttgactggttagaaagtcagaaagaaatgcttttgttctgaggatataaaccttctaaattgctcttgaaggttgaaattttttggttgctgttttgttgcttcatgttttaattattattatatttatatctctcttgttaaatctggggtatggggaacagtgccattaccagagaagaatttacaggattaaccttaaatagaagaaagtgtctctcttctaagtattaagaaattatctctgtaatagtgaacttatcggtaatatgattcagggacaatcattctatgaaatataattaaatgcccaatattcttcttttttaaaaaaagtttctattagatttttaaagtacagctataattcatgttgtttgtaacaaaagttgcaaagattaaaaagaactaatattttaccacttgtcctcctttctcagtctctgaagtataatcaaaatgatatgatatatagtgttctcattttatccaggtgttttatgcatctgtagtatcatctctttgtttgtagaacaacagatgactctccctcatttatttttaaaggctacataatactccatagaataactgtaccatggtatttcagacagccttttgagggacactcaggttgctttcagttttttttttttttttttttttgtcgttgttgcgccaatgctcttaacagtagaaaaatacctttcaatatatatctatatttagtggctgttttatacctgtaagatacgtttataaaagtatgtaaaatatgtttatattagtatgcatattatgtttagtatagtatgtatagtatgtatgtatagtatgtatgtatagtatgctatgtttatattagcatgtatgtatattaatatgcttataaaagtatgtaagatgtgtttataaaaattgaactctggattcaattttaatttgtatagagactgctagtttattaatttatcaaaatccacatcaccatatacttagtcacactagatgctatccccatttttgttcttctgaagggtgatacaaggcagctcattattgttttatttcctatatccttgattgtaaacagaattgaaactcatatccttattgctcaaatattttccttctctgtaatttacttttccatttttctgatgaatcatttgcttttcttagtattttcaggagcttgtcatatattatgggcattaatgtcgggtcatttacaataaaaacatttttcttgtcaattttttgttcttttactctgtttatagtatagtattgcctatatttttagttatattttatgtaaaccagtcctggcttgtttaagaaaaatctcaccacaaaaatgttgcacaaatagtatctactagtttttaaaaataatatatatatgctatggtttgaatgtattcctcgaaaattcatgttgaaatctaatccccatggtgttggtatgaataggtgagatgtttgcagaagtgattagtcgtgaggtctctgccctcgaggatgggattagtgcccttatcaaagtgactgaaggagtccctttggctcattctgccagaacacagcattccccttttcattatgtgaggatacagtacttcctgcttcctccatatgaggaatacagtgagaaagtgccatctctgaagcagggagagagccctcatttgacaccagagctgctgggtctttgaacttgtacttctcagcctccaggactatgagaaataaataaataaattatccactctaaagtaatttgttatagcagcaggagcaggttcaggctaaggcattatgtgtgtatgtatttataaaatgttgcacaaatagtaactactagcttttaaaactaaatatatatttatatgctatgtatatatgtacactgacagctacttatcatattcaataagttttaaatagattacaaatctaaatgtacagttatatacattaattttgaccttacatgtaatgaacatgcattatatttagatatttatgtatataatttaactacatagttataattaactgtaatttaactacgtagttaacaatacttgttatagtttatagttcaattatagttaactatatagtaaaattatgtgcacatatatctaaatatgaataaatgcatatatatctaacgcatatatatgtatatataaagctaaatatagttaactatatagttaattataactagttataatatataatatataaatatatataactctatatttatagttaactgcatagttagccatatcattaaaatatatgcatatgtatatttaaatataaggaatgttcattatacataagattaaagtcaacatatataattgcacatttagattattaatttctttaaaaattattattgaacattgtaagtagctgtcagttttttgttttccatgtaaatatccaattaagccagccataactattaactaataacttcattagttaaatgggtactgaattcaatcaaatcattttgtggaattcactatacaattatatttttcttcttttattgtgtttttatcaattatactgttagtttttctaatgtatgaacacccttacacttttaaaataaagtattcttgatcacaaatgatattcttattgcactgtaaaatttgatatacttttactttatttagaatggtagcattcttaatcataagtaaaattagtttgtagtttacattcttatgcatctttttcagattattaaaattacagttctttataaattaaattaagctgagtatcatccatttttatagtctttcactttaaaaacaatggaataaactatctcattattatagcaaaaaaaattaaaccataaaagtatcaggcccttgtatttatttgtaatggtaaatattcttcaatatgtttttccacacttcaataaaagtttttcttttccttctttatggtttctaaatgtccttgagttaacaatggacttggattattatttcataatctttctaatccacaatgaacttattttggtttttctttgttttccataatggttgatatggtttggctgtgtccccacccaaatctcatcttgaattgtaactcacacaattcccacgtgtcatggggggaaccccgtgggaggtgattgaattatgggggtggatatttcctggtctgttctcgtgatagtgaatgagtctcatgagatctgatggttttaaaaacaagagtttttctgcacaagctctctttgcctggcaccatccatgtaagatgtgacttgctcctccttgccttccaccatgattgtgaggccttgccaggcatgtggaactgtaagtcccttaagcctctacttttggaaattgcccgtctcgggtatgtctttatcagcagtgtgaaagcagactaatacaatggtgtttgccaaaatatatctattatggtcttttaaaaaaatagcttaatttttttctatttttttatttttaatttttatagatatataatagtcatacatatttatgggctacatgtaatattttgataccagcatacgatgtgtaatgatcaaatcagggtaactaagatatccattatctcaagcatttatcatttccttgtgttggggtcattctaaatatcttctattttgaaatatataatagattattattaactatagttaccctataatgctattgaacactacttattcctcaggtaaaactacttatcattccatttatttttattagctgattttctagttcattataatcacatatttttgttttaaacctgatttcttaaggtaaaaacttatcttttaatacttttactgaggaataatgttatgctatacagtgtagcattgtaagtgtacaatacaattatttttaataagggatgggactgtatttcttgagttgtttcccttcagtggcttcaatccattattaggtccttgtctaatttatatatttgcatttctcttacgaagtataaactgtatttaataaacttttaaaatgcaattataaaattgattcatcacttgagcaaatatgttttattccttcataagatgtcaataattggttcaagagttggtaatataatatgtattcaatctagtggcagaaatagacaagaaaagacttaattgtaattcagaatgtcatgtctaaattgatatttagataaagtactatggggacaacttatgaaggactggttacttctagcttgaaggaagtgtgataggagggctgagataagataaagttttcacgaagaagctcacatctgacatagctttcagagactttcttaaaagagaaaaaggaaaatgttttaactaaaaaatgataatagtatgtgcaaatattaggagttataatgacacatggaatatccatagaattttgaggatatttacttctgatgctcttcagtttgttttcttatgtttggtaacatgaaatttaaaaagaccaaattcaaaagtttcataacaaatgagtcacacgtgactcatttagcaagaaaggatttcttcacttacaaatctttggatttctagaatgtactaaagatagaagtatctcctgtaaatatctgataaaaagagatatacttgcctctgttcttcagccactgaagggaaacaagaacgacaagctcatccctaaggatgatatcatgcaccttcctaataactttaaatgtcttgacatattaaagtttgagttaagctacaccagagttaaaagcaccaaccaattcctcagtcactttctatacatgcttcaattctttttaaaattaggttgaataataagttatagcttaatcattgatttaactagaaatgataatcatctggatcatattaatattggaacacatagattgaatgctatagaaataaaatttatgtggctacatttctgccagggaacttaaggagtcctataaatcatcatttcagataatccaaataaccaagaatgtggaaatcatattgtatctatgcttattcttgtttatataaccatgacaaattatttttacataattgacacagaatcatttcattcctgctgtaaaaagaaggaaaaataagtaccattcaaaaacattctactaaacttgacagaaatattaagacagcagaagatgttttcaagatattgaattatgaataagcagaatgctagaataaccatgaaagttaaatatacatccaattttacaagcacttggaaaaataccagaaaataaagatacaggcactgataatacagatattaattgtaaatgatatactatgatggaagttgataactaatacaactcattagctaaattatatttccaaaacaggaagcacagatatacataatgggacaaaaagtaaaataatgaaaactaagaatgttctaacaacacaaagtataaaaattctcatgtatactttcacaatataaagaaaactaacaacatgtattctgaattcactgtatcagaatgtcttatagacattaatcaaagtctaataataactaaaaatgattttaagatgagaaagagtgtataagtttttaaactaagattcttggtaattttcaaaatgctgtgcaaactatgcctatgaccctcaagagcatttttgaaataaaaaagaaagtatgactttttcctattatcacctcttctggcaatgctgtacactaccatgagctttgactacattttccagccttctaaagtgccctactgaaactttgttatcctttctctttattgaaagtagtccaattcactgagctccaggaatgtgtaaataattttcagtaagtcatcgttcagtttgagttttaagccattattttcttgaatattttttgtgcctcattctcactctcacctgggactctaattaaatatatgttaaaagttttaatattatctcatagacaacttgggctctgttgatatctttaactttttttctcttttcttcatattgatctatcttaaagtttagtaattatttcctttgtcatcttcattcttctataaagcccataaaatgtttctttttcaaatatgcgtgtttcagtatgtttcagttttataatttgcattcagttcttttaaaatattttcaatttctttactgagatttcctatttatttattaagtttattttattaagcatagatttattggctgatttatagtctttatctgaaatttcaacatctgggtcgtctcagggttggactctgttaatcatatattttttctttgaatgtgaagccagtctgtattgtatccaagtcattatttctgcattctctaatattcctccaaagaaagatactatttttatattagaaggcaattaattggttaggctcaaattacatactttgtgtgcctatggagggagacagccaaaatctcagtgttgttcttttagccttagctgcaggatgttttgagtctgctgcagacatgctcaattcacctgtcagcctgagaattgggcaaagtttgtataccaatttgggggctcttatcttctggatttctcttttctgagatgcctctccaccttactttctagtacctgcagttatcccaggctcattcctggatgccaagaggatagattctctaccacagtgttagttatttgcagtccactgcacctgcagactgtccttacactaagactaaaaaatgaaaacgtatcctatgctggtcctgtcttccaagttttgtatcatctccaaatctgcctctgatacttaataatttgtttacacacacacacacacacacacacacacacatacctatataatataaattatacataataagtttttttgtttatagttgtgatctgttggcgggctggaccatttgaaacttactccttactctatcataccagaaatggaacttttagtaattaatctgaagggctgcaatctctatcatcactcataaggtcaagattaaacccatacctttaaacacagctcaaaatattcagcaaataaataaggcagtcactactgatggtagtaattattgtccaagacttgtattttttggagatatttcttatccccaaacatatccagcttcaattggtttatttctggtacttaatccttggttctactcttttatttataatccagcaaatcctctttggacttatattttaaattactcctgactctcaggtctccttatcaaggatattagtctactgtagacttaaacaatcagctcttttaacattgagcaactagagtaaaatatacctactacccaccctctcccatactacgacaggtcttttggaatcttacttatatagcacattcacaaaagacagcctacaaatatatcttctgctgcaaaggatgtttgttttagtgggtcttaaaaatatcttgatattcattttcaagggtggatttttacattagctgtggctcttacttgcaagctactgttaatggcaacattttcccatttgccgaaaactactcacaatgacagtggcttccaccaacaattttcgtcaaaggcaagtgatagtatatttcgtttttagaaactccctgtagtagtttctggcaatcatctttttctctctctactttttgaaaaagttcatatatatatatatatatatatttcccttgaacaatttatatgaagctcaatattaggaaaatgtcctattaattttttaacactcactagaaagcaatataacaagatgacctgtttaagcccctagtacagctgtggtaaccaaacagttcttttagaggaatatgtgcacattctctagagttgtttgacaaagagttgacaaacattttctataaacagccagacagtaaatattttgggctttgtgaggcatacaatattttccacaacaactcaactttaccattgtagcacaaaattagccattaaaactttatttacaaaaataggtggcaggcaatttggcctgcgggctgtagtttttcaatctttgctcaagagtatagtgtgaaacaattccaatttgccattgaacttctccagcattcttttatgtgtcccaaagcagacagaagtacagagactcataacttagagagaactcttgcatcttaaaggcaacttaactcttgtatcttaacagtaacttcctaggtattgatatgagaactcattatttcagtgattccataagccaagtgactaagacacttggcgagagatacaaattatggaatttctgctgtcctactcaactggaaaatcagtatctgtgttatacttgtgccaccaaattaaataaactaaacttcatgtcacattttgatttcaaaagtggcaccattctataaaagttatatcttaatcaggaaataataaaagaaatacctgtggctaaaaatggcaaactgatcaatggaaaaaagtccagaaacaaacccacacacgttcctgatctacagcaacaacaataatatgaagctttggtgctgtggggagcggaggaccatcttaatacattgcactaggtcaagtggatatatgtatgagaaaaacatcatctagattctcatctcacaccatacacaaaagttaatgtcataaaaatgtgttatataaaagtaaaatataaaacaataaagcttttagaagcaaacattagagaacaattccatattcttagggcaaataaaaagttgatacattgaactatataaaagccaagaacttctgttttttaaaagacattgttaatagagtcaatgaatccacagtgtgaggagcgtttcccagaataaagaaagaactcaaaaaaaatcagtaaggaaaaggaaacacaacagaaaaaatgaacaaaagattgaaaagacactttatcaaagaatatatccaaatggccaaaatagtatattttaagaagacttcaagttaattagttatcaaattaaagtcatgctataccattacacatccaccagaatagattacgtatgctgaaactctgaaaggtagacagaagttagactggtcaggcatcttgggacccaaggaacagcatgatggtgaattacctgggtttttattctccctcatatatcccagacttggagctgaagaagctgaccacaggcctaaagaagcttgcaaccgactaaagaaaggaaacaggagggatccttgtgatgatagaaatgttctatatcttgactctatcaatgtaaatgtcctgtgattttgttgtgatgttggaccacactttacaaataccgccatcaggaaaaaactagtaaaggatttgtgaagcttctattacttcttaaattcacaggtgaatatacagttaaaattagaaagttaatttaaaatatttattcaatgctttctgtgtgccaagtacaattatagatgctaggaaataagcagtgagcaatgccaacaccatctcttcaagatgtttgcaatctagttagggaaacagacaataaacaaacaataaaaatgtcaagtggtgaaaatgaaggaaaaaaaaacagtagtgaacatatagaaagatagaggagatgatatttcacatatggcattgggagtggtcttggcatggtcaaagaatagtaactaggcctttgtatccaaagtgtggttaatgaggtggagactggtaggattttgagttccaacatagtgggaagccagatcatatagtgccttcactcataataaggctcaattttaatctaagtgtgtgaaaggtgctgagggagagggatcatgtataattttgaatagggcattgccttgttctgacgtgtttaaataaggtgactatggctgtcttgttgagaacagactgatgaggaggacgtaacctattgattttcagttttgtatttcatttgcatttgggttttggttttgttttgttttgctttccttatttccttttttaaaatttttccataagttattggggtacaagtggtattggttacatcagtaagttctttagtggtgatttgtgagactttggtgcacccatcacccaagtagtatacgctgcaccttatttgtagtgttttatccctcgtccccctcccactactcctcgcaagtccccaaagtccattgtatcattcttatgcctttgcatcctcatagcttagttctcatatatcagtgagaacatttgatgtttggttttccattcctgagttacttcacttagaataatagtctccaattccatccaggtcactgaaaatgctgttaattcattcctttttatggctgagtagtattctatcatagataggtaggtaggtaggtaggtagatagatagatagatgatagatagatagatagatagacagatgatagatagatagatatgtagatagatagatagatagatagatagatagatagatagatagatagataatcacactttctttatccattcattgagtgatgggcatttgtgttggttccacaattttgaagttgtgaattgtgttgctataaacatgcatgtgcaagtatctttttcgaataatgatttcttttcctctgggtagatacccagtagtgagattactagatcaaatggaagttctacttttaattctttaaggaatcgccacactgttttccatagtggctgcatgagtttacattcccgcctgcagtgtagaagtgttccctgattatctcatccatgccaacatctactgttttttttattatggccattcttgcaggagtaaggtggtatcgcattgtggttttgatttgcattttcctgatcattagtgatgttgagcattttttcatatgtttgttggccatttgtatatcttcttttgagaattgtctattcatgcccttagcccactttttggtgggattgtttgctttttcttactgatttgtttgagttcattctagattctgtatattagtcctttgtcagatgtacagattgtgaagattttctcccactctgtgggttgtctgtttactctactgattgttcctttggccgtgcaaaagctctttagtttaattaggtcctagctatttatctttgtttttactgaatttgcttttgggctcttggtcatgaaatctttgcccaagccaatgtctagaagggtttttccgatgttatcttctataatttttatagtttcaggtcttaggtgtgcatcttgagttgatttttttataaggtaagagatgaggatccagtttcattctcctacatgtggctagccaattatcctagtaccatttgttgaaaagggtgtcctttccccactttatgtttttgtttgttttgtcaaagatcagttggctgtatttgggtttatttctgggttctctattctgttccattggcctatgtgcctatttttgtactagtaccatgctgttttggtgactatggccttataggatagtttgaagtcaggtaatgtgaagcctccagatttgttctttttgcttagtcttgctttggctatgcaggctcttttttggttccatatgaattttagaattgttttttctaattctgtgaagaatgatggtggtaatttaatggaaattgcattgaatttgtagattgttttggcagtatggtcattttcacaatattgattctacccattcatgagcataggacatgtttccatttctttgtgttgtctatgatttctttcagcagtgttttgtagttttccttgtagaggccttttgactccttggttaggtatattcctaaatattttatttttatttttatttttttgcagctactgtaaaaggggttgagttcttgatttgatgctctgcttggtcgctgttgttgtatagaagagctactgatttgtgtacattaatcttgtatctggaaactttgctgaattcttgtatcagttctaggagatttctggaggagtctttagggttttcaaggtaaatgatcatgtcatcagcaaacagtgacagtttgacttcctctttaccaatttggatgccatttatttctttctcttgtctgattgcttggctaggacttccagtactatgttgcagagtagtggtgagagtgggcacgcttgtgttgttccaggtctcagagggaattctttcaacttttccccattcagtataatgttggctgtgagtttgtcatagatggcttttattacattaaggtatgacccttgtatgccaattttgctttgagttttaatcataaagcgatgctagattttgtcaggtgctttttctgcatctattgagataatcatgtgatttttatttttgattctgtttatgtggtatatcacatttattgacttgcatatgttaccatccctgcatccctggtatgaaacccacttgatcatggtagattatctttttgatatgttgttgggttcggttagctagtattttgttaaggattttagcatctatgttcatcaaagatattggtctttagttttttgttttctgtttttttttttttttttggttatgttctttcctggttttggtattagcatgatgctggcttcatagaatgaattagggaggattccttctttctctgtcttgtgaattagtgtcaaagggattggtaccaattcttcttagaatgtctggtagaattctgctgtgaatctgtctagtcctgtattttatttttgttggtaatttttcaattactatttcaatctcactgcttgttgttggtctgctcagggtatctaatttgtcctgatttaacctaggagagctgtatttttccatgaatatattcatctcttctaagttttctagtttatttacataaagatgttcatagcagccttgaatgatcttttgtatttcagtggtgtcagttgtagtgtctcctctttcatttctcagtgaggttatttggattttctgtcttcttttcttggttaatcttgctgatggtttatcagttttatttatcttttcaaaggacccgttttttgttttatttatctcttgtattttttgtttgtttcaatttcatttagttctgcttggaacttcgttatttcctttcttctgctgggtttgggtttgatttgttcttgtttctctagttccttgaggtgtgactttagaatatcagtttgtgctctttcagtctttttgatgtaggcgtttagggctatgaactttccttttagcaccgcctctgctaaaaattccagaggttttgttaggttgtgtcattattgtcattcagttcgaataatttcttaatttccattttgattttgtttttgacccaatgctgattcaggagcaggttatttaatttccatatatttgcatggctttgaaggttccttttggagttgatttccagttttattccactgtggcttgagagagtgcttgatataatgtcaattttcttaaatttattgaggctcattttatggcctattatatggtctatcttggagaaagtttcatgcgctgttgaataaaatgtgtattctgtggttgtgagatgaaatgttctatatatatctgttaagtcatttgttccaaggtatagttttaattcattgtttctttgttgattttctgtcttgatgacctgtctagtgctgtcagtggagtactaaagtcccccactattactgtgttctgtctatctcatttcttaggtctatgagtaattgttttataaatttgggagctccaatgttaggtgcatatatgtttaggattgtgatatttttctgttggacaaggccttttaccattatataatgtccctctttgtctcttttaactgctgttgttttaaagtttgttttgtgtgatataagaatagttaccctggcttgcttttgatgtccatttgcatgaaatgccttttcccacaccttttctttaggtttatgtgagtccttatgtgtaaggtgagtctcctgaaggccccagatggctggtgagtcctcatgcattctgcagttctgtattttttaagtggagcatttaggccatttacattcaaatgttagtattgaaatgtgaggtacctttgcattcatcatgctttttgttacttgtgtactttggatttttggttttgcttttgttatttacttgtgtttttgttttataggtcctgtgtgatttatggtttaaagaggttctgttttgatatgtttccagcatttgtttcaagacttagagctccttttagccattcttatagtggtggctaggtaatggcaaattctctcagcatttgtttttctgaaaatgactgtatctttccttcatgtatgatgcttagtttcgctggatacaaaattcttggctgataattgttttgttcaagaaggctgaagatagggccccaatcctttctagcttgtagggtttctgctgaaaaatctgctgctaatctgataggttttcctttataggttatctggtgcttctgtctcacagctcttaagagtctttctttcatcttaactttgtatagcctgatgacaatgtgcctaggcaatgatctttttacgatgaatttctcaggtgttctttgtgcttcttgtatttggatgtctaggtctctagcaacacaggggaagttttcctcaattattcccccaaatatgttttccgaatttttggaattctcttcttcctcaggaacactgattattcttaggtttggtcgtttaacataatcccagacttcttggaggctgtgttcatatttttttattctattttctttgtctttgatggattgggttaattcaaagaccttgtctttcagctctgaatttctttattctacttgttcaattctattgatgagactttacagagcattctgcatttccgaaagtgtgtctaaagtttcctgaattttttattttttttttctttaagctatctattttcttgaatatttctcccttcacttcttgtatcttgttttggatatccttgcattgggctttgcctttctctggtgcctccctgattcatttaataactaacctcctgaattctttttcaagtaaatcaaggatttcttcttggtttggatccatggctggtgaactattgtgattttttgaggggatgttgaagagccttgttttgtcatattaccagggttgcttttctgggtctttttcgtctgggtaggctctgtcagggggagggtctagggctgaaggctattgaccagattcttttgtcccaaggaatgttcctttgatgtagttattctcccccttttcctatggttgtggcttcctgtgagccaaactgcactgactgttgtctcccttctgggtctagccacccagcgagtctacccggctacaggctggtactgcaggttgtctgtacagagtcctgtgatgtgaactgcctatggttctctcagccgtggataccagcacctcttccagtggaggtgctgggtcggggggtgctatggactccatgagggttcttagctttggtcatttaatgctttatttttgtgctggttggcctcctgctgggaggtggccatttccagagagcatcaggtatagtagtatggagagggactgacagtggtggggctctagaactcccaaggttatatgccctttgtcttccactactagggtgagtagggaaggaccatcaggtgggggcagggctaggcatgtctgagctcatactctccttgggcgggtcttgctgcagctgctgtggggggtgggggtaagattcccaggtcactggagttgtgtacctaggaggattacggctgcctctgttgagtcatgcaggttgtcagggaagtgagggaaagctggcagtcacagacctcacccagctcccacataaactgaagggctggtctcactcccatggtacccctgcaacagccccaagtctgtttccaggtgaagggcgagatgggcttgaaaacttgccccaggctacctgcctttcagctatgaaagaaaagggcttggttattccccctcctgtggagtctgcacacaggatttgcaccctctccccatttctggccaggaggcttctcaccctgttcaaatttttacaaagttccgttagtgatttcctcctccctgtggagttttaccccctgctcctctggccaccctcccaatggatctctgtggtgccaggaaggaataggctgctaggggacccagtgagctcccagggcctttctgctgctttctctacccctgtatttctcttggttctctaaattgactcatctccaggtaaagtcagaaatttctcctgcaaacagaccttcaggttctccagtgggggtgcgtgtttgagagaggagggtctccctttcccacttcttcagttaggacactcacagtatttgcagtgtctcccacgttttgcaggagcagtctgcttccttcagagggtctctgggtcctcttgggattgctggtttgttcttgcagttgatttcacttcttacttctgggtttcagttatattattatatataagctatatgcacaaggagattatattttttggcagtgatgcttaaaaacttggattccagacccagactgacaatcactagctgcatgaccatgttcaagttatttagcctctttcatcttcaatgttttcatatgatctatggtgcaataatagcactcaagtcagaaggcttttattgggattaaatgtgttatatgtgtaaagatcttcaaatagcttgagacatggtaagtaccatggaagtgtttgctatgtcatttttgtgttggtacatatttgagtaacattgtaatgaaaacaattaaaagcaacatgggagaaagcataaaaattattttccttaagagggttcatactctagtgactttgaaaaactgtttgagagcgtgctaatgtcatatagctcagatgcttactatttacacatcagtaattattgtaggggcagggaaggcactataaaatttgtctgtaaccaaaaattaaatatttttttctaacttgcaggccaatcacattttattttaattttaaaattaaaaacccaaatatgatgtatatagtaaataccatcaagatacctattaatgagaactattattttctaatttcttgagtggaagttattgtagtagatatattctgctttttgtcctgcatttgtacatttgggcaacttctcttctctctgtattgcactattgggaatataggtcatagattgccaaagtgtcctgttctcctggccacaatcattgattcaggaataggaaggtatccaagaacagctaaccagtttccacatggaattggacatatggacactgttttttttttttttagatgtttccctcttcccctcagacacatagcaataagagccaaattaacaacacagagtctgtctgagaattaagttaaataatcccaacgtgaactagaaaaagaaagaaaatctctgtaaatgttatttaattatagaacaattgacacaatacataaaaatatggttgtgttctatgtgaaatttgtctttattctagaatagtgattttaaacatgagagattcttacctaataatatcaattgatcaaatttgtgatactaaaacataaatcagtattcatccttccaacactggttctatttacatgaaattgtatcattttagaggggaacaaatgtgatttgccgttttttaaatgaatcttctgtaggtcacattatatttgggagtagtttctaattattattcaaaaaaagaaagaaaggaaaaagggaaaatttctgttcctatctgacacttggcatattagtcaagatcaaatacagaatacaataccctaaatgaaaataatatgtgctatatacaccatggagtactatgaatccataaaaaagaataacgtcgtgtactttgcagcaacatggatgcaactggaggctgctatcctaagtgaattaaggcaggaacagaaaaccaaatatcacatgttgtcacttaaaagtgagagctaaataataggtttcatacagctaaagaatggggaccctatagctcatatgccatatataaagatggcaacagtagacactggggaccactagagtgaagggggtggaggaagagaggggaacaaggaatgaaaaactaattattgggcaccatactcactacctgggtgaagggatcaatcatacatcaattttactctaagtaaaattgcattatgcaatatacccaggtaacaaacctgcatatgtaccctctgaatccaaaataaaagctgaaattataaaaaacaaaagaaaatagtatgtgctaaatatttatatggtgttggttagtcatcatttctaaaaacccaatgagtcctaatgccagtcttctcaaaagctcatatataggatagaggaaaaatggtgaaatatatagtatttatttacaaagagaaggcactatagatgttcatttacttcactgtagtgaagtattattaccatcttattatatatgtgcatgtgtcatcattttgtataccttcaatatacacaatacaatttatttatttattttattattattattattttgagatggagtcttgctctgtctcccaggctggagcgcagtggtgcaatcttggctcactgcaacctttgcctcccaggttcaagcaattctctgcctcagcctcccaagtagctgggattacaggcacctgccaccacacctggctaatttttgtattttcagtagagatggggtttcaccatcttagccaccttggtcttgaactcctgaccttgtgatccatcctcttcggcctcccaaagtgctgggattacaggtgtgagccaccgcacccagccataaaatttattttcaaaaatgctttcacagaaattatctcatttgaacctcaaacaaaaccttcaagaaggtaactgcattattttttaagaaaaaagtttcacagaggccaagtgtgatagctcacacctataatcccagcactttgggaggctgaggtggccggatcacctgagatcaggagtccaagagatcaggagttcaagaccagcctggccaacatggtgaaacctgtctctactaatggtgaaaccggtgtctactaaaaatacaaaaacttagcaaggcatagtgatgggcacctataatcccagctacctgggaggctgaagcatgagaattgcttgaacccaggaggcagagtttgaaccgagctgagatcgcaccactgcactgcactccatcctgggggacagagtgacagtctgtctcaaaaaaaaaaaaaaaaaaaagaagaagtttcagaaagattaagtagcttatctatggttaaaaacaaaaagcaaaaaactggtaactcacagaggtagaatctagtctcagttcagctgtttccaaatctctatgtggtacataacatattttcgaagtttgcatctcatgtgacaatgtgggaggcataatcaaaacatggaaacatgaaacaactagagaagtaatcacataattaactattataacagcaaaaaaaattaaaataggattaaattgaaggggtgaatgaaggttagtgtgatcagttagtatgatggcagaaaaagaaaaatattcaatgtgtcctaaaggatacataaaacaggaacaggtgtcgatagagttcatgtaacagtaagggacatttcaggaagcttgagtttggtgggaggagtggagctttggagatacaatgggaggttggagaggtgtgaagaaaaaggtgatgtcactttataaaggaaactggaaagtaaggcagagcaatttagacttgaaggaatttcatttgcttctaaaaactgaagtattgtaacatgcaatatgcctttcacaaacaaaatagtcacatatgcctctcagaaagaaaaggtaccatgaaataagagaaagggacataggacactgtgctgtatgtaaaaaagaggagagattaagtgtgataaaatgttctacttttaaagcaggtaattccacctttctgccaacaattattattttaaaaggaggcaaatagaaaaaaaattatatgttagattactaaagaatatacttcaaatctataagaattgaagcagttagaaaaactaaatagtttacaaatgtgacagcaaacgttaagtttcctgtgagatttacaatgtctttgtatctgccctagagatcactggggcttaatagaccaccaagtacaaatgaatcgttttaaaagattttaacgtcttttgaagttcctacttagaagtaggatctttaattgactaataattgtgttaaatcaaaatcatggaaaataagaatgtttataatattattttactttaatttttggcaaggtagaaagttatttaaagagacatcaaaaacaagttgatctactttattactttgttaatctatgtcctctgagaagcagacatctcatgggattaaaatcaggaggaagctggaaaaggctaagagaacagtcagatcatgatgaaattattaacctgagtgaaggagagaagaaaggatgattgggtacaaacttcctagactgctgtgcagtttgaggaaaatgaagtgaagttactgaggagtcccaaggcacaggtagccaccagaggcatcaagtgtgtccagaaattggcctgccttaatatcccagatacacctagtcatcggctaagcacagcccatgggaaatgtagacatagcctcagcatagatgcaatcatgggtttcagagcatgacagctggagctcttggccaattgccctccttgtggttggagatctaagaggtgcattcctatgggtgccagagtcactttgcttaaggctggacatgatctcatgcaacattaaaaagagcttttggcattttatttttgatgaacaatatataactgtgagctgtctattctactggaatttaatacttctattactttgtagttcttatattgtgtcacaaatggaaactccccataccatattgtgaagtgacatcctgaaagataatgagagccacagctataggcaggcaatgccaccgtttctagtaggccactgaattatccgtccactcatctagttaaggtatccatttattatttttttttaaaaaaatacacatagtctggcctttgcctaacttttcaacctcatcttttatatttcacctatggcttactgtacactatcgttcagtggtttttttctgttcattgagcaagccaaactcattataacctcagaatagtaatagctatactctcctttgcccggaatgttcttttagattttcacatgttggactctcacactattcagacctcagtgcaagtattactacctcaatgaagctttggttgatcagctcatctaaactagcaccttgtcatccaacaacagctatccaattactggtgcttttttatattatagtacttactagtaactgcaataatatcattttgttattctccagtctttgtagatttgtgtccctggaaaatcatagaactaatgctctctaccatataatcaatatctagactagcaattggcagctaaaagtcaataaatatttgttgaataataattgacaaaagaagacttctatatttcagttgctataatgggtctgagaattcaaagatatgatttcttccctcactagagattatagtccaaatagaaagtacagtctaattgcttagaaattacttttccctcacctcctaacagtcatctattctttcttaagttgctccaggcattccttctcatgtaccaattaattgtctatttttgttgttgttgttgttacataaataagttctttagtggtgatttgtgagattttggtgcacccatcacctgaacagtacaaattgaagccaatctgtagtcttttatccctcactcccttccttccctttacccccaagtccccaaagtctattgtatcattcttatgcctttgcatcctcagagcttaggtcccacttttgagtaagaacatacaattcttgcttttccattcctgaattacttcacttagaataatagtctccagtcccatccaggttgctctgaatgccattaattcattcctttttatggctgagtagtattccattgtatataatagtttctttatccactcgttggttgatgggcatttgggctggttccacatttttgcaattatgaatattgtaatgctataaacatgcgtgtgcaagtatctttttcatgtaatggcttcttttcctctgggtagatacctacagtgggattgctgggatcaaattgtagttctacttttagttctttaaggaacctccacactgttttccatagtggttgtactgtttaccttcccaccagcagtgtagaagtgttcccttttcactgcatccatgccaaaatctattatttgtttattttttgataatggccattcttgcaggagtaagatggtattgcattatggttttgatttgcatttccctgatcattagtgatgctgtgcattttttatatgtttgttggccatttgtatatcttcttttaagaattttctattcatgtccttagcccactttttgatgggattgtttggttttttcttgctaatttgtttgagttccatagattttggatattagtcctttgtcagatgtatagatggtgaagattttctcccactctgtgggttgtttatttactctgctgactatttctttttctgtgcaaaagccccttagtttagttaaatcccacttatttatcttcgtttttgttgcatttgtatttgggttcttggtcatgaaatctttgcccaagccaatgtctagaagggtttttctgatgttatcttctacaatttttatagtttcagtcttagatttaagtccttgatccatcctgagttgatttttgtataaggtgagagatgagaatccagttgcattctcctcctcattgtctttttttttttttttttttttttttagatggtagaatagctctgaacaacagagactttggaacaacagaaatatggcattcaagaaggcaatttctctagaactttatttccacaaattcataaataataaaacactagattgcatgcttctgaaaaatttgaagttttacatatcaagatcttttagaattttcttgaataaaacattactacatttggtcaacaaatgtctgctgataccaaccatgcaccaagcaatgttttgaaaaaatggagatacaatgcagatccaaacagataaaatccttacagacttagtgtttacttggaaagagagatatacacaataggcaaagaaatgaatatcacaaactgagatagggctttgaagaaaaaaggcaccaagtagggaaaactgcatataaaaggcttagtctagttatatagatcagagaagatgcttcagagaaagcaatgtttacccaaaaaaaaaaaaaaaagttactgggtaaaagtgaagggtatgtagttaggaacatatgaaggcaagagccttctagcagatgaaacagcaagtgtgaaaaaactgaaagaaatatctaacaaggggctgggcacagtggctcttgcctgtaatcccagcactttgggaggccgaggtgggtggatcacttgaagtcaggagtttgagaccaccccagccaacatggtgaaacctagtctctactaaaaatacaaaaattagcaggtgtggtggcaggcacctataatcccagctacttgggaggacaaggcacgagaatcacttgaacctgagaggcagagattgcagtgagccgagatggagccactgcactccaacctgggcgacagaggaagactctatctccaaaaaaaagaaatatctcacaatgacctgaaagaaaataaggaaccataatatgtgtaagtccttgtaaagtttgtaaattaggctaatcttaattttaaaaagcaaacaaaaaactaactatgctagcctttatttaaaaaaaaaaatcctaactttgggctgggcacagtggctcacacctgtaatcccagcactttgggaggctgaggtgggtggatcaccagagatggtgaaacaccatctctactaaaaaataaaaaaatagccaggcatggtggtgggcacccgtaaccccagctacttgggaggctgaggcaggagaattgcttgaatctgggaggcggaagttgcagtgagcagagatcgcgccactgcactccagcctgggtgatagagcaagactccatctcaaaaaaaaaaaaaatttaatataaaaaatgacataaattaaatgtgcacaatctatggaccttaagcatgtgttcgttatgatgtcctgcttggcaaagcttctagaaaaactgttgtttggttaggctcatccaggtttggactagccaagtatggaagaaatcgagcagtactggttctaatgatggaattagctgaaacttggagccatgattttgcaggtggtgtgatgaagaatggcagaccctggatttattgaaaatttaattacatacttagtacaattaaaccatgaaatcatgagggaacaaaaaaaattaaaaaaaatcatcaatgctgctgggcagctggaaacattttcatattacagacttaacttctattatcagtgtcaatatctatatcatcctctaatatctcatatgaatttcgctaatggaattaggaacaaaatcaggtggcaaagagcaagtatgctcacttattgataaaatacactggcgttgtttgatctcttcttcacagtactttgcttgtcctttgttgccctgaattacatgtatcccttatgagatgaaaagctaatttatatgattgatgttatatgcttcctgaaagtttaagtatatgaccaaatgagagagcagcaagaaactcactattttttaaaccataattgtgaaagatatgattaaaaatatagagtttctatatttgatagaaaacacaaatttatgtaatgatcttttcattagtttagcaaagcctttgttttcctgcagtaaatgtataattacaaaacttaatttagtatttggctcaattaactctctgcctgtaagttatagaacttttgtaacctgaataattgaatatgttttacattatcctatgtaattgtttgtttttaattttagacttaacattcttgtttattttatctatattattttatgtatgtgtgtatatatatttatttttcttgtttatttcagacattttgttatgattttttgattttgatgaccattatttgcgagaaaatttccaggtaatttttcattcattgcatctatgataaattgatggtatttctttaggaaagaaatacctgttttatcaagcaatcaccttcagaagaattcatatacagtgaagaagaaaatggtccttaacccattagttgaatgaaccctggagcctgtgttgcagctagcttgtcctcacattcatatctaaaccctgagctacaaaaaatttcatcattttaattagatgacttgttcaaaacaaacacatctacgagcaaacaacaacaataaaaacaacttggcatctaatttgaacaaggcattataatagctgtcttgggtgatgccgagatagatacaacaaatttacagccctcaaataatgcacaattaagaagacagtaaaagcatacactgacccagtggagcctgagagagggagtttaaaggggaatatacaaaggactatggaaattcagaggtggttgtgagagagttgaggagaagcaaagggaattttatgaaaaagcacatcttttcatgtacatcctaatctattagaagggtttcactaagtgaataagaataatacatttgaacatttaccatgataagtgagttgtggaaccttaaaaaacatctatgtttgcattcaggcaaaagaaggggtagaaaaagaaaaggtagagtatgagatattttgagaaaacccagcaaacaacacagatataaaagccaattgacaagaaagttcaatggaggaggagatgtctagcaatatcgaatgttctaggtgatcaacaaggatttaaatggaagatttagtatttaatgtggtaacaaagaatattgagtttttcagtttgggaggtagagttaggaggattgcttgaacccaggagtttgagaccagcctgggcaagataatgagactccatctctacattaaaaaaaaattagccaggcatggtggtatgcatttctattttcagccactcagaaagctgagacaggaggatcacttgagcctgggaggtagagggtgcagtgagccatcatcatgtcactgtactccagtatgggcaacagacagagaccctatctcaaaaaaaatcaaaaaagactgttgcagtacattgagagagcaaatgtggtaatgggagggctaaggaacacagagaatttaggtacatattttttattttaatatttaaataaccatatttatattcatagctacaacttatttgtgcattcaacatctattgagcacctactatgttccaggtactcttataagcatacaacaagaagcagaaactgaggtacaaagattttaagtaacttgctcagctggtaagctgaagatgccaagattaggagccaggcagtctcacttcaaaatccgtgtccctagtctcaaaaaaatagcctctttctctgttctaggcactctgatgctttcaatacattacttcatttagtacccactacagtcctgtgacatattgctatgctgatcattgtttaggtaaagaaactgaggcatagcaaagttaagtaactttcccaagctcacacagctagaaaaaggcggattggaattttagtctaaggaagcctgatcccaaggcccaggctcttatttagtataatactatgcaaatattttatttagagacattttggaaaaagtttggaaaatggtaaaatataacaaagaaaataactctacctagcaataactactaccaaatttttaatatatttctttacaatattattgtgcatttttacataactgaaaattttaaatatatacaattatatatgattattatcaagatttaaattatgtgcaaaacactgacgctgcatctagtacatagtaggcattcaaagaaggtatgtacaattatatttctacttttatcattttaattaaattaacatacagttgacccttgaacaacatgggtttgaactatgtgggtccacttatatgtcaactttttttcaaccaaacagggatcgaaaatagagtatttgcaggatgtgaaacctgataggattcgatagggagggctaattttttgaatatacaggttctgcagagccaactgtgggacttgagtgtgcatagattttggtaaacatgggggtcctggaaccaatcccccatgtatactgagggacaaatgtatttatatagtgcttcatacattaaaaggtatattcacatatgctatctcctttgttcttcaatgcatttccaataggagcatgaactttgttacattttcatttaacaaatgaaaaattcaacccgtgaatttaagtgatttgcttaaagttacacacacaagcagtagtaatgcttggcctagaacaccatgtcagataaaatatatgtaaatgataatcaatgtgtcattgcctcagatattgagaaagaaggtacaagatttcattttcaccatgagctaatcatataccaatttcaattccttggggtagaagctacatgatatcttattttgccccaacaatgaccctatgtggcaactgctatgtcggccccacagaatcaacacacacatgcacacacacacacactcacaaccctcagctaaagccatgacaggttaactgacttgctcatatccatgctccttctagatcttgcaaggagtgtatatatctcttttcttctacaactgagggaatagaataagcagagtacaataagaaagatacagactatgaatagaataggtatagaagtagaatgtgcaacttccgttactataaaataccatttcagagaaaatagagtcgagtcaacaccagtggatgcagtgtagggatatgcatttaaaagacagggatatcaccaaacactgaccaggtagagctgggtaaacagtggtgtgggtacctccaaaaagtcagggtgaaggactgcttttgaggcagttaacacaaataacaaaagggtaggagcttgagacatttggtggaaacaccagctattggtgagaggagggtattgtcaatggacaagattttctgcttaactcaccagtcacaatggagactatatggttactgtcagctaatctttctgcagattaatttcccttccaggtgctggcctttagactgatgctaacactcaggattcattaaccatatttatttaaagaaccacaaaaatgccattattcagaaatttcttatgaaagtgcctcataacaaaagaattatcatgggttaaacttatgctgatgctgacccaatgaaaaacatgcttacaaaattatctgcgctgacaactctacaatagtctaacacagggataagctcaagaattctttggagttccattcagcttttataattaggtaatttttctatcacagtcagctggagattaatcataaaatgtgaacagttttattttctgtatttcaggaaacgtaattggtgataatcattataattgtaaagaaatctgcagagccctttcattgtggccatagcaccggctttaaaacaagttcagttgatgtctgtgtgcatgtgtgcacacacatacgtgtgcgcacatgtatttgtgaaagagtataattatacaattaaatgaagaagtaaaaagattcttaagagaatgtgacagttgatggtctgaaagtaaagaaaaggagaaaggataatgcttctgaaaaccatcatttagacacgcaaatggaggcttacataaacctgttctgaccttatgtatttgaaatatttttaaattactgaagtctttggaaactgcaaatagtttcttatgaaaaaagatgctcttacataaaaggaactattaaacttagagaattgaacaatggagagatcagatagtaacttactattctttaaaagtcttaaatatatgtaaaattcacaaaaattcacaaaaagcagaggaatatttgtgtccccctaaaattcatatgttaaaatcctaccccacaagatgacagtattagaagttgagggctttgagagttgattaggtcatgagggattagtgcccttataaaagaggccccagagagctagctaccatgtaaggacacagccaggaagtgtcatctatgaaccagaaagtagaacctcactagacaccaaatatgccttgattttggacttcccagccttcagaactgtgagaaataaatttctgttgtttataagctacacggtttatggcattttgttacagcagcccaaacagactaaggcagaggcttacataaaccctgttctgacctcatgattgtgaaatatttttaaatcactgaagtcttaggaaactgcaaatagtttcttaagggaaaaaaaaaagtgttcttacttaaaaggaactcttgaacttagagaactaagcgaaggagggatcagacggtaacataattctctaaaggcttaaatccgtgtaacactcacaatgcagaataaacatgcacccacgcacaacctaaatctaaccagttactgctgaaaacctgaatgttttggggaagtgtgccagaaagctctaaagatttttaagcttttcctgacctctttattttcactgaaatgcaaatatacatttaaaaatctgtttacataaactgaagaaaaagaaatcaatataaaattttccaaatttcctggattttaaggttagaagcaaaaatgagagaagatattttcataaaaagtaagaaaataatcagttttgattcactaggtccaaaaaatgagtagaaacatacatctaaatgcaccagatttttaaaaattttgttctttatttcaagaacaacactgcatttttggagggatctatttttttcagggaagaaaatatcacaattttgaaaaaaaagagaccaatataatctccctttttgaattctagacgaacgataaaaagcgattttgttaatgattttttaaaaatgagctttgcaacatattggcagccctagactgaagaattttaccgttctaattacaaacagtagcagttattttatactaaacataccaaaacgtaagtgagcattttatatgaatatgaattatttctactgggtacctatatacatgttttaaatattctgtgatttacccagaatctagtcagaagtaggccattttgataaaaagtgcctttagaacatcgatgggtaactaaaaaatctatgcataatgtaaacattccaactatttgttaaataagaaacatttttgattattacttttttaaactatattcaatttggttattggtaaaatttagtttaaggcaggcatatttcttttcataattttgttttcttttttcatgaacatttatcatgtccagaaggcaggcatatttcaatgaagtaatgtttatgcctagctaacattttttatttttaatgatatgatactgggtatattaatgcaaagatcctacaattttattttataaactcttacctgattttgaatccttttttcaacttttccagttatgcatgaagacatcatacttgaaaaactaaatataaattagcttctcttttgtaaaataaaaacaaatttgcaggacttctgctagagagatggattaggtatacattcctctattttttttcttaagtaaaatatacaattaaaaaccttgaaatgaaagtgtatatgtatgtgtatatattacagacacatatatatgtgtatacacatatatagggatatagtttattaagtacaacatacaactacaaaccttgaaagtgtatatatatatatatatatatatatatatatatatatatatatacacacacagatatagaaagagagaggtacatacacagacacacacacacatacacacaccccttaagagttcttaaacttgacagcagaaatatataccataaaaggaaaaattgataaactggatttcatccaaattagattatattactctgtgaagaactctgttaagaggattcaaaaaacaagctacagagttggagcacatatttaaaaaccacaacatcaacaaaggactagtatcaagaatacataaagacctctcaacacttaacattaaaaaaatccagttggaaaatggataaaatacatgagcagataatttataggagaatatatgaatagtaagcacacaaaaatttgctcaccatctttagccattaggaagttataaattaaagccacatgaaatatcattacatacctatcagaatggctaaaataaataataatgacaacacccaatgttagtgatgacacagaaactgtgtcactcatacatggctaattggaatgtaaaatgacacaaccaccctggaaaagagtttggcactttattacaaaaactaaccatgcaactattacataatcagcaattgcctttctgggaatttatcccagagaaaataaaagctatgttcaccacaaaaacctgtatattaatgtttataatagcttaattcataatagccccaaactggaagacatcctgatatgctttaatgagtgaatgattaaacagactacagtatagccatatcatggaatctcgcttagcaattaaaaaaacgaacctactaacgtatgcaagaatctggatgaatctccagacttacgttgagtgaaaaaaagtcaatccaaaaaggctatatactgtatgaaaaattgtagagagaatactttaatggttgacactggttgaggaagggttgggagttggagggaagtatatgtggctataaagggtcaataggagcaatctttatggtgatgaaaatcgcctgtatcttaattgtatcaatatcagcaccctggttggaatactgtactatcgctttgcaaggtgttatttattgttgggtctctccatattatttcttataaatgcctataaatctatagttatctcaaaataaatagatctacttaaagataaatggctaaataaataatttgcaagctctgaaaggatctccataaaggcaatcacaaaggaaagctcttctaggtttttgagattttttttccatttttcatttaaatttttaagtttttctacgggaaacttatactgctgtggtaataagaaagacaaaatataatatgcttgtaatctaaaatatttttaagatacagtttcattcctgtgttcacatcaatacaatgttctatatatgagaggcaacttctaaattcaccatctgtctattatgaaaaattttatcctgtggtcagggtattttatagctagagtataaacttgtaatttgaataaagagtatgggttgaatagtagatgtgccagctttgctttttttctatcttagaaatttataaaaaattaagtttgcttttaaaacttaaaagtgttagttctgaaccctagagatgctgacctaatggcggcatattatggctgtatgctgccaattagataaaagcagcatcaggaatcatttcatatcgctttgcttggctggaagtgtgtgtgcacacagatacataaacacacttctaatttctgcaaaagatcactgttagttctttagaaaactgctggcctattttcaaaagccgaaaatgagctggagcccagtgctgaacatcagaaatcaagaggcaatctaagtgatggtgacagtaggttttagtgaatacaaaagatgaaatggtaggaagctggataaagataattctgctccaaaatccaaagggcaagagaacataaagatgtcagaggtcagtatcattgaggagggaagagttttgtagctctaattgattctccgggctcctagagggattgaacttcttttggaaacataaaggtagagggcataagcagaaaatatatatcagatacaaaaccaatttctcccagaatacatctcaaaaagtaatgtcattaaattctggagccctgaagcaaaattcttcaaagttgtctccttgcagttttcacaagaaataacctttgccatacgccctgggaaactcatgttttcatccgcaatatggcagtgcttatcagtctgaaaagattattctgagaagttacataaacttgtaaactattaaaccttaagtgaatgtaaaaatgttacgtcatcttcattagcatgcctccctaaaacaatagagagtgcttagcctgagaatctgagctaagcttgaagtgaaacactactctgctgtgtaattcattacttgaagaatttacttccggcctaaattctgtttagtggtaggtctgccatctagtggccacttacataaatacaagttgtgatcataaattaaagaccatatgaaaatactaggtcatccaaatggaccatttctagtccaagtataaaaaggcaaagaggatttgactgatggtaagaaaatttatattcagggatcacttagaggtaagtgtgctgactcaaaacactatgagtacaaaagcaaagtaaaaagtcatttagacttatgtggacttcaaaatgagaaatttatattcataaactttcactaaatttaaaagaaagtaaccgttgtgttaacttatttatgttttctcctcattatcttttagttcaatcacatttatattttctacttaatgtaaaccatgaaataaaattttcttcagtacttggatttgtgctgccaatttgcagaattgtcagttattaaataaaatgtaacacagtttcagaacttaaactctaaaatacaaaaacataacattgttcaccttcaaataatacaataacttttggggctctattattattattgctttctttgttaatagaaatgacaggtaatgctaggcctttgatgctcattctcttggcataatttttagttatttgtccaaagctacacactcccaccctcagttccttccagagtgctaacctgaaagcttatatttgtaaaagccccattattattaaaaagctcattaacatacctgcaaatggtatttgcacagtggctaagtacactgaacacaccctgagaagtatttactaagctaaattcatcagacaagtgtacaatattcacatttcagtgttacaattgttatttttatttatttggtttttgagttggtatgcttaagaagagattaaatctacctccaaattatagttctttgacatactaatcagttacattaaagccatttaaataaataatattttaaaaatccccaaaccattaggcatgttttcattattgttgtatccagttactttccccttaggcttattattattgcttgaaataacaggatgatatcatattgttcaaactggaaatatagataattttgcaattgctaatgttgtgtaaaaatgtcctatgataatccacaaaccaataatctgtattgttgatatcctaacaagtatttgtaaaacacaggccaaataataaaacaattcccattccatacttaatccttgattttatggggtcccatttatttgtaatttgtaaatataatctcttacaatcaagtatgggagcctcaaagtcatgaatgatctccaatttaaggtaagaatgctcatacatttgcttgtggatacatttctttttttttttttttttgagacggagtctcgctctatcgcccaggctggagtgcagtggcgcgatcttggctcactgcgagctccgcctcccgggttcacgccattctcctgcctcagcctcccaagtagctgggactacaggcgcccgccaccacgcctagctattttttaatatttttagtagagacggggtttcaccatgttagccaggatggtctcgatctcctgatctcgtgatccgcccgcctcggcctcccaaagtgctgggattacaggcgtgagccaccgcgcccggccggatacatttatttctaaataagaacatctcatgtggttcctaagactgattatgccaagacccatgtacttcaaaatacggcattccaatgtgtggaattttctttttccactcaatctgtctactttttaacaacatggccaaactcccaggatcttaatgccaaaaaaagatgatttttttttaaaagaaataatttaagatcctaaaatgaaagcaaaatgtccatcctcgtgaacaacaaagtcagtcacaagactgaaaccatggtctataataatttaaatttatttattacttactctattatgtgtcaaacttaccctgagtcaaaatcgtgaaggtgaacgtaacattaaatgtgcgttttctttaaaccacactgtgatgaaatggactctcactcgggagtctggctccagaggcctcacccagcagagtgttcactatcacagaggacttttcacacatttcctcggagaggagggaagaaatccatcaagaaaggggatttatattccaaaatcacaaaatggctactatatcaactggagaaaaactactcacaggaagaaaaacagcacagaacaaacctttagacagtccatgccctagcacaggatttggacagacataagccaagggccaaatctggctctctatctcttttgtaaataaagttttattgtaaataaagttcagtggacacaccatgcccatgtgttcccatattgtatatatgtatataacttctgtctccttttattcattgccttctctgtatgagatatgcatttctcttacctcaatcaataaaatccaacctatcgtgaaggtataactttgtataatggaattaaattgaatatatcatttggagccttgtttttacatttaatattttttctgagatttatggatactgctgaatataagtgtagcttatcaatttccactttttaagtgctatggactattcaattatacaaatcaataaaaattaacctatactatgccaatgggcattgggttggggttaacactttggcttttctcagtaatgtttctatgaatgtttttgtacatatttcttgatttacaaatgcagcagttttcgagagtttttacctaaatgttgatttatttttgacatagttggtaaacacttgacattgtgactttttttctttttggttagtagtaaaaggaatcttttgtgggttttattgataccaattatataccaattatctttttatcattgattgccatttgtgtttcatcttctatgaaaagcctattcaattttttggctttttccaatcctcctctcagtttgcttgtctttttaccttattgaattgaaggtgtttttttaatatattctagatactacctctttatcaattatatgttgcaaatatcttctcactttataacttgtattttgtgtatgaggtttttataaaagaaaattttacggctcacgcctgtaatcccaacactttgtgttgggcagatcacctgaggtcaggagttcgaaaccagcctggctaacatggcaaaaccctgtctctattaaaaaatacaaaaattagctgggcgcgggggtgggcgcctgtaatcccagctactcaggaggctgaggcaggaaaatcacttgaacctgggaggcagaggttgcagtgagccaagattgcaccactgatctccagcttgggtggcagagcaagactctgtctcaaaaacaaaaaaagagaaaattttaactttaatgtagttaaacttacctaaattttatttttatggtatacaattttatattttgtttagtaaaactttctctgcctctgaggtaatataggtattgttccatattataacctaaaaatgttaaataatctagaatctactgttgtacagttctaagaaagagataaatccctttattatacaaataaccaatttttttcagcatcatttattaagaagtctatctttcgtcattgttttgcaacgttaactctatactataaatcacgtttccatagatatgaaagtcttttcctggactctattatttcagactgttctcattggaacaacgtgacaatgcttaatcttttaattctgtatttcctttgtatacttttagccaatgttgtgcttatcagtacagatataaaattgttatatcatcctgtcaaatcaaacctcttatcattatgtattgactctcttcattcatactctttattcctactaatgcattttgtcctaactacataagtattattatgggtagtgttcaccagatacacctttatttatctctttacttttaatatttgtattcagagaaatctgatgtgcagaacaacactgttatgccatgaattagactgttgttgaatattcactggaagagtatttttgtacggccttgctctaaactttctaaatgaagtaattattgtcatgtcccatgcaactgtgtgcatagcactcaccactagcatagctattgactgggtataacatataagacctctcctatctttcctactgaatcttctaaattagttgattactaagttagaaacaatgtactaaacaatgaggtttttatttacaatagcaataacaatttcggtaaataaatagagaaaaacatcacttttgaataacacaattagtagatagagttggaggatggtaaataccagagacaacagtaatctagagcaatattaaataaaagttctgaagattattcagatataaccttacccccacttaatagttaggataccttttaaaaatgcttcaaagagcattatttgtacctccataagtaacaaaatattgaaatgagctattaaaagttataaatgaattcatgaaaacaatgcatttgaaaaaaatctatataataatactgcacgaaaaatgacagaaagacataaaactttacatcaggaatctgtctgaaaatatcaagatttcagtaatgtattttattcacagagaagcttgctctcctacgcaaaatttgtctaaaatgttaccacattagtgaatctaatgaattccaaagtcccaggttcctgtaggttttcagctttacagaaatgatcaaaattgagtgtctcaatgtattatttaattaaaaaaagtttgtctgaagtttacaagccaaaaagtaaaaattatatatgggtaatactttacagatttttttgaagggtagttgtggattttttaaaatgtcttatctaatatttagataagaacccaaataaagtatattgtcaatgtgaatatgtatacttatatatatgtatacacaaacatctctctctcatcacacactctctctctctatatatatatacacatacacatatatatacacggatatgtacacacatacacacatataaaaatatatatgttcaatggatacaaagttatagttaggaggaataagttctagtgtttaactgcacagtaaggtaactatagtctgaactaatgtgtatttcaaaatagctagaagagagattttgaatgttctcatcatagagaactgacaagtgtttgaggcaatggatatgctaattacactgatttgatcattacacaatgtatataggtaccaaaacatcacactgtaccaaatatgtacagttattatgtgtcaattaaaaacaaaataaaatgtgagtgtgtgtgtgtgtgtgtgtgtgagagatagagagagagagatgagtgtgtgttggaaagcttacaattttaaagtaaaaattcaactttggaaaaattcactagtgatgtcagtgttataatttaagtcttaaggagagattaagaagataagtatgcttaaaatgtgtatgcttaaagaaaatcttcatcattttcttaaatacttgatgcttcacattgataattccaactgaattaaattagaaattcatctgcattatcataagatatatcaacatttcatatgttaataagagatttaaagaattctcactctgaaatataatttaaagaaataaaattatctgaactcaggttattgtcaagactggttttatggttttatccagtcaagaaaaggcattcaggacatttgttattaactacttgtgcaaacaatgttaaacatcaatgaagactatcaagaatttggtgtcgttgtgggcagcagtaatcccaatattacttccaaaaatcttcttctccataaaagcaacaagaacactgcaaaaaaaaggtgaacttcaacttttttaggactctggagattaagcaaaaggtttcaattatataggtaatgtttattagaaaaataatcgctgaatcttggtaaaacatgaagttttgtgatgttttaacttgccccaatattgtctccctctctccaagcctgtgattgccttgaaaaccagcagttcaacgatcatagtaaaaaccagaagtgtagcaatgcctggagggagcagaatagatttagagctcctccaaaatctaattcccaagcaactgtcattatttgacttgcttctggaaaatcctatgtgcaaaaatatttggcttgttccctggaaaatcccacgtgcaaaacttgttacttgagctaagtcagagcttatccagtgcagaaagctgtttccctgtaggcagttactacaaagaattagcagcaattgttaaatattgtggttagctgaactggtgacagcagttaggaaaaaacaacaaggcaaccacaaaaaaggaaaagctaggaatgagttattcataggtggattagaaaagttctgtgataatcctgggaatctagaatgccacacttaacgcttacaagtttgtgtatgcccaagaaaaactagagaaggccctatgctgtcatgctgtcatctctagatgatgttgagcttctgtgcaagcaggaagtgaggcctaaagtggtgttgcaagcagcctgactgggaattgaaggtgtaccacaacgtgcaccctgagctcctcagcaaaagctgggagacttattggttccagcctgtaagaaaatctctatcaattttttagctaactaataagttaaccaataagaaagtttagtgtccacccataaaaagaatgctaattttacagaactaattcaggaaagtcattaaacaaataaacaacagcaacagcaacaacaaaaaccaatcataggaaaaggaggcagagagagttagcaaattatattatttaagatgtctagttttcaataaggaattatgagaaaaacaaataaagggccattcacagggagaaaaaaagcagtgaatagaaactgtccctaaggaagctcatacattggacttactaaataaagactttaagcaattttgaatatgttcaaagaaaattatggaagtaagtctcacaaaacaaagacttagaaataaagagacagaaaatatagaaaatcaccaactagaaattttggagttgagaaatactatcactaagcttgaaaattaactagaggtgccccaaaccagatttaaatggagagaaaaaagaatcagcaaacatgaagacagatcaattgaggttatttaacctgacaacagaagtaaaaagaataaaggaaaatgaacagagtgccccagaaacctaaaagataccatcaagtgtactagcatacttaccttttattaactatctatagtcctcatgttgtacatttgattcctagacttatttatcctgcatcattgcaattttgtaccctttgacctgcatcttcccatttccccaccctcacccctggtaaccaccatactactctgtttctttgtagtctttcttgtttttttttttaagattccatatataagtgagatcaggtgatatttgtctttttgcatttggcttatttcacttagcataatgtgctctaggtgattttcttatttttaaaagctgaataatattccattttctgtgtgtgtgtggggggagggggggtctctgtgtgtgtgtgtgtgtgtgtgtgtgtgtgtgtgtgccacaatttattttcccacttatccaatgggtaacaatactttgcttccatatcatggctattgtaaataatgctgcaataagcaggagagtgtaggtatcattatgaagtaatgactcccagattgctcggtcatattgtagttctatttttagtttcttaaggaacagctatactgttttccacaatggctacattaatctaaattcccaccaagagtatatcaggtttcccttttctccacatcctcaccaacacttatctcttgatatttttataagggccatcctaacaagtgtgaggtaatatctcgttgtggtgttgacttgcatttccctgatcattagtgatcttgagcaccttttcatatacctactagccattttacatctttggagaaatgtctattcaagtcctttgctcactttttaaattaggtttttcatttttattgctatcaagttggataattcccatatatattggatactaacacccaattagatatatggttcacaaatattttctcctaatccgtatgctgcttttacattttgttgactatttgctgtgcagaagctttttagtttgatttactcccacttgtttgcttctcttgcctacacttttggagttctatcaaaaaaaaaaaaaaaaacattgttaagaccaatgtcaaggagcatttcctcttttctctaggagtttttcagtttcaggtcttatgtttgggtctttaatttattttgagttgattttgtgtatagtatgagtccaatttcattcttttgcatatggatattcagttttccaaacaccatttatttccccattgtgtcttcttggctccactgttgaaaatgagttggctacatatgcttagttttatttctgggctttctattatgttctgttgctctatgttcctgttttcaagccagtaccatactgttttagttactatagatttatatatatatatatatacacacatacacacacatatacatatatatatacacacacacatatatatatattgtttcttcatttttcttttaaattacatagtaggaaaaataattacaagtaaaaataaatttatactgtatttttatatttaggtatatgttacctttattttccgtatgaatttgtgttactgccaagtattctttccttttcagcccacagaacttcctttaatatttttatgacaaggtctacaaatgagtaattctctaattttttatctggtattgtcttaaattttcctttcatttttatggcctatttttttctgaatagagtgcaccaatatacttaaaatggcagtcccacaaagagaggagaaagagaaaaaggaaaataatttttaaagatatactggccaaagactttccaaatttgaagaaacatgtgaaactacagagccaagaagctcaacaacttccagttaagataaatttaaaaagacacacagtaacacattgtaatcaaactgttgaaagccaaaacaaagaaagaatcttgaaatcagtagcaaagaagtgatttatcatatatgaaggatcttcaataacagtaataggcaatttctcatcaaaaaccatagaggcaggaatacaatgagatgacaaggtcaaagtcctggggcagagaaataaaaacaaacctgtcaaacaagaattcttcatccaggggaacagtattgaatcttagttgacatataattcaactgatggaaacgaaagtgtgtgtctgttggaagagtagtcttttagacctgagaatgctctgctactctgagatatagagtgccattgacatcagtctggaagccttatggtctgagtggactagataattaatctatttagtagattaattatgctttcctcacaaaccactactcagttaatgtctcctggacatggttcataagaaatctttgaggagtcatttgcctatatgcaagtcagcaaaatgtgagtttgaatctgttctgtctttccttgtcccttatgcatgtttcgtttgtagcattctacctctcctcatctttctacgtcttctcatcctgtaacctcttacacaggatttgattctgagcaggataacacactcaagtaactggcccatcattgtctctcagtggttcaaaagaaaaagaattgagtgaataaatcaagttcaccttcccaaaagatgttgcctacctttctgaaggaccaggaccctccactttcatagcttgagtgtaaatagcaatgaccccctagcggatgaccttcagaaagtatatcccacaagactgctgggaattgtatgcctgaggaagatgatcattaatccagaattattcatgttatattgaatgcaaaaagtgagatttctggatcaagtcagaatattatactttctagtgtgatgtgacaagaggcaggtggacaggactttacattcaaaagagcattttgacactaacaaagaaggacccagaggttctaaatctaagaacttatatacatatttttgagaaaggtagaaaaacctttgctctgtaggataaataaattctcttgagaagagagattctaggttcttggcttcttaacactttggaacagaaataagggtctccaggaataaaataagacaatccttctggatttacaacccttaaaatgtctccatggtcctgtgtttcatccctccatgtaatgtaaacacatacctcagggaggtgaatctctccagaatagcctgtcactatcttaccatcctttaacttccaaggtgattcctttaacccaattaccaggtttctttcttcaaaaaggcctaatcatgcagaaactttaaaatctgttttctacagtcccataggtgtacttccgtcattactagcagcctctgctgtgcagtgctgttcaaagattggcactgcccacatttgtatttcaatgtgaactgtatgacttgaaaaaaaaaaaaaaactcctgtagcacccatgtatatctctattcctgacttagcctagacactcagattctgagacattctttcatgatcatggatctatggctcattttctggctattgaaaatgactcttctttggggacagactatccataatggcccttgctatggtttcaatgtttctcccaaagttcatgttttggaaaattaatccccaatgcaacagtgttgagaggtaggacctttaagaggtgattaggtcttgagggctctgccctcatgaatgaattaatgtcattatcacaggagtgggttctttcttgtgggaatgggtttatcctaagtgagtttcagtcccctggccatccactctgttgccttctgccatgagatgacacatcaaaaaggccttcaccagatgacagcctcttgatattagattttccagcctccagaactctgagaaataaattttatttctttataaattacagtctttggtattctgttatagaccacaaaacaaaccaagatagatctgaacagtaaaaaccccagagtggtaaaattctgagatggctcttccttctagcaataccttcacacactcccccgccagcagaactacaccctacacatacatgcatacaaatttactcccaagaattaaatattttctataggttgagtgcacatagaaaacactttacaacaaagaaatgtgttttgtgcaaatatgtgcacattcagcaaatatttgagtgctacagaataagaagagccttgagaaaaatcactccaaagttttaatctgtgttgatattcccgtcattttaatttggtaagaaagaagctgataagtgaactccacaagttcataatggtctcagaagttatagagaataagcaagcatatgtataaattaaaaattatttttcctgtacttttaagataagtacttgagtgcttaacatgtgttacaaaaaccttggatggtctgacctttgctcccatttctagtttcactaccctgtgctttaaactccagccaaaccagcctgcctttatttattcaaggataacactctttcttctactttatgatgtttgcaatttctttacccctttcccaaaacatttttttacatttccccagcttggtataaataaatttctttgcatatattttgccttacacttaagttctatttacttaaaattgttaatcctgattgaaattatgcttggtttgtgtgactacttgattaattgtatctcctccaccagacatttgttccctgagaacagggaccatatgtttatgtcacctattttattcccagtatataggataacgtctgacatgtagggccttaataattttggaaaatagagtttgtaaataagtcagaaaagtatttacttagaaaaaacaaagttgtgagtccctgtttatcagcattcacgaaagccatttacaaggtctattgggagaaggtacaatgaaaagagggactgagaataaactatgatatttattctcaagaaaccaatgtctagtagaagagatacaattaatcaaataatcacacaaaccaagtacaatttcaatcagagagtaaaccttcaggttttttctggtcagagaaagatcctggccagagaagtatgctgctgcaaaggagtccgacaataaatacaattgctgggacaaaaaccataagactgtggtgttgtggagcaagtggatagtctgtttcaacagggatggagggcctaaggaaagatcaagcaaggcaaatactgaaaattatgcattggatttagcaaccagtggtcactagcagctatagtgaaagttgaaatgacagctaaaggagaagaagccatatataatcagcaaagctcagacccaatgctgaactacagactctaaaagaattttcacctcagaaattatcacttaaaataagcaattttgtctaatatcatttttagacaatatagcacagtatagatgtgaaccttatagaggcttcccaaaataattacctattagtaatccattcagttatctttattcctgttgcttggctttatttcatacttcctagtatgaaagcacaacacatagcagatttctttctaaaaagcatggcaacatatcctgggctatactctgtttgctaataatccatctcatagctcttgtgagtgcataatactcattgaaatcaataagaattacgggcacagaagtgctgcaaggctaagtttttaaactcaagaatatattgtccatacacagccaaatagcacttggatagtctgtgaatataattataatataacccattatgtcttctttcagagagaaagaaaaaaatgatgtaaatttaaacatagcatattctggaaacagtatgcttatggaacagccagagagattttcaaaacttgatcatctaaatgcagagaacagtttcaaggtatgagcaatgcattaagaggccacagatttgggccacatgaatgacctgggagacactttttaaaacagcacaaaaatagcacaaaagtagcacatttttctttgtaaaatatttcagtaaaataattatgcctacatttctcactaaacatttgctgtgcccaaatggatagatttcaaatagaaacaggctgggtgtggtggcttacaggtgtaatcccagcactttgggcggccgaggcagccagatcacctgaggtcaggagttcaaaaccagcctggccaacatggcaaaagcccgtctctactaaaaatacaaaaattagccatgcatggtggcaggcacctgtaatcctagctacttgggaggctgaggcatgagaatcgcttgaacactggaggtggaggttgcagtgagccgagatcatgccactatactccagcctggtgacagagagagagactccatctcaaaaaataattaaataaataaaaactaaacaaacttaccattgagtgaaatttacacattacaagaatttaaaacagacatatggaaaaggacaatatcgactgtgtcttttttctcagatttatggtgtacatacattctattctctgtcctcatacagtggtccatgagacatgggtcctcacagcacctcattattcaccagctgaagcctagtttttctagaccagcactggaagaaccaggttaaatacatttatgttgaaaatcaggctctatcctgccttttccccaccacaaaggtgaagagaatccctcagtatattttatgttatgcaatcaatgcaaaggaatgaactttgttctaggcataaaaataacttaatttgctgtatgaagtacaaccgaggatgcctcacttcatgctgtatctgcatgcatactttcaaaatgacattaaataatttaggtagacttgggcatatacatgtttagtttagatggaatatctaataaaactaaaaggagcttgatcatattggccactgataaatggagcctacagatgtcactgcaactagatatcactgggatttagagaacagatcaagagcttccctgtatcttttttgtttaaaaaaagatgaccctttattttctctatatataacactactgaaaagaggttcattgagactttctcatcaatcagaactatctaaaatgcaatcttacagctgctatatgatataccaccagtgtgaaataaataggaaaggaaagattaaaaaggcaatatttacatttagctaagattatgagtactctctgatatcatggataatgtaaataatattaaaatgaatattattgcagactaattcatttgtattgttatgatcaaatagtttttggagatacatacataatagccctgtctcagttagcagtgtagtgacatttattcaataccaataataaaccaggtgctgcaacagaagcagaccagatggtccaggagtttccacatgagagagcaaacttgggcaagtctttgaatgcattttatttcaatctttcctttattgcaatggaaagctgtcaacaggagtaagtctctatgctgcttaaggtagaatgagattaatggagcattatcaatatctccactaatttttattgcatatgttgccttgggcacaagttctatttttatggtaagaggaacatatatacagaatgttaacagattctgaaaaagcaacatcctgctgggtgaacacatgttagccattgccacagtagtgaactataaattaatattttaaagaactgccatttgtgtgtaaaaatatcgatctataattgtttcttagctacacacacatacacacacaaagcaattggatgttcttagcaagaatattcatatcagaagaattctaaatgcttcaaacgaggaaattattaaaagaaaataatataatgtttacataaaaattctatgtagttattaaaagaatggggtttataataagattccaaattggaaagatatacagagtgtattgtaaaatgacaaaaaatagtgaaagaaagtttaagagaatataaagcaaaggttaaacatttggaaatctataaagtctagcaagataacattaatgagaaaagtaggaatccaagctgattttccctagaaaagaatcttagacaaagcttacgtgctaatactttatttagagctgcaatcccgaaccagcaagcacagggaaaggaaagagaggcataaaaagtgaggcaaagtcaaggtttatctggccacaacttcaggaaaagacccaactggttgcttggccatagaggacatcacgtctttagggaagccaaccagaaactccatgcctctgtatatcagaggaagtaaaggaatggaatttatttgctaactctagatgtcttcttccctcccttactgattcacattaggattaactcaggaactaactccctcactttcaggttacatcacctggccccttaggtggcttctgagaaaaccaaatctcatgtcctgttgaaggacactttacatgagtaaagtaagaatagaatggagagcctctttaaatctgactaggttgatggccagagctattatggctcctggcaggcagaacggagcaatggaggccataccaggaagcccattactcaccccagtagcagccaagacacacagaagtgttagaatctgaggtagattcagctgcagtggtgacaccagcaaccaggatcctccatgagctagtgaatgggggcccagtagacagatgaagctgagtaaatcagagcaggctcatgaattgaacctggtatgttaggcaggacaaattacagctaacacatatccagtgatcatgaggagtgtggaaagtgtgaagaacataagacagcatgctgctacccagctctaggaaactactaccatgcaaggatattggtctatgtcacctgactttccaatttttcaaaaagactataccttcattttcccagtgagaataatcacctacaaactggatctctagagtttttttacataaaagagaatttctaaatattggcttatcaaaaaaacaaaacagagtgtagactaaaaagagatctgtttatgagttatactcaacccataggttactgttttacaaactctgatgtataaaacaaatgcgtttaagaactcaatccaaatctctatctatctatctatctatctatctatctatctatctatctatcatctatctatccacgttgctctccaggttcatacatgcaaaagaaatgatcagctactttgatctcataaacctagacaaacacataactctatcacataactttatcataactaacctctaattattcaattataccttcatttatccaacaagaataatcacctgcaaaaaaagtatactctattaatgtataaaatgttcccattaattagtaatataaatcaatatgtggacaagatatcagatttctgtcttcctagagaccaagaggccagtgaaagccaagaagaatgtccttaagtagaaattctcaaaaacatgtcacaaagaattttagtttcatttgaggtccagggattatggaaataaaagcaagactagtaaaggccagctgttttatggtgcgctgttcttcctaagacaaacaccagcttcatgtaagcctccaggcttaaggtgatacagaaagacctatgcttaccaacttgaaaaaataaaaatttcaattcagagatgataggaagaagtaacatacgagagaaatatacaggaaaataactctaaggaggcaaaggtgaataaaaatcattagtaagtgactcattttttgtaggaggagaaaaatagggttgaaaataaaggcttcatcttttgttcctcagatagagactaactgtacatctgattcttctgaggattgagaaagcaaattttactatctccctttttgtttccctgtgtaaagacaattaaatttcagtttatttctctctgtgtggggattgctcaaacattttttcaatattccaaattgtattgacatctctcatccaaggaaagcttttttccttaattctattctcttgtgttgatatattttttcaaagcgtttttaatgagatctgaagaaagagccaagtttaatctgcatataatctgtcatctgaaactatcggaaggacaacccttagttttgcaaattctttcatggaagattaattataagaggaatctacctgattaatttggtgaattggtgtagtccttgtagcaaaaccagacaagaagaaaacaagaaaataaaaacatagatgagtatcacttaggtacacagcagaaatattaaataaaatgctactagcaaattgaatctgctagactgtgaataataataatgatctcagaaatacaagattatttaacatcagataatctataaaaaatttaccatatttataaagaaaaacacatcttcccaatagttttcaattaaattctacattcattaataattaaagacttagcaaatatgaaacaaagagaaacctcctcagccaaataaaaattatctatccaaaaatgtatagcatatataattatatacaatgtactttatgtaatatattttccaaaagtcctatgagcgaacattgtaacttcatgattattgcattgtcttcatcattttagtgagaacacataatattgctggatcttattcttccttttgaaggttttgaagaaatatgttttcattcagctggacttctagataattaagatgatagagtagtttttcaactgctttaggaataagtgtgagtagccagcacttgaaaatcaaatctgccttttatcctgcccaagacaagttttccttttttgctgaagagttgtttccatcacgggaataatgttccttgatgctaacatgactccctactttgttttccagcctgaatttctaaattggcactagatccttggcttaccttctcggaggaggctggattcaaaggtgatcctaggtgctcttactaaatcagttagcatagagctagtggaaacatcaatggttttacataaaaaatttcaaagattgactgtattaaaagcattataatataacatagtacattgttttcaacctactctcacgaaataccagctgcccaaattaatatacttcctttctggtagttgactcttgtgtttttgtttgtttgtttttaagcacacaaagggaatgcatttgtgtatattctttaaagtgtcatactaacacacattttaacaagcaaaaaaaaaagaacaacaaaacttcagtgctatgtatgtatggtctttacattttatcctacgttcattttatgacataaaaactatcagacatattatctcactacacttcagaccaaatagtttgtttgtttgtttgtttgtttttttgtttttaaggcgaagtcttgctctgccgtcccggctggagtgcaatggggtgatctcggctcactgcaaccttcgcctcccgggttcaagtgattctcctgcctcagcctcctgattagctgggattacaggcgtgtgccaccacgcctggctatatatatatatatatatatatatatatatatatatatattttttttttttttttttttttttttttagtagagatggggtttcactgtgttggctgggatggtctcgatctcctgacctcatgatctgcccaccttggtctcccgaagtgctgggattacaggtgtgagccaccgcgcccagccaatagttatctttttaactaaattcctatgggcatcaaatgaacaggaagtagcgttcagataaatggcatattattgattgattttaaacacctttctacaaattttaagtgacaaagaagcacatgtatgtacacacatgtatgtatgcacgcatacacacgcacacatacacacacacactcatatattgtcttgaagagaatcaggcctgggttgtttccaagaaatcgcctgaaagtggtttcatggagaagaggagagaagggaagggaaggtaagggaagggaggggaggggaggagagggaagggaaggcttaagcaccaggggaacagtgtttcatataaactccagtgagaaatggcagaaaggcaagaatacaattagaagaaaaaagaccaccaaggtcaacagaatgaacagtttctgaagcatgaacaaaagtaaaataacctgtagtgattacctgaccgccagttcttgcaagggttctggacattttgagataggactggagctactaaatgtactgaagcggtttgaataaatactgaactagccagttttggaatgatgacttaagttctatgatgaagttcagtataaaatatggatgagagtgtcacaatgactggacttctcttcagaattgcactgcgaatgtatccgataaaatttccttgatgtaatttctaatttatgaccacgggcagtccttttatatttctgttcaatcctcctatttctgaaacatgcatatgaatcacatccctgtggttatagcattttactgaaatctggttgtattaaacattacccagcatataaaatataatttaatagctaaagcttaggcaatattttgctataaggcaaattgctttaggttgcactttgtagaaaacatttcacctacaaataatgatttaagaaatccaaatcagcctatcttctcatgaccccagcatttagattagtatttttcttattatccattgttactgacaccatgaaaccagtgttgccgacccatgtgacaccctgaaactcagtttctttagcttgcttactacactgcctgacttcataacagcacttatcactcagtatttctccatctccaaaatctataaacttatgtgattttaatcccattctcattacctaatacatttctactttatccacataaatatctatatatccttacttatctagcttaattctgactgttctttactcactacccagacaaatattcagtttagttgcatcattattaccttcactaactgtctgccttcctaaggatttttttccctctcttatcaccatcatcattcccaatgtttgctgggttgctaatagttgatcctgaatctttcctaccacctttttcggttggtgttaatgttactggcaaaaggcagaagaactgccctgctgtaaatttcgacatctaatttcaaccagagtttcattagcaattggtattcctttattcacttttgtattgcttttctgatgaattctccaataggcctatatctaatccttctcctccaacagccaaaatcccacttttattttctcaaaagcagaagttatcagaagacatcagccacgtgatgttacttcttttatctactctctccgtatttcaaaatatttgttacggtaatacccttatttctctctattagaatatgtatatcctatatttccaaagcttgcctgctgtttcttttagacttgctatagaacacacagttataacaactcttttggttgtttatactcatttgattgttgctgtctttttactttttcttttttttttttttttttttttgagatagagtttcactcttgttgcccaggctagagtgcagtggtgtgatctcggctccctgtgatctccacctcctgggttcaagtgattctctcgcctcagcctcctgagtagctgggattacaggtgcctggcaccatgcctggctaacttgtatttttagtagagacggggtttcactgtgttgcccaagttggtcttgaactcctgacctcaggtgatccagccaccctggcctcccaaagtgctgggattatggtgcgagccaccacacctggccttgccatctatttttaaccaaagaaagctattgcacctactgcaaaagtttaaacaaatcattgtttaacatttatgtactctcttttatttcaaacatcctacattgcttttatttcacagttccatacaatctcccctcaacactgttaaatcaagttcaggctaaaggtttctcagtacaccgtgaactaaaacctaaatggaattgtaaacagacggtagcctcctcttgtgtcaatcaccaagttttggctaaataaatgtggccaactgttgttagaatcatgttcaaataaggcaaatgccaaggtacaaccaatctggctgtttctgtaccaaacttccaatttctgtgttttacttttcctttttctgtccataaatcttctaccatgtgactgcgctggagtctctgagcctactctggttcggtaggctgcctgatttgtaaatcgttctttgctcaattaaacgcttctgaatgtagttttgctccggtttttcttttaacagcacctataacataaatttttacttctaccagactgggtaatcaaacttttcttcacttttagttaaaccattgattttttaaaaatcttatttgactattttgtgctgtttgtctggcaatattttcattttctttccttgaaactctgactcttctaccatactacttctctttcctctcatcatcttttgtgagcactccctgaggcacatctgctagtcttacgggtgagattttaaactcttttaaggtgatatcaattaattactcattaatcatgtactaaatgtatattagttcatagattttctcagatgaatctaatttagcaaggtttcctccttttagtgtggggttcttttcacactgtatggactagaaatgtaaatataaggaaataaagtctctactggtctccactgctgaggtctaagctacgcttcatgggacaaaccattaaaaattacaaacaaaactttagtgtttggaccaggatcaaccatatagatctatgtccatcactgttttctgatagaagatccaaccattaatgagaaacaagcattatggccacacttgaaaaggtcaataagatgcttcagaacacaaaggggaaatcattaatgacgttagatgaatcagtaaagaatccaagtcaatccccatttagagaacaatataaagactaaatgaatttcattataaaatgagcaagattgtaagtataaactaacagccataaataatacttcaaaatgcggctatgcttcaaagtatattacaaaatatatttctgaatagtgataagcccagattttctgaaaggatttttctgagttttcaaaaagtcctgggtaatgcagggagcgttctcactcccatgtaaacagaggagtaattatggaaatattatagagtaatcttagtggacaaaaaaaaagataacaagggccataattataacataggcttaacctcaaatattgaaacatcaccaaagaaagatgctctggctttgaacattgtttttataattaatttttttctttaataaaggagaaaattttattaaaaatcatgtctacaattacctaattttgttaacccatctgaaaaattatgaacacctagggttaccaagcaaaatacttttattatgtttttagcataatttattcattaactgaaattcaaatgtaaatcaaggttttgtatttttatttgctaactctatcttctctgtagagacctaatgatgaatgttattttatattcatattactgcttgttcacctttacacacccccatgaagaatataaattctagtagagaccacgtatttcacatttactactctatcttcagcatctaaaaaccacaaattctaggcccaaatttggaggtaggactatgatcaattttacagacacattgtcatctttatttttaataaagctaccaagcgtgaataaaaagtaaataccatcatcacactccaaaagctcaataagagctctttcacagagagtagattcttctaaaatagttgttttaaataaaagaatgaaaatgaactactcacattacttcatctcttcacttctaggctactccacatagcagtgaagtgttctttggttgacaatgttacctggtagctgacttaaccagtcaacacatctaaatttctcattcagtctctcccctctcccttactgttcaaaagaataatgacccaatgtgactgagaaatcacaaaattttggaacaaaaagggacagaaaatatcaggttaacctcctttattttacagattaaagaactaaagctcacatacctgcaagagtgtttccctgatccaaacctttcaatggttctgggtcacttataagataaaccttctaaagttttggcatgctacaaatgtcctccaagattctgccccagccttcagctccagacgtgtatctcctcataggaattaatactatctcctggcacctataaatgacgagtatccctgtgctcttagtgacccaaaggtgaccacttcctcccttgtacttacatccattcatacttctattatagcacttttaagattatggaatgtagaatggaatttatcagtttaaatgtctgtctcctcttactagtctgagtacaggaactacagcttattcctgctggaattactaatgtctattcaagtgcctggcatgtgccagggcacctggtggaagcccaatatgcatttgacaaatgaagaaacacatacataactaatggcacatattattatataattaatggcagaaatgaagactgtgctttattaccaatccacagaattaagctaagaatctatcaatatcaataaaaaagaaagtaataaattttgagataaaatttgtcttaaaaatcagtgtcagcaatatgtcaagcttacaaacatgctgagaaagcctgctctacaatgttcaaaaaaatgttgtttttcacttttctgtccactaattaagcttgattttttttccaggcatagttttgaacatgaatatctatttcttattcctttatgtttaatttctatagtacagtaagtccttatttaaattcttccatagttcttggaaactgtgactttaattgaaacaatgtatgatgacacccatttttttaaaatcatcaacattgtaagaaaacaatgttgaataaaacaacattatttgagggccactaaagtcacagtttccaagaacttgctgaaaacattagtgagaacttgctgtactatattttgtaatttttcattatacacaccactattttgataataatgtggattgagcagattatggaagagaataccttcaatcattttgcttctataacttaagttctcaactcctaacttaagaatggatttctagaatctaacttgtgtgaaaactaagacccaccattgtgtatgcaaggtaggaatagaaaaaaacccatacacaaaatgtaaaccaaaatttaaaaacagttataggtacaatttccatttataaacacatttgaaataaaactttaaaatttggtaaatgtatgttaattgatgcataccagcgtcatcattttttaattttttaaattcattgcgatctgacttataataatataaaatgatccatttatccataaagcctgtcattatgtgtagctgagttatttatgtgtacatcttttaacagaacttttaagaatagtaaagaaaaaacaatataaaattggtgattctttttataaatacaaacgtcaccatttatttgctatgttcaagtcctaattatgtacaaggcactgaactaaccacattatgtcaatttaaaccttgttacactccagaaaaatcagcaatatcattaccctctaatttgaccaaaaatttagtggatatactcaattataagagaagtacttttgttacataaatattacttagaagtgagaagtgagaaatttagtccttttactaggtgtgctctaaattattttattttgatcaccatacttagggaagaatccatcaatcatagcttggggtaattgtagcgataacctatatgcatttaaaagaaaaagtcaaggaaatataacaccaacttagtcactatttctgggatattatctaataattgttaactattggacataatttcaaataaacctttcaaagactgccttatcagagtaagcagctatcttgtagagatcatgtatatgtgtctacagaataaatgagtgaacgggaatggcctaatttcgtgggacaacactcatgaaataaattttccagtgataatatcacccatagattcatacacttgagtatttcagagtgttatcctctagaaaactgtttaagaggactcagagaagatgaagctactgatatctcaagataccagtgaagaacacaagggaatgaaattcatgaaatgtgatcagaaaccacttcataggttttatataattttaacataaacatatataacccatatattaattaatttgcagagatttggccatatcatctacactcttagaagattttgtcattaaactggccaattaagagaagattttctttgtaaaatgaaagattggcttatattttctggtgtttcttattcatgggcatgtatcacaacctaactactcttttgtaagctttaaggggtagaatcagactgaccagcatctgcctacctcaacagcctgccttttaattactgtctattaaaaatgtatattcactctccctcctctaaacttttcaatataattagtaaaacaaaattataccttggtagtgtctaatgctttctaatggcagtctcttggcagataagaggatgtgcatgtatattcagttgccatgtagcatctcagaactgggtatgattcagtgagtgcaaatgaatattatctaacacaattcactttaaaagagaaagattataagactaactaaggaagaaaaagaataagcttttctaatatatcatttatttaatatatagatatatatctaatgatctatctaatgatatctacctatctatatatagatatacttctaaaaggtatgtattttgatccttaaaagtcatgctgcaattgggtaacattcttaaaacttatctatcatattttataaaacaaaacatgtgtctaggtccgtcatagaagagatatttactgtatgggattggtacccttcctttatataatatgcaaccaaagaaagaagtgtttctttttgccaaagaaaaacagtatttaaaatacacaatatatttttcacccatgtttgagatatccgcaataaccataaaacagctggagtgttttcccaagcattatccatgtcttagccatattctttgctctcatgttattcctagcccccaaataaacccatcttctagacatgtcatcaatttaagtatctatcttgccaaataacaattccaacatttttaaaaactgttgcgttttacattgtgaagctaattatggcagaagtgagaaaaggagtaggcaaaattttactgatagcttataaatataataatcgctttctaaatatataaatttgagtttcagaaggactagggcttgtaatgattatgtggtcttgttgttctattgtgctaatttgaattgaaatggtgctgcaatgccaaaaccactgcttttaaagtaattttctacctgatttatttactcacattaataaaaaaaatattgtgctgtagtcattcacagaagctgaaacagcaaaatacaaactagtccaccatgatctaatttgtacttgccaccacaatatttcttccaggcacaatcaactactctgtcagcatcagtgaacttctctataatgtttaatgagaaaatgtgaagaaagaatatcaaaaacatttttatcagggctcaattttccaacccacttatagtttcaagattcctaggcaatagatgaggctcaggaaaaggtgaagaacgactaatgatcttggtttctcatctgcggggtaagaattaagtagacagagagagagggagattgtacaggacttagtaattttgtagctactcaaacaagggaaagagaaacgaaaagaattctaaacctgccaatgccactccctttacatattaacaggaaatagattacaaagagaaaggacaacctcagatgattttagcatcattttagcagcattcctaggctgataatatactagaaacaacatggtaaaacttaactaaaccataatacaattgtcactaaatagtaatagctaaaataaatagcatttatatagtactgtgcagtttccacacatatatcgccatgggtgcttctatcatcttcagtgaatagattttaaaaaaataaacctttccaaaatagtttgagaaagaaaatcaagaacacgcttgaaaggaacttaaaaagaagagatttatataaaagtttataaatgggtagaaagtaaagtcagtatacattttgaaaagtgacattttatggccttctgttacatttacagtgcatgtaaacattgtttcaaatatataattaaacatgacgaccaccaccagccctcagccctcagccgcagatatacttcacccactccacattctcacataagtaccactgttttaataacatgaggatttcttccatcctagtcaccaaagggcccaggggacactggagtggatagctttagtctcctccacttcaatgtaccccattgcatcccaccaaaaccatcctaagaatactcaatccaagtaaaatgagtatatattttatggtatatttatagtaaaatataccatgtataaatacaatatagtatatttttatgcaaatgcatattttttaaaagtcctccaatactatccccatcttctaatgagctggctatatctaacctgccatttagaagctctggatatatcaatacattaaataattttccagttaaagtaataacatcatttctgccatgagtcacacatttattcattgaacaaatatgtaaagggcctactttatgtcatgactcttctaagatttggtgatacatcagtggaaaaaagacaaaattcttaatctcttgaagcttacactctagtgaggacaaagacaaacaaataaattagtaaatgatatagaattatagcaaggtaagaagtatggagagaacaagatgggagtcagttacaattttaaatagggaacctaaggtacatctcaatgataaggtgacatttggaaaagagttgaaggtgagagagaggtcatgtcatgcatacatctggagtatggaaagagaaaagctagttccaaagccccgaggcaggatcatagccagcgtgttaagggaacagtaaggaaggtcaatgtgaggaagttaatggaataaacaaaatagagtagaaaacgcagtcagagattacaaggatcttagaagacatgttttgaagagcatgaaaaaaatagaggagtcagggataagccaattttttcatattgccatattttatagtaataagctagtttctgcttataaagaaatctgggacataggacagtaaaccatgtgtcctccggaaaactttagcatgtgtttctcacattaggttaaaacatgtatgtgtagtagctcgtatttatgcctttcctatagtgtttaacataaacatttaagtctatcctacaagcaacttatatgcaaaagtaagagagacagagatagaggcagagacagagagagcactaagaagaaatgtagtggctaagaaggctttactctgacttggtgctcccttctggctctcggatcttaaaatcacagtaaatatattgctgaacaatgaatgataagaaaatgcatcgaacacacataatacccagggtgggttaatttttaattgaccatttaaaataacaatattgcacaaaccagctggagtaaaataagggtaagtatgataaggaatctttaggcattaaaaataaactgtatcatatatgggaagaaatggcttaggtatgccaagaagcaggacctcaacacacagctgatatggggaaaaaatggcaatgatagtggaaccacttcctataatttactaaggcaaacgagataacaaaagcatctgatttagagtctttgcttactctaaataattgcacatcaattgagtccagggttcttgcattgagaaataagggagtactactttttaatcctgacaggaaaattaaaaggcccaagttattacataatgtaaataatgtattagagttagcaatgagaaagacttcctttatagcaaggcttatttcataattccagggtaaatctattgtttcgataagattttttttcaattgatacataaataaatgtatacatttaggtacactcttacttttacagaaatttaaatttatgttaacgtaccacttaaaattgcattaaataaaatagcataatatgtgtttttgtaatgtaagaaagatatcagtgtatgctaaaatatataaaatccgatgctaagcaaatggagtaaacaacaaaaaacaacatagccatataaagtttacaaaataattcacatgtagtttacaattgtgtttagaacgtgatctactgaaaatgatagaattatttatagcatctctttggggcctaggccaccttgtacatatagaaagccacagttcttgggtggctgacatactctgaaatgttctcagattttaaattgtagaaacaacacttcccataaacagagagctctctgggggcatctataggactaagtggtaattctcagggaagcaacgttttgggaacattccatcatactgtaccattaatgaattgcctgatttatgaccaatgtaaatttggagctagctaccttcccagaatgcttccaaacggcagcacagttgcaacagtaacaccatcaacacaggaaaagacagcagcctgaggaattcacaaatggacattttggccaaggcgtgaacatataatggatgcagagttccaaaggaggtgctagacttcaagcagcacataaaaactgaaatactacatatgagtaatgttacacttcaacctttgtcacacaaaagctctaaagggctccagatatggggacagcagatatgggcagcatccttgaagcaattattttagagagagctctgctgtgagtataacaaaaaaggaagactgggaagcagttccctaaccctgaactaagatttctctgcaagtacaaaaaaagcttgaatgagctacctgcagttgggggatgctttggcctggagcctaattcacatctgaaaaagctaaagaggccagtgagtaccgagtacaagcctgtgtttgagtttaaaagcaaccccttcacctagatattgaaaggggatgaattccagaagccaaccctaatatctgcagtagaatcttcagtgtggagccatttaaaaacaggctggcccaagagggcaacatgcccggataagagttcctggtagtaagaggtggagtttactgtgggagtccacgatgatggggaacaccaaacaccagccaattccacaacagagttgcaatcggagggacccaacaggcaagtttttcttcaaaaatccttctctcatgtctactgtccctctctatggatgtgattatgtggttcaagaattgttgaaccaatttcagattataacttttgtgcatgtctaacatttcctttgcagtcatagcaactattgtttttgggttttttttttttttttttttttttgagacagagtctcactcttttctccagactggaatgcagtggcgcgatctcagctcgttgcaacctctgcatcccaagttcaggcaattctcctgtctcagcctcctgagtagctagggttgtaggcacccgccaccacgcctggctaatttttgtatttttagtacagacggggtttcaccatattggtcaggctgatctcaaactcctgaccttacgtgatccacccacctcggcctcccaaagtgctgggtttacaggcttgagccaatgcgcccagccagcaactattgtttcttaatgcctcagcctaataatacttatagtaatctgttatacatgtgtgctttaaggattttaaaacctctccatttcttagccagaacctaaatattcaggttactttgctgttgttaattttttaaacatttcttattagcatccctagaagttttatttctattttaactttcttattattttggctaataaatataattacttttatatttcggagttgtgtttctgcttaatcttttttttgatgcttttgaagagggtgcaacaaagtaattgagggcaaatgctttcagtagtgtgctgttgtaaaagatttttaatttagtatttgaattatgtattaatatcatttcagtgtagctttctttcaggaaaatattaagagatagctaaaaataagaaatgtccttttttgggcaagcatggtggctcacacctataatcccagcactttgggaggccaaggtgggcagattacttgaggccaggagtttgagaccagcctggccaacatggcgaaaccccatctctactaaaactacaaaaattagtagttttagtagcacatgcctgtaatcccagctatgcgggaggctgaggcatgagaatcctttgaacctgggaggcagaggttggaggcggaggttgcagtgagccaagatcatgccactgcactagagcctaggtggtagagagactcttgtctccaaaaagaaagaaagaaatgtcctttttgccccatgttacacaaatttgttgtattaagacatattaatgtattacatttattacaatatcatttactatattctctctccaaagttttacagttaaagtagttttgctttaatttaaaggtattttctttttactgaattttctacttataacttcataggatattgagattacatttaaatgggcaaaatattttattataatatcatgtatcctcatatttgaagatgagtgtagaaaaaaaaatccccactacatcatgtcccatttagtgttccaaatttctttatttgctttgatacatctgactatagcattatagatttaaatattttaaaagcaaatagtggttaatttatatatcatactagctagatgaattactgactacgctacattttttcctatgtcagggaaaagttagaacattgtactagtacttaaaatagatataagcagatgatctccagtatattttcattatatccagtatatttcattattatcttataatacagtatgagctaagctaatgagaagaaatattgaaaccaccttgccaatatcagtaacattgacctaccttggcctcctaaatcagttttggactcaaccatcacatactatgaactaatttgagactctcaaaccttttatttcacagtatttcctagtgcctacgattgtaagacatatttaagggggaaatgggtgcctaaattctcaattcacattaatgcgtttaatgtgtaagaaagggtagtaggctactgctttgcaaagcagatttttatgctttggcccctagccatacctgaatttcttagaaggaaaatgtttcctcccttagaagtgcttcaagaaagtggaattcaggaaattgttttaaaagagtcacttaaaatatgaaatcagcagaaattggggatttagttgatagtagccaaaaacattgtaaagagcactggaggctgtgtaattttgaaaggattgtgtttgtaggcattgtgttcagcagtcaacatgagcaaaaacgataagaaaaaaagattcagcagaggctccattgccagggatgctagcagcctgccaaacacacagaggtagcaaccattctacctctttggctgtcttcagggtaacattacccttccctgctaaacaaaggaaaaggtgcccattgaaatctgcagcatgcagtcacacctgcttaagttgtgcttgcttttccttcatacaaaatatttgtgtaactgcaagcagagggttacatctccacctagcatataaaatggagaaacagcatatattataatttttcacaagacagacaataaggacaaaaaattttagttaagtatattttactatgttatttgtgattgtatattgaatcgtattgtcatattaaatttatttttacttcattatatatagataggctgcctggacaattcaaggaaatgtattcctcttgttcctagaagtacaggttgtctcctgtcttataagacagctatttggttagagcagcttctgattttctacataaggcttataatttaaatatttcaggaaagagagggagaaaaaatatatattatatttaattagtggattttctgaacacaaaatgagaagagaaagaaaatgactcttccttctggtttcgtaaagggacatactaactttgccgttttagtctattagctagaggaactgagcagcttcctaggatattctaagtaaaaaagaagtgatgggcataatccccattgaaaaatgccaggtggctgcctgagggtagaggagactctcagtatatataaagaatttccctcaaactagctctcaacccaattccctatggactcatgactcatgagtaagtcttaggaaaaaaagacactcactgaaaaaacttccaaggttgatgactagatagatagatagatgcatagatagatagatatgcagaaatttctgttattgtgaaatataaactaatacttgaaaaaaaaggaagacttgatttcagtcctcattggaatctcatgtgcacagagtaaggaacaagaaataacagggatgatggtttccaatgagaggtgaaaatattcaaaagatgtggctcaactgtggacactggatgccaccaggaggcggtgtaggaagcaacacgtgcatgatccaatctgaagggaacatcagcaggggaagaaatagatgctgggatattgagttactattttttcagtgtttgagccaacccaagcaacgtgctatgccctttacatcagttacctcaggtgatccctataattaaattagatattataattcccaatttacatatgatgaaactgatgatttaagagcaagtatttgaggaaactacccacttctggtatcactgtcctgtcacacatgaaaatatacaatgactccatctctgggaattctggaaatcaaaacattacattgcaaatcaatattagaagaccaagagcaggaaggagtgtcattactcaaaatttataaatagaacaatatatagtaactgttaatacacaaagctaagatggtggtagggagattgttagctattcatgatttaaaagaaaactataaggtttaagataagacacaatgaaattattaatagcactaaataagaaccatggaaggaggagtggagtttaggtatcataggcttatgtcatgattacacccaagaaagaaaataaagatttcaagaatgctgcccaaggtggaaggcacaagtcatgtcttgacattgtcaattggcattaacaattacattctggaggaatttcactgtctccctctgcttctctcacactacctctccattccctttttgtacagatttcagaagtagaaagcaaaggaaggcaaactctcaagcctcctgtgcttttactttcagttattttattactggcctcattgtatgtggaggctaatgcaaatccatcttggatgctaatctgccgtgttgactcttgattaacccctgttcagggaaagcctctcagagttctaccttgtctgttgttagggtaaatcctgcccttaggccaaacatccttgaccataaatcctgtccttaggcaaatttacatagcattcttgcttttcccttggaaatctgtcaacttcaatccgatctttgtatgttggttatgcgggaagagacaacttatatctttagtttacaggtctacaaatcaagatcaacagtactgtggtatataagacctggatctggcaggtaattgtgtggggatccaccatcatgtctcactgtcacccatgactagggcttctctttggaaatccatagtaaatgtttctttctgaggaactggatatgtcagcctcttcctttggcctcttagcctccttagactttggggataaatttgcacatatctagctattgcagaacagcataaaaggtttttgttttgttttgtttttactaccaagcatcataacaaattaactggatttttaaaaaactaacataaaatggttaagcaatgcatccacagctacacagttaataggtaacagagttgggatgtaaacacagtctgtctgacttgaggagccattttttaatgctttttattttaaaataattaaatattatattcacaagaatttgcaagatagtacagagaggaacctacacccttcacccagtttcttccaatggttctgtggtacataactacattacaatataaataccaggaagttgtcattggtgcaataaatgtgtatagcttcatgccattttatcttgtgtatagattcttgtaactaccatcaccacagctaaaatacagacctattccttatcacgaagatctccctcatattacccttctacagtcacaactacactctcctccaaccatttctaaaccctgataaccacttacttgttctctattctatagttttatttcaagaatcctatataaatggagtcatacagccgggcgcgttggctcacgcctgtaatcccagcactttgggaggccaaggagggtggatcacgaggtcaggagttcaagaccagcctggccaagatggtgaaacgccatctctactaaaaatacaaaaattagctgggcgtggtggtgggtgcttgtagtcccagctacttgggaggctgaggcagagaattgcttgaacccgagaggcagaggttgcagtgagccgagatcacgccactgcactctagcctgggcgacagagcgagactctatctcaaaaaaaaaaaaaaaagaaaggagtcatacaatatataacttcctgatattaactttttttaactttgtgtaatacctttgatccatccaaattgttgcatgtatcaagtttgttcctttttattgatgaatagtattgtatgggatggatattccagttcgtttaaccattcatttgttgaaggacattttgattgtttccagttttcactattacaaatacacttgctatgaacaatcatgtaaatgttttcatctggacatacattttcattgttctgtggtaaatatctagaattatgactgctgggtcatatggtaaatgtatatttagtttatttttgtttgtttttaagaaactgccattttctccccccaaaaggattaatgtttaaccactgtattttagttattttagtacttactatatttggataaacagtatccatgatggctgtggtagggatagagacaggagatagcgggaggtccagcgaaactccaccttcaagcctagggcagcctgaagactgaaaaaccagactgcgggtaccagatgaagtctgtcacctcctaactgattctgaataatgcccacctgcgcactaggggaaggagctggagccaggagaagcttaaactgttttcagaggggaggagccaggcctctccagctcctgtgtggtggcctgggattcaatctgtgaggcaggagacctgccaacaggagtctctcactttgctgaaagttcctctttccttttttcttttcacctaataagcctgtcctactcaccctgcaatgtgtccgcatgcctaaattttctgggccatatgacaagaacctgtttttttctagaacagtagccagcttgcaatattttcaatatggtccccaatgatccctgcctcctcccaatattcacagccttgtgtaatcccctcccacatttttctaggtttagaatgtgtggtcaatagtttaaaacagaagtgatggtagacttccaagattaggttgtaaaagactgtggtttcatctctctctctctctttctctctgtctgtctctcttcatatggcctgaaggaagtcatgttggaaggaaccctataggcgagctcagttctaaagaactgaagccttctgcaaaaaccacatgagcaaacttgaaagtgaatcgttcagccccagttaagccttcagagactacaactctagcaaacacttcaactgtaaccttttaagagaccctaagccaaactcaactagctaagacactgccagattccttaagaagctaagttttgtgttatttgttactcaagcatacacagcaaatatatattttgacacaaaagtgcagtgatgccaaaataaaaacttaaaatgtaagagtggctttggaaccacctaatgaatggagctgaataaactctaaagattttgagaagactgctagtgatatcttaaagagccttttacacactgttcatagaattttgactttgatgaataactcctgggcagatacaggacagagtcctaatcaagaaacttccaaatttttcctgactgaatttaaaacttcctaggaacaaagactcctttgtaacttccattgttctcctttcttattagaaatacctatagtggttattcatatgcttgtcccaccttcgtatgttggttatgtgggaacagataacttatctcttgagtttacaggtctataaatcaagataaacgtactggagctttacctacagaactgcacccaagaaaacttatcataactggtcctgattcatatagtgaaattctagattatgagctgatgctgtaataggatgaggctttgtggggtatcgggggtgggtggcgaggggccttgggaaagggtgagtgtgttttcagtgtgggagggatatgaatcatcagcagatagaggaaaaactgtagcatccaggccccaaaatggctcccagtgattgctgaatcctggtttcacactcttctcatggtccctcctatattgtattaggatcagtctatgtgaccaatagaatatgactgaagtaatagtatagtgtgtcactgctgagattcagttatagaaaattgtggcttccgttttgttccctctctctctcatcatttgctttaaagaaagacatgatgtaagtagcccacatggtgaaaaactgaatcctcctcttaacagccacatgagaaaccttagagtcagatccctagtcccaattaagtcttttttttttcttttttgaaactgcacctctagccaacacctcgattgaaacctcatgagacaactgagataaaatcattcagctaagccactccagcattcttgatccacagaaacttttggataataaatgtcctattttcaagccactatgatttggggtaatttgttatgcagcaataggaaactactactgtgattaataagacttaagaataaaggctgggtgcagtggctcacacctgtaatcccaggactttgggaggctgaggcgggcggctcctttgaggtcaggagtttgagacaagcctggtcaacatggagaaacctcatctctactaaaatacaaaaattagctgggcatggtggtgcgcacctctaatcccagctgctcaggaggctgaggcaggagaatcacttgaacccgggaggcagaggttgcagtgagccgagatcacgccactgcactccagcctgggcaacagagtgagactcggtctcaaaaaataataataagaagaagaataaagatatccacaaacacagaaacatgggtaagatttatctgacacagaaataactggagtttttcccaaaaaatgtggttttaagcacagtttagatgctcagaattattgtttcagaaaggcataagtgaactgtgattataatttgtagaacatatctctaacatattgaagtgtatccttttgaaacaggaaattttctctgacttgtttactcagccggtagttctcaacccctgagagggtgcaggggctgggatgagtgcttctgggcgccagcaggggcagaactctgtgtggccccgtggcagagttttggagggtacctgcgacccctggagctgaagagggtgtgtgatacagtgtggtctgttagctttgctgtctacggacggcttaagtatttaacagctcattgtgacagccctctgtatttcgagctcttgttcagcatccaagaagaatcaggccgcacaaacgaattgaagacggtaaatgtgggggattttattgccgatggaagtggctctcagcaggatgggaagctggaaagggaggggagtgggaaggtggtcttcccctggagttcagggcagccaaactcttctccacagtcccaccatcaagccgtccctctgaagtcaagctgcttctcaccaacatcaagctgcttctcttctctccttctctgccacatgctgccagtggagcctgggatttttataggtacaggatggggggtgaggtgggccagagtggttttgaaaaagacaacattcaagccagaaaacagggatgtaaagttctcactttgggccgtgggtccaggcttgatggtagggccctcgccagggatcgcccgcttctacccagtatttccctgccctctgtccatatcacttttggaggaaaatagcaaacaaaagaagctgtaagtgtgtctcctatactattcaggagagcacatattctgaccaggtaatatgaattcatttggccagtgtctaatcttatcaaggattgcatagaactgatgacattaaataattacaccagctcatctggttgtgataccacattcacaaagacaccatctaattataacctggcttaactcataaattttcctagagaaggcccagttcactagctacctgttatttgtttctaagctagctggtatttgtgacctgtatcataaacaagcattctgatttttatgtaagtgatatgtggtcatgttagcagaagccagttacggtaactcagatcaattctggatgccctgcagaaaaaaataagcttcttaatttttaagtcaaaagagcatgggaactgcactgagatcttaacaactagtgctctttcctctgtcccttcaacagcagtgagctggcctcaattccatctctgattttactcactttaaattcaatactactattactaaatctcactgtgttacccattcaaccaaatataacttagtaatagttttcaggcaattgagaacatacttccatttaacaatgacaagaacaacaaaatgctagatgaatgaatgaatgataggtcagttaacttttagaagctgtagttaaaagcaagtattttgaatgtattaacaaggcaatgtaacatgctgggagcgggggaatctcatgtcatgtttagtgtgtgtatttgctacaatttgtcagtcaagtataattttacaaagaccttgtatttagaatcaaatcgcaatgcttggaagtaattgagttgcattttgggatttgccttaagggagatagaaggtgagaggcttctagcttaagtacaattacagaaaagggccttgcatttttatgacttaggttattggccaatcaatgggtcattggatctttattattttaattaaaattggttcactttgatgacataaaacatattgattatgggtattctcctcagagtcttgaaagatttggtagaaaatagcagtctctacctttctcatgtacccatcaattctgttaactctcttagtctgatttctcttttcttctttgattttacttctacatcactttttgtttttattcatattttgcagtaatcttatggaaatgacacccacccctacacagcgtataaccaggagtcattactactctgtatttgataagtgtagaaagggccattgctcatgcaaatgtctacacattctctgcatagctacttactattagcttcaatattgtttaactcaaacactgtaattttgaccatagacccaaaattattctgttattttctttttcactcatgtgtttatgcatttattaaaaaatatttcagtacttactgtgtattaagttgggaaggaaggaaagaagggagagaaagaagaaaataaagaaagagagaaagaaggaaagaaagaaggaaagaaaaagaaagaacgaaagaaagaaagaaagaaagaaaaagaaagaaagaaagaaagaaaagagaggaagagagtaaggaagggagggatggaggaaggaagggagggaggaaggaaagggaagggaagaagggagaagggggagagagaaaaaaatgaaagaaaaggaaaagaaaagaaaagagaaaaggaaagaaaagtaaagagaaagaaaagaaaggtaggcactaaaacgttgcaggtattcataaagcagctgcttaaaaataaaactaattcttttctataaggttattctcttctagacaaagttcaactggtcaaatactcttgttttttaaagttgctttgtaataattgtcctaagcttgttttatttatataatttagtgtatttagagtgtggatacttagatatttgggtttcaaagttcacgtgctcaaattatcatctaagctctaagatacaaaaaccaaaaacaaacaaacaaacagaaaaccttaacaaaatgtttataatttccttaagctgacctttaagaacatccctgaaatgcatcttttggacaatattttgtttgtaatgtttctggacattaggaaaagttaatatagacgagggaaaataagtaaggaataaaactctacatgtctaaagaataatgccaagcaggagaaaggaagtttagcatttttaaactacctaagtatgttaggtaatgggttacttatgaaaattaagtatttgtacatttgtacatttttatagcagcccttcagaccaaaacatgttattgaatttatattccttcagattttagaaaactaattcatgtgtttctttttctactacgttcatcgttcaaaggcaaaagttatgattattcacactaaataggatttttaaaagactatcaataacttcttatttgcacaagatttaccaccaaatgatttacaagattcgtttctatttttcagaggtatttgtttgttttgaattttgaaaatggtaataagcactgataagacatcataagaaaagtgaggtttacaagtataagttacccagcctgtcaattattggcttggtatacatgcccaagatcaccacattaatatttagtggtatgaccattaattttatgtatcaactttattgaccacagggtgccagataaaatattctttctggttgtgtctttcagcctgtttctggatgagattagcatttgaattggtggattcagttacgtagcttacccttcacaatgtggttgggcatcatccaagtctttaatggtctgagttgaacaaaaagcaacaaaaggctgggtgcagtggctcaagcctgtaatctcagcattttgggaggctgagatgggaggatcacttgagcccaggagttcaggactagcttgtgcaacacagtgaggccctgtctctaaaaaaataaaaataaataaaaatgtaaaaagcaagaaaggggaaattcactacagttttcctacctcactgtttgagctgaggcatctcatatcttctcagacactgggagtaggatttactccattgactcccctggttctcaggtcctcaaactccaactgatttacaccaccagctcccatgtaagccaatttctcttaataaatcttcatatatataaacaatctcctactggttctctttctctggagaactctgactaatacaagtaggaagcgttcaacaaagatttatccagtggagattcaaactaatgcctgacacattttatactccacgcttttccaccacaccaggtagtgccaatttatagaaaatactttctccagaaggcttggtatttagaaatgtcatataatattatattgcttgtcatggtaacaacgtgaaatacaagaatatgatactaaaatatttgctttaaggtagaaattttctcttacaatttttcctcctacaagaagggcgtagatgagtcagacactgatccaattctcactggcccagttaacttgtctaatgtaattgagaagatgaaatgaaggaattcatctatacattaactaataggcttccttaagtactaagaaatgtctactccaaaaggaaggatgtggctttcttaaaatacgaaccaaacatagaaatctcagaaggtcctttataagataacttatatagcaattaaatggcattatacactaaaattcatagtccttacagttttttgaaagcagtctcaatttagtttgtaactgtgattttctttattttctaagtccaatctcatttttttctttggttttcatttttaattgacacataataattctacatatttatgtcgtacaaaataatatttcaatacatatatacaaagcataatgatgaaatcagaataattatatttatgacctcaaaaatttatcatttctttgcgctaggaacatttaaaatcctttcttctagctatttgaaaatatacattgacttattcttaactatagtcaccccacaatgctatagaaccctataacctattcctcctttattgcatctagctgtaattttgtatccattaaccaacgtctctatcctttcctccctcctaccaatcccagcttctaataatcacagttttcacggtttacttctataaggtcaagtttttagctcccacatgagtgagaatatgtgatattaatctttctgtgctagacttattttgcataacataatcccctccagactcacccatgtttccaagaatgacaggatttcattcattttattcaaatatatatatatatatatatatatatatatatgaatgaatagtattccatcgtgtatatatactatattatctttatccattaatctggtgataagcaattaggctgattccatatcttgactatagagaatagtgttataataaatatggggatacatatatctttctgatacacttactttatttcctttgggtaaatatcaagtaatgggattgctggatcatatggtattcaaatttttaatttttggaggaaacattatactatttttcaaaatagatgtcctaatttacattctcatcaacagtgtataagagctcccttttctccacatcctcaccaacatttctgatttttttttaataacagccattctaattggggaaaaattatacctctctggatttaatttgcattcccctgatgattagtgatattgaacatttttaaatatacttattagccactcgtatgtcttattttgagaaatgtctattcagatattttgctcattttaaaaatgaggttatttggatattttgctgttgacttctttgagttcttaatattaatcccttgtcaaatgagtagtatgcaaatattttctcccattctacaggttacttcttcattcttcactctgttgtttcctttgctgcacaggagctctttagctttatataatccattggtctatttttgcttttatagcctatgtttttgaactcttaaccacaaaaactttgcccaggccaatatctctagttttcttctagtagtgttatagacttgggtcttacatttaagttttcacccattttgagttgatttctgtatatagtgagagatagagatctagtttcattcttccacctacagatatctaggtttgtcagcaccatttattgaaaaggctgccattttcccaatgcctattctttgcacttttgtgaaaaatcaattggctatacatacgtggatttatttctgggttctctattctgttccatttgtctatgtgtctgtttttatatcagtatcacactgctttgattactatagatttgtagtatattttggagacaagcagtattatgcctctagctttattcatttttctcagaactgatttagttatttgaggtctttcgtggttccatacaaattttaggattttttttcctttttttttttttgaagcatgtcctaagtttggatggaaattgcattaaacctgtaggctactttgggtagtatggtcatttttataatattaattcttccagtccatgaacatgggatgtctttccattttatttgtgtccactctaatgtatttcatcaatattttataattttcattgtagagaattttcaactccttggttgaatttattcttaggtatttttttattatttttacagctattataaacataattgctttcttaatttatttttcactaagtttattattggtgtatagagagactaattatttttgctcatttattgtgtatcctgcaaatttaccaaatttatcaggtctaagattttttttggtggagtctagattttcctatatataagatcatgtcatctccatatagggataatttgacttcctcttttttgagttggatatacttttttaaagagatagggtctcactgtgtagcccaggctggtttcaaactcctgagctcaagtgatcctctcattctagcctcctgagtagctgggactacacaaatatgccactgcacccagctgcactttattcctttctcttgcctaattattctggctaggacttccagtgctatgttaaataagagtggtgaaagtgggcatcattgtcctatcccagtttttcaaggaaaagctttcagttttctccattcagtatattagctgtggttttgtcatatgtggcctttactgtgttgaggtacacttctatacttaatttgttaagaggtgtttttttttttttcatgaggtaatgttgaattttatcaaatgctttttctgccactattgaggtgatcattcaattgttgctgtgatgtatcacatttattgacttgcatatgttaaactatccttgcattcctagaaaaataatcccacgtaattgcaatgtataatccttctgatatgctgttggatttcatttgttagttttttgttgaggatatttgcgtctatgttcattcaaaatattggtctgtagatttcttttattgttgtgtccttgtctggttttggtatcagggtaatgcttcccttataaaatgagtaagaaagtttgtactcctttttacttttttgcaaaattgtgagaactgattttagttctttaaaaatttggtagaatttagcagtgaagtcatctggtcctaggctttgtgctgttgttattgggagattttttatttctgatttaacatccttactcattattggtctggttagattttcaaattcttcctggttcagtcttcgaaggtggatgtatccaaaaatttattcatttcctctaggttttccaatttattggcatatagttgttcacaatattctcttgtgatcctttatatttccgtggtatctgttgtaatgcctgcattatgatttttgatttatgtgggtcatctctcttttttctttgtttgtctcactaacaactgttcaattttgattatctttccaaaacactatcattatattgtttttattttattgatcttttgtattttttgtgcctgttttgtttatttttgctctgaattttattatttctttctatctactaagttgggtttggtttgttcttgcttttctaatttctcagaatgcatcattaggttgtttatttgaaatctttcttttttgatgtgtttttgccataaatttctatattactactgcttttgctgtatctcacaggttttggtatgctgtctttcaattttcatttctttgaagaaatttcttcatgttcttcttaattttttattaactaattgaccattcaggggcacgttgtttgatttgaatgcatttgtacagtttctgaagttcctcttgttattaatttctatgtttatttcattgttattttttaaaaatacctcacatgacttcgattatttttaaatttattaggatttgttttgtgacctaactttgtgctgatgagaacaatgtgtacttgtagttgttgcatcaaatcttctctacttgtatattaggtctatttggtctatattgcagttgaagtttgatgtttctttgattttttgtctaaatctgtccactctctgttcaatgttgagagtgggttgctgaagtccccgactatttgtaatggagtatatttcttctattcgttctaatagtatttgcttcatatatctgtgtgctctggtgttgggtgcatatatacttataattgtgatatcttcttgctgaatttatttatcattatataataactttgtctcttttaatgttttttgacttaaagtattttatctgatataagtatagctacttctgctcatttttggtttccattcacaaggaataactttttccattctttgactttcagtctgcatgtgtatttccaggtaaagtgagcttcttgtatgcagcatatagttaggtcaattttttaaatctatatagcccagtcagcaaaacttttaatttgataatttaaaccatttaccaaagattttattgaatgttgagaatttactcctgttcttttgttaattgtttactggttgtgttgtaaaccctttgttttcttctctgcctcttattgtttaacattgcagtatggaggtattctgtagtgagatcattttacttctttctctttcttacttgtgcatctgctgtaccagtgagttttatacttttgtgttttttcataatggcagatatcatcctttcacatccacgtgtcaggctctcttatgcaattcacgtggggctggtctcgtggtgatgaattttcttagtttttgcttgtctaaaaaagatcctatttcttttttatttctgaaggatagctttcctgagtataatattctcgtctcacaggttttttttatttctttcaactctttgaatatatcatcctattctctcttggcctgtaaggtttctgctgagaaatcttctgttagtctgatagggatttccttgtatgtgacttgttgcttttcccttgctgtttttagattctccccttgtctttggacaatttcagtatagtttgcctcagagggcacctgtttgggttgaatttatttgtaatttttttagcttcttaatctggatatccatatctcttctaagacttaggacatttttagctattatttcattaaataggtttctgccttttagcatcttttctcttgctgtaacttctataatgtaactatgtatttgcttaataatgtctcttatatcctatagagtttcttcattctttttcattctgtttttcttttcttttctcctcttttttgtctcattgggtaatttctctattcaccttcagaaattttttttctgcttaattcagttctactattgaagtttttctattgtattttttatttcacttattgaatttttcaatttcaagatttcaggttggatctttttaaacaatatctatctctttgctaaatgtctctttcagatcataagctattattttttcttggattgtctatttgtgttctcatgtctcactgagtttacttaagatcattattttaaatttgggtctgttactggagaattatgatgttgctttgaaaatgccatgtttctttgctctttcatgtttttcctgttcttaaattgatatttaagatcttgtaggacagtcccttcttccaattttatgtaatagttttaatagggaaagactttttcctgtagatattttcaataatgtgggttggatagagtgctttggttaaggttctaggtgggcactgttgtatattatccatatgatttctaaagctgtaatcaatgtcatcagtgtctgagagtgcatcagcggtctaggctgcaattatttgtgaaatctgtggcagagctttactggggacagggatgccaggttggttggtccttggtctccaggagagcccacagaggtgcacagtcacgttgcctgtggaggggtcaagattgcctgtggcggtgacaggctcctcatgggacagtcctcaagtttatggagagcgtgcacagtcttgtgatggccccattttggatgaagcagggtccctgatggtgatggaaagccctgggcaggtggctcttggattctggggaatgagtgtgtcaggtcactatgtcctgagggctgccttcccagtgtgctggatcatttatgccctgatgtatagagctctgcctgggctctggtaacaaagttacagctgcaccactatgttcatcttttgtcatgatgctgcagctttcctggtagatgaggtggaaggtcagcaagccccagggatatggaggtgcaggggctattgggccccagggaagaataaactcaggtggtggctcttctctaaaaatggggccatgctgtggcagcttgggtctttggaggtgaagaggacccaatgtgaattttctttctgggacaatgcagttgcatggactccaggcagctctctatacttgactcagctcctgcaatggctgtgaagctctcctgttagtaggagtgtgagtattcatcgtgggaatgtggactactgaggatctcttgcttttcttttttctgcagtggaaagctcctcttggcttgcagacaatcctggccagacacttcattttctctatatgcatatatgatactatataaccctagtatctatgcctcagagggtttttgatatttcgtaatagaaaaaaaaatcataagatttactgaatcgtaaagtgcttttttttcctttgatgaagtcatttgaaatattctaatatctagcagttgtccctctgaaacatttcatggggaagggggaatccttccagaatatggaggtttaagattgtaacctgatccaagtggagcttgacttcttggctcctgattttgatgctgttttccctcattatacactaagatagctttatacaatgtaattagtggttttagtcagcacattcatttcagggtaaagggaaaacaaaataaaatatctgggaatgggtatatattttaaattaataaagttactttattttatcctccctctttactagagaagctaaatgcaaaactaaatagactagcaattattatccaattatccacagacatgtgtatgctttagctgtatttttaagaataccaacaatgagaaagctgacagtttcacaattagctgacaaacaaagcccccattctctctctactcctcctccttactctctgattttacaagatcaaattagtattactgaataaactatctcaatgctatactgctactgctaaggattaaattctgtttcaccatctaaacagaaatttaatttcccagtctaaacagaagatacagatccaagaatatctaatgaaatacaacccacagtgtgttctaattacatacagttgaggttttcagagttaatcctaaagagagtaataacttcccccaaaatcagacactgtccaatgccttgatttcagtctagttcgactttgagcaggaaccccagacaatatgcacctaaactatggacccacaaaatctatgagataataaatttatgttgttttaagctgataaatttgtggtaacttgctatacatctatagaaaactaatacagtttagttcaatattgtaaggatttcagttctcttaagttaatcaacagagtcaatgcaatgtacataaaaatcccaggacctttctgtgcaaattttaaaaataattttaaaatttaagtaatttaaaactaataaatttaaaatttaagtaaattaaaactaatacaattttgattcaatattttaaagatttcagttctcttcaagttagtcaatagattcaatgcaatgtacataaaaatcccaggacttttctgtgcaaatttaaaaaataattttaaaatttaagtagaaaagatccagaaatgaccaagttaatactgaataggaagaacaaaggaggaagatatatactgatactagtgcaaggacaaacattacatggaatttaaaaatatatccaggagcagaaatagtgtaacatttatacaatcacttgatttattacaaagttgaccttgaagtaaaaagagaaaagatgattgatttgataattgttactaggtctataggatatccacatggggaaaattgtatcttaacttttaccttctgcaacatctgtcaacaatcaatttcaggccaggcgcggtggctcacgcctgtaatcccagcattttgggaggccgaggcgggcggctcacgaggtcaggagatcgagaccatcctggctagcatggtgaaaccccatctctactaaaaaatacaacaaaaattagccgggcgtggtggtgtgcgcctgtagtcccagctactggggaggctgaggcaggagaatggcgtgaacccgggaggcggagcttgtagtgagccgagatcgcgccactgcactccagcctgggtgacagagcaagactccacctcaaaaaaaaaaaaaaaaaaaaaaaaaaaaaaaatttcaggtgtatgatacatttaaatatgaaaggaaaaacaataaagtttctacacagtatcttcatgaccttaaagtttagcaattatattttaagcaggacacaaaaatcactaaccataaagggaacatctaattgatgtactagttttattaaaataaaaattatttttctaaaataagctaccaagtgaacagtaagccacagagtagaagaagatattcacattacactcatcagaccaatgaataacatttagaatatgtaaaagtcttataaatcaattttaaaaatcagataacttatttatgagtgtcttaaataggtactttacaaaatagaaatttacatgatcaataaacacataaaatggttctcaacttccatatttatcaagaaaatgcatattacagtgctccagcactgcatatagactagaatagttaaaattaaaaggactgatatcattgagtgttggccaaaatgtggaccaacttaaaaagcaatactatttcacttctggtggattaaacatatatataaaactttggaacttgccgtatcttctaaagctaaatatgttatacttgatgatgatctaagaactcttctcccaggtggaattgaaaatgtacttaaatgtgtgttaaagcacatgtataagaatgttcatagcagcattattaataattgttaaaaacttagaatgcttttccagtaaggaaaatggatgaatctttactaaacaaaatgtcatagttgaatttcacaaactattttgaataaaataaacctgttgtaaaaatgtacatatgttctctgttccatttatataaaactaaaaaataacaggcaaaattaatttgtggtgatagggaaaaatgactcctttttaaaaggttaatgactgggtaggcacacaaagtatatttcttgtggtactgataatattcaacttcttaatccatgaatgctttcatgggtgttttcactttatataaagtcatttatattttttattttacacttctttttacatatgttacacttcaacaacatgtttaccaaataaataatccaaaaatatatatatttggtcataaatcaggtatggttcttcaacaagaatctgtctccccctactaaacagcaggactcctgtgctccttagagttgaagatacacacatacacacagacaaacacattcacatacagccaaacacacacatgcctggaaaatattgctggattcaagatatgtgtgtgaaggatgattgaacattgatctttgagaaacttttacggttgttatgcaccccacatacataatatatgatttgtagttgcgtgtctgatataaaagatctaatttttataaaattgtgttacaagtatttgattgagactgacaacatgaagtaggaaatccttaaatggtgacctacatccctaaggcaggtgaaaagtatcatgagaatcaactgttattttgcaaggtgtagtaactcaattttaaaatggcccccacagatcccttcctcttattatttacaactatgcaaaactcccttctcttgagtataggcttgaactattaacttgtttcttatgaacagaatgaagcaaaagtgagaggtatttccgagattaccttccaaaagactgtgactttaatctccttcacaggctctttctcactttctcatttgattcctgcaattgaagccatctgctatgctgtgtcctgttctttggatcagcacatatgacaaggaagtgaaagtagtctctgtccaacaatcagtctaacagcctgagaagaactgaattctgtcaatgaccacgtaagcttcgaagcagacctttcgcttgttgagccttcagatagacagcagccctagctgacatcttaactgcagtcttgtgacaggtcctcagacaggataagccaaattatacccagactgctgatccacagaaaatgagaggtaataaatatcgttgttttaaaccactaaatttggtagtaatgttacatagtaaaaaataagaagtatacaatatatcaaattgtgctgcttctttatttcatgctttaaaattttatttccaatttttagtttttaaaggtattatctatggtattaaaaataactataaatttattattaaatgtattttattatagttttattaatattctattacatataagatataataccaacttatggatttataaaattatttatcctgatatataaaataaattgacatataaaataattattttattaatcatcattgttatttaaaataaccacatataatcatagcctaattatatctcaaagctacctaatgccttctttaagtgactagtttcacattccaaagaagagtcaactaattttaagtatatttgtagaattttcgtggatagttctaagtagtttggtcacatatttagttaaattggaagcaagtaaataagaaaatagatccgccatgaacatatccgatattggagtgtgaaaggcaaatacccagatagttatgataaaaatgaacaaagctattaatctgacaattaatagggccagatttagcaagatttcagattatgttttattttaatgtccatttatcattgtctataagatccaaagaatgctcatatacattgaataaattgtccatctgtcctattttttaaggatgatttgactaaaaacattttttctcacgtctattttctcatagtagcacttttgacacatccatttcccatttttggttttggaaaatgaggtcactctacctatggaaaagacaaaggaaattttaagtctctccccttgggttgtttgtagtctcattgagaagaagacaaagatgtgtatctttatcttcccttaatacctgtaaattaggaaaagtaagaatggaaaaacaaaggaacaaacggagacaatgagatacagaaaagctcaaagaaagataagtcagaactaaacacaagttttcttatgaataaagtatctcttctttatttacttttatcttgtttcctagatcagttgtcttacagaattagaccaaccaattacaaaaatgacaagatacaaacatatagcaagcatacaaattctcaggaaagctacacttgaaactagttatgtggcaatgaaatagacagattgaatatattttgaagctgccacaattatctaaatatttagtaatatttaatctgtaagatattttggtaggtttccttgaggaagcacaatttcttctttttagagggaatgtcacctgtcagtttttataaaatatattgcatttgggaaatctaaagtcagaactatccataatttttaaggaaaatgtaaaatcatcaaatcagtagcaattttatattttgtttctgaaattgttttcccaccctcttcaactttatgataatttatcgggttttcagagaaaaaatacacaggagatacaaagaaaaaatatttttccaggtttatctttccaacatgcttttgttcatttaggatttgtttagctgttgattttgaaagtttattttttcatacatactagctgcatatagttgataaaagcctcaaatacagccaggcatggtggctcacacctacaatcccaacactttaggaggtcaaggagagaggacggtttgagcccaagagttcgagaccagcctaggcaatgtagtgaggccatgtctccactaaaaattaaaaaaaaaacttaaaaagattagctgggcatggtgatccacacctgtattcttagctactcaggaagctaaggcaagaggatcacttcagcccaggagttcaagcctgccatgagcttatgatcacaccactgcaacagagcaaggtcatgtctgaaaaactaatgatcataataataacccaaaaaaagaatatgaaatatctaaatctatatccacaattataaaaaaggaaagagattttatattcaaccactgaatatgtatatggaaggcaggatggcttcctctctacccaccaatagaaaagtaatgtacaatattagcaaaggtttgtgccttcccaattttcttatagcattctgtggcttgctacttgaaacatcaggggaattgttgtatttgaaagaaataaaatcataattgttaagatcaagcaatggctttacatgatgacgtgtatattttgttattcgatcctccttggcccgaaatgctgactatttaatacaagagatatttctaagcaatttgaagcatgattggcttcaacatttgctttgtacttttctcagaacaccaagtacataatagagttttgtgatttttttttttaaaaggggtgtgaatatgtagtattacaattgcaataatgacctacaatagtggtgattcagaagttgccttttagggctacgtaagactgagttccaaccataaaaatggcagcaaataaaccaatcatttaaaagtgtcttataaccatttttttcaaagtatcagtaatttacaaaattgcacagcacattagtcaagtcttgtattaactaaatttaaaattctaaataatcatacaaagtccatatcaatgctttgatacttgacattatggtacagtgggtttatcatttattacaatgagttattttcccaaattcttgcatctgtggtttcttctaagaaaataaatttattctatgcattttcaaatcaaatcatttgctataaatgataaattttttttctaaattgtcatagaaactatgcttatttcaacatataaaataatcaaattcatgctacttgaaggaaaagacaagtccatatttaaaagatagatttatctattaattaattacattttatttcaaatccaaaatataaagcaggttcaccctatagtttttgctttttattcttttaattggggaagcaaaagtgatgaaatttaaatatccaactcctgcttccttggatcttactgaggcggggagaggggtacatcaggttataaatattaaataactcaagtctgaaagaagggatctttaatgagcaggaacccactgtacaagctgaaggtgatagtaattattttataatgttatagtgtcatcttacagataagttttagacacgtttattttatgagaaatctagaatttcagtataatagttatttgaaattatcaggttgtcacaaaaaaaattattgtaaactcaaatttcttgtcttaccagattccagaaatagttgtatagacagccaataaaagatttgccttcataatatttgtgaaatacacagtaaaaatagcatgcgatgactaacttagagagcaataatgagggtatgggtggcagacttaaatgggagtaaaaacagattggagaataatttgtataatctgatcccattttggaatactaataaatgtccaaatatatatatatatataatttttttcaaatatcttcacagaaaacacttgaaatagttatctctgggtgataagactacaaatgattttattcttacatttttaaaatataatttctaatgtttcaattataaacatgcattactggataatttttaagaaaaataattgttttatgtgaccatgaagtaagcatcctttgttttccaatgtgaaaaatactgtcagtaataccttggtaagatgaatatggtttgtatttatgaggaggttatagttaatggagaatcaacaaagaaactctaatgccattcagtaaatgaaatgacaaatgaaatacagggttatatatgacagcatctatcagaagtatataatatggtccaagagttaagcaatggcaaaggaaaagaaataagaactataatatatttataagagtattggaaacatggtagttttcaataatcaattaatcaattaattacaattttattttataattaattgattaagtacatttaattagtcaattgattttacaaataattacattttattttaatgctaaaatataattaattaattaaatttaattacattttattttaattctaaaatataatgtatgctagtcttctgcttttattcttttaactttggagattgaaaaaagctaaggtatgattatgcccaatcttctgctccccagtctggggtatattacccttaaaatcagtgggtagactgttcacttttgcaatggactagtactacaattgtctttcgatagcctctttcagaaactgtgttgaaaaagcctaatagattaggcactctcaacaacaacaacatcaacaaaaacaaaagcactttatcatcattcagaaataaaatgaggctataattacaacactagcagcatttcacagtttactttgaaattatcctttgaggtggacatatttcatatatgttttacatggaacattttaagcatttcccttatgagtttcaggtggcattgatactggtttgttgtttttttcgtattctctttcaactatgcgcattgtttgggacaagacatgttgctgtggcatatgttactaggctacttaactgttaaattgggcatttttccttgacacaaaatcctatacattatctttgcccaatgtgtttagtttaaattcctctgcccactattctaaaaaaaagaaactataaacactaaagtagaaaactctggccaatttattttatctataccatatagatggatctacatggtatagatatctatggtatagatataataatctagagctatatagattaatctatatctatagttatagatatccataagtgttaacaaatacattgcctacattgtgtaacttatatttttgtatttttattataatggtaattgatatatcagcatattttagcatttatagctgcttagtaggaatgtgggctataattgccactttctacctttctattttcttaggaaactccaggattctaaaagtaaagccctatggaaataaatcaataacatttcaaatgaagaaccaaaatcgggaaatgcaaatcacaactctaacatcaacattaacttatgtaaacggctcatttgaaattatcacactttttttctgtttataaaacacagttatcttaaccttaagcattgtatcatccacatgttttcatctttgggcttctgaatatgtactagccggacaaaacaaataatagtctttataatacctacagatccctgtaagaaacaaatagcctactgggttaccagatgcgctatagtactacaaaattaaaggaacagactacaaaattaaaggaacagatgctctttgttaaccttttttctaacaaaaaataaataaagttttaaaaatagagattgggagcaaactcagaaacctcacatctctaaatattggaaagtttgaaaaacagggataactgaaaatgttgcttaaaaacatcaagctaaaaatgaagagaaaatctttgataacaaagaagagagacatcaagaaccaaaggatgaattttgagtaaataaatatattgaatgatgtaaacaaagaacagtggtaagagtaatctaagcaacctcaaaagttttttaagtaatggaaaaacattgtttagtattatataaaatttgtcaatgctgtgatttacaaaagaaaagaaaccgtttagtcaaggagaaaataacaagtttttaggaaatagaaatataaggatttcaaataaaaataaggacaaaaacaatgttttgcatgtagtgacccatggattgccttacacataagaatgagaaactcaggtagagaagaagaaaaatgagcccttcaaactcattcatactgaaccagaacaaccacaaacaaacaaaaccttaaatattaattgtcttcttaaaagggttaaaaaaaaacaaaataaatgctcatacacaattgggtaaatgtaaaactggcaaaattgagtaaggtcaatgaaatgtatcactgttgattttctgattgtgatattgtgctatagttatgccagatgttacagttgaatgatacacagtatgtttctatattttttctaacaactctttgtgaatctcaaagtaactcaaaatagaaagttaaaaaattaaggaaaataaaggttgaccttttcaatcatctcagctattgttccaattacaaagttaagtaaatcttacaaatttccttcaaatggtcttacaacatatctttgaggatattaagaccttaggagaatataatcggaaatcatttaaaatcagaaaactgagaaattgagaaataatcaaaagccattagattcacaaacacagtgagactattatgtgactgtggccagaaaagaacaattaaacatccccccacccccagcccccccacctcctcacgtgagctacttaactgggcaatgatatggctatagaaagaaaccatgaatttgaataccagaggttgccaaataaaacgaaaaggggtaagacctaaataattgtcttaaatattaacctaagcaaaaaacctatgtaaaatcaaattaaaatattaaaataacgttagaaaactccaaatacatgggaatactaaaaatctaatataaccaaatataaatctaagaccattccactcctaaaacaaaatacaggagaatactttcaaaaccttggagctgccagtttttctgttttaattattattatttttaatttaggacaagactgctatgatttgaatatctgtctcctccaaaactcaagttgaaatttaatccccaatgtggcagcagtaagaggtggggccttaagatgatgagtatgctcagcccccctgccatgtgattccctgtgccacttcagaactctgcagaaagccctcatctgcaagaagacccttaccagatgtggacctttgaccttggacttagcctccataactgtaaaaaataaatttcttttctttataaattacccagtttgaggtatcctgttacctgaaacaacagaaaatagattaatacaaagagagaaaaaaacagcattaaccgttaaaaataaaactaaactggatttcaccaaaatcagcttttcacttattaaaagacaccattaagaaaatggagaagcaagccactgacacagattggagacgaaaatgatatattgacagtacgcatattcagcaaaggactgctatcaagaacatacgaagaactgccaaaagtaaaaatatgaaaaattattgataaaaaaataagcaatgaaaaaatgctcaacatcctatatgaccaggaatatgcatattaaaaccataaggagatactattttacacttataagagtgagtaaaatcaaaaggactgataacactaaatgttgacatgtggaccagtcagaacccttatgtattgctcatgggagtgtaaaatcgtgcaaatattttggagaggagtttcttaaattaagcatatatttagccctcaccctggcaattcattactaacaataaaatttaagcaggagaaataaaaattcccttgaattccatgaaataatatgtgtaagtaggtacatagcattgttattcataatagtccataaaatgagaaaagtctaaacatcctttaatagaagaatggataaatattcttgaggcatgttaatacaattgaacagtgtaaacttaaaataaaattctaagccccctaactgatagaatggatctccctttcagccaatgatgttctaaagtaaatgtgaaaaactagttcaggccatcatgggaaggaggggtcagacatatctcattatgccctcctccctttggaattcaggcacaattgatcagtgttaacattaaaaaagagatcttaagactgaccaaacagactctttgtggcaatcagatacatcacaaaatgacatataccaggccctgtaagaaattgaagtattttaccctgaaatatatttcttcgatatatctttaaacagccctgtaaagctgcctcttgtggggaaaatcaacattctgtagagaattctcttccctttccaggtcttttcctgatccaggagagattagctaagtctggtacctttttaagtctgataacaaacatttgccctctattctatctgaagcctgctacctggaaacttcatatgcataataagaaatttggtctcccaaaccccttatcttaacccagacattcctttttttctattgattctaggtctttagataaattctttcaaccaattgccgaacagaaaatacttgaatccatctatgatctggaagccccggctttgagttgtcctgcctctcaggaccaaaccaatgtacatcttacatgtattgattgatgttttacatctccctaaaatgtataaaaccaagttatagtctgaccaccttgggtacatgttttcagagtctcctgaggctgagtcatgatcgtgtccttaaccttggcaaaataaacttgtaaattgattgagactcgctcccttgaagggaagaacccagtaaccacctgttgaccaaagagcccttgggtcctgaataaccagcagcaatacccaggtagtatgccatggaccttgggtgagactttgagacatgctggcttcaggtactagctcagtcacagtggattaaagcaccaagtgtgctctcgaggtccccaatacaagcctacactcttggacagcatttctggacctgccctggaccagaggggagcccactgccctaaagggtgagtcccagaccttgtagcatttaccacaagctgactaaagagcccttgggtcttaaatgaacattggcagtggcctggcagaactctccacaagctgatggtggtgatggacctggggagaggctcctctgcctatggaaagaggtagggaagaatgggaaggactttgtcttgtggtttgagtgccagcttagccacagtagaatagaacatcaggtagatttctaacgttttttacttcaatccctggcttccagacagcatctccatctgggcctgcgcagaactttccacccggaagggaaggacataaacatggctgcctttgccactggctgactgtagagccctaggtccttgagggaacataggcagtagccaggtagtagttacagtgggctttgagcaagacccagtgctgtgctgatttcaggtctagcctagggcagttccagtgatgtggccacagtggggccctgtgtcatcccacttccagctccaagtggctcagctcagagagaaacaacatttgagagaaagtaagaaaagagaaaaacaatctgcctggtaattcggagaattcttctggatcttatccaagacaacaaaggcggcacatttatgaggctgcaataaccctagtgtaactgggcttagggtccccgttaaagcagatacagcttaaatcacaatgtcgaagtcatttttaatatctgaaaagccttcccaagaaagatgggtacacacaaggcagactgtgaagactaaaacaaatacctaactcttaaatgcccagctacagatgaacatttacaagcattgagaccagccaagaaaacttcaccaaacacagtaaataagacaccagagaccaatcctggagaaagagagatatgtgaccttttgttacgggatctttggggtgttgcttttctggcctgaaacctctgcctggtggcgcctttgcccaagttttgcttgggcgcactgggctcattcttcccaccctgcctggcaggctgtgctcagctcacgctaccagcctagatcccatgcctgccaagggtgagtcagcaatagagcaatgaggggtgggtgagtgagtgtggggtccggccactgctcagtcagacatgccagctgctgcagtggggcagacagctacaggtgctggctctctgcaaggcatagttgaaccaggcacactgcaagcagcttccctggctggccctggaagcacattggtgcccagaagctcagagacacaaggaactacagaaacccaaagagggagtcacagccctgactctgggagctcccaggtctgggatccctgaggggccacagctcttcttctcttctcctgcaacatggcaaacaagggacatgtttcagccctgtttgtgttagctcttttagttctgccattcagtggctcccaagttcttgtcctgcaacaggaggaaatgaggtaggcagacaagtggagggtaagcaagatgaaggggaattttattgagcaatataacagctcacagaagtcccacagagggtagctcctttctgcaggcagggtatcctgatgagtgttcagctccgagcacagaagagaccaaggagtgggaagctcctctccaggcaggtcatgccatcattttgtacctctcagcaaagagaaggccctggagtgggttgctgttctctacagctgatagtcctgacttctctgcaagtttctgaagctctcagcaaagaggaggccataaagtgggcagctcctctcaggttctggtcatactgacatctcccactctcagcagagaaggtaactactctctgcagctggtcatcccattgtctgctcacctctggctgagactttggcttttatgggcctcaaatgggaggaagtgtgcactgatttggctcatgggcaaccattggtgggcccagaaaaggcaccacaagttcccactctagtctgtgggactggcagcccaggccccagctttcaggccctctatggcccaaaggtggggcctcaccagggatgtacccccttccacccagcaatctgtccacctcctgctgtcattcatggtgcctgggcttggccctgactttcctccaagatcagagtgggcaccacactgagagcagggaaaagccaggcagcaggagcaggcacttctgatcctgagagggcaggggggccttcctgggaccccaagagtgcagggatgtctaagtctgcagccatgatttgggcagccacaactgcgcccagggttggggggtggggctcctgctggctccatggagctggaggttggagtctgcagccacagtttggctggctgcagcagtaccctgggagctcctgccccatcttgcaagggccagggctcctgcttgtccccagctcccagctgctccatggagaatgcagccctggccatgcctccttgctgcagctggcatgatggcaacagcaggcaatctggagcagccactgccattactttcagaaaattaaaaatagctattttgagaaagttcaatgaatttcaagatgatagagaaggaatccagaattctatcagatgattttaacagagactgaaattaaaaaaaaaagcagaaattctagagttgaaaaaatgcaattgacatactgaacaatgcatcatagtctcctaatagcagaattgatcaagcagaagaattagtgagttttgggatgggagcagtggctcatgtctgcaatcccagcactttgggaggccaaggcaggtggatcacgaggtcaagagatcaagaccatcctggctaacacggtgaaaccccgtctctactaaaaaacacaaaaaattagccagatgtagtggtgggtgcctgtagtcccagttactcgggaggctgaagcaggagaatcacttgaacccgggaggaggttgcagtgagccaagactgtgccagtgcactccagcctggtgacacagcaagactccatctcaaaaaaaaaaaaaaaaaaaaaattactgagcttgaagataggctgtttgaaaatacacaaccagaggagataaatgaaaaaaatgtattaaaaattgaagcatacctattaggcctagaaagtagcctccaaaggccaaatctaagagttatcgagctaaaagaagaagtagagaatggaaggaactttgtcttgtggtttgagtgccagcttagccacagtaaaatagaacatgtggtagatttctaagggttttgactctaatccctggttcacagctagcattgctggacctgcctggggtttaggggaatttgctatcctgaagagaaggacacaaacatgactggcttcactactttctataggattagaaagttaattcaaaaggataatttcagagaacttccaaaatctacgatatcaatatttaagtacaatagggttatagaacaccatgcagctgcaactgaaagtggaatacctcaacacatttaataatcaaactcccaaaggttgaaaataaaaaaaggatcataaatgcagcaagagaaaagaaataaataacatataagagagctacattacatctggcagcaggcttttcagtggaaaccttatgggcagggcaaagtggcatgacatatttaaagtgttgaaggaaaaaatcttttaccctacaatagtattactggtgaaaatatcctcaagcctaaaggagaaataaatactttcacagacaaacaaaagctgaggaatttcatcaacaccagacccatcctgcaagaaattctacagggagttcttcaatctaaaaggaaaggacattaatgagcaataagaaatcatcttaagatacaaaactcaccagtaatagtaagcacacagaaaaacacagaatattataacactgtaatttgagggtataaactcctattttatgtattaggtaatagaaaaactcaatgatgaaccaatcaaaaataataaaggattacatcttttcaagacatagtacaagaatacataaaaacataaaaagttaaaaggcagtgagataaagtgtagcatttctattagtttttttctcatttgtttgtttatgccatcaactttaagttgtcattagtttaaaataatagattataagatagtatttgcatgcttcatagtaacctcaaatcaaaatatacaacagatacacaaaacataaaaagcaataaattcatcacaccactaatgaaaattgccttcactaaaaggaagacaggaaggaagaaaagaagaaagagaaaatcataaaaaaaaaacagaaaaaaaatagcaggagtaagtccttatttatcaataataacattacatgtaaatggattaaactctccaataaaaaagacatggagtagaagaatagattttaaaaaacccacaatgatctgttgcctataaaaaacatacttcccctataaagataaacacagacagaaataagaaataaaaaaagatacttcatgccaatggaaaccaaaaaaaagagtaagagttgctatacttatatgagacaaagtagacttcaagatgaaaactgtaagaagaaacaaagaaagtgattatataatgataaagaggtcaattcagcaagaggatatagcaattgtaagtttatatgtaccaaacactggagcactgagatataaattgcaaatattcttagccctaaagagagagacagacctcaatacaataatagctggacacttcaacacctcacttttagtattggacagatcttccaggcagaaaatcaacaaagaaaactggaggactcacattatctgatttcaaattatattaacactacaaagctatagtaaccaaaatagcaaggtgctggcattaaaacagacacatagaccaatggaacataatagagaacccagaaacaaatccataaaactatagtgaactcattttcaagaaagttgccaagaatatacactggggaaaagacagtctcttcaataaatggtgctgagaaaactgtatctctacatgcagaagaataaaactagacccctatctctcaccatatacaaaaatctaagactagaaactataaaactactaaaagaaaacatcggggaaactctccagaacatgagtgtgggcaaagatttcttgagtagtaccctacaagcacaagaaaccaaagcaaaaaagaacaaatgagatcagatcaagttaaaaaatcttctgcacagcaaagaaactatccacaaagtgaagagacaaccacagaatgcgataaaatatttgcaaactacccccctgagaaaggattaataaccagaatatataagtagctcaaacaactctataggaaaaaatctaatcatctgatcaaaaagtgggcaaaagatctgaataaacatttctcaaaagaagacatacaaatgtcaatggcaaacaggaatatgaaaaggtgctgaacatcatcaatcatcagagaactgcaaatcaaaactataatgagataacatctcaccccagttaaaatggcttttatctaaaagacaagcaataacaaatgctaatgaggatgtggagaaaagggaacttttgtacactgttggtggggatgtaaattagtacaaccaccatgaaaaatagtttggagtttcctcaaacctcaaaatactaaaaataaggcggagcttgcagtgagccgagatagcaccactgcactccagcttgggggacagagcgagactccatctcaaaacaaacaaagaaacaaacaaacaaaaactaaaaatagaactaacatacaatccagcaatcccactgcaaggtatatacccaaaggaatggaaatcaggatgttaaagtgttaacttcactttatagtaggcagcattatttatagtaggcaagatttggaagcaacttcagtgtccatcatcaaatgagtggataaagaaaatgtagtacatatacacaatggagtactattcagtcataaaaatgaataagatcctgtcatttgcaacaacatggatggaactgggaggtcattatgttaagtgaaatgagtcagaaatagaaagaaatgagtcaggaatagaaagataaacttcacatgttctcacttatttatgagagctaaaaattaaatcaattgaattcgtggagatagagggtagaagaatagttaccagaagctgggaagggtagttggggacttagggggaagtgaggatagttaatgggtacaaaaaatagaaagaatgagtgaataagacctagtatttgatagcatgacagagtaactataatcaataataatgtacttgtccattttaaaataactacaagagtacacaatttgtttatgacaccaaggataaatgcttgagaaggcagatatcccatttactatgatgtggttattaggcattacatgcctatatcaaagtatctcatgtgccctatatataatcacacctactatgtactctctacaattaaaaataataatttttttgaacggcaggagcaaaatttcttatagcatctggatacactgcagctatagtaaccttgttgttttatcattatcagtggtgtcttttgctacccaattcaatattctatagctactcaactactctttgtctatgcttctattgtttcttctcttgacatgacaaatgcttctggaattaatttatgcttcttcctagctttttctgtctaataatgtcaccgtactactgctttttctctatcttttagcttctgtacttctcaaatattactgctatttatatgtggccattttctagagggtaacatagaccatcaaaggatctgattgaattgactagttaccatatgaagtggagaatgttagtactgtatgttctatacctctcatattgccctgccttgtagaccattgattattccagatgattgactgaatgagaggtgattcctgctccaataatccctggctctgcttgcagaaccacatggaactaaacacagtgatccatgcaccaggaacctcttagaaggaaactgaaaatgtcatgcacatagaggctctccagaaagagtattgtagtaagcagccatcttgtgtggcctgccctaaaacattcatttattagtgtctcttccatggacatctcttttcttacactgatcagtctttgtattcatgaagcaataccaaatgattaagattatacctttgaaattaaaaaaaaaaatctgatacttgacaatgcctctcatattcttttactttctgatttttcttagacgtttggtgattttgctttgttaggatggaattttagtcattttatcagtttccaaaaattcccccttgaaaattagattggagttacatttttataagttattcatggctaaattggcatcaaaatattgaatatttctaccaaggcaattatagtagagtaaaatccactgagccaacctcttgtaatccagaaattccaatatttccacaagaccaaattgaaacataatagaaaatatcaatagtaatatggctcatataataatattacagctatataataaatgtttcatggtatttcattatatcaaaatatttttagaatataagaagtgctaattactctatttaacatgatagctcagaaattagaaatatcaacattgttcaaataataagataataactattaagtatttaatttgtgccagggttccaagagcttaacttgcattggagcatttaatcctcagtgggagatttatcatccccattttgcaaatgaggaaacacttacagagagtttaagcaacttgcctaacataatacaactactaagtggtggaaccaggatttaaactccaggcagtttgatctagagaccatactcttaaccattattaagatcagtctatgaaatatgaaaaccatcaatttaatctcacagagtcacttctttgagacatatgtcaagttttaatatatattaagggcaactttgaaaagaaggcagtgttgatgagagtaaaaaagacaatgatatatatattatttacattgcccaaatgtttctatgatggttaaacaaagtatcagatacagccttttagcttgacaacgtatgttttgttttctttttctttttttcttttagctgactcttgctcctctcaggaagagaacatattttcaagtttatttgcctaggcatcaaatgtttaaatattttagtcaatttctaattaaaataattacttttaatcaacattttcttatatttctttctcatttttaatttcagagccagacaattatgcatttctttagtcaacaactagctgctaattatttactatgtgtcaagtcttataatgctgaagtgaagaaaagagatttaaagtcatggatgtggtttcctttggaccttaaattctagcacaaaatatgataaacattgtaatcaatgctatcatgtacaggtatgtggtgttatgtgaatatatgggaatacctaattcgtaaactgggtttagaaaattcttgcagaagaaagtggcatccaaacaaagaaccaagaacgaataaaaattattatagataaagtgaagcgggtctagtggaatgacaaaattactgagtgtcaagaggtggaaggacttggtgaataatttgaaaaggaaccatcggaggatgatggccacatttctggctccagccatcaggtaaatattaacattcctttaaatctgcatttttgttttaaatcgttttcatatttattatctttatttaatctgagaacaactttttgggagatagagaggtatgcattttctagctgaaaatacaaactgtttacataatttgcctaaagtctcagttgaagagggtaagggagggtagttagtggattgcacacagaatgaagttgttttcaccataatttctactcatttagaacatactttttattctgctgtctaaagagcaacatgtcttctttcagacaagattattatctggattcaaatcaatgatacatttttccctttgtcatctgatgtagacatttctaactggctctcctgacaggagcaatccatcatcatagctggtggaacaattttgatcaactatgtcaacacccctatcattaccaccaagtgcaaatgcacattaatattctatgtaatggccaagcagatgcagaaagacaatacatctcttcaaaaggctcctgcaggcctcttctttgttttctcaccctccctctttttttcaagctttgatcatatgttctaattagatctcaaggttcattttactataccacaagcttctgtatggccactggaatccttctaactccatttacctacactatccaattataaacttagatggaagttaaacagcctgtgagaactcagaaggatatctcattgaaatggtagaagagttcactgctgtatctcagtagcaggcaggcacctcaaactggttaaactgtgtgcaccacagtactggtgctatgaaggtttctttcacaatagttttgcattttttaggtgttcaagatatgtctttgtggtgtatgcatgtgtgtttctgtgtgtgtgcacgttgtgtgtctgtgtgtttcttttgctttttggatgggtgggaagttaataagtgtcatgaattattaaaaaggaacttgaccttatagtgattccaacagaaaggaacaaaatctggagatatcagagagtcccttgtgcatattccagggactatgcgggcaactatctctgatggttgcaagaggaaaaaagaaggatttcagcatagatgacaaattatcactcaaatgatgatagtctgtggttataggccttgcctcccacttggattttggtattacccactaaaagtgctcatcttggaagaggatgtggagcctcagatgccttctctgctttccctatatggtccaggaaagcctattccctgagacttttctcaacaatcttacctcccaagacagacaacactactaaatacactccctgaaggatgaaggcatcttgttcgaggaaaattacctagtgaccatcaagcaggccatccagaggcaaaactccttatctgaggaatttagaagtaatttgacttccctattatcaaaagcatgcatctggtaccaagctcttttcccaaaactttgtaagtaactagaatttctatagatctctggaatgtatgcatattgaaactcattgtgcaacccttgctgacatcaaggcaccaaaatatctataaatgtaatcattcctcatgacctacatggctaatacggttcaaaatacccttaagctcccactttaaagtccataaaaacccctaaggaaaatccaccgcttcacactcagtcctcccttgctgaggtgcctcgctgtactcttctgcagcatgctttctatctaataaaaccttccttttcaaacctatactgttgtcaataaattcttcttgccaacctgagagtcaaccactttctgatgctggggctctgacaccctgccgggcatctttttgactcatcctgggactttactgggatttctcccttcttttttctctctgcttccctcaacagtctggtactttactcttagaaaccaatgatctttggctgaggccactcttcagtgggatcctgaagccctagagaaggagtgtctgtctgtctctgcccttggggccgagaaactggccagggttcttttccatttttgaattaccagtgaaccagcttaagtactctttggcaattgagggtttctggctgagtgcactccttggtattatccaaaggccaagacaaaaaagcaaatttactattgcccccttccaagggtggcaagtccaccttcactttaacactgtaaaccgtgccttggaaatgagcagcagcaaaatcaactctgcacagacacaatctgctggttgtggaccccattttgaattgaactttgtcacagacatcacatcgcaagtcacggacaagttctccttcacattaggtttgagctgatcactcaaacaagggcaggcctagactgctcatccaggcaagggtaggccctctatccatggtaggcacccccagatagagtgagcaaagggaaaagggaggtcaaaatccctcgcaggcacttcaggaatcttatagtgccgtatctaaacccaacatgggttcaactcattcttcagttctatcctatttgcccttgggttgcattcttataaagtggtcccattttgacccacaaactctttaaacttttatattcagagaccccatatgttcaggtcttttgggctttatctgatacgtaaaattacataaaaattgcataatcttccaaagaacttcttctctacccgattctgatgtcttagatgatccttccatttgcctctcacactctcctcatcctgctcccactttacctacaccctttccatctgcttcatcccccaatcatcaccctctccccataaacagatactttatcctcctcatatacttgcacaggagttacataagccactagtacagagtcctcagaaaacctccaaaatgttttccttgtccataaggtggcaaatgaagatttgggaaaaattcgaattcatgcacatttccaatattggatcttttgcaaattccatcccagttgcgttcatttagccaggagcactctaagttaattcaagaatttcaggccttaactatttcctttgttttaacgtggcaagatatatttgtggtattaactagttgatgttcccgcgaagaaaaatcttgcctttagtttgagcttaggtggatgaaactcatgctcgtaatcctaatgataatatagccagggaagaagctgtccctgacacagaacccaactggcaacaccaggccaccaatgttggcccagacagaggcaggggcaggtgagattatataataacttgtttgttggaaggaatgaaaaagaccgtaagaaaacctgttaatttttctaaattatgagaagtcagttaggagccatctgagaatcctgcccttttacaagctagactgctggacactatgcaaaaatatgcaaatttagacccccaaagccctgcaggccaatccattctggctgtacactttctaagtcaggcatccaaagacgtcagacaaaaactccaaaaattagaggaagacccacaaactccttttcctactttattaaatgcagcctttccagttttcaataattggaaggaaatatcaaaaataaaaaaggtgcttggggcgcggtggctcatgcctgtaatcccagcactttgggaggccgaggcgggtggataacctgagtttgggagttcgagaccagcctggccaacatggagaaaccccgtctctactaaaaaatacaaaaattagccggtcatggtggcacatgcctgtaatcccagctactcaggaggctgaggcaggagaattgcttgaacccgggaggcagaggttgtagtgagctgaaattgtgccatagcattccagcctgggcaacaagagtgagacattgtctcaaaaaaaaaaagcgtaaattggaggagaaaaaatgccgtcgccaactaattacatggcgacagcactggcacattctttttcattaactaataaacccagggctcatccctatgctactaacagaatggggacctgttattgctgcagaaatccaggacactagagtagaaaaggttcctaacctccaggttacaagccaaccctggaagcctgtcctcactagaaataagagggtcatcggaagagcgagtgaccctctctccctcatgaggtggggcacctcttccttctgggctgtcacagctacagccttatcaatctacctaacaagggagtcctgcagaatggggacgagggcaatgccaaggacaagctcttctaactctattcctggattataatcaagcctctgaaattcatcctctagatgactgatggggccttgaggccatccagcccctatcttttccatctctatggataagtctagagtaaatctgattgtggctaaacaagagataatgttcttcatagatacaggggccagttattcatctttaaacatttactatggcccaatgtgccagtcctccatttttctcacaggtattgatggaaaaccccaaggaggctgttttacactgccactcccttgtaaaatggaaggctattcctttcctcattccttttagtcgtgccaagctgccttgttccattattaggccatgacttaacacaaaattacatgctaatttacaacgaagccctcaccttccagctgtattaactcacacttcactaaaagagcaactgcagtctacagaaactcaaactctaaaacaagtgccatttgaagttggaatacttctcttcctggtcaatcaatatcagctgctcttgtattcattcagcttcagattcccaataagttcttcagactccctgatgcctcttgaaaccagaagcatgaaaagagttacagcccctaataacaaaatttttaacccatggattattgcacccatgcaactgaccttgcaactctcattttagctgtaaaggaatcagatggctcctatcagctagcacaaaccttagaattattaatgaagctgttattctgattcatcctattgtcccaaacacttataccctttttggacagactctctccaccacagcttagtttactgtacttgatcttaaggatgactttttctgcattcctgtacaatcagatagccaatttttgtttgcttttgaatggcaaataacttaacttgaacaattctgccccagggaatggcaaaacacttaacttgaacaattctgccccagggaatcagagatagcctccaccttttcggacaggccctagctagaaacctgtctaccctgcagcttctccaagacagcaatctactcccttatgtggatgaccctactaatctgtagtcctaacaaggctgttttagacaaaaatacagtgttagtatcaaacaaacttgctgactgtggatacaaagtatctccttctaaggtacaaatattcacagaaagcgttcacttttggggccttattttaacccttggtacaaagagcctctctagcgctcctgaagatcttatcttaaacatgacaactccaggaactaaacaacagcttctgtcctttttgggtatggctgtgttttacagaatatgtattccttcctttggattaaaaggaaaacctttatatgaagccctccagggaagtgaggaacaacctctatcgtggactaataatgtgaagcatgctctaaacactttaaaaacaggctgtaatctcagtcccagccttagccctacctgatctgactaagcctttctttttttacgtacacaaatgaagggggatagttttgagagtgagcctaagatctatggccctctaagcaccccacagcatatttttcaaaagctttagacctagtatcctaggaatccctccccacctcccagcttaagagccttagcagtggtagccctcttagtctaagaaaccttaaaaatatattaaccctcctgggatcttatggctttgcttcactgctaattaccccctagctaaaaaaggagtctgtgcgttcatcaataaaacatgttccacttctcttttctgtacaggaatgcggaaaaagagaagtgaaaactaatgtccaaaaaaattttcaaacaagccacatggctatacacactttcctaaagtaaccactactgggccaaaacctctactgattggtttctaaaaatcacatggcttctcctattacttggacctttattccttgttactcttcttttaatctttggtctctgcctttttaatgctctcattaagtttatatcatccaggttacgattccacctacagatgactatgcaatcccaatatcggcctgcaacagcaacttccatttacatggggcctcttaatggaatcgtttcttctccccatgaacaagtttttcatgatcctcattcccttcatgacaacagagagaaaaggaaaaatacaacttatccactcactatcccctttcagcaggaagtaaccagacagacctggggcccctcttcactgtgctattttctgtttcttgagactgtaataggcagcaggtagacatgagcatgggggaacacaaagggtcaaagatttgaccaagatattttcaggaagaaaataaggagaggaaagatcacctggagactatcaagcaggccatccagaggcaaaacttcttatctgaggaatttagaagtaattcaacctccctattatcaaaagtacataacttcaccctgcactcttcaactactcagtgattcccacacctcagtctacttcaaaccctagatacctagctccagattctttagagaagaggatttgaggtttcctctcatctcctcctgtggctatcttaagattattaaacactttctctgctgcaatctccagtgcctcactatattgactattacataactgactgcaaagcatgtctgtatttgtgtaaaatattatcagaattgtgggaaaatagacaagttctatgatagagtctatttctaacccatgttgactccaagtctctatattgggcccacctgcaaaatcagagtgtaaacgaaagagttgagctgcaattagaaaccttaatgaaaagcaacttttcaggctttgcttttttccttggctattgttggggcttaggaactgataccccaaaatacatgcttcgatatgcagaactgaagaaacctcaaggtctctctgacctctcacttccccattgtctctcccaaagcacaggatgagttgttgcctgaagtccctttatctgcctaaagtactgatccaccaggagaacaactgtttattcttctccttactattatctcattatctattacagaaaagaaggccaaaaatgtaaccacacttgaatagaccctttcacaagataatgtctgtctctcaggctcattcaaattccatggagaaatatcttaaagttaatcatctctgccctccaatccattcattctccctagttgtcatttattgcctgtcaacagaattcctcttttcctccctcctataacctgttttgccaagacctaagttcccattctttctgtacccacaaaagatgatatataagcttctaaaccctatttgggggataggtaatcactccgtgattctcactgtgtacacattaataaatctgtatgccctttctccaattaatttgccatttgtcagttgatttttcagtaaaccttcagaggacaaaagggaagttttccctttggtccctacactattaattcctatgtcttacctactcaaatttcttcaagctttaaacagagtcaaagcaggaaaaagcagaacaggtaaatgacaggaagtttctacttacagaacacttgtaaaagtgtatgcaatgtcctataaaccatcatttttttcttaatcgtatctttataattggatttaattatattttcaaaattttaaggatagctcatatatattgaaattaatctctcacacttccatattcagaaactctagatctgacatagagatcatttcaccttcctgattaatataggcagtacgtggtgcacaatgaagacagactttgcggccaagacaaaagtacctgagtcttcaccctgttggaacagtgtatatcagagtgactttgggagagtaattttaagttatttgttttctttcctatccataaaatggttttccaagtcccttcctcaagggttgctttaaggtaaaatgagagaatgtatgtgaagttcctgtcaggtagtgatctctcaacaaaacttccttccctcaggctagatttcattattagcagctcaagggtataacttttacctttacttgatcttctcagcttctgttgggaattttattttaaactgaagggcattttctctttgcttcacttcttaagtaaattcagtacatttaaattatttcccttgatcttcctacctcatcttcttttacagagaaactaatttgaccttccctccaagctacttgtcacttgtctctttttctagtccttatgttatattcctattcttagccaatgatttcaaatgcaattctttaagtaatatttttcaaattgcctttaattaataaaatatgttgtattaaacacattgtattacaattgtatttaattaatataacgtgttttgcttgtctttctgttagtatgaacttatggttgaaggcattctcaggggttaacaagaattctggacagaaatatggctataagtaagtattaatcaggctgcactttgacccacttccttgtaactgaaagtcactagatcctgaatatttgtatccccattcccactgttcttatagatagaatctctgacatcagaatcataaggcttttctttaagaattgcttaaagatgttcttcggatccccaattccagtgaaacagctgatgacaaccattttgaagacccccacagaggaacagaatcaacatgagatggtttcttcctctccccatcctatgacttccccctgtactcttccaccaattaacaatctccacactttgacccactccaaaacccttaaaaacccagccccaaactacctggggagatggatttgaggttccttcccatcttctccttcgatggcccaaccattaaacctctttctctgctgtaacctcgtgtctcagcatattgactttttgcacatattgggcaaaaaaaacctattatggttacttgattgtgataacatcaaaagtacactgaatttggagtcaggagacctgaattctaatcctagctttgacattaattagctacgtggatataggtaactcacttcacttctgaaggcctcaaagccctccaaggattttgagataggcaatttttccctcaacttagcattatcatttcatggttttatgatgcaacttttacagcatcacaatgttccattaataaaattatattggtttttccatatttttaaatctaaaccttcaaataactatttgttttcatttttttctggtgtgttgcctttgtctttcccctttattctttcatgttttgcttacctaaggaaaagcttacaagaaggagctgtgtcaacagtagttggtatggatccacactaacttttatttggggttttaactaagagaacttaatgtatgacttattgtaaaattataaaaatcaaatcaagttttataacaacagccatagaatggtctttttttttgcaaaaccaaagatacatatacataaatgaatatgatttatgtagaaaatgatattaaaggatacatacaaaattattgagaagcaattagccctggaagagaaaaatctgagctagaggggtagtgaggctaaaatttgtactataaactgtcctatattatttaatttggtataacaagagtgtattattcttataataggaatattactttaaacatttttattaactgatatttattttatgtatataaggttttttttcaatgtggctttgtaatctaccacatactggacttaaagttataaacaggagagatgactgaagtggaggaaggttcattagcctcacacaggaaatgccttgaagtagaccgtgggtgaatctgtttaagctgtgacccaagcagaaatactttcttctcaaagtgatttgaaactattattctcattgaatctatgataagaaaactaattatgataacagacatacggttggaagaggaaacacaggtagagctgtctttacattagagaaagaactgagagagctaggcaaaagccatcattgggggtaacagaacacagcagggggaagcattctgcagagcatattggaacaaagcaagtctctccaaaaaaatctaaagaaaatattttcagaaagtgcacaaggcaaagactaatggctccctgcagatattcataaggatataagaaagaagaggctttccaagaaaatataacatatttcaacaacaacaaaagactgggctagatttgagacacactaagagtcattaacaactagaagttcttatcataacactatctatactgtttacaattgtgtcactttatgcttatataaagtataaagagaccactttacagaatatgggttcagtcattgtcagggtatcagagtatcttttgttttcctttattatattgtaaggacaacataaagtaacccaaagagaaaggagagaacagcttaacctctctaaacactgcacattttggaagtctaatcccctctccctgtcccaaatcctctcattatatctaagcccagtggaagtatgctggtcctcacaggctggcagttttctcaacctgcaattagagtgtttagctctttttgccagctacagctttagtcatcaattccaggaaaccctgacaccaattcactgaatatctaaacatacattacctacttgatcatctatattcccagatgcaatgaacatattttcttgttatctttttaagtcttctaagttatattgtgcacaatttaaatacacttgccttagtttctgagacagccgtttctcggttttctatctttcccagttatttcttgccaatctcctttgttagctcctcctcttcaacatgaattctaaatgtgtttgcttctatatcatattttctgctctaatataccctgtctatatgttattacatcctaagaaaaaaacaattcctatcataggtcaaacttatgctctaaattccaaaatcatatacccaatggctgatataatataactatgaaatgagcaaattcaatatctaaaggccactaaattggaatgagacttctacccgaaacagattcctccaagtcttccttaaatccataagttactttcacacacacacaatgccccaaaacaagaaaccccaaagccacatttgtttcccaatttccttcaatcccacattcattcccagcaatttcagtcaattttacctctaaaatatgttttgaatttgtttacctcttctgcaattctctagtgcattactaatataaatacaatgcaagcaacatatgtaatttttaacttgctagtagtcatattaaaaataatttgtgtaagtcaaagtgataatattttggatatatttggttaaaatatattattgacattaatttgacatgtaaaatataaatatatttgagatattttatatcatttttccttgataaatgttcaaaatttgttgtgtgtcgtacatttacatggcacatctcatttcacatagccgaagttcaagtgcttgataagtcacatgtaactactatatcggacagtgcagctctagtatatggcaacattacctgttgcctggagaaatacaacagactcatatctggtatcctcacatctattcttgcccatcctccatttccaataacatacttcctatggattggtgagaactgaaaacgacataatcctctgtcccacagggacaggaactgggcagaccttcctgctcctgtgttaataatactaagagcaagcaaaacaatacttagctgctttctccaggaaatacctgctcctagaagagaaaactgaaacagttaaactgaccaattatcaagactagtaagctcattaagatttactaccaaaccttcaattcattttgtccactcatccaaatctacttatcaccacaatccaaccagttctctctcttgcaagatacactttaaaatcactcagcacaggctttaaaatgcttctctaattttcccaccttgagttatccacatattggccaacaaacctattatggttacttggttgtgataacaccaaaagtacactgaatttggagtcaggagacctgaattctaatcccagctttgacattaattagctacatggatgtaggtaactcacttcaaggtggtattctcctttatcacactaagtcttagtggtagtactgcttgattaacatacttttggaaagtcaacattcaacaaaatcaagaggaaacttcttaaaatgcaaattggatcatgcccctcccctgttaaagctattacaatagttatcaatgctttggaacaaaattcaaacagcctagcatgtatgaaaatgtcaaaataacttattgtctgtcttcctttctaaactcttaccactctactcctccattcagtaacttttagaaacagtgcctccttcctgttctttaggtataacaagcaattccaaattttagcatctttgcaattactcttctctgcctgaaacattccttcagtgttttaaaattgctgccacactcttatccttactaactaactaaaattcgatctcctcagagtgtaaaagactgctttgactgaaagtgatttatctcttaggccaattttcttttcatcatatcatcctgcttccttcctatcactcatcataactactttatccatatctttctttactccctgtctctttctacaaaaatgtaaactccatgaaaatggaaatcttatctgtcttatctatctccatatggctaagtgttcgatagatttattggcccgtagtacgtactcaataaaacaacaaaataagtgaataaaaagacaataaatggataaaagaaaaagaaagaaaggaaggagggagagagggagggagggaggaaaagaagggaaaagagagagaggaagggggggagagaaagagagggaggaaggaaggaaggaaggaaagaaggaaggaaggaaagaaggaaggaaggaaagaaggaaggaaggaaggggctctgaaaacgtgccataagtaaggcaagtgtgataatcccctcccttgtatattagaacaccatgtaacaatgcatcaaagggagaaacccaggactccagagctactataacacgtagctgagaccaggatcaaggtcttctgatttctaatcctgtgctcaccacagcctaacacactgtctttcagccttctctgattgatgtggttcttttgaagctaaatgtaaggcttcagatttaataaataaggcatttgaaggagaaaattattctctatgcattaattggtgagttcatatgtttttgcatttacatctcctacttgcattttgattagcaattacttctgtcaatttaacaccaacattttccgtaatcagagacatgttataccttggaacagactcaatgagtccctgaaactggtgagacagcacttcaatcccttcaccttggctgctctagtagtgaacatgcctgactaccagtctgatttcctaaatctcctctgagattttagatggttagaaatacttttgacatatgcttggcttcagctcattgcaaatacaaaaacgcttgttccaaatacaagcctcatttttttctattattattgttagtatcattattagtattacctgtatcactcttctgaagtcacttttaaagagattccatatcctgagaaagagaaatccctgaaaattacatttgatcagtaaatttagtgaggcataaatggtataattagtatttgattgaaatttctatcctcctttagtagtaaatatattgtaagagattgtttgtcatctattcgataatttcttatcccttctctcttgcttaaagaatctcaatttttaaatattaggcggcttaaggcaggtgactgaggaactgaaagggatgactatgctgccatcccaaccatacaggatgaattttgaacactctatactaagcctagtaattccgttcctctcgccatttagcaaggtcatgtttctttgacatgcatgaagactcttaaaaattttaactctgcttatgtttctactcctcctccacctgtacactggcgtccaggtacccttcacctaattgtagttctttctcctgtcttgacctccgtatccttgcaaatgtgctgagccataattccaactatccaactcttgactcattcatcaaagcccaactggaatgtcaacaaatggctacatctttgcataattttctccatggcagaatttaaagtctctgtattttaaaacatgattccatgtgcttccattatattacttatcacaatgtattcctgtcatttgcttatgtacctctttattctatgagaatgccaattacttgatagcaaagatcatgactcaaccatgtttgcgttcttaaaacctagcacagtgattaaaagatagaaaatactcagccatttttcaagtgattgactgtatcctgtacaggatagaaaattacttctcaatatgatgtcttcttcattgtatgtttcccatgttcatgataatctcacattccacataccctcctcaagacttttttctgttttatactttctagctattattatttcaaagggttttatttagaagagggtatcaaaaagattatgtatagcttaatatcttaaattggcagcagctatatttataaaagacattaaagtatggcaatttaatattctattcactaaaatatttgactaattatacctctaaatctttacctgtcattaaacaaatgattatctgaagtgatttaagactctttggattggtttattttactaattaataagcaaaagactgtttaaattgacttatggtcacataattgttaaaaaataactgttattgttgaaaatgatgatgatgatgatgataataatgatgatgatgactatgataataagagcacgatgacagaagtgggtcactttgtattttctaaagatggatacaatattattcctcatctcacatgctccttttgacctttacactctttccattgaaagatggggttcgtgtctcctctcctttgaatccgggaggcttttaacttgcttgtaaccaagactatgacagaagtgacactctatgatttccaaagttaggatacaaaaggcaatatggcgtgtgctttgttaactgtaacttattcttggatccctgaaatgtcacacaaaaagcccgactatccagtggctaccatgctgtgagaaagccaagccccataagaggctaaatgtcaccttcctcagtcttctactccttagtccagatgtcagacatgcacaagaaggagtctgtaccctttctaaattcctgacccatagaatgtgagagcatgatacattgatggttgttttataccattatgtgtggagtaatttgttatgcagcaataataactggaacaaagagtgtgacaaggaatgtttatgtgttcatcagtcctatttcttcttaggcacagaggaagagggcattcaccagctcctttgcagtttattcaggtccttttgatggattttgtccaatgagatgtagaggaaagtacattgcattgaggtctggccaccaaacttcctattcaattatctactctctctcccatttctgcagtgacatggaggccagcttatacagatggcaaaatcacaagattgaaagatactgaatcattgagtcactaccttgtagagacctattcaggaaaacaggctggcatcagaccaacgtaaggttgataaataaaccatcattgcaataagctactgagatctgggggttgtattacagcaagtagtatttgttattctaactactacaaaaactaatactcactaagcagttacaatgccctagaaattttactaaatggcttgcatacattaacccttttaaactctgatgaaccatccttacgtaggtatctttgttatccccattttacaaatgcaaatctgaagttaaaagactacatgacttacatagggttacaaagatattccaaagaatgggaatttccttgaagacggaggcaaacctaaaataagtttgtactctaagagttaaataagcaaaatccactggaagagattagctatttgtaaatgcattgtcaatgtgagtttttggtaaatgggagtcgtgaatttaatcccaaaccattaattttagagacaaaagaagatatataaaaatccctggttttattttaattttatattttttagtaaacagaccactatggaattgttaaaatgtattttacagccatttttaaggttacaaataatttttgttatgggatctttctatattttatgactttaattaaatttctgatttctgttccaaacattgcaatataagacagtataaaacacactttaatcattaaatttatagataattttgtgactttttagagcttataacaccaagggactgataatagaggataatgtgcataaaatacactccggcacattccacaaactctatccttaggatctttttttcccataacccagccactaatacatacactaagaaagtctcatccgggctgttctacaattgccatcatctttaaagagtaatcttgtcacctgaactaggtgaaatgaagaacttttaaaacaaccacacggatccgactttgcagaagcttctacgaagacaaatagcatcaaacagacatgtactgtgcattcataattacattagtggccacaaaatacaatgcttagtacacatccttggaactcttaaaaccatcttaaataagagatcaagcaaatttaattctttgtgaaaatatatctcaaggtagtttctactgtccttaatttttgtagtataaaatttaacaaagtaacatcgcatgttcttgtccttaattccttggggtctaatgattacattttgaacaaatgtccaatttggaaaccaaatcaaccactttatttaatgcagaacactataacattttttgggggggggggcagggtctcactttgtcacccaggctgcagtgcagtggcagaaactgtagcctcgatcccccagggtcaagccatcctcctgcctcagccccacaagtagatgggagtataggcatgcaccaccatgcccggataatttttctgttttttacagagacgggggtttcaccatgttgcccaggcttgtctcaaactcctgagctcaaccattccacctgcctcagccttccaaagtgctgggattatagatataagccactgtacccagacagactttgttttaaaggtctgaatcttccttatttcatatagcctacattcttttgtgggaacaaagaaaacagataaataaatgaataaatatgtaatacgtcaatcatcatgacaaacgctacgcaagcataaaattgagcaagaagatgaagagtagctgcggtgggagatgctatttttagatgtggctctatataggatctgtgtagggtgttggataaggcaaggatgaagctgacctgaagaggcctcctgtgcagagtcttggaagagagcatcacagttagagagcacagtaagtggacagatgccagaagcatgggcctgtctgaggaattaggggaacagccagcaggccaatgtgtctgaatctcagggagcagggaagagtagtagtaggataagtgctctttaacaaattgcccaaaaagtgattcttgagatttatgtgtttataactgttccatcaacaaagggaagtctatggagtctaaaggctcccatggtataaaaacattgagctgttgtattctcctatggtaagagaaaatgttcttcaggcattcaggtgcctgaagaccctgaatctcttgctgtgactttccctaccagtataggacctcaagtgcctctattcacttagagaacttttgctatcagactccagaatatttttcccgttgaaactccattatttagtttacagatactggagttataaaattcccagtctccctccattagctacatcaaagtctgttttctaaaattcatcattttataagttgtattcccatattattttctccagaaggctgattcaactctccaaaagttgtttttgaaatgtagatatgcagagaaactttatgtttgaagaggttagcattccttaagagtttttaggataaaaacaagtttttgtaccaaaataataaaacttactagattgaatacttaatataaatctaacttatttaatacttatacaagtttataatagtatgacatttaataattcacttaacaaaaagcaaaccaaaaactctaagattctgcaagtaaccgtcttccccatattacccttccattcacaatgttagccatttcccctgaacacctggagatgttttcaaagggagatgcttggctccttatattcagctactttgagtcaaaagctctgagctgcacttgtgtagagctctctgagtgcaggactagactgcatcaaagtcctattggaccatggactcccctgccagtccagtggtgttgaccctttggtgaaagagcacttcccagaacgacttcaagctgaacatctttctctcagaatgagcaactgagatcactaactagcgcggcttttgtagcttaacacgtttcctgaatatctttttcttactctagtcacctctgctcccttagtcaaaagtttcttcaaatgggatacacaagaggagggccattaaatgtgctgagagcataagacttcttgctgaccagtgccagcaggcgttccaaggtttccctaccttatactctgttttcagaagaagcagcaagagtactgttacagacttctttccactaaggtttgatttaaatttgcatataaaactaaggttactttgctattggccttttacgaagttcccttaggaatccccctggtaggtggtttctttacaaactggtcctgacactagaaaagagtcatattacttccagaagggacaaagtgttttaactggcattccatgagtcctgtgaggttgaagagcagagtaacttagatgaacttaggaaatctgcctaacactgaaaaatgaaaagctatgaagtctttgtacattaaataaattggaaatggtgcctgaataaattctccacagtcaacaaagtatcagaaaagcatgaaggggagaagcgcacatttgatagccgttaggactatggagagaaagtgttccctggggttagaaaaactggcttgacagggaactatgatcattagtgccaagcaccgggaactgtcgccctgtgggtggagacaatgcaccacagggcctcaagcagtaccatcaggacccagaaactagtgagcttaccaatttattctccaaattgggcacttaaaaggcagtataatccagtactgtcctgtgcaagccaagccatacatatatatactcatcctgtcactatattttaaactcacttagcatatacttattttatgtaaactcatttgtaatcccaataatcttcagacacaattaatactacactgcccccaacccccttatccacaggggttatgttctaatacctccagtgaatgccagaaacctcggatagtaatgaatctgattgccatcagtccgaacacatttccatttctgtcttccacccacaaatttaatgccttttccatcttaactaagcacttatcataccctgtggctgtgacttttgagtctgaagagtgatagcaaaactaataccagtttctttttccttctttacaaccctacagatagaagattcattcttactgtagatcttagtaaccttggcatatgattttttttctttccttaataagtcaagaactttcaccttttcacttaaaggaagcactttacagcttctttggcatatcaggattgcctgcatcactacgtgcactttggggtcatcatgaagtaaaataagggttacttgaacacaagaactgcaatactatatgactaatgggaggggagcacagacaacatggatctgatggacaaagggatgatttacatcccaggcaggacagaatggaacagcatgaggtttcatcacactactcagaagagtgcacgatttaaaacttataaattgtttaactctggaatttcttatttaatattatcagacagtggttgaccacagataagtgaaaccatgaaaatcaaaaccatgaataaggggatgtctacttctctataacatgaaacaacaacaacaaaatgacatgacagaatacagctgatgaatttcaacattctataaaccttaaaaattgagtttcaaaacataccataatcaaaggcgaggctaaaatttaattttacgtgttgaacaaataatgcaaaaatatcaaaaggaatgtaaaaactcccttgcaacctttggagaagggtgggttctggtaattaaacaactttatttgaaaagcatcagggcatgaatataaaatttggaaattaaaacaaaaaaacaagagtttgatccagaaaagaaagggtgagaaaaagagtacctggatgaatggcaagccatgagggtgaaaagaagagtagaggagggtggagagtacagcctgggaccctagactgtgaatagaaagggttagcagaagtcattctaggtggtcgtgtagctccaggaacctcgaagaaaagacaattctaatattcaaatatttgggatgattagatgtataaaggaaaactaataaaaaggtgagtggattcttggaaaagccaggcaggattttcgtaaaggctaaaacaaaatctctaaggcaaggttagtaaactttttctgtaaagggtcaggtagtaaatattttaagctttgtgagccattatagtctcctcataactcctcaaccttgccattgtagcacagagtcatagatataaaccaatggctgagtcacgtttcaatatgatttatggacagtaaaattagaattttataccattttcatgagtcacaatatcatattcttcttttgaattttttcaaccatttaaaaacattaaaaccattcttaggccacaggccatacaaaacatatagtggatcaaacgtgacccaaaggccaaaatatgccacctgctgatctaaaatagtaaataatgattcacatatatgagaaataaaaaataaaagagaacctccatacattagaaatgtttggcaaacagtcacttataaagtagaaaggtattattaattttataatatttgagatatcagcatttttaatagtccatgcaagtttttctaattagccctaatttgtaatttggtatgattttatctatttaaaattagctattttctgaggtgttggctatggagttgattattttttaatgaactttattaatatctaatttacatgcaactttaaatgcagtttgatgagttttggcaaacgtatcctccaatgtaaccacctcaaatgatcggttttcataaaagagtctgctgagaatttaagacagtgataaatcaatctgtaagtcaatctgggaataactgacatcttaatattgaatctccaacttcaggaatatgatcaatcccttcagatatttaggtgtttttaatttttttaatgttgtattataattttcagagtatagatattatatttgttttgttaaaattattaccgcttattttataattttggatgctgtgatatagtctactttataaataatattttctaattgttagttgctactacattgaaatacatattttgagtttcattgtatcattgtatttctctattgtccatgtcttatttaatttgcattttttttccttctttttggagatggaattttgctctgtcacccagtctggagtgcaatggcatgatctcagctcactgcaacctctgcctcccaggttcaagcaattctcctgcctcaacctcctgagaaactgggactacaggcacgcaccatcatgcccagctaattttttgtattttagtagagatgaggcttcatcatgttggccaggctgttcttgaactcctgagctcaggcaatccgcccaccttggcctcccaaacaggcgtgagccactgaacttggccctaatttgcatttgaagcatggacagtctcatttttttcatcatcttgggaaacactgttcagtcctttacttttacatacaatgatacttaaaagtagaaattcagtagtgttcttccattttcccctgcagggaagaaactgatgacatcatgtaaagtaaaaatataaatggtaacatgtacagctgagacttgaactcaggtcttctgattttacacaatattctttcattattggaccatttccaaacttaattccagagaattgtaattggataagataacattctacattggttagtgactatctgaaactgtaaaagtctttccctttagcagtttgagtatgaaacttcaaatagccagaagctcagcctggaagacacataaagaaaagatgtctacaaggccaccaagaaaaaaaaaatgttaaggaagaaaatgacagaaatttatagaagttgtgacactgcaggtaatctcaattgagaaagttatatttaattccaggaaaagccataaatctgttcattcctgtaggtgaaatagaatcagacccaaagattggattgttatataagctgatattttatattggactgtgtcccaattctagaagccatgtaaatgattcatgtaaaaacaattaatgtaaactgggccatgtaaatttatcttatttttctttgtttcctcaaaaattaaccttcatcaagtcagatatgcaaaatatgttcctattccctgatatatagagttagaaaactgacacagaaaatgcaaacttgagttatggacctgaaaatctacacacttggctttggaaagtatctctatatttttgaagcgcctttgataaggcacatatgaaaattcacaaacaaaacatgtgaaatctacattctgaatgcccgttataggaaaaattttacctgaatcttgtttctttttgtgaggatacttcactgcgggccacttatactaccctctctctcaattcaattatgtactcttttaaaatttcctccatttgtggttaaatgtcttttaccaaaaaaagatgaacattgagagttcagttctcatttatgttttaaggggtctataaaaattatgtgcagaattataatactaccttaaattaatataggttcaaaagcataatttgcatttaacagtctatcatttagatacctgatgttaataagcataagtatcctcttatttaaacattgccttataaaagaagagatttcttgatttaggactttgcccttcatgttgctctacaagcatgcttatgtagttaatattcgtcaagatatgcaaaaatattaattagcttcagtaggtctagtaagtactaactctatgtggtaataatagtagtagtagctatcttcttattatagcctattgtttattaagcatttcatttctattaactcatgtaagcataataatcttttgaagtaggtttaataccatgtctatcttacaaaggatgaaattgaggctaagtaagatttgtttcttgctttagttttaaccattatattatgcactcttaatagttgtataatttacacatgtatattaaatatcaaacagatcaaaatatttaatactgcttattctctgagtgtgctaagtatgatagtctataacctcacttgtctacacactgagtccagtggaaatagcaatactaaatgtcacagtatttagtgacattctaaatatcttagaattttaaacaactgctagcataattattgatcaaaacaaatagtaaagacataatcatatttttataaaaccctataaaatgccaagttctgatcttgagttagtattttattgtttcaaaggcactgaagagtattcataaaaatttagacataaaatgggattctgatacacttacaaatatcctcaatagcatagcctatccctccctgagcttgtataattacacatttattgctttaatgttgacactttttagataccttgaagaaaggatcaaatactttgcagttctaaggccagaatattggccaacattaaatttgaccttgtaaaaagaagattataccagatcaagtttattctcttctgtgaaaaagggacagtctttaagaaaaaaacggatagattttcatttacttgcacctaagtgagaatttatttttatgctataacccagttagcgattaagtccataagtttatggatcattttccaaggaatccctgtagaagtcgtgtagaggttcccctagaggctgcttagggaactgggggtatagagatagagacgatgaccctctgggtattcctccctggtttcaagtacagcagctctgattttatttgctttatctttttgaccataaagtgtacttaaagaaataatatatctgccttaaaactcagaaaacactctttcaaaccatgtacttagagacatgttctcagttgcatggaacatcagatactaaaggttcttaacactaatgctcttaactgaatctctctagcagtgattacagtcagataaaggaccaatataatttaatgttttattagttatttagttgaagaagctaagactctacatttcatgtttctgattgatactaacttgataaattcaacaaccaaaccagaaaacaatctgataaatcatatgaagaatcatatacagtgtaataggattaggacttaaaaacaagaacagaacaaatcaaaataaaggatgcatacataggcatacaagataaaaaaaaggaaaaggaagtcaacctctatccaataaatataatgtttaaatggaaaaaaatataggctaatagcagttggctatattggtagaaataacataagaacaagtcttctaatttatttgacattggacaggcactaatttgaatgtattcttgatagtctcttttgagaagtttgttgaaaattaaataaagactagtgaagaacacaaaatactaaatttttcttatgagaaaaagttaacagaaatggaagtatttatcttgaaaaagagatgactatgggagaaaattactgctctcaaaggctattaataattacaataaattgttctcctgccctacagaggaccactgtatatgaggaatatgtaaaaataatggcaagataatttgatttgctataagtaagctatcttgataatgaggaaatgtaaaaatactggaacatctaactgggagaagctataagatgtttttttccatccctagatagctttagtaagaagaaaaatgcattccgtaccctggttcccctgtgctatctcactggtttatattctcaaatatccactcaggaatagtgaaaatggagaggtttcactctggcaagactatatcctgaagttcatgtgccttctttacacttttaatgtttcttttatggattcatctacctctcagctttgggttattactagtccactaatccacagaggtaaggcctaaaaattttgcaacaagaaaattggtaaagtttcttgctgcccagacatagtcattggtacagggccacattttctaatcacttagaaatagttgtaggttgctcacaagtatttatcctgaggtttctctttgatatggtaattggtttgctttcaggttttcccaagcctcagtgtactagattctttgtcttgacacctttagactttgtcttacaagctcttccacagcatcctgctgccctgccagactccgtaatatttattggcccttttctttacaaggtccacaaatgacttatggactgctcagtatagccagtgacattcaggcctatcagatattaatactactgatgctccactcatatattctcagcacttctatatccatcttacagacttactaacagttaagtccagaggcttaaaaattgaattctattcatacttaaaaattatattcaccagtcccactgaatcttcctacagcaagcacctgctaccctgcctgagaattactttctttggccacaaaagcttgattggccctgaacatgaggttcaggtgacacctctgagggtagcttttcacccaggatgaataggtggctaaatatccagtttgttcatgtcaggtaagataattctgaagtgctgaggtgcattctgcagtactacccagagtttaacagcaggatcaagccccaagccccagttgcctgcagtgacccataattacaccttcttggttttcttcccctctctgcctcactttgtctcactttctcttaaatagactattgataacacaaatccttacttcagagtctgtcttcaggtgaatccacttaaggtatctccatatctttacatatgcattttccaaagaatgtgcattttttggtaacatttaaaagaacattttacattaataattgagggaaaacaatcctggtttctgtatatacagtgtgcctgcaacaaattgtgctctcacgcctgggaaggtggaatatatgtccccaaacagacaactcccagactgggacccttgaagtgtttgttgttgccagcaactccaagtgagatttcttgcagaacactctgtgattttatgatctaggatgagagggtttggccataaaataccacgttttcctatcaattccactacagtgataagaaagattctttcctttttgttcaacaaaaataaaaaagcaaattactttatgtatttttctttggcttctgatcatgctaagagacacctcaacaaatcctgcacccaacaaatcctatcttttctgcacacgcagcagtaaaatgcactcatttgtgtaagttataaccaaatacataagtaaaagtgttgtttgtgacagtagatctgactttggggatacatatgaacttctaaagttttaatagatttcagcattgacattacagcatagaaataaagcatttcttgcagtcatcccaggcattccagatggtgaagaacattgcaataattcaatggaaggaaaagcaaacttacccgaatcatcatgactgaacatctgatatcatgaattgtatcatagatcttctttgagatgtccacaaattgattatcatccaacacattcaatgagcttttgcttaaggcttccaaggcaacattcacttgtgttacaaattcaggaattactgttaaaataaagaataaggagaagattgtcctctttgtatttttggatttatacagtagtttccaggaaatgtagaatttggttttaaacaaatatttgattaatagatctttaattgtattttttaaatatagagatacacaaattttagcaggattatcttgaatctctgaaaagtaaaacgaatcaaagacaattaaaggcattttttttttctaaaccccaggcttctggagagaaaggcattattatataaatgttttaaaagattatctttctcctttatatcatctttgtttttacaaaaccttgggaccatacaatcatttctcatcctattcaatataaaccacaagacattacaaaaaggaattggtgtgtaaaacagttggaattgtaaacacaaagatatttaaagaaagaaagcaattgagttgctaaacagaagaaaatttagctaaaagtagtaattctgccttatagaaataataaaaatattgtaaacttccttttagtaagatgttttctctataataaaaaaaattagtgaaaaggaattggcattctcatatgaaaactatctttaaaataacaaaacactgactgactatagggatgcttctatcagtaagccaatccatggattatctttttaaattaaggcttcaaaatagtttcaaataaaaacgcttcttcaattttacttttaaggttaatgatattaacagttattatctcttcactaggctcaaggtacttttctaagtgttcaatgtgattcaaatcttaaccccagtattaactgagtattaatagtttaacaactaggacacagagaaatcaagactcttccacagattcattctgttaatgtgtaattagagatgtgaactcagagtcccaaaatgcagtttttgggactttacactttacactcaaactaatctactatatcatagtgaggaagcctcttgcccatatgaagatgtcgggtaaaaagattaatttttagaagaaataattataaacctggaagatagaaatattttgactggtataaaaatatcaataaatgttatttttctacatttaagttgtatctgcttgtatggcataccatctcttgcaattctgcctgccatgttattgatatgaggaaattttgatgatatacatgggcactctttttatctggtcctttctttcctctagctgccaaaatgtatcacttataccctacttctgagccaccatatctgctgacattatccactgtgctcctattctctgtctattctctaggcacattgtctaataaaaggtggctactagctgcatatagctattaaaaattaaattcattagcctcaaattttaaattcaattccttagtcatactcatcccatttcaactgcttaacacatacatgtgactagtgattaccattttgaagagtggatatatggctatcatcagggtaacttttgggataacagaaacttctattgggtcataccactttgcactgagaaaccttcaaatcacagtctccctttcagcggacggaataataaagcaagagggagagcaaactcataccactttgcctaggagaaacaatctcaaaccacaattctcttatatatggatgtgactctcaaagtatatctctaatctagacctttctccttaatttcagaactgtatatccaactgacaatggcaaaattctgcctgaatcttttataacatctcaaacatattctatctaaatctaaatacatttctttctacccaggaaacctaattttcctttaccatattctatgttggtgctgagtcattcatgaaaaaaacccaggtgttttatctgacctcctatacttctttattccttacatccaaatacctactaagtgccatctgctctactatgtaaatatatcccaaatccattgagaatttttagccccactgtctctattcatcatcatctactatttccatccacagcatagttcttcccatgtctaaattctgctcattctcaggttcattttaagtataatcttatgaatggcacctgctcttagcattaagtattatagtatctctcaaatgatggacactcaataagttgttttatgaacacatcatgttaatacagtgtttacaagttttcaattgttccttgaagcttttctttgtttatatcctaagtgcataggttggcatgcagtaaataaatgatcgaatgaattaagtgattaaatgaatgaatgaattaattaattaatatgtaaaatcaagcaaagagtaggtacaatgaaacatgtccagcttgcatttaaatgtgattttggttttgttaacaactgaaaagctccaaaaatatatttatgcaggcttataggaacattcaaatctgcttaatgagttaatcattacttttgtagtgttaaaagaggagggaacatctaagaaaatgtgtccagttatttcacatttccttcaggttctggagtagacagcaaaccaaccgtcaaaactactactctaaagaacaggacaaaatggcttctagcctctgtgatatgctctattcactccaaagacatagttaagtaaaaagagatatgtcctcaaaacctgtagggacctgtcggctacataactttattcatagtcatccccactaaaaaatgctttttctcatataccaaacaagtgtgcaatacagtaataatttaattctgtctattaatactttcaatctgctattattgatacagttcccaccatcttcctatgtagattttggcaaaaaaagaaaaatttaaagtcatgtaaagatctgtttttcactgccctgtgaagtaactgcaagaaagatttaaggaatcttacaaaaaaatacaacacagccttttcattagtgcaaaatgatttcattttaactcctctaagggccttttactaataaattaatattagcttcaattaaaataaaatctttcagaagcaaatgtttaatttctgaagtacagatggaaactactactttctcactctaacaacataaatgaactattcaaagctgatatgtaattcatttctcatttcattagcttaaacatcagctgtgggtgtactttacttacactatggacatatggttgcttggatcaaactaggagtaaatttttttaatgctttcaagaaaatacaaaatgagtataaataagtaatcagtttatggtaatttaggaagaatagcaaattgacaagcctgtctttactccataatctacctaggttttcagaaaatgaggtttagacattaatatacaatcatgctatagaattattgatcaaagagagggataccttaaacacatccattctaatcaatggaaatgccaggtaggataagctgttctgaactttggagtgtagatttatcaaacaaaggcggccttttggtcaacaccccggcgacttcaaagtatcttgtctattttacacagccaaattcagaaccagttctgaactcttttgcagcctatactttctctgcctactttattcagaatagacagaataatagctaccattctcactcatcttggcactgtgctaagcattttagatgcatgtctcataatcctcacggaagccctgtaaggcaggaactattactatcctgatttacctatgaggaaactgaggtcacatagttaataagagattggctggtaattgagaatatagagccagctctctgaaccctaaatctgcactgctttcttttgataagtaaagtccatggggtttctgaattgctgctctcctgggggaattcatgataattttctgacaatgcagttaacagacctacacagccaagttctcctaggccttgagcttctgtctggtagtagcccaaaaatatttcatcccttcttaatccttgataaatttattatgtgcatttgaaagtaggtgaggatacattattatggaattaaataggtcagaaaagaattcagactcattacaataatgatctaaaaatgatatcaccaaattgttttctaccattaataaagcccagattaaaatatttctaattataccattacctttgaaaattactggtggtaaagaaatttgcctttgaaagctcacataatgctaagtcatcatttctttaggttatgttaagtaactgggagagaattaataatactagaaagtggcattaagcatataaatgacttctacaaataccactttatactcttctttttttcatttattcaataaatgctaattattgtggttcatatatatttaatatttagggagccaatattatgtatcaagaatatgtttggtacctcatagatcatatatcatacaaatcaatgactagtaaggatttcaccatttttcaaatgatatgtcccaaagtactgacctactctgatcctttatcacacatcacatggttaacaagagcagcacttttgacctctgtgttatactctactctatctttcaagaatatctggaatatcttcaaaaagtaaaaaataaaatactagagagaaaggacttagatatagcttcatgaagctgatacattatgttttccccctctggcagagtaggttttctacatatgaaacgctaatcatttaattagcctgagtgtccacctttgagtctctccagtgacttagaaactcatcttctttccctgtagcttaatttaaaaaatcttcatatgtctacataatgggttaatattaataaataatatttctgatttaattatattaaaagtgtatccaatgaatttttaatatgatgaagattaagctctttcatgcttttcctcacatcattttctaatttgtttacatcacagtaatcatttacacaaatgtgactacttaaatattcaaagttggacctgaaccaagtaatgttctatgatgacctttgttcttttatgtactactttataaattttatttattttaaattgttaataaattttatttttttaaattgcttggttttctttgcatttctcagtaagaattctcaaatgtttaaattatcaatactatttttatttatgttatgttaattaactgggagagaattaatagtagaaagtggcattaagcatatgaataagaagttcgtgcaactgttttggttcatgcaaatagaatcatactgcatatactttttgtatcaactttcactaaacattaaatttttttctatgtaagttgtatatggaattattcattctcattgctgtatagcatgtcattatactaaaatgtatttatccagtctatggttgatgggcatttgcataatgtttagtttgggactataatatatatggtgctatgaatatcctagtagatgttttttggtgaatatatgtgtacatttttagggaatatacatatcagtagacttgctgggccatagtatatccatatatttcacattagtaaacatcaacaatatcctaagtggttggaaaaatttttacccctatcaacaatgcctaaatattctagttgctctgtatcttccctaatatttggcacataccatcttttactttttagctttctgcagagtatattctcttgttcccttttaatatctcttccagggatctggtttctgctagttaagactagggattactttgattttttaaaaaatctactcctgcatcttgagtttagactgttaaatcttcctcttttagaatcactcaccatcctattgctcaagatcaaatcttaatttcttcactttctaccattcagaaaaacagttacaacagggaaaaagttaaagaaaaatagaaaggtaaaagggctccaaggtctgtagtgttagcaaaatgctgctcagtactcagagggtatcctgaactagaggaacagggaaagaagtctagagtaaaaaggtgcagaggtttaaaaggtacagaggtttatagggtgggatcacatctagtaggagaaatgtatcttcctttgaccagtggtgttgaatgaaggtggtccttcacatattgctggggattccttggctgaaaataaatagaattgatcttacctctacaaacttcaactctctttgcacagttgtctataattatgtgtcagagtagaaccatttttccaaccttgtctatctggtatctttctgcccattcttcagattcagattattgtttatttatttacttttataaatttattttttattgatacataatagatgtacatatttgagggtacatatgataacttaataccttcatgtaatttgaaatcagattcagtttaaacataagcttctctgcgaaacttccctcaatcagcacccccacacttgcctccaagtatattaggaaatcctgtctcttggacacgctaatgcctgaaatatacgtttattaaagcacctgtgtcttagccaggcatggtggcatgtgcctgtagtttctactacttggaaggctgaagcaagaggatcacttgagccaaggagttcaaggcttcattgagctatgatcacaccactgcagttcagcctgggtaacagaatgagagccccttgcctctgccctacctttttgtaaagctcctatgtctcttactttactgtatgtgttttcttgtactcagccacttctaaaatcctgacagaaagctctcaaagtataaactctgtcaggtcactttgtttcctcaggaaagtagtaggtagtagagtaagaattcaaaattaggcactcagactcagagcctgtgcccatagccactatgttctattgcttggatgtaagaataaccaccctgagacatacccacaaaacattgcaggacacttaggataaagagaagagctacatctttaagagagaaaagattatcagcaaaatattaaaatcagattggcattagacttttcatgagaaaggctagataccaaaggaaaaaacataaaataatgccttaattctaagaaaaatttattttaaacttgaaattcaatatccaaccaatccatcagttaagtgaatgatggcattatttcagacattcaagtacacagaatatttaatttctattaactgtcaggaagacacttggcacacatactcttaaaacaagaggtgaatccaaaagatcaaaacgtggggctgaggaaatagtggagttggaaaagcagtataaggaatacccagagagtattgagacaatatgtaaacatgtgatatatttgagagccagggttctcactatgtaaacagggaggtactgctaaggaatgacaaactgctgtggtaagacaaagatgaaccccatgggactggactgaactgaagatgttggcttgaactcataattttatatgcagatataaacataaattgtatatacagatatatatgtgtattatttttgtgcaagaatgaaggagaaataagaaaacacatcttaatttgcctatcttcacacacatttttaaaaaagattcacattaaggataaaggaataagaagacttgttatatacaaggaatcttaagagtaaggtagaagggatatgagaagatagatttgtctcagagtagtttttgtacatttttgacttctgtaaactttttaagattctacaataaaaaaaataaaattcaatcaacaagggtagggagttggggagaggaaacctaacaccaaatgcaaatagcaataaattaatgaatgaatatgtttaaaatttttaacgtgtgcaccactgagttgctcatacttcactattttctaaagttgtgttgtttaatacagtggccaccagatatacgctgctatttaaccttatattaaaatactataaatgaatacaattaaacatttatttccttagtcactctagcccaccacatatggctaccatattagatagtgtagatatagctcagttctatcatcacaaaaagttctattggacagcactatttcaaatatttgcaaatcaattatttgtgaagcacctgtcctctgcagggcactggtttaatgttggatgagtgatatcggtatcatctttgattctgtgtatatctcactactatgagttaaaaaaccctaaagaaaccctctctggcacctcaaaatgccctgggctattgcaaaattgtattttagctcctatctaatgatacaattcttagctttattggtcaacatgtatcttccttggtataaatatagatgactacttaacaacaaaaaacatagttttccttgtagtttgagaaattatagattatctctttgccatattaattgtgttaatcccttgaagtttatgggattctacagctgatgaaattgtactaattgcaatatatgttaacagtgtctggaatttcagttccaatttgttactttcattctaacaaaactgttaattaattttaaggagttgtaatactacagtaaaagattatggattcaatctcattgatagttgtgattttattttccgcattagctgtatttcccatggaagcataagagcttcctatatgcaaggggtacaaggttaagatttttaaagaacaggccaggcgtggtggctcatgcctgtaatcccagcactttggaaacaaacaagaaagatttttaaagaataaatttatttttcctgtatttgatattcatttattttgaatcctcctactattacacccaatatattaacttcggggagcccaaattaatacggcttaaacatataagcatgtttaactcatgtaacatacttttctagaaatctgaatagaaattgattgtaaactttttggctgtgagagtttggtgaactgaattattacttttaataatatttgttgaatgaatgaagaaaactcctgttttaaatgcagtaggggagcttactatttaaggcaactgaagtaacttctatcataaatatttacctcctaatttctttttctttttaaagctgaatttccacatgttggtttacagacactattttaaacaagtctatacaagaaaatgaagttttataaccatgctaagcatgtttaaagtagttatagaaatccaaaaactttctgaatctatgtaaactatgattatgaaacatcagaaaacaaaataagctaaagttcccttctataaaatgaaaaagttggtttagttcttctcctctagcatagttactctctgattccataagtttcttcacaatcatacatgcattgtatttattttctctggctatatctggttacaagcagaaattcatttgaaaagaataaatggaagaatgagagggtgggtagatgactggatggctaggtgggtggataaaaggaaagaaggatagtagtaggagaagttgggtggatagatgcatagataatacgatgtgtgaataaagagaagtagagatttatttttataactctcctacatctcccccaaaagtgaattaaaagcagcttttaaaaaagagtcaagtgtgcaataagctttaaaacaaggccaacaggagccacataatcaaagttagggagcagaaatataattacattaaaaatcctagagttaaggtacagcaattaagtataaaattgattgtttgaggtccaggcaaaaatgaagcaatgggttatatggttcatattacctactaaaaggaacctaagcactttgaaattttcaaatgaaaatgataatttctattttcatcaggatatacttgaaaagacttttccttctcaatgctgtatactaagaggaataaatgtatcatgtatttatttatgttattggttattaaataataaaatgaacaatagtctttacaaatgatgttaagaaaatgcaaaagcattcttcataagactatttattttttacaatatcagattatcgtctgcagagagttaaagtactagagttttgatttgcacctacctgatatgacatacagaaataggtcttgatttgaattctagagagaaagtcaatgcataaatgaataaatgatctcaacatggcttttgacagaagtgagtcacaaattattcgaaattgatgtcaacagtgagttacttcttgtaggatggtcattcaggtttatcaggcaaaagaacttccaacacttgttttagaaacaaaaatgctaatgatgtaaattgatattctcttgtgaaaatgaaagtgacttgtatcagctgcattttattcctgagacagaaagcctcagatcaggattacaaaatatgataacctatatgacagtgtccatcataatatctgatcgtttggaaataagagaagacaaacatctgatcacttactaagtaccagttattttgctagtgatttacacgtgtgaaagcagtaatgtgtggtatgttgaggcttgacatcaaacttcctgattgggggtctcttccctgattgcattttctcattgcattttatatgcattgtgttttctctgaagttttacaaggctgtagtcctgtgcaaacagtaaattcattgctcggtaaactttattataacacagtagttttcaaactttaccatgcatcagaatcaccagaaaggcccattaaggccccacccatggagttcctggttcaataggtctaaagtgctgcagaagaatctaaattttaacaagttttcaactgatgtggatactgctagtccagggatcatctttgagaatcacttttagcagatacaattggttggctccccgaatactcactaccaacattgttgctaaaagaaccatgaatttgttcaaacgtccagttacatctgagaagagggaaggtgatgcagttctcggtcagttagagtaggttagtattctctgtgctcttcccatattgtattaaagaaggaattttattgtaatagttgttattgtttgtcaccctatttgatgttccacaaagggaagatacttagaagatatgtgtgcataaattatatatatgtgtatttatatattaatatatatctgtctgtatatatgtatgtgtatgtgtgtgtatttggcatatatatacacaccaaattatatgtgtgaacacataaattatatatatgtgtatgcatatatatgtgtgtctatatatgtgtgtgtttctgtgtgtataccaaacacttttgtgtacatatatgtatatatgtattataatatatctcatattgtatatcaatatattataatatacctcaatatatcatttgatgtggaacacatacagatatatatacacatacacacatgtatacacacaccaaatttggtatataaaacatgcatatacagatacacacacacacacacacatatatatatacatacacatatatatcatttatgtgtaaacacatatgtttcgtatcatcagtttctcccaccaaatttactcttctctctcctcatgtatctcccactctccatgttcaatcaatcaatcactatgtcctgctgattcggcctctcaaatatgtttctggcacatagtagatgctcagtaattatgcactgagtgaatatgcctacctagcacaagttctatcaattcaatgatctaacttctatgcatcataactcacccagttttacaagtaaaacatataatgattgtcttttaattaatgcacctactaactttatcattaaggtcaaaggagttatcattaagttatcattgaatcagttgctgtgaatttcgtgtaggtctctctcaatggaaaagtttgcttctcaaaccttttctgttcctattcactaaagttctgccactgcaattcttggctgtgcctcaatagtgcacacacagtacatttagtatattactgatggacaaagctctgaagttaagaggattaataaggataaaacccaaaatacctaaagctaatatcaattcactgagtcagcaagaatgctctgaaaaccttttattttgaggcatgaaaacctctcacatatcattttattatttctacctctggaattctccaaatcatcatgaggctgcctgcaaatgtagagagaaagtatatataagcaattttgttatttttaattctaataatcttaaatctacctacttctttctcctcaaaagacctcattaccttgcctattatcctcaagatgcctagagatgcctagagagacagatatgagctaagatctcattttttcaggctacctccttctatccttctatgcattgtgtttttcttttactgcaggaagaaatcatttcaatagatatttacttattgatatgtataagttttgatgatcacaaaactaaggttcagtcagattaagtattaatgtctaaaactgcatagctagcaaaaaatgaatcacaaaatacttctaaaaatgaagaattgtcctataaagcttttaaaaggttaacaatctctttgaggtaaaacaagaacataacaaactactggtggctgaaaatgtagattttaattatgtatttataatatgatttcaatatattacctgttatatatttgcctgtgtttcctactaactgtagaatacaaggcagaataacaaaactgccaaaagagaatcatataaagcttcagagacattaaaatgagaaaaagtagagttgagattgtaatatctatcaatgtagtaaaacagggaaaaaaaagctaaaagttagattacaacaagttgtaatttaaactttaagccaaagaatctattcttaatttgatagatatttaatggcctttagaaaattccagtagtattctaacatgactagtagtgagaaagtaaatctgctacttgatctgccttaaaatttcctgtacaatgtaattcattactttttctgtgaattaatcagcattattttttcttttttctttcttttttttttttttctgagatgaactcttattctgtcgcccaggctggagtgcagtggtgcgatctcggctcactgcaacctccgcctccagggttcaaacaattctcctgcgtcagcctcccgagtagctgggattacaggcgcctgccaccacgcccggctaattttttgtgtttttagtagagacggggtttcaacatattggccaggctggtcttgaactcctgacctcgtgatctgcccacctctgcctcccaaagtgttgaaattacaggcgttagccaccgtgcccggtcatcagcattcttgacaagaaaaaaatcaagcacctttctaatagactttcatgagattatgacctcttctaggagattagactggcctcaagtaaccatcatgctaatagcccaatgattgttaacgagaatctttggaatagttgcatataatctaatagtgattgtctaatcatcatgttttaaatgaatcatctctatcaagaggacatatttaaatttactttttctaaagcctatttccttgcagcatgttggaaatagagttttatcatccggtcataattaatttgtctgagaagttgttttaacagtggttttcaactctgttccaatgagagtgtctcaggaagcactgtgggtagagagagaagaaggagggggtgaggagaagccctactgaaaatagtgtgagttcccacactcaatcgctgttacaaagacagcagcactttttcatctgttctatatatttaagttcagtttcactggaataaaaggttgtgtaatactaaaaagactggaaatcattgctctacattatgaatatagaagtcttgtataaaatagaaaagctgaaacaggaagacaagttaggaggttttagagtaggctagaagaaaagagttcataaagatctgaatgaggatgttggcagtggaaatgaacaggttgggacatttggtactgagatagaaacttcacgattttattgctgattagatgcagggaggtaatgcaaaggaagaattccaagatgactaaggtattgactaatcctgatgtctagaagaaagtgggcaaactattatcagtaataaaagagccaaaaggaaaggaagtctcgatgggttaataagagtctattcacgttgagtttcaggtaagtttcaagtccagatacctattagacagtcaggacagagagagagagagagagagagagagagggatttggtaaacatttgcattgggatgacagttgaagccatggcaataggccaaatcatgcttgatattaggctaatttccctatagtttgaaagaggaacttggtagtcataattaaatgtgtctctgttgatagcttcacagacttttaagacaagaggggattcatccttttggtgacacctgtcatgttacaggaatacctgtattgtatgtgaaaggactgtggaactcaaaattactgttcaaatgtaagatggaaatatttattgacattattattacattgtaatagagacttaacctaagacttgtcttttttttagaatttgttaatgaaactgcatttatctaatgcactataagagcaatatcttactgaaacattctaagcgtaggttaagaaatgcataatcgttggcttggtaatctctttctgggcaataacagcagaaccaacctccagcaaagaaagcttagtagcagagatcctatctacattcagaatgggactcagtgtatttccctgataagaaaatggagaaagtggcaccagaattgaaagtttgtaattgtaggacatggtaggtgattgcacatgtagggggctgggacagagggaataccttcagagattacttgcaataaggtagtgtcagtttataaagccaagacaaaacagaaatcaggacaccataccaggaagaaggaatcaaaaccagactcagctgaccctaaggctacaaggccacaaatgtcgaactttttcctcagtgactgctgctgtcaactacaaaataggctccctcctggtaaagatagcaggtcacatatcttagttaccgctcaggaaataacctgtcagcacatcatctctgaacacaaaggacaagataattgtcccacgttctgtcaggcagaagtcccagtcatctgcagaagtggtaatatggaacatggtgtatttgtattaacattaactcttttgtctctggcttcagtaggaaaaattttggagatggcaataacactttttagtattggatgatttccttagtctttcttaatgcaggggatgcatacctaacttttgtagttaataattaaggtatatctatgttgaatgattaagcaaaatcaaaaccaagactgatttttatttttttacactttctatttttacttcaaccagaatggaagaagtacacataattctggataaattccaaatccactgagagtatatttggtttatgtggtagggaaattagcctattattaaaacagatttttaaagatttataggaagaggcaagtagatgaaattgccctgtcagaatatttcatgactttgatgggataaaagtaaaactatatgatttctattgtactttctcagctgttactcaaattgattataactataaaggaatttcattttctgattcatcaccatattaaaatgactatgaagtcttctaaacaaaagcacgaaattctgtctcctcttctagtattcaattcacatagcaagatctctttaaaatggtcatcatattttgtatttatccctaagtgtgttttaaaaatagccaaggttagaataacaaaataaactcacacacacatgtgtgtgcatgcgtgtgtgtatatatatacacacacacacagatctatatatctatatatctatatctatacacacacacacacgcatgcacaaaaatcatgcctgttgattgattctggaaactagaagaaattgtatactgtttataatccaagggaggattatctgtatggatttcaagaagattttacttcactaaatgttgtgacattttacaaaatgttggttgtgtcatgctttaccccctggctttaacacatccacaaggctttgaaagcttgattagcaaacataaataataaaaagaaaagtagaactacttagggggcaatattaaaagatggatgtgctaaatacaaagcagataaataatcagacatgttatttttgccccactgaaaatccatgccaaaaatagtaacgactgtttttctttttcttgtccactttcttttgaacattgatacttcacattttgttaattctgaacaagactatgaaaatgttacatcattttactgaattgaaaacattaatgaaatataatgtgtgagcagatagattctatgagtttatgtgtgaacttacactagaaagagaagaatggcagtagatgtggggggttggaaggaatccagtcctatacacacataagagataaaaataaatttatttattttaaattcatccttgaaataggttaatcattgaaaaagacggatctacagattccacataaccaccccctggttccatccttgcaagccgggcataaatgctgagacagaataataaataaaataacaatttaaaataatttctgggaaaattatgggactatatacatggaaagaaacttcctgaaaactggtttaagaatacatttaatcatatattttcaaaaagtaattatatatattaaaaggtaaattttacatctgtaccaaaagtaccctgtcttttgccctctcttctgagagaaacattgcatttttctgcaatatctcttcctcgtgtcctctatcctacatttatagagtctcaaatatgctcagcctcaaaattaagatgctttgagcttccagaaaacactacacagataaaggtggctttcaaaagagatgtttcttattgtctacgtaatcatgcagagttaagcagtcactgcaacctttcatcattttctacaataaggccaactttccagataaccacttagtgaaacaagaatcctgtatttctatggtggagctactgcgggtctcatccaacctcctgccatgtttgggccactgactgtttgggcacttacgtccagcttgcgaggatggagccatggggtaagttaagtagaatttgaaagcagatgagtataataggagtacttactctggctttcagaatttaggcagagagaaacagggactgccataactcagtgaattttccctataactagactccataatttgtaataaactgcatatttaattaaccagttaggaggctatttttcctgtctggttcattgtttgtgtatgtgcaaccacagcagaaatcatgaaagcagcagcagcactgggagaacccagcctctaaaatgtgttagagtatttatctctgcaagatagaggtagttgataaaatagcaaggttaaagggcagacacttgcagatcaagcctttaaacaaactttcattttgaacacataccataacttagatgggttcattaaggagacacaaggcatttggaagtaataaagttagtaatggtttcaaaccaacactgtagggaaactaaacttattagaagaaaataatgaaataatcataaaatagctgacccattacttagcaatgtacccaatacattgtaatgtgcattatatatatatgtaatatataccatatacacacatacatatatatacacacataaaaaatacattgctaaagatgagataagagagttacagtggttatatcttacatttctcttccccagtatccatcaccctttcttccagccctgaattttctctcaggaaatcaccatttccctttcgtggatattttattgggagacggtacctgcctttcactctttaagccaaagagatcatgtcttctccttccccatagtatctatagacagagagttggcaagtgatctagtcagccaaaaagattgtctttcctcggattttgaatcttgagctagtgaagcaacaaggtaaagaagaatacaggatcttccattattctctagtgttacatattgttcagagaaacatttacaacatatgaaacctacgaaaggaaaataaatcttggagcccccaaatcactaatctaaagggaaaagtcaagttgggaactgcttagggccaacctgcctcccattctacttgaagtcatccctctgctcattgagataaatgcgtatctgattgcctcctttggagaggctaatcagaaactcaaaagaatgcaaccatctgtctcttatctgcctatgacctagaagccccctccctgctgcgagtcttctggcctttgcttcaagttgtcccgcctttctagacggaaccaatgttcatcttacacatgctgattgatgtctcgtatctcactaaaatatataaaaccaacctgtgttctcaccatcttagatgcatgtcattaggacctcctgaggctgtgtcacaggcgtgggtcctcgaccttggcaaaataaactttctaaattaactgagacctgtctcagattttctgagttcacaaacctaaaaatgctggattaaatatagttaaaaaattgtaccatgggggtagaagaataatttttttaaatcctcagaaattacaaaaaatataatcccagaagagaaagtaagtgctagagtggtgtttgccctggagaactctgcctaaagtagcaggttaattccaatgaaccatgcataaaagagaggatgaaaagtctgcaccatgagtgggaaggaaaattgtatctgaactatttagccttcactgcataaagcttgaactttcaaagcatcacactcattggatgaagtaaatctatactatccattcagagagaaatagttgggatatgtaaactggaagacagatttgaagaaactacacagaatgaaacacaaagaataacaggaatggaaaacaaaaagagaaggtaataaagaagacggaataaaaatcagattgaatatatgcttactaaaaggcccacagtaatttccagacttaagaaatttgaacaactaagaatagaaaaataaaaataatatacatccagaaatagtaaaatacaatgaggaaattttttttctttttttgagatggagtctcgctctgttgcccaggctggagcacaatggcatgatctcggttcactgcaacctctgcctcccaggtataagcaattctcctgcctcagcctcccgagtagctgggactacaggtgcctgccaccatgcctggctaattttttatatttttagtagagacgggttttcaccatgttggccaggctggtcttgaactcctgacctcgtgattcacctgcctcagcctccctaagagatgggattacaggtgtgagccaccacacctggcctacaatgaggaaaaattttttaaaatcaccattagaatatcacagatataatttttactgatgaatgctaaaattactgggcaaagcattaggagaaatagtacacttgcaaggcatgaaaatacttgccaaaccatatttattaaatatcctggtgcttgtattgaaaattctttgatacttctggcaccaggaggattatttattttcttccacttgagtataaactggacctggtaactcaattctaaacaacagagcacggaaagggagtagtagctttatactgaagaaacatggcaagtactgtcttaaacaagtgattgaagttaatatcactagttatataagtcatgttgatatggattcctgatactagatgatgagaaagatacttcatctgtgtggtattcttccctaaaatctgtaattccagtgaaatcatgaacactttagatacatacaaattgaaggtaattctacaaaatgcttgcccagtgctctttaaaagtatcaaggtaaggtatatatgagaaaaaaaaaattaaagtctataacctaagcttctactttaagaaactagaaaaagagcaaataaaattcaaactaagcagaagaaaataaattatacaaattagagcaaaaatcaatgaatttggaagcagaaaatcagtaaagaaagtcaacaaaatcaaaagctagttatctgaaaagatcaataaaatttacaagcccgtagccaggttaactaaaaaaaaagagagaagatacaaattactaatatcagtaatgaaaagggactatgacaactgatatcatgaacattaaaaagataataacaaaataccatgaacaaccctatactcacaaatatgatagcctaagtaaaataaataattccttgaaagatacaatatactgaaactcatatacacagacatagataacatgaataggcttatagctattgaggagattggatcaataattaataaacttccaaaacagaaagaaccaggaccagatagactcactggttaattctaccaaacactgaaggaggaaattataccaattctttccatctcttccagaaggtggaagcagagtgaatactttccaactcattctatgaggccataattcccctattaccaaaaccaaagacattgaaagaaaggaaaattacagatcaatatttcttacgaacataaatgccaagatttttaagaaaatgttaacaaaactaattgaattatgtataaaaggaattatatactaattcttttagtatataaataattttattataaatagtcataaataaatctacaaagaatcaagtagatttatcccaggtatgtaaacctgattcagccttcaaaaatcaattactataatccatcatatcattaggctaaagaagaaaaatcacataataatattaaaaggaaaagcatttgacaaaatcctacacccactcatagtaagaactctcagcaaagtaggaatagaagggacctttctcaacttaataaaaaacatccacaaaatgcctacagttaacatcatacttaatggagacaaactagatctcttcccactaagatcaggaagaaggcaagatgtccactctcaccactagtgaatgtaataaacaataaaaggaaataaaaaccattcagacttggaaggaagattaaaaatctctttgtagatgacacgattgtctatatagaaaatagcaaagaatcaatttaaaaagtcctggaactaattaatgacagcaagcttgtaggatacaactcaagtcttttgatttcttatacaccagcaatgaaaaactaaaatttgaaattaaaaacacaatgccattaacatgagcaccaaaaaagagatacttagtataaatctaaaaataatatctacgagatccatgtgaagaaaattacagaactctgatgaaagaattcaaagaagatctacataaatggagagtgagttccggtgcctagataggactcagtatggtctagatgtcagtctttccctacttgatgtacaatcaagttaatatttaatacaatccctatcaaaattccagccaggcattttgggtatttactaattgaccctaaacttaacagggaaaagcaaaagacccagaatacttgatacaatattgaaagacaaaattagaggactgacactacctgacttcaagacctactataaagctacagtaatcatgacagcattgtgtttgtaaaagaatatacataaagtaaaagaaactgtgaaaagttgtcacatttcgaaagacactatgaagacgtgataactaaatgcaatgtgatattctggaacagaaaacagacattagtagtgaaatttgaacaaagtctacagttgccttgcaccaatgctaattaattagttttgacaaatataccatgataatgtaagatgttaactttaagggaaactggtagaaaggtatgtgggcactttactatctgtactatcattgaatctcttctgtaaacacaaaattattttaaaataaatagtttaaaaaaagattctaagccaaatatctctcatgtaaaaacatacaaaagtcctaataaaattttagcaaggcaaaattcatcattacaaaagaaagatactattccatgcccaaattagatccatttcaggaatacaagtttattttaacattaagtaatctattaattttctaattcatcttatttacagattaaaagggaaattagatataagcttctcaacagatagaaatcaagtaggaatttgtgacataatttcttactcaaactaggaataaaagggaacacctttaatttgacatagcacattcacaaaaatttaccgcaaacgtgatattcaaatgtaaaatgttacaagccttattttaaaataggataatagcaacaaggataaacactaacaacacttctctttagcgttgccttggttattgtaaccagcacattaattaaaagcataaagatgaaaaaagaaataaaaaaatgtacaaactacaacaaacccagagcaaaggttaagaataaacagtgtattctggaagaaaaaaaagaaacaatagttatgaaaattttctttaccagttatcatggcattttaaatttagaataattaagatgcacagtaaaataatagagacagacatatagtctattggaacaaaagacaaatttttacacagacaatgcatttatacttgattatgtatctggctctgcacatcattatgggtaaaaaaacttttttatttaaacaattattattaaaaagtttttatataattggttaggcatatgaagtgaataaaaataaaagtcttatctcaatatacaaaaaaatacaaatggttaagatcttaaatgagaaaggcaaatttatttatttatttagagacggagtctcactctgtcacccaggctgtagtgtagtggcgcgatctcagctcactgcaacctcctgtccccgggttcaagcgatttgccaccacgcctggctaattttttgtatttttagtagagacagggtttcaccgtgttagccaggatggtcttgatctcctgacctcgtgatccgcccacctcggcctcccaaagtgctgggatatatagatgtgagccactgtgcccggtaaaacttgaaaactttaaagggcaatttttaagtcctcagtagagcaaaggatataaaaccacaaaccttgaaattttctttaacaataacatcataaagagaatgaaaaggaaatgtaaactaagaaaagatgaaatatatacaacccatagtatccagaaaaataaaaacaaccccaaagaaaaatggatcaatgttgtaccagtatttcaaagaagtgaaataaagagataggacaaacatattggggggaagaagctcaatctcatagggaatcaaggaatgcaaattgaaaacatgatatcatttagatatatctcatttacacattggccaacaattcaaaaaatctaagtctatagaaggttgttaaacatctgaactcctccttcactcctcgctgaagtagaaaatcagaaaaccttttggaaaacaatttggtatgacctcgtaaatctgaacagccacagaacctatggccctgtccttcagtcccaagcatgtatcctagaaagcttttgcaacagatgcaccagaattaaattgttcatagtagctttgtacataacagaagaaagagaaaaagaggaaagagaaaaagaggatgagaatgaacaaagatttgcactaataatccatacgctcatcagtagtacaataaatatatttcgatacatttatataatggggtaaagcatctgtatcttgaaaacaaaatgtggagaaagcaagttgaagaggattaaaaaaataaaatttgatcctacaatacaacaatataatactcaagagtatccgcccacaccactcacatataaaccatacacacacacctaagtattatgttgtattgactgtgtaacaaaagtataggaacaggtataaaaatgagcaatacaaatttcagaacagtgattaagtaagagtggggagacaggaccatgaggtaaggttaagtacatagatatttacttgatttattattagtagtaatattttaagtacatatatgttatatttactcttgtgtttgatatatatttcctagttttcaaaggttcaaaacaaaaaatttcagtcatatgaacttttgtggttctggctcctctcccttctgcctctccctggtggcacacgcaacttctcatgcctgcctttcacatgcaggctcatcctcagcccctctctaacccccactatataaaagccctgatttcggctagccaagttaatttctcttgcttccacccaagaatctcttctgaaatgcaacataaacataatctttccaacttagaatgacaaaaactatctccctaggtatttaagttattagttgtattacttttgtttcattaattgtagttttattgattttagatcatatgcacacacatatcatgtttgagcttcttttgctgatttctataaaagaatttgtacaaaacagtgttgataataatgtatccaacacatagggacacatgaaaaactgaaaagaataaggaaaaaaaggtgaagcagtcaaccctattttctcaagtggactctgcatttggctcattattcaatctttaatcctgtgttaccttccttccaccatcctgattcaaaatccccttaagcaaaatataattagcacaaggagtcaactgaaagtaaacatatatgattttaaattctgatggtaccttatacttttctaggtgctttcatggtgaagtcttcctgttcatgaagtagacagtttaggtgttgcctgttttacaaataaggaagtcaaggtccaggcaggttaaaagattcatctgaggttatagagcaattatcaatgacaactctgatactgatgctacagattcagagaggattgtcttattcttaaaaagggaaaatgtatataaagcccttgttacaatggtggacacatagttaagtacttaataaaggcaaattctctctctcttatcccttgcactttgcctcacttatcaattccatgcagctgattattctggtctataaatctaaagtctcagcaagaatgttgagtgaacagtatccaaagtcacatagcggcttttcctatcctgacccaactaaatgtattttgcaaatatgtcacttattaattattactacacaaagattatcacataatcccacattccaagcaaataataaaaaactgtcacatacctaaagggttagaaaaaaatccagattttaagcaatacatagacgcagtgtccagatacttaactaaattttttgaaggttccatgtggaagcacagatagtggacagaccacaaaactggccatcagccacctggattttgtgttctgtagtttgactttcagcaaatcacataacttccctgagtctcagcctcctcatctaaagacagacagtttaactaggtattcaataaggtccttccctgttctgagtcttcttttatttttttaactgccacaaatttatagtatcttagtgttactgccaatatagaaagccaaatgacagcttcaacgctggtgtttctcaataatgcactttatgctatagcacagaagggcttagtgaatcgatgatggtgccaaaattagaatttatggctgtgcctaatctattgttttgctagtaagccatactgcctgatactgcctccacttaacaataaaacaagatttaaagggcaaaactgtatgatttcatactggcatatgcaagggtaaaattgaaagacggtactataaaatcatctcaccataacgaccatcgagtacttacgctctgcaaaaaatgtgtacttgtctgcccttgccagacagatagcaatatttggttcaaaggattatagtggagttaagaaaaaaagaattaaagactggttttcgtatgtctgaaagctttgcatacaaaagtacatcatggaacgacactcactagaaaaagaacaattatacttctaaaagtaagagatttaataagcaatgagcttaaaactaggctgaaagaaaagttaattgaagtctaatttatctctttctggaccctaaattactaacaacaaaaaaattagctaacagttactgaacctgcgtgtcaggcacaacggcaagcattttttatgtgttaattcacttaatcctcacaagagccctctgaattagatactgttaatattcccagtttatagatgaagacacagagatttgaagttatataactagtacagagcagaacaggaagcaagaatagtttctgttaaacatgtgaccttcttcctgtatgtaaaatggccatgttagtaatttttacatgtgattttcatatattcataaaggagtgcatgttgaagtctgcactctttaatgatgtaaaataaaaattattaagaactaaaaataagttttatcattatagtatctggaaaatgttacatatcatttgcatgtgtgacattaactattttaaataaaggtatattgaaacttaaaaaattagacttgttccacaaacatgaacaagtcagtttttagtcatgattctaaagatgcttttatgtgatattgtaaattgatattagaatatgtaagtggctccagtcatctttaacacttctaattattcagagagatgacataatatcttctgacaaattctgatttgctattttcccactagctgtttttttaaattgacaaactccaaattttaatttgatttaggatgagaataaataaaaatggttgattctcatttgcaaactgtgacactcattatgaatttcataaaaatcaaaagtattgcattttattgatctaaagacttaagtttcatttttagtttatttcctgataattcattttttgacattatctaaaacatatcctttgcaaatacacaaatggagaacattagtttcttaaataaggtttactaactgagactgaacttgcttgtcaaatgtgccaagaaatgcaggctgctgctcagctccattaagcagccactctgctggtttaaatattttccagagtgggcagtagttcctgaggcatacctggaagagaggttgacagggttgccatactgccaccctaatttgcaagaccaaagtctcatttgagcagggttttcactgaagcatcatgtctaaaacacatctttgtttatactgtaggtggcaggatttttatgctttaaacattttgctataaccctgcattttttgcaaatgaaaatttaagatgccatcagataacattttatgaaaatatttatatggttccagaaaaaatagccaggccttgaaggtgggtgcctttcattcttggtattgttcataaattaatatacattgtttgatataatcatatttcacattaggtttaactttttctctttgttctgcaaattcgatatttttctaaattttgagattcaataaattaaaagcactaaatattgaaacttaaaaacagaattcactcctgtttaagatttgaaaatgggtatatctgcattgaatccaatatgccaaatgactttatttcagacttttgagtaaggaatataaatttctgaaagagggcatcatttttagccattaatatctgaaaaagatagcaatttataaacaaaaacaaaaacttatcaattctttgcaagcttatgaaattctgaatcaatctttttattttggcttccagtagtacaaaatgtttccattcacatttgatatacttacatatatttaaaatcatcactattttttcataatatatgaaaacatttttatcatgtctttttaaaagcaaattatgtcagtgaagacaattttcttggctaacccttgtacaggctaatttgcttatattataaacatctataaaaattcatgttttattatatatttcaaagctctaaaatgaaattaatcagggtgacttgaagttcatcaggacaccttggcttcttcttaaattgaagttgacatatgctcttccttaatatctgtttcttactctacttaagggaaatggcaaattatctaaaagttaactcaaattgcttaatatgctatttcagcctttgcatttcttctacttggcccatactctcaactaattcaaaaagagttctctatacaaattcctacatttaccaacagtaaaatggctatcactcacgtctacttaagatgaacaactaatgatctattttgtacaaatgtgtttatgcaggcattttagaggaaattttatctccttaggtaaagtttatgaacctttctcagtaaaaacatgagacctagaactatatatactctgctcttatttgaaatgcttcatgagttttttcaccaaaagtttacctcagtgtttgaaatcattatgtgccatcataacagttacacacacagacatacacacaaatagacgcttctaataacaccttttttttcgtctctggagctcaaaattctgtcattaaggctagattccgggccgggtgcagtggctcacgcctgtaatctcagcactttgggaggccaaggcgggcagatcacgaggtcaggagatcgagaccatcctggctaacactgtgaaaccccatctaccaaaaatacaaaataatagccgggcatggtggcgggcacctgtagtcccagctgggaggctgaggcaggggaatggtgtgaacccgggaggcggagcttgcagtgagctgagatcgcgccactgcactccagcctaggcggcagagcgagactccgtctcaaaaaaaaaaaaaaaaaaaaaaaaaaagggttagattccaaccttatatagatagggaaatagggaaatgagggacaaaaaataatatccttggccaagtgcagtggctcacgcctgtaatcccaacactttgggaggccaaggtgggcggatcaggaagtcaggagttcgagaccagcctagccaacatggtgaaaccccgtctctaccaaagatacaaaaaataaataaataaataaataaataaataaataaataaataaataaataaaataaaaataaaaataaattagctaggcgtggtggtgagagcctgtaatcccagctacttgggaggctgaggcaggagaatcacttgaacctgggaggttgcagtgagctgagattgcaccactgcactccagcctgggcgacagggtgagactccatctcaaaaaaaaagaaaaaaaaaggcaaaaaataatattctcaatggccttttttagaataatttttacatttttttcttgcaaacatcagatattaagcctttggtgctatctttcatgactttaccactttctactctgcaacatatttacatagtaaactgtgattttgacatagagatattcgtcacctttaacagaaaagaagaaatctgaagcccacagaggttgatttatccgatatcatatggacaaagcctagctctcctaattctaaatttagttcagtaccccacgatccatttctgtaccctaaactatttctataaattgcctttatttgggcaataatagatgataatttgtctggaaaactgggtacattccatcaagtgtgtctttaaatttggcctatattccttggaaatccatgctatgctaaattcagtttctagaatgttttattctgtgttttcatcatgcctgaagagggtaacataaaaaagcaaatatttatttcccattattctaggccatattccagttgagcaataatatttgtttatacataactttttttttttttttttttaggcggagtctggctctgtctcccaggctggagtgcagtggtgcgaactcagctcactgcaagctccgcctcccaggttcatgccattctgcctcagcctcccaagtagctgggactacaggcacccacaacaacgcctggctaattttttgtatttttagtagagacggggtttcaccatgttagccagccaggatggtctcgatttcctgacctcatgatccacccgccttggcctcccaaagtgctgggattacaggtgtgagtatatataactcttacttttggaagttgaattaattcactttttcctagactgttgtcctaaatgcaataatgctccacattctatcaaagtgtaggtacagtgtatcccagaatcactagaaaaaggtaactatatgcccaccttatgtagaatacttgaggcatatatatccaaagaatatatgttctacagattgtggagagcacgtcactaattaggaaccaagtatccaaacacatagatagctaccttcaaaattatcttggttaaaagaatgacagaaatcagaaagtttgttgctcttatggtcattttaggttttcagtatttttttcctatggcaagttgcactagctaaaagtagcataaagagagttagagagaatcacacccaggtgtaaggcaaagctgaatagctgagcttctgaagtctttgtggctaaacttttcatttttaagacatagtagtcagtacaggaatcagaaggtggaaccatctgcagctatcagcttatacagagtacatgacagtgatccaaacagccacaagaataagcagtcctaacagtagcatggtgctttacttcacttagtacagtgacagggccttgacccgcaagctccagcagaaccccaccacgtgtgtgatgtgtattcaacctgcaatggtaacatacagcaatacattaggcacacagtaatgccagaagttttaatattagactcagaaagataccacaactaaaaatttctacatggggctcctatatgcatagaactcttgtatatggaaaaggaatatgggaaaataattttttttacgttgctccctgatagttactctcctggggaatttcagggtcctgatttttaacttctcctatctcctgacccttacgtagatgataagactttttaaaagccatgttctatcttctaaatgttgggttttggtagatgacttgctacttgaataatagaaggtaaagtatagctacatatagtttaatgttgtaattatgtaaaacttacaactaaacaaagctgctacgtatcactattaagggtgtgcctaagagcttttgtagttataataattagccacatataggctattttagtaattgttataattattttcatctaattaattgaaatagatttttctcattttttagtactctagtatctaaaaagtgtctgcttaatattcatgacacactctcctgactcacttgcttgtgtggctggtctccttacccacctcccagtgccattcagttaaaggcaaagtttccgaatcctaaaattttctacatctcactatgtagttaggccttgggtagctatcaagtacatgcctaacttgcctgcaacaatctttcttagaaatttttgagcagtgtttttagctgcttcatgattcctttcccaatctacaaatgtgtgtttttgtgtgtgtatgtgtgtgttgtgttgtgtgtgtgtataaatacattgagggggagtatatatgaaggctgtcaaaataatcagagggttataaaccttagaaactctgagtccatggattgcagattgttttttttttttagacagagtctcactctgtcaccaggttggagtacaatggcatgatatcaacttaccgcaatctccacctcctgggttcaagagattcccctgcctcagcctcccgagtagctgggactacaggcatgcatcatcaggcccggataattttctgtattttagtaaagacagggtttcaccatattggccaggatgatctcaatctcctgacctcgtgatacacccacctcggcctcccaaagtgctgggattacaggcgtgagctacaatgcccggtgggattgcagattctttaaaccaccaccaattgtcagacagaagaaagaaggggaaagaactaatgttacaggtgggaagaggtgaggagggagctcaaacacattgcctgctgaaattcttagacacaagccttgaccatgataaactttaaaatgaaatcacacaaatcataacttcaccattaccggacgaaggaaaaggaagagagtctagattgagaagagagagagtgtatcttcccccttccttatttaaaataataaaacctatcatttacggagcacttcctatgggctggacattcccgtaaaactctgcatggcatatagcctttagttctgacaaaaagtcctatgatgtgggtattattatctttgaagctcaaataagattaaaaccagtaccaagatagatagctagtaagtgatcagtctggatgattcttttgcctaagatttgcttctgtttcacagtgtttgggggaggattaaatgagagtttccaatgaacttaccaactcttcaccatggtttgtccactttgccaatatcatcttccttttattcaagtaggctgcaattgcattaactttgttttcagactctaaagctgggagataaaacactgtgttcccaaggcgtttgctgctgttgatcctctgcctagagttctcttctcccagcttgtacagtgtctggctccttctcctcttaactctcatcctaaatgtcatccactctgagaggccttctctgaccacgtagctatagttcctactactgtttgcatgagtagcaacttctttacttgattacttattatttgtctttctctcaagccttgggctgtgagggtaggtgtatatctccagcaattgccatgacaatgacataaagacactcaacacacaagtgaatgaatatatgcagtaaagcgtaagagcctgattcagagcctggtacacatttcactcattacatcttaaactcctccattctctaatagctacaagaaggcaaatgggtcagaaaaataatgaatactgaaatatttcccttgtctacaaggtgaatttggtaaaatgggaggccctcagatttctttgctctattttaattcctgaatttgagacatacaaactatctcatcctccctggcccagaaactttaggtctaacagacaattgaagcaaaaataaatatactcatacatacatacataggattaccagtgtatgcaggctgcttagccttcaccagtcataggaaacatctcagcaggggcccctgtttcatcatagctcacatgttcttccccgggagctgcacaggtaacatgaatgagtgaagctggcccagggacagcattgagcacaagactagatgtcctagataaagaaggcagctccaccccagctttagctaattcataagtgatgatgccatgatgaaataaggcccaaggttgccaaatgtatctttttttaaaaaggctagaaattagatttgtatataaaatctttctaattataggtagcaaaaattaatttaaaaattttaaaatatcatgtgtggaaaacatctgtgtgattatgctctcattgaccatcagttcctaattatcatgatccaatatcattcttttttccttttcttcttctcttccctcaaggggacattcttgaagtatggcagagaaaactctaagttcaaatatactttgacaagatctcaatttcctccaattagaatatagaatcttcaataagtttttcaacttctctgagcttcaatatcttataaaatttgagatattattggttgaataaaatagagtagaacttcttcacaggtactaacatttcaataataatttatataaaaacaattaatttagtgttcaaactgtcttttacaagattgaacacaatacttataaatttcaagccaatctttagcatcacttggataaaagtcagaagaataaaaaacagtaaaaatccagttttaaaaaaatcatatcataattaagcatctgcttttgcactcagttgtgtctgtcagtgcaaaaataagtcccctttaaaatagaaggaaagtgacagttcttagaaagaaacttacgatgtgtggtgggttactttttcactttttcatggacttaccctttcatctccaagaagatatggaaaaaactgaaggaggcaaaggttacatttttcaagggtaatagtacaccgtggttctttctttattaataaattttactgagatagcttattgctcctttttttttctctactagaagtaagtaattttcctccttaactacaaatgatttttaagtaaataccagttttactaaggtttccagattcccagttctaacgccacaatccctgatgacttaatgtatcttctatcctggccccacttcattattaataatgacagctgactgatattaggtcaaaatatggaccagagatgtaagacagattttgtatatcctgcctctagtatctacaacaaccatgaaagaaaggtcttatacccattttatgaacaatgaaagtctcaaaggagttgaatgacaagtattaaagggctctgtgtttgaaccaatccagaggcaaggggctctaaaaatctgacttctcttgtgtgtgtgtgtgtgtgtgtgtgtaaataagtgctatggtttgaacactgatcgtaacttggttttgtttatatacacttgctaattatttctggtatttcagatttataccacaaagactattttcaacttgcttatttctcaggccagatgttacagagaaggatgaggctgataaaaggcaatatgttaaaaatttcttattaaatgagattctgacctaaggagaaattattctgtaatatttcatcctcaaaacaaaggtaacaagtttattctcttaggaactggaaaagctgaagcccatatttcctacaacatgataaaactctaaaacatgaaggcaaataaacaatactatcttaagccagtctgaaaagattttaaagtcagtcacacctttattcccttcatcttaacatcataacttgtaggaaatcctcacttaacattattgataggttcttgaaaaccgcaactttaacacaaccaattttaacgaaggttaattgatataaacaagagttaagctcccatggcatgtttctggtcacaaaaatatcaacaaacttctaaataagacaaagagactttcaatattgagtattgaaataaatgtgagctatacttaccattaagaaagacaaacaaaaacaaataaaataatggtttacccaatttttggtgaatcagtgagtgacagtggtggtaaaggtagtgggttaaatctaagaataaatattcgcaaaagtgaaaattgtaaagagcagctcttctatcatgcagttctaaaacaatcatgaacagggtgggctccctgagcacttttgcactgcatcattttatgtagtgaatttgtgggattattgtctactttatgaacttttattttacagtaatatatattaattaactcattaattttttaattccagttctgggtcacaggtggctggagcctatccccgaaactcagtgcacaagaagggaaccagccctgaacaggacaccattccatcacacacagcaagtactaaacacacacccacactcactctgattgggacaatgtagacaagccagttaacctaatgtgcacatcttggggatttgggagcaaaccagagtaccaagaaaaaacccctatagacaccagagaatgtgcgaattccacacagacagtggcccaggtgggaattgattttctccccctatcattgtttataacaacaggagttgaacaaaatgatattattcaaggacctgctatatttaacttctaatacttatttaaaatttcaattatccagttgacagataattatgttttaaaacaagtaatataaatttaacttgttgtctagaccaaaacctatgaacttttctcaataactgattacggcagaataaaatttagacaaaacgtttacttaaaaagaattgaatagcagactaattagtgatcttaaaagcacccataagatagatgaaagttcataaaatgcacacatattcaaaaacaaattagttcagtttcgcattacattcaaaatataatttttttagacattcatgcttatatcaaatgtaagtgaaattttgttaacatagtctaatgatcagttagacaataagataaaatacaaattttaagtttggaaacttaatgcaagtttaatacattaaaatacagagaaaatggtgatgtttctaagaatacttcttcgttcagtatctgatggccagcacatgcctttgaataattttttttccacaaactaaatttatggttagtcaagttttgccatttctacataattcctcatttatttgggtttgtttatgatacagttttcgtagaaatacttataaaaagaaattttaagccgggcgtggtggctcacacctgtaatcccagcactttgggaggccgaggtgggtgaatcacaaggtcaggagttcaagaccagcctggccaacatagtgaaaccccgtctttactaaaaatacaaaagattagctggacgtggtggtaggcacctataatcccagctactcgggaggctgaggcaggagaattatttgaacccaggaggtggaggttgtagtgagctgagatcactccactgtactccagcctgggtgacagtgcaagactctgtctcaaaaaattaaaaaaaatttaaaatgagaaaagaaattttataatttatattatcaaattagtgtgatttaatgtcagtaacacaaacagtaaaggaatgcatggtgatttatttctatggtgttttgtaggaaaggacatttgaattttctgtcaaggttatgaaaatgatctctgaaagctctcaatgattttcgttaactaaatcaataacagtaatatttaattacattcactaatggattctccttttattttatagagtcggatatttattaaataagtgcatgccagcaactatatggacaaaagacaaagcaaaatatgaaaaaggtggaaagcattatggtatgtggttgaaaacattgcttgaaagttttaaaataaccttcagagccccatctccttgtacaggctcttatttattttgcccatgaagctttattttcaaaatgaagcttgctttgcagctggcccagtgggatagcagggtttttatcttgccctttgtccctagatcaaccaagtcatctatgaatagttagtggaatcagctgagtaagatcatttgcaggtggagttgctgggagatatatatatatatatgtgtgtgtgtgtgtgtgtgtgtgtgtgtgtatgtgtgcacgcgaatttggataagtgagattttcttctaaatataatgcatactctataatcccagtggtcaatagtaatctctccacctatgtgaaggtctttgagacaagtgcacctatctttctttgtattctgtcgttgtgatccatagataccaattactctggtcttccctcattttgatctgattgctcccagttctctgtgcacgccaagcttcctctccaatatccatatgccacatgtttttcctcatccatgctattgccaaaatccatgccctctaagtgaaactttatttccatgtttctaggtcatccctattctccaacaactagattaaccacctcttctaaaaattcttccatgcttagatgaaactgatctcaccctctctgagtggttcccaagtcttagtatgcacatgtaaatgctcttcaaagctaattatgctgcagttaccaggctctgtccctagatatttggtaaaataattctgatgcatgcaatccagaaatatcttttgagaaccttcttgcataaaacttctctgagccacagtggtatttcaacttcacatcactgcaccttaaaggtagaagtattttttttttttggttcagtaccctttccctattactttaagagcactcgttcacgcattgcaagcccttgagttactcctgagagaaagaaaggagctagcaaatacttaagaaatcgagttattaaatgagtcaattttaggtttgaatataaatccacttttataaagtatgaacttggtcaagttgcttagctcttctgagccttggatatcacaactataaatgggaataataataaaaatgggaataattacttgatcataatcaaatgggaaaaaaaatcaagtgtttagtgttttattctcccttattcatgttttcaaaagagaacttcaccttgagaaaaacactcttggagtaacatgtcccatagagctacttactgattcaatatttactctccctttacattaacggaatcccaataattgagggaagcaatatgcccagttaaaatctacacaccaagcctacttttcagctagggataaccatgcgatgttggtcagtaagatgtacgtagaagtccttgggtagaaatgcagagaaaagctcttcatataagataggggatgggatgtagggataaactaaacttgtttgcaacactttgccttttgcttttctagaacatagaatatgaacataattgtttaagcagctatatcttaacttccagggaaaatctaaaagaatcacaaaatcctttgccctgatattttaatgccaccaaccatacacctataaatttcttgtcattagacaaaaataaaacaattacattggttaatctactgtttggaatgtctgttactagcattcaaatgcgatttgtaactggataaaagaaaacaaacaaacataaaacaccaaaaaacatctttcacttcttactcccactcttcaaaggaagagagtatttatttgtgagactaagaaagggcatgaattaaaatcaccaagttcctgttctcctgtgggtaggagtagatactgagtggatgaatttaatactgagagaaaactatttagaaaggtcattaggattcaagttgattcacagaattcattgcactctccaatgcagctccagtaataaagctgacattttgacccatcatcaaacctacattatacctacgttgtggggctgttgtgagcttttacgcagcattgcatataaaatgcctagtctcgcacctgatatataagtcttatcgaccatcactatgaccattcttatcactatcatcttcattttgaatattctttcttttggtaagtcacagttattctcctgctggctttaggctgctgttttaatttccctaagtctccctctagttgtgatctttggctttgatttaccctacacatttatgcacttctttttcttgcctacttggttctaatttttcctgcctctagccagttggcaaatttctccttttgatgtctatcttggcattaaataatgtttaattaatatatgtcagtgttaccaagcataccatctgaaacaaaattgccattcagccaatgtaaactgaatgtgaatcttacaaattcttgccttagcttcgtcaattcctggtcacttgagttatctccacaacccttggccacttgctgccctgaggagcatgacacattgacaggttggctgtcttcgtatcactaggactttggtgcaggtcttggttctctcattcctaacccagcctgagacattctgttcctgataataaaaaacacattttccttttatatataatattccatatcttctaatacatctgtaaaaatacttttgacctagtaatttaaagatgcttcttgtaacaccataaaaaagagaaaatattgccaaatgttgccaaaggagagaatagacagaaataaagaacagtaatgcaaatgaagcttttcatttagacttttgttaaagtggctgagaaaatattcttttggccaagaaatgtgttgttatcaacagcttccaaaattttggcctttaaaaatcatgtttacattattattattaagacatcaaacatgcaattaaataactctctctttaaatgcaataactttgccttccagaccaatgcccatcacaaatagccagccagattatgctctgtacagcttcaggagtcctcattcccatagattatgatatgaatagtggcccttgagttttacatggtagcccaagtccagcttctactcaactgatcaatgatttttaattatgttggaccatctttgttgaataggtaaaaaataaaatatagatttgaaaaaaaatagttataacatgttagaagagctttctgcaaaacataattttggaaaagtcatgtttccattgggatcaagattgtccattctattaagttaccgaaagaaacataaaaactaaaggtaaatttataccttagggggctgctgatatttaaaggttggaggtagaagagggttggacttggtggaaatcctaagaagtaacttaactgtgcaattaaagtgaactatagataaaattagaaagtgaaactaataaaaaactcttagcctgttttagaatcattcaagttattctcaacaattccacttattatttcctttaaatgtattcttttactaaatataattagttgcatacatttttgaaaacctgcaatgaatacttttttatggtaactacttaaatgccaagatttaaatttcaaaatactgattgtttccataaacaaagatataacatatttttatactctccgagtgtattttctattgccaaaatactgtgtttacaataaactttaaaaaattctcgctattttaacctttgtccactgctacgaaaaagctccaaataatactctttatgctgaagccaaggaaatgtgcgtatgctatatgagtgtcctagtgaccaggctgtgatgtgtggccttgcactctcatctacaattaaatagttcaggagtagacacatgagtcagatggattatatccaagttggcatttaaaggtcttcatttgggaatgtgcatggcaccctggaacactgaaagtgagactaggtagactagtgggtgaaaatgacagtggctgaggtgaagctctgctggtagatagggcccagaacacactcagaacaggcctcacagaggatttcgaatctttttctaagttctgtggaaaaccattgaagagctctaagtagaggaatcacacacttatatctgtttttaaaatatcaccctactgcttctggctttgagaataactggtagcagatcagcctgccagccataaactattggaaaactcgaaaaatatgtgcaacagctcttttcaggcactggaaaacagacactaaggaactgtgtttgcaatgaggagtggaacaaatgaggaatgtcctacagtcgcccaggatttctgcctggaggcacttcctagatttagacatgagcagaggaaacccaagcagggcatgccaatcatacttagctgaagagacagaaatcaaagttcagttggaggaggtgaggcagctggaatttgtagggcattgtaccagagaggagggcactatgcagtaaaagagttccagaaatctctatacagatttcctggaatctttggctgagctgtaaatgcagagaagagactacacaaagccttgcaaaacaaacaagtgccaggaaaagaacaaatcctggttggcgggagggagttggcaggagtatctccattctggacatttgggaagaacaagaatcctgctgaatatatgttgccagctgcacttaagtgtcaaccttaggaaaagagacttttgacaaaatatggtgacttactggagaccaaaacattggtatttagtgtcccttttcactagatacaccgctccccagggcattgtgagggagcagagagctgcttttcaacctccactctctcaaggacctagaaccaatctggtataagccctcaaaagtctctagttagtcacctttcctagaaatccaagaactcccatactcctgcttgaactgtgcatcataaatcccataaatgagcccagacctgaacaaacaaaagtcaggacttatttggcttatgggtatctggtaacttctgctttaaacctgcagcacaaaagcctctgaggtaaaagaccacattacggggtcccttttaaaaaatttatttttaatgatacaggaggtaaatgtaattccaacagcagtaagaacaaaatacaaattaatgtctcaataaattaatctgccacactaagtatctattttataaattcaaaccaaatgtgcttaatcatcaagggttgtatttaatatatttttttaacatgccatttgtacttctatttaattgtgatgatatgaacaggagttggaaatactgggtagaagagggcagtctacacctgtaatcccagcactttgagaggccaaggggcacggatcacctgaggtcaagagttcgagaccagcctgggcaacatggtgaaaatttgtctctactaaaaatacaaaaaataaaaattagctggacgtggtgccatatgcctgtagtcctagctactcaaggaggctgaggcagaagaatcgcttgaacccaggaggcggaggttgcagtgagccaagatcgtgccactgcactccaccctgggtgaaagagggagaatccatctcaaacgaaaaaaaaaaaaagaagaagaagagggcagttccccagcaaagcccctactctcaagcctggacacccgtggccctaaatgagaacaggcatttctgttttctctcccaaaaagttgccttttggcctgccatgtccctatcctgtatcccaggctccagaaaagaccagcagatgaggatataagacaagcagatgaacagcagaatgacacagcagagaaagagggaagagggggaatgtctgagtgctgagaggagttcggcttggggtggtcagagaggagtttagtggctgaatggtccaactccaagggaagatcatctttccactccatccccacttctggctccccatccattccactgagggccacctccaccactcaataaaaactcacattcgcttgaattcccagcactttgggaggctgaggcaggcagatcatgaggtcaggggttccagtccagcctggccaatatggtgaagcctcatctctactaaaaatacaaaaattagccaggtgtggtggcgcacacctgtaatcccagctacttgggaggctgaggcagaagaattgtttgaacccaggaggcggagattccagtgaactgagatcatgctactgtactccatcctgagcaacagagcgagactgcatctcaaaaaacaaacaaacaaacaaaaaaacctcacattcatccttcaagtccatgtgtaatccaattcttccaggacagtgggcaagagctcaggacacagaaagctgtcactctggccttctgcccttgcaaaaaggcagagagtccactgaactggttaacacttaaagccatgtgcagacagcaaggctaagacagcattgtaacactggggttgcaggcacccacccctagacactaccacagggccagagcccaaagcactggccccagcctctgcacctgcccatctgcatgctccccttcctgcaaggggtttgagcagtgatggcaactgaacaagtgagccacaaacctgttccatgtcctgcatgggggatcagggaactcttcagtttcatgatgacaagatgctctgagaagccatcatttaacccgatgcatgccggttggccttcagtttgctttaattagtttatcatcatgcttaaactggatatggagattcaaaaggaactaaggtagaaccaagcacagccaaatgaagataccctgtcataattttacaacttctgagacatcataattttacaacaaaacattggagatattttctggaccaaatcacagagaagtaaacccaaacagagcctggcagtcttcctcagctgtggagagaggtcagatttgcaagagtgggatagctggatttgtgaggcactgtcccagagaggagggagctacacagaggaagaattttagaaatcaccacagaaatccccatgagtcttttgggaccaaaagcaaacattaaaataagaataggcacacgaaaggcaggagtgcaaatacacttaacgataatcagtaatgactgtagtccctcagctacatgcttatcagtttttgtttagtattgactgttttctgtacattaaagggtgaaagaaaaagaaacattaaaaatgtgctgggtaccttctatgtgcaaaactttgaatgacagatttgattttaccatttcaaagaatagaaactagcaaacaagagtcaagatgagttgttcatatcttgcctgcagaaaaaataacgtgcttctttttgttgtagagccgaggagtctccctatgttgcccaaggtggtcttgaactcctaggctcaagggatcctcctgccttgatctctgaaagtgctgggattataggcatgagccgctgcacctggccaacaatgagcttcttaataattgttttcaatgaagacaatgaagggttgttctgaggaagatgctcacctgttctacatctcccctgcaagcaaatctaaaggcaaagagtgcagctctaaccaagtcataaggcatgccttcttgactctgaggctgtttagccacaagaactaccaagggactctaagtggggtcctgctattagaaacattaaatctaggactgaaaattgtctgtttgaaatagttatgtgctcatattaaaaaatgagaactgattaggtaaattgggagagcaaaagggcaagacaatgtctgttattgatgattttcagattgctgaattaaaatgcttatttcattcgagaagaaggatttaacagccaaaatcacacttaaccatgcatgaaaagagccactgttgaaaaatggctgataaaaatgattactcaattttaaaagcctgcattgtttaacgtaattgatgcaaactttagagaactgagtcagaattttgtaaaatgaacaagctcaatccaactaatacaagtgcagagtgccctttacaattttgaaagtaatacttgggtgtaaatgactacattggattacaagatactttaccacacaacttagaagatccttttgacatttagagcagaatgtatcaaacagcaggaatgggtaaagtgaaggacactaatacttgatctacatgttacgcttcactcttacaatgctctcatcactctttatgcaccttcttcatctacataaccaataagagtttcatataaggcagatgatgctactcgacatttggcacaggtagtacttataaataccttacaatttggcctccatctatgggattggtagaaagggcagattcatattcaaaaagtacactaactcatattaaatgtgttcagagttaggttcagtataggtatataaggcatgagtcatataaaaagtgaatgtatataaaatgctgcataagttataggaaaataatacaatgaagggtaaaatatataaactgaaactataaataaagataaactgtaatggccattaattgttagtgtacactaaattaatgtatatttataaattcatattaatagatgtacattaaattcacgtgtgtattgggggtagcgggagatcagaccagaaagggtgctagcagattgttgcaacttctttttgtttaatcatagtctctagtatcttcctctttggggggtaacaaatatattttaaaaaatcctttcatatttcattcattcagtgaatgagtttacaaaataaaattcttttcaatatgtgtttttagtcttattcataagggaaaacaaagtaggcagagagcttttcagattttaattctgtcataattacttacatgtgcaaatacatagaaaagtttagtcaaacagttaggcagctaattgtgttgaaaatacaactgcatgctcacaaagataatcaagcccctagggtgtacacttctgtttcagaactatttttaggccctcaggaacttcagccacctcttgactcctggaaaacaatgtcaaaatctaactaactgaatgtgacccagcatttatttcaaagcgacaacactaaatttgattgcaaagtaacagtaagaaattaaaagtttaaaagccagcaactgtgaatgttcaaataggaatgttcctgctatcaattttctacacatacagtgaataaattgtgttaaataaggaactgatgttcttcacagtagggaaacaaccatttattgcaaatcctaaatttgataggaaaatttactttcttttcttattctgtgtcaaaaaatatttttggaacatttaaaatgatcctgagattgcaattgtttatcactacccatgctaaaatagatacattaaggtgttaaggacctaaagaatttagaaatgtccttcaggggaaaaattcctgaaatttcattgtacatgtggcatatatttctttgccattgtcgttcaaattttgcattctagaatcaattaccctatcaattttccctcaaaaatattatctctaatcttattctctccctttaaaaatcttcaagtgcaattcttaggaccctataatatgattattaaaattttttccattgtgtatattgatatttagaaagagagtgtgaaaagaattgtgattggcttttaaataaattttcttaaaactgtatcatgaataatttgccataatttacattttatgtgtcaatttataaacactatgtatttgtttctcattttattatgtcaccttgcattataactaagatgttatctctgcttgtttcttaacttcaatcattttatgagagaaataccagttacttactcaggaaagatgatttgaaacatggaaaagaaaattatttcccatgagggaatgtcaataatgggaatctaacatcaccattcttttaatatttaatagatagccattcttttaatattgacattgtgccatgctaatattatttcaagtgtgatctctgccaaaaggtaggtgtctagggggtaagaatcaataatgacaacaatcttttatttgtaggcctactaagtgttacacattgtgctgacagcttttagcatattgtattcaatcttgataagaaagcttcaaggtgagcattattattgtcatgttataaatggcaaaacagggcttagatcattttcccaagttataaacctagtaagtagcagatgtgagattcaaacctagggatacatcatatttaaatgttagattaagtagtatcaagtggcagctaagacaagacacctgagcatgctgaagggtacctagctgtgatgttattgtgctcctctaccattataagtcattctgaatccttgtcaattcaactctttatttactgggaaaattctcacttttccttctaaaatcagtgcagctcagacttgtccatagagaagtctttcttgatgatcacaggatttctttcctgaaatctcacggtccattttattacttaagtctgtgtattactcaggttctccatagaaacagaaccattttatgtgtatataaatgaggaatgacccatgcaattatggaggctgagaagcccacaatatgccttctgcaggctggagacccactaaatctggtcgtataatttaacctgcatctgaaggcctgagaacccaggagaaccaataatgtaagtttcagtccaagggcaggagaaatgtgatgagacattccagctcaagcagtgaagcaggaaaaagagggataaattcatacacatacacacacacacatatatacatatatatatatatatatatatacacacacacatataaatataattttttttttttgagatggagtttcactcttgttgcccaggctggagtgcaatgtcacgatctcggctcactgcaacctctgcctccggaattcaagcaattctccggcctcagcctctcgagtagctgggattacaggtgtgtgccatcacactctgctaatttttgtattattagtagagatggggtttcaccatatcggccaggctggtatcgaacccctgacctcaggtgatacacccacctcagcctcctaaagtgctgggattacggggtgagccacggcgcccagccaaagagggatgaattcttacttcctctgccttttgctctattctgggacctcaatagattggatgataccaatcactttggcaggggtgattgtgggccttgcaatctactatactgagtcactgattcaaatgcaaatctcagccagaagcacccttacagtgtaacaccccaaaacaatgtttctcctgggcaccctgtggcctactcaaatgaacgcataaaattaactgtcacagtctataatggagtataacatgcggcactgcctggtacaccagtcttcagctctgtcattagaaaccctagggcttgaacatgtttcagggaaaaaaaaaaaaacctactacaaaagtactatcgtatgtcaaaataaaatgaaagaatgaacgaacagttgaacaatgggcgaatgagtgaatgtgcatcacacatagctggacgagaaaaatttaatacttttttttctcacagaaatagagttatatcaaatatacttgaatagtttctagtgttttcagactgaaaaattaatttcaaagaaactttatttactttatataataccctgtaagtcatgaagctcaagtaattggactgtaaattaaattactgagttacaaggacccatattacaagctattcctcctgctgtttttcatcagaaacgttcatatgatattgtggaattgaatttttaccatcaaataaatattgcatgcttggttaaatgggacatgattccaagctcaaaaaataaaatatagaacaggcaattcactggtcagttgtgaaatatgaaaaagaagtaagcacatatttcttttttttattatactgtaagttttagggtacatgtgcacaaggtaaaagtttgttacatatgtatacttgtgccatgttggtgtgctgcatccattaactcgtcatttaacattaggtatatctcctaatgctatccctccccccctctccccaccccacaacaggccccggtgtgtgatgttccccttcctgtgtccctgtgttctcattgttcaattcctacctatgagtgagaacatgcagtgtttggttttttgtccttgccatagtttgctaagaatgatggtttccagcttcatccatgtccctgcaaaggacatgaactcatcctgttttatggctgcatagtattccatggtgtatatgtgccacatttatcttaatccagtctatcattgttggacatttgggttggttccaagtctttgctattgggaatagtgccacagtaaacatacgtgtgcatgtgtctttatagcagcatgttttataatcctctgggtatacacccagcaatgggatggctgggtcaaatggtatttctagttctagattcctgaggaatcaccacgctgacttccacaatggttgaactagtttacagtcccaccaacagtgtaaaagtgttcctattcctccacatcctctccagcacctgtagtttcctgactttttaatgatcaccattctaactggtgtgagatggtatctcattgtggttttcatttgcatttctctgatggccagtgatgatgagcattttttcatgtgtttttcggctgcataaatgtcttcttttgagaagtgtctgttcatatcctttgcccactttttgatggggtggtttgttttttgcttgtaaatttgagttctttgaagattctggatattagccctttgtcagatgagtagatggcaaaaattttctcccattctgtaggttgcctgttcactctgatggtagtttcttttgctgtgcagaagctctttagtttaattagatcccatttgtcaattttgcttttgttgccattgcttttggtgtcttagacatgaagtccttgcccatacctatgtcctgaatggtattgcctaggttttcttctagggtttttatggttttaggtctaacgtttaagtttttaatcaagcttgaattaatttgtgtataaggtgtaaggaagggatccagttttagctttctacatatggctagccagttttcccagcaccatttattaaatatggactcctttccccattgtttgtttttttttttttttttttttttttttttgagacggagttttgctctgtcgcccaggctggagtgcagtggcgcgatctcgactcactgcaagctccgcctcccgggttcacgccattctcctgcctcagcctcccgtgtagctgggactacaggcgcgcaccaccatgcccggctaatttttgtatttttagtagagacggggtttcaccatgttagccaggacccattgcttgtttttgtcaggtttgtcaaatatcagatagttgtagatatgcagcattatttctgagggctctgttctgttccattggtctatatcttcgttttggtaccagtaccatgctgttttggttactgtagccttgtagtatagtttgaagtcaggtagcgtgatgcctctggctttgttcttttggcttaggattgacttggcaatgcgggctcttttttgcttccatatgaactttaaagtagttttttccaattctgtgaagaaagtcattggtagcttgatggggatggcattgaatctataaattaccttgggcagcatggccattttcacgatattgattcttcctacccatgagcatggaatgttcttccatttgtttgtatcgtcttttatttggattcctaggtattttattctctttgaagcaattgtgaatgggagttcactcatgatttggctctctgtttgtctgttattggtgtataagaatgcttgtgatttttgcgcattgattttgtatcctgagactttgctgaagttgcctatcagcttaaggagattgtgggctgagacaatggggttttctagatatacaatcatgtcatctgcaaacagggacaatttgacttcctcttttcctaattgaataccctttatttccttctcctgcctgattgccctggccagagctcccaacactatgttgaataggagtggtgagagagggtatccctgtcttgtgccagttttcaaagggaatgcttccagtttttgcccattgagtatgatattggctgtgggtttgtcatagatacctctttttattttgagataatttattgagagtttttagcatgaagggtgtagattttgtcaaaggccttttctgcatctattgagataatcatgtggtttttgtcattggttctgtttatacactggattacgtttattgatttgtgtgtgttgaaccagcctttcatccccggcatgaagcccacttgatcatggtggataagctttttgatgtgttactgtatttggtttgccagtattttattgagaatttttgcatcgatgttcatcagggatattggtctaaaattctctttttttgtagtgtctctgccaggctttggtatcaggatgatgctggcctcataaaatgagttagggaggattccctctttttctattgattcgaatagtttcagaaggaatggtaccagctcctccttgtacctctggtagaattcggctgtgaatccatctggtcctggactttttttggttggtaagctattaattattgcttcaatttcagagcctgttattggtctattctgaaattcaacttcttcctggtttagtcttgggagggtgtatgtgtctaggaatttatccatttctttgagattttctagtttatttgtgtagaggtgtttatagtattctctgatggtagtttgtatttctgtgggatcggtggtgatatcccctttatcattttttattgaatctatttgattcttctctcttttcttctttattagtcttgctagcggcctatcaattttgttgatcttttaaaaaaaaccagctcctggattcattgattttttgaagggttttttgtgtctctatctacttcagttctgctctgatcttagttatttcttgccttctggtagtttttgaatgtgtttgctcttgcttctctagttcttttcattgtgatgttagggtgtcaattttagatctttcctgctttctcttgtgggcctttagtgttataaatttccctctacacacttctttgaatgtgtcccagagattctggtatgttgtgtctttgttctcgttggtttcaaggaatatctttatttctgccttcatttcgttatgtacccagtagtcattcaggagcaggttgtttagtttccatgtagttgagtggttttgagtgagtttcttaatgctgagttcgagtttgattgcactgtggtctgagagacagttttttacaatttctgttcttttacatttgctgaggagtgctttacttccaactatgtggtcaattttggaataggtgtggtgtggtgctgaaaagaatgtatattctgttgatttgaggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaagtctctttgtaggtctctagggacttgctttatgaatctgggtgctcctgtatgtggtgtatatatatttaggatagttagctcttcttgttgaattgatccctttaacattatgtaatggccgtctttatctcttttgatctttgtcggtttaaagtctgttttatcagagactaggattgcaacccctacctttttttgttttccatttgcttggtagatcttcctccatccctttattttgagcccatgtgtgtctctgcatgtgagatgggtttcctgaatacagcacactgatgggtcttgagtctttatccagtttgccagtctgtcttttaattggagcatttagcccatttacatttaaggttaaaattgttatgtgtgaatttgatcctgtcattgtgatgttagctggttattttgctcgttagttgatgtagtttcttcctagcctcgatagtctttacaatttggcatgtttttgcagtggctggtaccggttgttcctttccatgtgtagtgcttccttcaggagctctgtttgtcaccaccaggcctggtggtgacaaaatctctcagtgtttgcttgtctgtaaagtattttatttctccttcacttatgaagcttagtttggctggatgtgaaattctgggttgaaaattcttttctttaataatgttgaatattggcccccactctcttctggcttgtagagtttctgccgagaggtcagctgtaagtctgatgggcttccctttgtgggtaacccgacttttctctctggctgcccttaacattttttccttcatttcaactttggtgaatctgacaattatgtgtcttggagttgctcttctcgaggagtatctttgtggcattctctgtatttcctgaatttgaatgttggcctgccttgctagattggggaagttctcctggataatatcttgcagtgttttccaacttggttccattctccccatcactttcaggtacaccaatcagacgtagatttggtctttcacatagttccatatttcttggaggctttgtttgtttctttttattcttttttctgtaaacttctcttctcgcttcattttattcatttgatcttacatcactgataccctttcttccagttgatcgaatcggctactgaggcttatgcatttgtcatgtagttctcgtgccatggttttcagcatcatcaggtcctttaaggacttctctgcattggttattctagttagccatttgtcaaattttttttcaaggtttttaacttctttgctatgggttcgaacttcctcctttagctcagagtagtttgattgtctgaagctgtcttctctcaactcgtcaaagtcattctctgtccacctttgttccattgctggtgaggagctgcattcctttggaggaggagaggcactctgatttttagtgtttccagtttttctgctttgttttttccccatctttgtggttttatctacctttggtctttgatgatggtgacgtacagatggtgttttggtgtggatgtcctttctgtttgttagttttccttctaacagtcaggaccctcagctgcagatctgttggagtttgctggaggtccactccagaccctctttgcctgggtatcagcagcagaagctgcagaacagtggatattggtgaacagcaaatgttgctgcctgattgttcctctggaagttttgtcccagaggagtacccggccatgtgaagtgtcagtctgcccctactttggggtgcctcccagttaggctactcgggggtcagggacccacttgaggaggtagtctgtccgttctcagatctccagctgcgtgctgggagaaccactactctctttaaacctgtcagacagggacatttaagtctgcagaggtttctgctgccttttgtttggctatgccctgccctcagaggtggagtctacagaggcaggcaggtctccttgagctgtggtgggctccacccagtttgagcttcccagccgctttgtttacctactcaagcctgggcaatggcggggtgcccctcctccagccttgctgctgccttgcagtttgatctcagcctgctgtgctagcaatgagcgaggctccgtgcttgtaggaccctccaagacaggtgcgggatataatctcctggtgtgctatttgctaagaccattggaaaagcgcagtattagggtgggagtgacccgattttccaggtgccgtctgtcacccctttctttgactaggaaacggaattccctgaccccttgtgcttcccgggtgaggcaatgcctcaccctgcttcggctcatgctcggtgcacagcacccactgtcctgcacccactgtccgacaatccccagtgagatgaacctggtacctcagttggaaatgcagaaatcacccatcttctgcatcacccatgctgggagctgtagactggaggtgttcctatccggccatcttagctccacccccagcacatatttcttcttacctaatttgattacccaaaattttgccaccgtttgtctagtcatttaataataactttggaatctttgcttatgtaaaaagaattgcaaagagttaataacctctctatcctccaggaattattgcatagtttaagacattccttattaacatcccacaagaatttcccagtggcccacaatagtctttcttcacacaatattttttgtaacattgtctattctataattcattatttttataatttgattatgttttctaatattccaaaaatttcacatctacttactttccaataatttttttcaaaattaagtccaaaatcattcacactgaatatagtgctgagtataaacagggcctaattaattgggttgaaaaattctctcatagctcttatagcaatgcttctcaaagagtggtccagggcctccaggggggccttgagaacccatcagaagatctgtaaagtcaaactatttttgtaataatactaagaccttatttgtctttttcactgttaggctctcatgagttaactgtggatttttttccagaggctgcatgaagtgcagtataacagattgactgcagaagcagagaggaaaacccagatgttttctattgagccaaatcattaaatagatttgggaaatgtaaaaaaatgctactcttctcattattttgtttctaaacatatatttatttttcataaaaatattgtttatgttaacttctaatgggtttatcatagttattggaaaaattaatttgtaaacaaatttttaaaaaatatgtcagttttagtatctaatacagaaaatatcaataaatttaatctgcatacgaaggctttttgtagtcttcaataatttttaagagtgtaaaggagtcctgagaccaaagagtcttagaattactacttttaagcatctcaaacggataagtacagatacacttatttggaagaatagcaactactatttactgcatttgtccaaccagctggccactttatacacattacatcatttaatcctccacagtgctatgagccagatattgtgctcctctctttttgggaaagaaatctgtggctcaggatgatcaggatgttcctctaaggtgataagaggaagcactggactttgaaccaggtctgactacgttcaaacttcagattcttaatcattaccctggctcagtctcaaaaaagatttaaaaacttgttgcatgagcacatgaaaagctgatcaacatcaaaagtaattaaggcaatacaaactaaaaccctaatgagatgtcatttcatagccactaaggtggtcataataaataatctagacaataataaatatgaacaagaatgtaaagaaatgaagaaaccttatacatcactgatgggaatataaaatggtgcagccactttggaaaacagtatggcagttctgaaagtggaatatatatgtgagttaccacatgacccagcaatttcattcctaggtatctatataagataaagataaatgaagctatgcatagcctaggtatccatagctaagacaaataaagtatatgttcatgtaaagacttgtagagaaatgttgataacagcattatttataagagcctaaaaatagaaataaccctaaatgttcatcagtttaagaatagataacataaaatgtggtatatctgcacaatggactattattcagccataaaaaggaatgaagttttgatatatgctacaccaaggatggacctcaaaacattttgctaagtgagagacgccagtcacaaaggaccacatgttgcataattcgattatataagatgtcatagaaaggcaaatttaaactcaccaaaagtagataattggttgcctgggcctggaggtcggaaggattaatagcaaatagacataagagttcttattgtggtcatgaaaatgctcaaaaactgacttatggtgatagttgcacagctcagtaaatatactaaacatcactaacttttattcttgaaatgggtgaatatgatacacagaataagcctcaaaaagtgcttaggccatttggaaagatctctttttaacagttactgaaggaacatacagtagttaaagaaataacatagtaattaagtgatagtaaagaaaaagctgaaaacttggtgactgaaagcttaatagagattagggagtcagtgcaagaataagatcaacacagaataaacaggggaatgaaaacctaaagagaaaagagcaaggaaggatgagacaaagatcagggaggcaggttgttaactgtgatttcacagttctaaaaggaagttggaactgagcagattagaacagtctttgtccaaagcaatgtgaaaatagacatcaagacccttaatttttctttcctttgacccaaggatttatactgtgaaaatttatcctaaggaaattatcttaactacagaagaaaatgttacgcatgaaataattttaaaaaataaatccttgccattgtttacagtgtaaaaactaaagaatacctaaattctttaagaaaaatagtgaagtaaatcactacattcacatagtgaactattaaacaataattaaattgatgttaccaatgagattgtgttcagtatcttcatctgtaaaggcgataatattagcatctagctctaccaacaaaaatctatgtattttttgttgagagaattaaatgtagctaacacatatgaaacatgtgcattcttaaacacagtgagcaacacatggtaagcgattatttaaaattaatctctgttattaattgacagaaactgacacatgggagaatcaataagggattagagtaaaacaatttagctagctattaaaagaacaataatttttaaatcatttatttattccaaagcaaaggagagaaaaatatggtacttttgtgaatatctaaatcaaactttaatttctatattataaacataaaagtctgattgttaaatcttagaaatctttcataaatcagcagaggtaataggttcaccaattatgaaatttcttctttgagaagattaaaagaagaaattgggaaagagaaataaacaattataagctaaaataaaaagatagataaagacagtaaaggaaagattttaaaagctcagccagggttaattcttatgtcctacttggtttcctaacccccaaattccttttatttctacagacagggttacagatagttcctgctacttgagtgccgtctaatgtcccaattcctatctttcctgtagtgaaaagggaattttaaaaatcagttctcagaagggtcagagttgatttaatcttattcataatccagctctgaccttgtgttaattctagtaactagacttctggtttacctatgagattaagtcaccattttctacttcatttcaataattgaattctttattgtcagatttcttgagtggctccctgcttctaatacccataatttgctggatttatcttgctagaatcccatggatctcatctttgaaatacagccgagtggatggagccttgcagacatccctcatgcatgatacttatttgacttcataattaataatacatgtactaatgttacccaggattgtacacacctgttacatattaataaaaaaggacagggttatatttgtgggtcttggttgacacttagagcttgcctaaattgtcatctcttgcctgtcaccatatactcaagaaactcaacttcccttgcctgactagctttcttgacttacaatataggttgttacatctccaaaacaatacttatagcatccaaaaagtcacattcagtataaaaagtgtcaactctactactgaatttttccattgcagataccaattctatgtcaagttccagagataaaaattgagaatcagagagtcagagaggtcaaggagacacagctaatcccttgggtggttatacctaaaaacctaaaatctaaactctaatttagagatggtagagctgtttgtttgttttacgtactccactagacagatagtatagagtgtatatatgtttagaaattttctatatttgttttaaatattactatgtctgaagacaggaaggagcctatactatttacatgattctattctaataagattcattactactaaccctatttaacagttattaagcaattgcagtaattatggttattcatatttcaatacatgaaatattattaaagatagtgtcttaaataatatctcatatttatcatttgatgagaaattttaaatacattattagatttaattttcgtaaccatcctgagagatatacggatgagatattcttacccctgtttaatagataaataaaatgtggcgaaaaaaaggtgaagtaatatccaaaggtaacattatttttattttaggtataatttgaactcagatctgcagactcgatatatagtgttggtagtaaaaattatgctcctgtctctataatgtatttttaatggaattttagaagttagcattatgctaaatggaatcagattaagaaacatacctctgtctaacattgaaacagactccaaatgtctttataatgggcaagtggatacagattaagtgccatgaactatcatcatcctaagagtcttacttcctttcatggtgattgtcagggatgcttttctgagattcaaatattctcatggatgagttaaaagaagatgaaacaagatgataaaaccagtctcttttcaagaaaccataaacatgttagcaaccatcaaatttctttacgccctcattctagtaaattataagctatcaaaactgcacacgttctgaaagtttactaaatgcaaataaaatagtctctttgccatgctgtaacttgagataataaaggacttaaataaattcagtgaaagcaaaaccccatatgtttgggtgtcagaggctactttgactaagctcatttcaaattataacatcagcaaaattaagctattaaaactacaaataaaagagtatttttagttctaagaagaaataggactaattggatacacatatgcctcctaggctgtatatcttaaatgtgaggctcatcagtagttattattaaagttggcagaaataatggacatagtaaattgtactttagatttttctttatgcacaattgcttggtgttatcttcttaattgagtcacagaataaaatctaagaaaacagatgtaaacacacagacattaaaatgcatcactacttttgcctttaccttttcatattggttttcgaagtgatgcatggttaaatgaacctaatttgagagaaatttggagatggccgctgagtctgtgtgctggtcagggggttgctttctactgttgatattattctttgcgtattaacctcagaaggggaacaatatatggaaatgggatagaaagtcttcagaaaccacagtaggaagattaatattcatagcacatttatgaagtaggcatcattatgtgtgtgtgtgtatatatatatatatattcacatatatataatttttgaaaaattattttacagataatgagtttgagatacaaggatggtttataacttacacaagatcacacagatttcaatattctaattctaattcaattttttctaattcttagttgcatgtgttagtccttatctaggtcttagaaaattacacttcttttttgcaatagtccaaatagtctaaaccgtacttagcatttagtgttcaaccaagtttcttgactatgtcagtaaaatgtgctggctttaaacgctgggatcatgtcatcatcactgtttcctcagagcccaacaaaatgcctggcacatatcaggaacttcataaagagcattaaatgaatagataattgaggacatgaaaaatacatccatttattcatttagaaaactgtgtgtatttataaatgacagcattccaagtcacacatatttaaacttatgaaatttctagatggtttaaatttataattaatgtaaaaatgaggaaggacagagaaaacattctttgtatgcaaatattattatcttctacatagtcaataagattttagaaaacaatgttgcatagaacatatgaaatatcaattgcttactattattgtcaataaaggagagcttctcttatataacattcattataaacatctgtgtgtaaggaaagaaattagttttgtgctataaatattggtcatataattcattaattccttcatttattcactaagaggaatggactactttaggtaatgttgtaatataagccacatcacaggatcctttatttctcttcttcaatattctgaatttattccttaatattcaataatttttggaagatattatctttgtcgtattatttgttcaatgacaactatatgtaaagaattatttggaatatttgctgattgaaaactatgtgcaaagggcagtaagaatcttttcattgttttatttaattctcaacaaatataacatgaggtcaccatttcacatatatgaatactgaagttcagaaagtttaagcactttgcctaaagatgcaaaaccagtcattggcagagtttaaagtctctggcacattgacaagccctctcaatgtggagaaaaaggaactcataagctgttggtgggaacgtaaactagtacagccactatggagaagggtatggaagttcctcaaaaagctacaaataggaccccaatatgatccagcaatcctggtactggtaatttatccaaaagaaattaaatcattatatcaaagagacacctgcactctcatgtttattgtgtcattaatcacaacaggcaagacatgaaatcaacctaggtgtctaacaacagatgaatgaataaagaaaatgtgacacatatacacaatggaatactatttagccataaaaagaatgaaatcctgtctttcacagtggatagaattggaggattaggacattatgttgcgtgaaataagccaagaacaaaaagttaaacaccacactttcttactcaaatgtggaagttaaaaaaaaaaagttgatctcatagaagtaaaagaacagaggatactggggctgggaaaggtcaggggaagggagtgatagggagagatttattagaggatacaaaattccagctagataggaggagtaagttctagtgctctataccactctaggatgactctagttaacaataatatatagtttcaaatagctagaagtggatatttaatgttcccaacacaaagaaacgataaatctttgagatgatggatatgctaattaccctgtgcattactatacattatatgtatcgaatcatcactatgtactcataagtatgtgcaattattatttgtcaattaaataaatttaaaaagacaagccctctcaatcttcaaattctataatttttactcttcctctaaatctctataaaattgattgtaggctgggcataggggctcatgcctgtaatctgagcactttgggagggtgagactggcagatcacctgaggtcaggagttcgagatcagcttgaccaacatggtgaaaccctgtctctactaaaaatacaaaaattaaccagacgtggtggcggttgcctgtaatcctagctactcaggaggctgaggcaggagaatcacttgaaccccagaggcagaggttgtagtgagccgagatcgcaccattgcactccagcctgggggacagggcgagactccatctcaaaaaaaaaaaaaattgactgcaatgtgtttttgttgttgttgttgtttgtttgtttgagaaagagtctcgctcttgtcacccaggctggagtgcagtggcgtgatctcagctcactgcaacctccgtctcccgggttcaaacgattctcctgcctcagcctcctgagtagctgggattacaggcatgtgccaccatgcccggctcatttttgtatttgtagtagagacagggtttcactatattggccaggctggtctcgaactcctgacctcaggtgatccgtcggctttggccaaccaaagtgctgggattacaggtgtgagccactgggcccagcctgtagtgtgtatttttgtatgtttctaattttaaaaatcaaaaattgaaattcctgccactgtttacttaaataaacctaaattagataccactacccttatgatctaaagtcttctctctatggtcccaaacagtctctttatgaaagtttatgatttctatagaaggaaacatccttcagacgaactgaccaatggtactggcaatagaggcatctgatttagaaagccagttggtataaatatggccttatcatattcctgccttcctggttctagaatccccagtgtatacaaatctaaacatgaatgctttcttgcccacaagtataaagcaaaaaatgtttcctttctggaacctaaaggtatacaaaaattctagtccttcattaactatatttaatttaataattaaggaaacatattaaaaagctaagccacaggtaatttcaaaataggggagagtaaaactcaggaaagagaggagcaagacttatctttattaaaggtttatcataaattagaaaaaatatggcatagtctttatattttcaggcatagaaattttgccggcattctgaactacaaatgctgctgttaagataattttgtcactaaacaacaatatgtgatgggaacaaagcaagatgccaggagatacaataaaggctagaatgtagtttatagcaaatttggcccactgcagtggaattggtaaatggcttctggaaaatgtatagcatcataaaaaaccccaaagccatgtttcctctgaaaaatgttaaacaaaggtttcaaacataaaaatgctcatttccatattgattttgatgaccagcgttaaatcaggcagtgtgaatggctgatggactctgctcctctgtgtcattattctaccatttcattctgaagggaattactgtatagatggcagtttgaaacaattttcaagcctctagatagagggttttattttttttctctaaataaatgtaaacaattcttttctgagaataactgtacccaaagaaggtggaaacttgggaattcagtatgattttaaagaataaaggtgttatttcacttgggtaagtattatttggttgaattcttcatgatatagcaaaataatttttgaaaagtccctttttataatgacaagctatgcatacatttctgaaagcagcagaaagtttctgaatcatcttgaaatatcccacatctgaaataatggcgtggtggctcacacctgtaatcccagcactttgggaggccaaggcgggtggatcacctgaggtcaggagtttgagaccagcctgaccagtatggtgaaaccccgttctctactaaaaatacaaaacttagctgggagtggtggtgtgcacctatagtcccagctactggggaggccgagacaggagaattgcttgaatctgggagacagaggttgcagtgagccgagatcgcaccactgcactccagcctgggcaacagagagagactccatctcaaaaaaaaaaaaaaaaaaaagaatatttagttggaaaccattgccttctgttctcatgttagaaagaatgtggaatacatcctccaatttgttgtaatataggaaattaaattgaatagtaagtatgtgtgtgtgtatatatatatatatatatatatatatatatatatagagagagagagagagagagagagagagagagagagagagaaagagagacagagacagagtcttgccctgtcaccaggctggagtggagtggcatgatctcggctcactgcaacccacgcctcctgagttcaagcaattatcctgcgtcagcctcctgagtagctgggactacacacatgcaccaccatgctcggctaagttttgtatttttagtaaagacggggcttcaccatgttggcctggatggtcttgatcttttgacctcgtgatctgcctgcctcggcctcccaaagtgttgggattacaggcgtgagccaccgcacctggccaaatagtaaatatattcataacaattaaaaacacttgtttggtaactgctctcacaacataaattttgtatgaccagtaatgactggattagagacttttgcttgcagctatatggtaggatagacaattctaattacttgatcctaataacttacttaattacctaataacttacatgaaacgttatttttatcacatttctgggctctcagtaagtaaagagactcattgaaggtgttaggttggggaaagagttgtaaccaagtgtgaaagacattgggcatctagacttgagtggaaaaattgaggtgatgagattaagaatcttgattatacttgggaccctggaatggggctaatgtggtctgagatctgcagatgtgaatataaatcttcggtagaaaaaaaaaatgcctcacaaaaagcagcaaacaacaaatatcagatttacatcctgaaaaaaattcatgtactagagtgatctaatatagtatttctctttctttgtctatagatagagatatggaatcataaaatcagaaaacaaaaataatcatcaggcaaattcaataaatagtagaaaaaaatatacatgtcatttcctatgggccaaacattttataagtttcaatacattaaatgatttaattctctagttattgtctaaggtaataacaatttccatatttccattttatttatgaaaagattgaaattaaaggaagttttatgtcttattaagagccaaacaggctggatgccatggctcacacctgtaatccaagcactttgggaggccaaggcgggaagattgcttgaggccaggagttcaagaccagctggggcaagatttttgtgagattccgtctctacaaaacattttaaaaatgagtcaggtatggtggccacatctgcggttccagctattcaggaggcttaggtaggaggattgcttgagcccagaaggtagaggccacagtaagctgtgatcctgccactgtactcttgcctgagtgacagagtgagaacctatcttaaaaaaaaaagcagacagcaagaatctaccaaatatctaaaattgaagaaatatatatgtttaaaaaaagttaacaaatggatgaatcatcatatcatacacaactgaagaaaagattagtgaattggaaaagttatctgcagaaattatctggattacagtacagtgaaacaaaggcctggaaatacataaatctgaataaagaatatggtggatagaatgagactacccatcatgtatactgtcacatgctcaggacgagataatcgagataatagaataaatgacatatttgaatagaaaatagctaggaactttctgaaacttgttagagacatgagttcacaaacaggaggcaatgatatatacctccaaaacagtataaataaaaatgaatccgcacttagacacaccttagtgaaactacagaataacaaagacaaaaaacaaccttaagaatactaagaataccaaatcatgaaagacaatcaggttggcatcagattcagaaaggaatcctgactcttaagcctcttctcttcctgtctactctttcttcagtctttcttgcaaaaatgaaacacaataacttcatcttagataaaatatgatgttagcattaattagtctatatatttttatcagtcttagaatagtggctaaaagaacaggctttgaacagcagatttgcattttgctatcaaccctataatttaattagccgattattagcttaaatataatcaattcacataatcccactgagactccatttcctcatctgtacaatgcatattattccatgtactgcatagtatggttgtgggattgagtgtgataatgtatatacaatttagcattcttcttggaatgtataaaacaatacagggaaactatcaggttgaatcatatgaaattatcttgtaggtcaaaaaagttgaatatcagtcatttcacttgggtcaacttaatagtaaattgtggtttcaagttgagaaagaatcaagtttacttttaaattcatatacaaaaagagacatacattttaataaggaaaagaagctagtttacaatcaatcttgcctcctacaccattatagtctgtaggttttactctacgagtgtccgcttgttgatgatgtgatgtaatctaccagaatctgacttgaatagaatatttaataagttgataatcatataactacttttatgattagaccatgtattggctgctcaaataacaaaatttcctggtgcttctactggtaccaggggatttatggtttaggcataagatttaggcttgcattttattgtgactattctaaatatttctctgatgtgtcaggtagtcctttaaggtggccaccatgaccctttcttcctgagtttgtgacttgtttgtaacaaacagaaaacggaaaagttgatgggatatatttgattacatgttcgttacttcacaattcgttacataagattatatttcttgtcctgatggagtctctctcttccttgatggcattcagaagacaagcaactttgttggggaaatcatacagcaaaacctgtgggcagcctctaggagctgacagtggcttttggcagatacaaagaagaaactgaagccctcactcctacaaccacagggaactgaattccgccaacaacctgaatgagcttgaaaaagcctcaaatgaatccacagccctgtctgacaccttgattgctttctaagactccaatcagagaacacaactccaatcagaggacacagtaagccatgcctggatttctgacacacaaaaacccacatgtgagtattgttttaagctgagaactttgttgaaatattaataggcaacaatgattaacaaatatacctggaaaataaagagctatcatcagagagtggctcatgaaggaaaagaaaaagcaggttattctttccaaagccattcacaaatttcacaactacgctaacttttctattttgaaacagttgcaatcttaagaaaattgaattatcaggatgatctttaaaagtaatcatttccatgagaaaaatacccaaagagattcaaaatccagagagtatgacatgtgcagtaacaagtttgagagttttttttgtacaagaataatgttgaaataaggtggttttatggtcataagtacagtttttaaactgcaactttaccattaaatggcttaatcaaaactaaccaaaacaaatatactcatcatttactcttcagaatatcacatacctagcttctcagtcaccccatcaccaatggctttgatcctgcagttttctttagaggcagtttacagagccaaagaaaaacaaatgagtggaccattactaatactcttcaactgcacaggaatcacatttcctctattatagcaacgtaacacattggtgatataaagttatatcattcagtgtaaaggattattctgtgatttttagtatatattgttctagatagcaggcataaattgggtactttgttgagaatctgctgcccaagttaactgcaatatcctctttcgttaaatacttcaaagtgtcttaattggctcttctgtgaacattctgggctactcactgaaagacacataagactatacatggaagcaagaatcttagaggaagcattcaggacagagaagggaaaggaagcttgctttttgctgtcactgcctaggcaaatgatagagcttcaatttgctctgagaaagagaaattttgattatactttttagcatttgtccacaaacaagaagcaaaacttagaaatatgttcttttcccaatcaaaaatagaatgttgaacgaatttatctgagtaagggcaagagatacatttcctgactccatagtcaatgaacacaaaataaatcaaaacgtagctccagaaaaaaaaaattggggaagaaattcccacatcttattgaaaaatgatgggaaattggaaaggggctcctgaaaaaaaaaaaagcctggagaaattgctgaagggtcaattgggaaaatgcttattttcctcttatttcagggcaacacatgacagaatcaatgtcatctcaagagattccagtagctgaatggtttatttacatattaaacacaagttggaggaatgagtttggtctttgagtatcctgaattttacactatttacacatcccctcttgaggttttacttagtgtactgtaaaggcaaacaaagccttgtctatccacagaaggactcctccagatcctatgggaaagatccaagagctttgttaaacaccaaatagtctttaaataacaatcttctgataacttgatagtaaacagccatactttagtgatttcctagtaaacataaattaatatactatatcagattatttggaaagatcattattttctttgaaaataaaacaaaaacaaaaacaaaagtctgtaattttgtgcacagacccaacaatctcatttcccatttatgacagaattcagtgaatcatgcttctacaacacattctgcttcagggcacacatctaaaaattaatctttctgaggatacagtaatcatgaccactccggtgtcaattactgtgtatggagaatgtactatgtgccaagtgctctgctatttcattcaatatgtagaaggttattacaacaacccatgaggttgctgtaagtatttcctctaatttttcagataagaagacttgggctgagagaagttaaataacttacctacaatatcagaataaagttgggatttgaatgcagacaatctgattcctgagtaccattgttaaatagcagatattaaaaaaaatgtgagtcagtgttagaaactgaataatatcatcttacatttattcaggaacatttaacaatatgattgcttaatgagattcataattttactgcaatcaaatgctgcaaaactcaactcctgaattagatttacggtatgctgcaagtagatggttaaaaacatgatcacattgtagatatttacaaaaataaatgaataaaaataaaaatttgcactatcatgtttagtagcatggagaatttggtatgggaaggtcaagacaacttcctagtttgatgagttttgtaagatatttcctaattaagtgtgtgaaattttcatcatgtaatattaaagatctctcatatacaattctgcacaaaaagaggtctgaaaatctgaattattttatagtacaaataacacaaatgtagttgaaattagcaaatgtttagtgactattatatgccattaagtatatcaatttcacatgcatccaaactttaattttactgtccaggaggtgacaatatataataataaaaataataataattttaagagtcatgaagtaagtactatatgccagaatgaaagggagaagcactaaagagatggaagatttcattctgacttagttaagatggattcctagagcagatgtcacttggatgggtttttaaatagtagaatttcaacaagcaagcaagaaggtatcaaatggaaggaatatttcattatacttagtaggtaacaaggccccagcagtcagactgaagactcaaacatacatgggctctttggggctaccctccctccttgtatctcatttcataaattgattttcaggcagagcctctttagtggggaaggaacatacacaatgaactattgtgatcaaaacatagacaaatgtgcatgacaaattggtagagataggaggaaccaaatattgaaggaagatagagatagttttccaagaacattcataataaaggaagaggactagcagtaggaagcaaatacaacaaatggggtctgaaagatgaaggaaaacagtggttctcagcactgcattgcgatagggccttgaactcagctaaacccatctagcctaacaccattgtatactttggagtgaaaaagggctgtataataaattgtgtcattaaatgtggccaataatcctatcatgaaattcccctaattggcacagagactctcacttcttaaggtgccattgagttgttttaactgtgaacatagggatgaaatgaaaagagagaagcaaatcacgtaaagatacttaacaatataattccattttataaatctcaaaaatgtacagctacattagatattatgcactatattcttatctggcaaaactatttttaaaagaaataacaaacaaacaaaagcactcattagtggttatcttggggaggcagactgtggtgaagcaggaagaggaggtcatcaacgaggggcactaaaggggcttccaaaaatgaagcaagttttatttctcaagctgagccataggtaaatgggtgattattttattatcattatgtaatctttcatgtatgatatatttcatcataaataaatattgattttaaaggtagccggttttatctttaaatgatatatatatgcttctctaattttgtgtcctactttttattcctgtataatatactctgaaaactttccaatttcattaaaaattcctcagtaaagcatttttaatgtttggaacaaaatctattaaaatagaatagattcatgatatatattgttgggtactttcctaattttcattgctacagtatcagattcatttccattataaaaccagtgactgcttcagggcccacagaaatgggcacaattgtaaattcagtaggctcaaatatatatttttaaaaggctatgtttgtacatctttcttagcctgttggatgcgcagctcactgtgttgaggcagacatctgttggtatgcacaaaaataaaatattgttgtcttgtttttgtatttttcatatccagagaatcaagtcatagcttttgcctgagggagaacctcaagaaaaatgaactagtgtgacgtgtgtttctgccaagcagaaaagaacatggaagtaaacttatctacataaattaggtcagacagctggtccgagtctgcccactcagcctgctaggggagcaaccaagcaaaagttaagattgccaatttgtttcattttgtttccctctggatttcaggagttgatgtagaaaaaaaaatcaggaaggaggaactggagattaatcaacccagggatagtttttgtaacaggggaaagggatcgctgagataaatctagggagatgaaaactgggtttagaatatttgaggaggctttttgttttgtttcactatgcaaatggggaaagagtaaaaaaaaaaaaattaaaaacacacaaaatctcaaaaatgtgaatagtgaggaaaaataatcatccatatgggagtatccgtgacatttgtaaaaattccgtgaacacggccagacgcagcggctcacgcctgtaatcccagcagtttgggaagccaaggcaggcagatagcctgatgtcaggaggtcgagaccagcctggccaacatggcaaaaccccgtctctactaaagacacaaacaattagctgggcatggtggcgggcgcctgtaatcccagctacttgggaggctgaggcagggagaatcgcttgaacccgggaggtggaggttgcagtgagctgagatggcaccattgccctccagcctgggcaacaaagtgagactccatctcaaaaataaaaaaaaaaagtctatgaacactaaaaaaaaaaataagagtcccttgttagtctgtgtctaaaaaagaaactagcactggctcttgaaacaacatcaaggtatcaagctctgcttccttctgtctcataaagcacattgttctgaactaccttgagatatcaaaaatgtgtccaaaaacagttgaaaatctgaattattataactaaagggttatcaggctcaaaggaacctgagtttgagggtgggtcatctatttgcaacaaaatatttagaagtagttgagaatctgtcttttagagtaagtggatcgttgaaaatgcctcctctttttgccatcctcttcacttgggtaacgtccttagcctttttggatttaggctttcacttcatgtgccctgggaagtcattctagacctcattccattaggacctagacatccattactctaagtctgtcactgtgggctctctcttcccgaactaactgtgagctcctgaagaatacatactttgtacatcatagcatctcaccacccagcatagtgcctgatgcataataatatttgttgaatgaaaaatcactgaaatagaaagcatatgtataaaaatgttagttctagtgtactgggattcaaaggatcatcatgatctacacttatcagtcttaacttggaattaccagaaagataggctcagacatctgcaactaatattatttttaaagaataatcaaatattcagacaggccaggcaggaatacacacgctagacaggcttaattctggtgtggcgttcatcatcaaacatacctgagagtcatgacaaagtgagtttggttaagtagatatacgatttaaaagaaatacaacttaactgagagctcattactgagtattagtatgtgtaagaaacttgcatttaaaggtactctgtggcctctgtgtttatgccaattttggtagcaagcccattttattgtaggaagtcactatttcatggatccaccatttaactgggtcacattgggaaaattattttatgcaaatctttaaaatgaaaataatattatgctcatagggctgttaccaggattaaatgtaatggcaaatgcaaatcacctagcagtaccttcgatacattataaaccctccacgaatgacgcttccctctaacccttgagaacaatatgtcagtagcacctacaaacataaaataggatatctcttttaattgattgtaatttccattattatgttatttttgctatggaataggaaactctttatttttgaatttttacactgtttcatatattctagatgcaacatttttgaggagtatgatatgatatgcaaatattctttcccactctattatgacttttcactcttttaacagtgcctttcacagaggattttttttaacttccaaggaaatcaaattataatttttttatgtcattacttggtgttgtatctaacaatgccaaaccaaagtcacaaaaatttatcctatgttttcttttaagagttttctattgtaatttaaagctgttatctaatttgagtcattttttgtatataatgtaaggcataagttgaggttcaatgtctaaattgttccagcaccacttgatgaaaaggctagtctttctccactgaattatcttggcatttccatcaagaattgtttgatttctgaactttccaaatgacctcattgatctatgtgtctactcttttgcaaatatcactcttaattactatagttttatagtgcaagtctcaaaatcaggtacagtggatgctccaaatttgtttgcttgttttgtttttttttttttttttttggctattctggttcctttgcctttccatataaatgtatttttgtaattctttctttagaatcagcttatatatagctggaaaaaaattctgctaggattttgactggtattgtaacaagtttatagatcagcttaggaagaattgatatcatcatcatattgagtatattccaataatggaacatgatacatcactccattttttaaggtcttctttaatttctttgactagcgttttgtagtttctggcaacatataggtgcagcaattatttttttttagatttatacttacgtatatcaatttttgaagttttggtaactggtattcttttataattttggtttccaattgttcattgctagcacgtataaatataatagatctttggaattcacaatcatgtcatctgcacatagaaaaattttattttttctttgccaatatatatgccttttatctttcttttgccttattgcactgactagaacctttaatgtaatgttaaaaaggaccagtgaaataactagccttgtcatgttcctgttgttaggaagaaagcattcattcttttactgttaagaatgatgttagctgtgggctttttgttgataccttttatcaaattaggaaagtccctttctatttctaatgtatagagaatttttattatgaataaaattggaagttcgttgaatgcttttttctgcatctttgatataatcatttgatttttccttttttagtctgttaatatggtgggttgcaataattaatttttgaattttgaacggtccttgcatccttgagataaactatacttggttatacagttattactctatattgctgggttagatttcctaatattttgttgcaggtttttgcatctacgttcatgagagatactggtctgtagttttgttttcttctaatgtctttgtttagtttgatccctcgggtattactggcctactgaaataagtttagaagtgttccatctttttaattttttgaaattatatttaatgtaattccttacatgatgcaatgtttagtagaattaaccagggaaactgtccaggcctggagttttatctcttgaaagcatttaaactgccaatttaatttctgcaacagatagaggacattcaatatgtctctatcttcttcagtgacttttttttgacagctttaagatataatttacataccatgcgagtcaccctttaaagtgtacaattcagtgcgttttggtatattcacaaagttgtgtatctatcaccataatcaatttaagaataagtttatcaccccaaaaagaaactctgcgccctttagccatcactctcaaatgtccccagtccctctaggcaaccactaatctgctttctgtgcttatatatattttcctattggagtctgctatgaaataacattttatattaatggaatcataaaatatatagtgtttgactggcttctttcactcagtataatgtttccaagtattattatacttggaataatgtagtatgtatcatactttattatatagtatgtatcagtactattatactcactttagggctattaataatgatgctataagtacgcatgtgtaagtttttgtgtgggtgtatgtttttatctctcttaggtatacagataggaactgaattgctgtgtcagatagtaacacatacgtatattgtttaaaaacagtctgaccattttccagagaagctgtactattttgtattcccaccagcattgtgtccaatttctccacatcttccccaacactccttattgtctgttcaatgacatttaaaggtacgtgtccttcaagcacttggttcatttcatctagttcattaaatgtatgtgcatagacgtgtttgtagtattttattattatccttttagtgtccatggttctgtagtgataccctgtttcattcttgatattaataatttgtattttctatttctcttcagtcaacaggggaactgctgccaccactacctccaaagtggacttcattttcaaaggctaggagagttaaatgagtttcatcccatacccctaacccctgcttatctgtcctctggcctgagaaagtgttttgcttggaggttttttgtccatgcttggtgtgcacttcccagattcagcttgcagaagagtctaagccaggaaatatggggaaaaaaaggggagtccagggaacatattattgtatggggttatccttcaaactctgatttcctctccagtctgccattactttacagagtcctccaagatttgctttaagtattatgtccaatgttgtagttgacatcagtggaagagttagggaaaggtatacttactccatttttaacttgggttggtgccacaagctacccagtcccacgtatgacttactagtcacataaactgcctgacctagtgggaaaatctactcacctttctgctcatttttctttcaaggacacaatacttgaaggataatcctgaaacattacaagaacctaaagtatctttgcaatcaaaagaagattaaatcaagttcagtataattttagttgtctctaattacatcataatgtaatacaaatattttgacatcctttccaggaagaacatactttctttttaaatttaaataatgtttagattcctacttttgttcttacatcttctacctggtcttctctgacctacaaaacttataaaacttacagttgtattatgctctaatctattcctttttgcccctattcattttgttccttaacatattcctgccttgttttataaaagaatcccactatttaatatatcctcaaccacagttaaacaactgaaagatttgaatcatgctctccttctcagcacttagtttattggtatcctcacagcaagtaaatatcaaatcagttttgactgaagaaacaagtaaagtgagcataatccttcattatattctcaccctaaaatggcagaggggatagcattgcatccagacacttatatgatgagaagctggagacagttttacaggctcctcacaggtaaatgttgatagataggaggtcgtaaaaagggacagaacaggaaagtttgcacttactttcagggattgaagtctactgttttcttttttattatagaaggagatgggggtgagtggatgtggattggttcagaatatgaattatgacttgattagcctctcatttcataatggtggataagaaaaagctggtgatcctaaataaggcctgataattatctaggaatatcaggaattaatattctcctacaattatgttatagagataattaataagctaatttcttaaatgtttagttccagggtagtactccaaattttctacaatttgagtatcctgatttctggattaaatcattcccagacaatagcatcaattaggagatacatgcatacctctgttctgttttgcattaaaggttcacatctgtcatcccccccaaacattcattcttcttgagagaaagaattatgtcttatttattttgtctttattcattatttgataggtacagtgcttgtgcatcagtatagttcaatgaaggttaaagtgatcttctaattgtgatgtaattgcatgccattgtaccaatcatcttactatttttttttttttttgagatgggtctccctctgtcatccaggctgtagtgcagtggcttgatctctgctcactgcaacctctgcctcccaagttcaagctattctcctgcctaagcctcctgagtagctgggattacaggtgcatgccaccacacctggctaatttttttttgtttttagtagagacggggtttcagcatgttggtcgggctggtctcgaactcctgacctcatgatccacccgccttggcctcccaaagtgctgggattacaggcatgagccatcgcacctggccctcatcttactaaatttgttcagcatttgaaaacttttaaagcattatatctatatataaaaacactgaacttttttttttttaaactcagtcaatttctcatccctctatcatgtagctttacattattcaatatctgtacattgaaaataagggtttccacgtgtttgggaaagaggaaatctatgaataaaagttactctcatatctaatcatttgtatatcttcattgtaggaaaggcaatggcttaaagtgaagtcttccccatttttctgtgggaaatagatgttgctcattactgaacaaaaacccaggatgtatttgaatatgacatctgaattttagaaattttccaaagtcaatgtagagataatctaaaacagattatgctgaattttttggaccagtatgtgctttccaggtgggacagggaaacaactctgaggcttacctctaatgtattctttccttctttctttctttctttctttctttctttctttctttctttctttctttctttctttctttcttccttccttccttccttccttccttccttccttttctttctttctttcctccttcctttcttcctttctttctttctttctttcttccttccttccttccttccttccttttctttctttctttcttccttccttccttccttccttccttccttcctttctttctttctttctttctttctttctttctttctttcctttctctttctttttctttctttcttttttctttatttctttctctctctctctctctttcttcctttctgtctctctctctctctgtctctctctttctttctattatattttaagagatggagtctcactccatcaccccagctggagtacagtagtgcaatcatagttcattgcatccttgaactcctgggctcaagtgatcctcctacctcagcctcctgagtagctaggactgcaggcatgcaccttcatacccagctaaattttgaattttttgttttttttttagtagaagtgaggtctcactatgctgcccaggctggtctcgaacccctgggctcaagcaatctatctgtctcagccccctaaagtattgggattacaggcatgagccactgtgcccagccatcaaattcataatgttttaaaccaacaagaatcctcccctccccgcccctccccttcctccctccctccctcctttccttctttctttctttccttttcttttttcctttcctttccttccttcttcccttccacttccacttcccttccctttccttctttcttttcttttctttctctctttctttatctttctctttctttctttctatttttctttctctctctctctccttctttccctctctctgcatctttctctctttctttctttctttcttttttagagatagggtcttgttctgtctccctggctggagtggagtggcacaatcttggctcactgcaaccttcacctcctgggctcaagggatcttcctacctaaacctcccaagtagctgtgactataggggtgcaccaccacacttggttgattttctaattttctgtagagatgagatctcactatattgcccaggctggtctcaaactcctgggttcaagtaatcctccttcctcagccccccaaagtgctggaattacaggtatgagccaccatgcccaacctaaccattctttttgagattagggtagtcgcttccatcattaacctttatcatccacttaccttctgtttctttctttaatgaagtgttaaattgtaccccaccactgcattgagagaatacttttgagtgaaactttattagcctttgtaatatcagaaaagatctgtgtgacatatgcagctttaactaaaagaaaccactggttttgctcaaaacagtgatattttccagcaaatatcacagaggttcatacacaatttttttttttttttttttttttttgagacggagtcttgctctgtcaccaggctggagtgcagttgtgcgatctcagctcacagcaacctccgccttctgggttcaagtgattttcctgcctcagcctcccaagtagctgggactataggtgtgcaacaccatgcctggctaaattgttgtattttagtagagatggggtttcaccatgttggccaggatggtctcaatctcctgacctcatgatcctcccacctcggcctcccaaagtgctgggattaaaggcatgagccaccatgcccagcccacaaaattattaaaaggtaatttgataggccaggtgcagtggcgcatgcctgtaatcccagcactttgggaggccaaggcaggaggatcacttgagatcaggagtttgagactggcctggccaacatgctgaaaccctatctctactaaaaaatacaaaaaattagccgggtgtggtggtgtatgccagtagtcccagatactcgggaggttgaagtgggagaatcacttgaacctgggagacaaaggttgcagtgagctgagatcctgccattgcactccaccctgggcaacagagtgagactacttccccctgccgaccaaaaaaaaaaaggtaatttgataaattggaagctttaaagaatccctcagatagctttgctctgagagttctgtcaaatgtttattttttatacatgaagtagttttacagactaagatgctttcaaatttgcttttcacatttaattaaactgtcatctgtcattaagataactattaattagatgttcttgatatctttttaattctctaaaaaagtgactatttctgaaaaggaaaacatctttaaataaattccttcattataaacttagatcagatgacttagtctttcactatttttcttttggtataaaatacacggtttcttctaccattgtattccttaagcatgtgtaatagcgatacacttcaacaacagaatgaagctgctaaacattaggccaaaaaaatctcctttgctatatcgtgcgctgcttatcatttgaattgttaaaaatgtcttctcttcaaaataattttagtttgaagaaaggacacaaaactggtaaacctagatgctgtggactgaatgtttgtgtccctctcaaattcatgttgaaaccctaatccctaatgtgatggtatttggagatggggcctttgagaggtaattaggtcataaaggtggagccctcataatgggattagtgcccttataaggagagacattagataacttgcttcctttatctttcggctctccatcatgtagagacagcaagaaggcagctgtttgcaggccagaaagagggccctcaccagatgctgatgatgctggcaccctgatttgggactttcagcctccagagactgtgaaaaataaatctctattgcttaatccactactccatttaatttgttatagcagcccaaactgaccaagacaccagattacaataaaaaaaattaaaaacatattaggggaagtgaaaacagccctggatataaaattttgtcagaacaaaatacaaatctcagtattggttgttttctgtgatttatgttttatatattgcacattaacatatttccacttcattcagaaggtaaatcacatgaaatctaaccaagtattgctttactatattccaatccaataataacaacaataatgttaataacttgctatttatagaactaagactatgcagcaggcatttcaagagatctatatatgctatttaatggaaattatcacaaaacctctaagagataagttttattgcccttgttttacagatgacagaactaaggcttagactggttaagtaatttgcctaagatcacttattgttggtaagtattagagctaaaattataatacagcttttggttttaatatctacaaatattatttgcctactaaaccacaataaactaaattgcttagtctttatgtacttctctttcttttgacaaacctgacaaattgttcttgttatatatatataatatatatatatagcaaataattaatttcaaccattagaacaatagcaaaaacaacaataaaatcatttaaaatatggacaaaatgtccaggtgcactgactcatgactgaaatcccagaactttgggaggctgaggtgggaggatcacttgagcccaggagtttgagaccaacttcggcaacacagtgagatcccatctcaattttttaaaaaattattgaataaaaaaattacatcgacaaaacacctagttctccaggagtaaaaatgtataagattggcagaaaacttcttaagaaattaaaaacaacacttttttatattttggacattttttctttggttattttatattttggccattttttctttggttattaaaaagatgtagaattttgacaatttgaaaacagctaaatagcaaataaattaatgcattgtagacaaatgagtcttaaatttatttcttaaacgtttaagtaaaataatgtacagaggaacattgaagatctcctagttaaccctcttctagcacttacagatatggggcccatagagtttaacgtattttcacaattatatcacagtaaatctaaatctagaattttggttttccatatttcctctgtaatgatttctccacatgaccatggcacataaaatgatacttatggcaatggttacagtcctctatgtatgtctctaaaatgatgaaaccatgttgcatgaattagcaacggagaggatttcctcttccacagtattccgtactatcaataatcaactctattaaggatccctggtaagatgtgcattgtattattcatccatttaatatatacatttactgtatgtcaggtcctttgctaatgtttccagtattaaatgtcaggcgagaaaacagggaggggtataagatatatgtgcactaaaaatgtgtagtctctcggaaccaacccaaatgtccatcaatgatagattggattaagaaaatgtggcacatatacaccatggaatactatgcagccataaaaaaggatgagttcatgtcctttgcagagacatggatgaagctggaaaccatcattctcagcaaactatcataagatgagaaaaccaaacactgcatgttctcactcataagtgggagttgaacaatgagaacacatggacacagggaggggaacatcacacaccaggacctctcaggggctggggggactaggggagggataacattggtagaaatacctaatgtaagtgttgggttgatgagtgcagcaaaccaccagggcacgcgtatacctatgtaacaaaactgcaagttctgcacatgtaacccagaacttaaagtataataaataaaaaatgtatagtctatttggtgacatgggaccatatgaagcatatccagagtataagccatttagaagttgtagtaggcagcctgtaacattgtccagtgatatctgcctcctggtattcatgccctattcgcttctaacaaactgaatacagcaaaagcgatggtatgccactttagaagttatgttatacaaagatgctggcttgcatcttaggctctctctctctctctctctctctcatctggatcattcacactgaggtgccatgatgtgaaaaaatataggcagcatggagaggtgcccatttagtgaggaactgaagcctcctgccaacaaaaacatatgaataagcttggaagcagattctttagcctcagttgagacttagatgactgcagctctggccaacagtgtgaatacaacctcacaggagaccctgaccaacaccacctagcttagctgctcccaggttcatgaccgtcagacattatgagacagtaaatgtttgttgtcttaatttgctaaattttagggagatttgctatgcagcataaataactaatatggagaggataatgtctgttgcagttctcagtttttaaggaggcagagtaaggaagctgtaatttggtgggcagctcacactgttgcaggaaaggccataaaaggctgagtcagtactcatgagaaacgtttgcccattaactaatgagatataatatgcatgtcagttaggtgtaatgtgtaagttaaacgaaataaatctttagtcactaaggtttttgagcttggaaagttctctgagaaaaaaccatgattcagcaattctgactgcacaaattctatgctattgtctacatatgtgttcccccaaaattcatatgttaaaacctattcgccaatgcaatagtagtaagtggtaggacctttaaaagatgaaggtcatgatggttctgccttcatgaacagttattagtgcctttttaaaagaggcttgaggaagcttgtttgtcctttccaccacttagaacacatcatctatgagggatgcatcctccccagacattgaatctgctggtgccttgatcttgaatttctccagctccagaactgtgagcaataaatttctgttgtttataacttgcccagactaagatattttgttatagcagcctggatgaactgagatggtctaattataaaagcttactgagcaccttttaaaaagtaaataaaaacagagcagttagcaacaaaacctaatgcaaccacttgcttaactctgtatgattaaggtagatgtgtatgtgtgtatctttgtgtgtgtgtgttctagtatcttcagtgggtttttaaaataaaataaatgagttataactacaacagttacagacggtgttggataattgaaagggtttgcaaaattctatggaaactactcaaggaagacctattcaatgtaagaaatgcaacatagcagaagaaagaatgtgcagcccacacacccgggcctgggagacttgcacacctacctagagtcccttctcagtcacacaggatgtgcttcatctctgaattatgaatcttcaggatatacgtcccactgatcacatagccaagccatgctatgtaactggttagcccatgcgtaagccatcaatctacacacccctaaacattgtaaacaagctgactcttggtaccaacaaggtgatttcaaacttaaacaatgtattataaatataaactagttcaagccttcttattgtggccaaaagtcagtgtcagacctccaggtaatcatggagagttccagcccagctgtaagataactcttttccaaatgatcatttaaaacaaaagaaatcaatcattgacatgttatatatataatacatactatacatatatagttgcaacattacatataatacatatatttatatataatattgtaaatatatagaaacatatgcacatatgtacatatctttaatatatgtaatagatattcaaaaccagcataacagatgtttgccatgtgacactaaaatctggtttcttaacaatgacaaaagaaatgacaaatataggaaatgaacaaatacaaaaagttaagcataagctgatagcagtggaagccgaattttaaaattttggggtcatatagttagattcatgatattctaagcctcctgggtggggactggtagagtaatgcattttacagaggatagcgaattgctttctttatcatgtgactaatttagttattctggttttctgcatctttttaaggcttcttttataataataataataataataataataataattattattattattattattattattattattattattattattattttctgggagcccgctgactttgtattctaatgtggatccattgctttctggatctgctgggcatctgccaacttgccattttattcattacatctctgggttagaatcactatttcagcattccatgtcgtcctatttctgtttttcccatctcttgtttagtttgggcacactttcaagtcatttctcaagaagatctacacaagttacatttctgagttcttatgcacacaaaaaggtttttatttgaccacataatttggatgaatatagtattctaagatcatgttaattttctcatgaacatgaagccattgcttcattgccttgcagaactcagtgttgtgataagaagtctaacaacagtcaagcagaaactcacagctcctcagcagagccctcctgtgcacagtttagatagaggcttttgctgctctctttcatctatctccatgtttccagctgctttctatcttctggatcttttttttttccctgtgataatcctacacccatgcatttgccattaagagtttattcccttttgtgttcctttactgttattttaacgggatgttagactgggactgcgtagttatatcttttcagtttactcttgtgttagctttctaaatagatggaaaagacaaaacaaaacattgttagtaccttgactcaaagttatttgattgtaattgtggagatacggcaaatacattaataaatgcaaataatggaaaaacactaataccgatttaccaacagaagtagctattaaaggatatataaataaataacataggggagatggcaagagaagtacaatattttaacttacttcttcttccctcaaaaataatttcattttttatcaacatccatactttaattcctctttttacataagcattttgaggcatgtggtaagggaatttgtataacctttcttaaatcactacaacctacaatcaacactagactttagaatatctggaatcttaaagaaatactgccagcagtgtttataataaatgatacttttaaaaatccctatatcagcagaggaattttataatataaattgttcatttaactttaactgctacagattttggcagacagtaaaattaaatggtggatgatcaccagaatatattacattttgcaagatagcactgggttactaatacatttcaggagaagaaatctcttcccaggtccttaggctgctgtgtagtattattaagcagtaatactttcttttgtaattgatgaaagaggaagctgtaaattaccatgagctagaaattttgatttgtgaagtgaaaatatatttcagtagaaatcatggcttggcacacagtggaaaccgctttccagctgtctaaagtctccttggctttattcgaactacttctatcctccctgagctggttaactggacacctgatcgatgtccacttgttctgctctcagaattgttcttccaattgtggctatctttagaatatcctttccacctttagtcaagcaatctttcttcattgatgatcttatgatatctagtgtttacagtttttttgtttttctattatactttaagttttagggtacatgtgcgcaacgtgcaggttagttacacataattttttcccaagtgaaagagagctaaatagaatttacccatgcatgataaacaattaattgatttcattgaataaaatattcacatctattaataaagcttgtagataacattgtcatttgcaaatgttggccggctaatttgtttttttcttagcaacaatatgccctttcagcatttgcttttacgtccatgaagtctgatagcataaatgcaatataccttatttcggcaacagctataggtactgctcacctaagaaatgcttaattcttcatttactaaacttgctcgtcttgaaaacgtggcaatataattatacccattgtaaccacccccacccaaccaggactacatctgaggaatcacataaaaattggcatgaaagacatagttgggaagagggtggggatgaaatggctaaagctattgtcaattaagttctgctgcctgcaccaattacttaccaccaggggaaatgcaatctgatttacacactcgaattcacatggtttatgttctctcccaaactagaggaaagaaaatctaagggacataatatcttggtttattctccagcctcagtgaccttgaacctcgaattaagttttacagatgagtatataaaagttttatcagctcacatcaataaatatataaccagacttttctggctatatataaagacccctaaaaaagtaaaattagctgtctttgcagctacaggctattcatacatgaaatagatacttgcaacaactgaagggaattgtttcattagtttcataaatctgatttttgagatgaaatggaagagagaagccttctgccagtttgtctacatttttaaaaacatacactatgttatggtttataaaacattttacagtaattatctttcaaagatacttaactattggattactcagtagacagctatctagaacagagctcctaacagctctggtgaggcatattggtgtgtgttagtgagaggagctttcagatcttgagctccttagctctcaaggtagctgggaaggagctaaaactgcttgataactgcagagcctctgatcccctcgggccttgagcagccacttcttttctcccagtggctgtgcaaacattatgattttattttatttttttgagagacagggtctcactctgttccccaggatagagtgcagtggcacattcacagctcactgaagcctcaaactcctgggctcaagtgatcctcacacctcaacctcccaagtatttgggactacaggtgtgtaccaccatgcctggctaacattttttaattactattttcttcttttgtagagctgggtctcactatgttgcctaggctgatctcgaacacttgggttcaagcagtcctctcacctcagccttccaaagtgctgggattacaggtatgaaccactgcccagcctcaaacagtatgatcttagaaaacactagtctatgctgttacaaagaatgtctcatacttagtaatcttaaaaattagtgaagtcaaagtacccattccgttggatttaaaacaaaatataaagttcaattcagtatcactctacatttgaacaataccaggatacagatgtgttaaattttgtcattgtagttaaagaaagaagaaacctcagtatatcactgaagggtaaacgttccccctttttgaaaacctgcatagactcctttatacttttacatatacagcaaaacaaacattattttatgaagctagtgtcttggccatagaatcatattcacatcatatattctgctatggcatgtcttccctggaatgtacctcaatttggagtggtatcataataccttgtttaataaatctaccagaaataaagcaggcttttatgcttgttttaaaggtttcataaaccatctaaaagaattggctttgcaacaagctgctgaagggcaatgttcttggttgcataatatggatgcaagtagttccattgtcccagtgatgtccaattaagttggcagcatcaatcctcaatttcctttctctgggtccttttgcttcctcgttgataatcatcctctcctgcttctcatcatccccaacttccccctttgctaacagacttcaaagccctttattatgcagggaatatgccagtgtaagagtcttagtgtgaggcagagcactgtctgcaaagaagctcgaaggccaggtactcacccctatgcatgctgacagccaaggtgtgggcacatgatttaaactctactaagataatgcttctggcactggaagttgagtttaaagcaagtgaggcaaaagcagggatattttatgatttattccagtggtagaaccatctgaaatgtggtagcgaataaatgtaccagctgtgtggtccagtgtcataatgttatgatactgttagtggcattaagtgttcagagggggctggaatggtactttgaaaagctattctttgggatgactttaactgtgttcctatatgaagtgtcccttgcagtctgccagttttttcttcttgttctccagtcttcctgtgtttttctgcctaatttagccattcttaatttcagttctttgcaacccagaaccaaaactaatacttaatacttcatgtctaatctttttaaacataaattatttttctattgccttcagcacataaagatccatagagtaaatctgaattagtcattttacagaaatacgggaaagtaggatcagaatgaaagatgtgacctctttctctttctagatgatatcttgtttcccaggagaagatccatatgaggctagtcacaggtgttctagagttacagaagatacaagacctctggaacacctttgcactggtgaataaccacacagcatgttcccattctctggttcatcttccaattctcccttcttttcagcccatgccaattcatctccactgttgttaacccatccttcatttagcaaaaatctcaaagttactgtattagtctgttctcatactggtctcacactgatatgaagaaatacctgagactggctaatttataaagaaaacaggtttaatttattcatagttccacatggctgggcaggcctcaggaaacttacaatcatggcagaaggcacctcttcacagggagacaggagagagaatgagtgcccgaaagggaaatgccagatgcttataaaaccatcagattttgtgagaactcactgtcacaagaacagcataggggaaaccacccccatgattcaattacctcccactgggtccctccctcaacaaatgaggattatgagaattacagttcaaaatgagatttgggtggggacacagccaaaccacatcagttacatattttacatttttcagatatggcagtatctcaacccctctttatgattctttaatatccactcttaagccctttatattattcctcatttaacaataaaatttctatcactgtgtcagaatatattattttttaaaaaataaggctataccaacagtgtcactttagattactccatgtaccatgtcaaaaaggtgagaaaagattttgcatcacacaatacatattgaagattgcagtttttatagcattttcttttttctgacaagtttgtatgttcatttacttaaaatggcaagataagaatcttgccattcttattttagttctttaactggatccttagtctcttaactagatctgggtcctatataaatccagtcttccttggacagaaaatagatttttccactcagaagttctaacagctactttcttcaactcataatgtcacctaaggtcccacactcctatgggaacagaagcacttccacggtcatgagatcttactcttctttagagaggctgagttgtaatttaatttccaactttagaattatcaacacgaagacacacagttatccaggttagccaagtgatctgcagacagaaacctcttgttaatgctctctaattgtgttaaaaaaaaaaaagagttatattaacgtctaatccaaaaggcagaaaggatataatttgaaagcctgttcagactgcttaaaggggaggaaattcgccaacaatggctcccaaatgtgaaagcacagttactaccccttacagggatttgctggaagcattaccaaaattaggttcagtcagatctttcaacagacgtagttcaatgatggttcttgtaagtaattgaatacacaatattcatgatcaattgttcaaaagcttgctaaagaaccttttaaaaatctgaccccaagttttctggaagtggctaagatctaactctggacagtaatgaatcactttcttaatcttttctctgccccatcctttgacacagcccactgtttccaggggttgttttcctcctgaattgggatgacaacctattctcctgcttaactagactgtatcacagtgtaatcttgcagtacattttaaatttaaattttggagaaggacttggtgatcattgatcattgggcccctctgctatgtgtagatgctaccggggaaaataaaaataaagaaagtgtggtgtctgtctttaaggacattacaatctagtgggagaaacttgtatgtaaatggctgattatgatcaaaggcaaagtgaaataaacattaactagaggacaagctcatagtaatacagataatggagcaattaattctaactgaaagggaatcaaaagctcctttgcaaaggtggtggcatttgagaaagtgtttagaatgattatattttaagagggcagtagagaagaaaaggcaatcattccaactgcagggatagaattagcaaagccttagaagctcaattcaagagatttcgttttgggttttgatttttttttctttttaattctaacatacgacacaatggtaggccctgggagagattcaaagaaaaataatatgagtgtctttttctcctgtagctcatattccattttgaaagaaaagccttttttttttttttttttttttttttgagacggagtctcgctctgtcacccctgctggagtgcagtggcaggatctcagctcactgcaacctctgcctcctgggttcaagcaattctcctgcctcagcctcccaagtagctgggattacaggcacatgctacaacacccatctaatttttttgtattttttctagagacggggtttcaccatgttggccaggctggtcttgaactcctgacctcatgatcctcccgccttggcctccaaaagtgctgggattacaggtgtgagccaccacacccagaccagaaaagccatttttatgacagtatatctgaggagttcatcaagagcatatacttgtctgggatgatgtaattgagttggcacgtcccttaagagctacagtgcacgagaacagaaagaattcattattgccaaagatttctagaggacatgaatataagctttttcttgaaatatgcatagaatttgatgtgagaaacaaggggtagagatatttaaaaagagagtgatggcagttaataatcttggcatgtccccgccattgtggaagtattaacttaagtgttgtggaaggtgccttttggcccacatcagaaaaaaaaaaaaaaagttagaaataaaattttaggtgaaatcaaattcctccagagttcaagaaggtaaactgagtgaagaagactggggctataatgagacagagtggaagagactatggcatggtagagaccatggccaaggctcagtgaaaaagaggacaccactaagctccagccaattcccgtgaaaattatgttggtcaaaactccactggccacataaaaattctttgagtcatacctagtatgtagactactaattttcaaacactgccggactgcagagggtaaggactgctagaactaaaacctttagtttttataaatatttaagattgtaggacagagctgcaatgccaaaaaaaaaaagcatgttttaatcaagctacaaaatgcaagatatgtatatgtaaaccatattaaatgaaagggaattgagaggggttaccaactgctattaaagttttttcaaactacgttttaaatgaaatacatcttaaaactctatctgttgcttaaactggagtaaacaatttacaacaaaattttagaaaaatttattggctcaaaatttctttcaactgtctcatttgcctttgagacaaaaaacatgtaactatatggcaattgttcattctaagaaggtgggaattctggatacacactttccagtctcggcctcatcagatacttgatgaatgaacctgtatttgccatcactgccagttgccaacagtggatgccaccaggatatcttggtcagattcatttatgtacctgttctgttttggtccatgagcctggcaaacagtaaaactaggtgggggttggaggtttgcaacagctgctctggggcctgctgattcctgaattttatagcgttcataaatcacacaaaaatgtcttatgtccgtccacttccagtttaggtttttccccaacgtagtacaaaagaactgaagttgacactaagagtataatttgtaagccttcacaatacagtccagaaggtttattatttatttaaaaagctaatatattctatattctctattaagaattcctgacaggaggaggagcttagtaacagggataaatggggtggaataaagaatttcacatgaagattacaatattatgcttctatctgggtgaaatgtagcattccagatgttgactacatttcactagagtttgtgaacaatataaattcctgagatataataggtcagccctgcttcttaatgctgagaaaacacttagaagatcatcaaattttgaaaatgtactaatgagctacaaagtctgattaaaatcaaaggtgctatgttctaaaaaccttctttgtgatttagataagtatggcttatatttcatcatttatgacaatactttaaggcaaactttgcaaagacggaaaagtcttggtaataaacaacaattcactatagctcctcataaagtcattttcagaaagcagggttaaatcctgaagactgtataaaagaaaaggaaacacagagaaagacagtccacagatattactgttcacttgctaaaaagtaaactattaaggcctcataacacaaaacatgatatttccaattatttaatttggcaattatttataactaataagtccaagatgtgaagcagacgcaaacaacgatgaacatctcctgttagtaaattctggaggatagagtagtgggaagtatctttcatagacaatgtctccatgggaaagaaaattttcacatttttcagctttggttaagatcaaactgatctaattagttttctcatctaatttattgctcagaattccttttagtaaggcatgcttttcataaatttcaaagaaggctatttggagaatagtttggaattagacataaacaaaaatggaaagctttttcaaagatacaccaaaatttttctgagtaactaaaataacaaaattgggacatcataaactataccgttacgctaataataagatgctgtttatacataataacccaggattattttatattcattatatttgggatataggacataatttatctagagaattttaattaaaattatatacaactaattagaagaaaacagatttttttctcttctgaatgtgataatgtagccatatggattagctatctagaaaggttattataaatcaaagaggtattaataaacttgcaattaagtgtttaaataactttgtttcattattttctgatctcagagtgattgcaaacagtggcataaaactgtaaacctggtacctcaaacagaattatgatcataaagtatgctcacaagactaacacgattataaaactgagacagaggcaaaatattagtcctcctagattttacctaaccaattcctgataggaaatttttatttgtctaaaaaaaaaacccctgttacattcttcttttacttacattctattctcagaaggtagaaaaaaatcagggacacagaaaactctgtatgtggttttgaccaacatgaaaggagtgcttaaatttagttagggaagagatactgaatgaccagagcacaatcatctttttaaacaagtaaatatattgccataacttattgaaaaagtaactactatgtgccctattgataccggtgactttgaggagtggatatagcaatataaatttaataatatcaagagttttatctttccttaccacattgttagcattgcattattttagaaatatttcaaagagatagtaagaaaattacataccaagattcatcaatgattttgtttatcaacttgctagaaaaacagcaaaactgatcatcaattccctgcaaaccttgctaagcttgccttgcagcatagcacttcagacctagtctctagtgaatattattcaactgttggtttgtttctcttaattcatttcaaggagtggcttcaaatataaaagaaaaattaaaaaaatgactcatctttgtcccttctactcttttggctaaacaatgtgcatatcaaatttcatattccatatgcataacatgaaaaatgattctccaggatcgatgacttaaggttggaatttcaaatattttaggaatcacagatgcaccatcaccctagtgtgaggaggcaatagtaaaaattctaacctgaggatttcacaaattcacaaagggttttcccaggaaggagttctgctatcatgacttataaaaatagttgattgtcctcattgtttttgaatccatatgaattcagacacttctgtaagtttcttggagaaaggttaacaatagtgttaaaatgccatttcactgagggattcaagaactaagcatttgctggctggtttttcgaaaatactaacctgagtgctgcaatcaacacaaaagagtggttccacatttcttatgcaatcaaagaagattatgtgcaagaacaaattgctgttttgcaaacagactgcagatgaaggtaagagcatttctctggaaacgtaggacagacttgctgtgtttaagtaatgtaaacaaaaacttagggatatcaatgatacagttaacagagggtttggtgactatcacatacttgataccatatcagcctaattatatctcctaatagataaggcattaatgaacattctaagtggtttctgactaaggcctgtgggtaatttatataacgcatatatttatagaagacctctttttaccaatgaatatatttacttctcagtgataaatttcaaatcgcataaccaaagtgtgcaagcactgtatagcaatgtatgtcaaaagaagcaacacagactagaatctttcccacatgtatgaatattcgtagctatgtagattcaaataagagaaattgtgcagctgttattggcaactgacttaccagtacttgtaaggaagttaacatttctcattacaccttccgtgtaagcccctggctcgtaactgtccatttcacccgtgacgatgtgagcaactcttgctgcccggcctctgatagcacccgcagcacggtctaaattatcagcatcctggtctcttaaggctatgatacacttgttgacatcttccaagatatggctttctgtaagtaaatgaatcaaattagtttttgcgtgtgtctgtgtttaaaatcatacaaatctagcatattataattatgttaacttctgacttcagatagagtgcacattggaaatggaagactttgagaattataaaaaaattggagacatattttgcttacatccctttattctttaatagcaaaatccatgaaatataacatgttacatttttaagagaaatttgtattgactgcatattattttagattctagttccagtagattagattttagactgacatagaggtggaaattaaagacagtttctagattaaaatgaaaacaaaatatgtgatgatgaaattctacatcgtgaatgaaagcaatattatacagattataaaacttatatatacataagtcttttaaaagatggatttaaacaaatgaattccagagaaagttgcctactctgaagagtgtctcctgacctcatcctctccattctttagatgactaggccatgaagatagcaggaagttactatagcacagtaatattttctttcttcataaaatgattaatactcccagctaaaactaatgaatgaagatgcacaaatatgtggaatatcaacaaacatggtcaatgatatttctaacaaattgaaagaatattaaaagaattagtgttctggcttctggctttatcacatgaatccccacttaatatctttaacgactatttctttaaaacacacacagaaaacaattataacaataagatctcagtaattccagaacatatcattaattctctttctctctttttttgtccctctcactctctctgtctgtgtctctctgtctttctctttcccaatctgcttgtgtatatgtgctgactatgtgtgtgtttgctacaaaggacaattattcttcagttttctttcagagtcacacttccctcttgtcgtccaaaaaataaaatcagtctgggtgtggtggctcacatctataatcctagtactttgggagacctaggaaggaggatgacttggggccagaagttcaagaccagcctggaaaacacagcaagaccctttctttacaacaaaataaatttagccaggagtagcagcatgttgctgtagtcctagttacttgggaggctgaggtgggaggattgattgagcccaggagtttgaggctacagtgagctttgatcatgccactacactccagcctgggtaatagagtgaggccctatctatctatctatctatctatctatatatatatatatattaaattaattatatatagttaaaatttaaatgtatttataaacataacattatttaatcatatatgtattcatatatttcataatgatatgttccggaattactgagatcttactgttataattgttttctgtgtgtgttttaaagaaatagtcattaaagatattaagtggggattcatgtgataaagccagaagccaaaacactaaatatatcctaaatatatacgcacccaatacaggagcacccagattcataaagcaagtccttagagacctacaaagagacttagactcccacacaataataatgggagactttaacaccccactgtcaatattagacagatcaatgagacagaaggttaacaaggatatccaggacctgaactcagctctgcaacaagcagacctaagagacataatttttgaaaaaagaaaataaagtcaaactaccattgaatatggtccctgttaaccttctgagatctggcttctattattctgttatacatattttatgatttccaaaatccttcatgatcttccatgcctctgtcctgtgggcatattagaaccttggcctgaacagtctgtcccctttgacctgcttgctcaactcctactattctttcaagccactaggcaaatgttcctgcctcaggaaatgcatgctgacctcctcattctctacaacaaaaccaactttgttccatgttgtttaggattcacataaaatggtttatgtgcctcaattagagattctacctgtgttttaattatttacttttaaaaatatctctctagtagaatttgaaatatatctgagggaaagaattttatcttattcctcgaggtattctaagtagtacttgttataatacttggcacttgttaggctaacaagaatgcttgttgaatgaatgaatgaatgaatgaatgaagctctcttataagacattcttaaatcatgggctatgaacctaagtgaacacatatctgttatctgaaattagataaatttaacccatattaaggacatttaaagtcacttatattaaaaatattaaacactgaaaaccttcattataaattaactagggctttaacctaatttgcagcattcagttatgaatgtatcattaagccctacagtaaatacagtcatggtccaatctcaacagaaagcatatgtatattatcatatttcccctggaacagaagtataggttggaccttagaaggtatagtaatcatcaatttttaagaagtccacagatgtacactttaatgacacattaagaagctaccattttcacctaaccaagatggccaaataggagcagctccggtctgcagctcccagtgtgattgatgcagaagatggatgatttctgcatttccaactgaagtacctggttcatctcactgggactggttggacagtgggtgcagctcacaaggggtgagctgaagcaggacagggtgttgcctcacccgggaagcacaaggggtcagcggatttccctttcctagccaagggaagccatgacagactacctggaaaaacagggcactccctgcccaaatactgcgcttttcccaaggttttagcaaccagcagaaaaggtgattctctcccatgcctggctcagtgggtcccatgcccatggagccttgctcactgctagtgcagcagtctgagatcgatctgcgaggcggcagcctggctggggaaggggaatctgccattgctgaggcttcagtagataaatacagtggccaggaagctcgaactaggtggagcccaccgagctcaacaaggcctactgcctctagactccatctcttgggcagggcacagctgaacaaaaggcagaagacaactttggcaggcataaacgactctgtcagacagctatgaagagagcagtggttctcgttctcccagcatggtggttgagctctgagaatggacagactgcctccttaagtgggtccctgacctctgtgtagcctaactgggagacacctcccagtagaggccaacagacacctcatataggcggctgcccctctgggatgaagcttccagaggaaggatcaggcagcaatatttgctgttctgcagcctctgctggtgatacccaggcaaacagggtctgtagtagaactccagcaaactccaacagacctgcagctgagggacctgatagaaggaaaactaacaaacagaaaggagtagcatcaacatcaacatcaacaaaaagatcatctacaccaaaacgccatctgtaggtcaccaacatcaaagaccaaaggtagataaaaccacaaagatgggaagaaaccagagcagaaaagatggaaattctaaaaatcagagcacctcttctcctccaaaggatcgcaactcctcaccagcaatggaacaaagctggatggaaaatgactttgatgagttgacagaagtaggcttcagaagtgtggtaataacagacttctctgagctaaaggaggatgtttgaacccattgcaaggaagctaaaaaccttgaaaaaagattagatgaatggctaactagaataaacagtgtagagaagatcttcaatgacctgatggagctgaaaaccatggcacaagaacttcatgacacatgcacaagcttcaatagcagattcgatcaagtggaagaaagggtatcagtgattgaagatcaaattaatgaaataaagtgagaagacaaggttagacaaaaaagagtaagaagaaatgaacaaagcctccaagaaatatgggactatgtgaaaagaccaaatctatgtttgattggtgcacctgaaagtgatgggaagaatggaacccagttggaaaacactctgcaggatattattcaggagaacttccccaacctagcaaggcaggccaacattcaaattcaggaaatacagagaacaccacaaagatactccttgacaagagcaaccccaagacacatgattgtcagattcaccaaggttgaaattaagggaaaagtgttaacggcagccagagagaaaggttgagttacccacaaagggaagcccatcagactaacagcagatctcttggcagaaaccctacaagccagaagagagtaggggccaatattcaacattcttaaagaaaggaattttcaacccagaatttcatatccagccaaactaagcttcataagtgaaggagaaataaaaccctgtacagacaagcaaatgctgagagattttgtcaccatcaggcctgccttacaagagctcctgaaggaagcatgaaacatggaaagaaacaactggtaccagccactgcaaaaacatgccaaattgtaaagaccatcgatgctatgaagaaactgcatcaactaacaggcaaaatagccagcgaacatcataatgacaggatcaaattcacacataataatactaaccttaagtgcaaatgggctaaataccccaattaaaagacacagagtggcatgttggataaagagtcaaaacccgtaagtgtgctgtattcaggagacccacctcatgtgcaaagatgcatataggctcaaaataaagggagggaggaagatctaccaagcaaatggaaaacaaaaaaaagcaggggttgcaatcctagtctctgataaaacacactttaaaccaacaaagatcaaaagagataaagaaggccattacataatggtaaagggatcaattcaacaagaagagctaactatcatatatgcacccaacacaggagcacccagattcataaagcaagtccttagagacatacaaaaagacttagactctcatacaataataatgggagactttaacaccccactgtcaatattacacagatcaatgagacagaagtttaacaaggatatccaggacctgaactcagctctgcaacaggcagacctaatagacatctacagaactctccatcccaaatcaacagaatatacattattttcatcaccacatcgcatttattctaaaattgaccacataatgggaagtaaagtactccttagcaaatctaaacgaaaagaaatcacaacaaactgtctctcagaccacagtgccatcaaattagaactcaggattaagaaacttactccaaacaacacaactacatggaaaatgaacaacctgctcctgaatgactactgggtacataacgaaatgaaggaagaaaaaaagatgttatttgaaaccaatgagaacaaagacacaacataccagaatctctgggacacatttaaagcagtgtgtagagggaaatttttagcactaaatgcccacaagagaaagcaggaaagatctaaaattgacaccctaacatcacaattaaaagaactagagaagcaagagcaaacacattcaaaacctagcagaaggcaagaaataactaagatcagagcagacctgaaagagatagagacacaaaaacccttcaaaaaatcaatgaatccaggagctggttttttgaaaagatcaacaaaactgatagactgctagcaagactaataaagaagaaaagagagaagaatcaaatgaacgcaataaaaattgataaaggggatatcaccaccgatcccacagaaatacaaactaccatcagagaatactataaacacctctacgcaaataaactagaaaatctagaagaaatggataaattcctcgacacatataacctcccaagactaaaccaggaagaagttgaatctctgaatagatcaataacaggctctgaaattgaggcaaaaattaataggctactaaccaaaaaaagtccaggaccagaaggattcacagccaaattctaccagagatacaaagaggagctggtaccattccttctgaaactattccaatcaacagaaaaaaagggattcctccctaactcattttatgaggccagcatcatcctgataccaaagcctggcagagacacaacaaaaaaagagaattttagatcaatatccctgatgaagattgatgtgaaaatccttagtaaaaaactggcaaactgaatccagcagcacatcaaaaagctcatccaccatgatcaagtaggcttcatccctgggatgcaaggccggttcaacatatgcaaatcagtaaacataatccatcacataaacaaaatcaacaacaaaaaacacatgattatctcaatagatgcagaaaaggcctttgacaaaattcaacagtgcttcatgctaaaaactctcaataaactaggtattgatgggacatatctcacaataataagagctatttatgacaaacccacagcccccaatatcatactgaatgggcaaaaactggaagcattccctttggaaactggcacaagacaaggacgccctcactcaccactcctactcaacatagtgttggaagttctggccagggcaatcaggcaagagaaagaaataaagggtattcagttaggaaatgaggaactcaaattgtctgtgtttgcatatgagatgattgtacttttagaaaaccccatcatatcagcccaaaatatccttaagctgataagcaacttcagcaaagtctcaggatacaaaatcaatgtgcaaaaatcacaagcattcctatacaccattaacagacaaacaaagagccaaatcatgagtgaactcccattcacaattgcttcaaagagaataaaatacctaggaatccaacttacaagggaagtgaaggaccacttcaaggagagctacaaaccactgctcaatgaaataaaagaggacacaaataattggaagaacattccatgctcatggataggaagaatcaatatcgtgaaaatggccatactgcccaaggtaatttatagattcaatgccacccccatcaagctaccaatgactttcttcacagaattggagaaacactactttaaagttcatatggaaccaaaaaagagcccacattgccaagacaatcctaagcaaaaataacaaagctggaggcatcatgctacttgacttcaaactatactacaaggctacagtaaccaaaacagcatgatactggtaccaaaacagatatatagaccaatggaacagaacagaggctcagaaataatgccacatatctacaaccatctgatctttgacaaacctgacaaaaacaagaaatgaggaaaggattccttatttaataaatggtgctgggaaaactggctagccatatgtagaaagctaacactggatcccttccttacaccttgtacaaaaattaattcaagatggattaaagacttaaatgttagacctaaaaccataaaaaccctagaagaaaacctaggcaataccattcaggacacaggcataggcaaggacttcatgactaaaacaccaaacacaatggcaacaaaagtcaaaatagacaaatgggatctaattaaactgaagagcttctgcacagcaaaagaaactaccatcggcgtgaacaggcaacctacagaatgggagaaaatttttgcaatctacctatctgacaaagggctaatatccagaatctacaaagaactcaaaccaatttactagaaaaaaaaacaagtccatcaaaaagtgggcaaaggatatgaacagacacttctcaaaagaagacatctatgcagtcaacagacacatgaaaaaatgctcgtcattactggtcatcagagaactgcaaatcaaaatcacaatgagataccatctcatgccagttagaatggcagtcattaaaaagccaggaaacaacagatgctggacaggatgtggagaaacaggaacacttttacactgttggtgggtgtgtaaattggttcaaccattgtggaagatattgtggcgattcctcaaggatctagaactagaattaccatttgacccagcaatcccattactgggtatatatacaaaggattataaatcatgctacaataaagacacatgcacacgtatgtttattgctgcactattcacaatagcaaagacttggaaccaacctcaatgtccagcaatgatagactggattaagaaaatgtggcacatatacaccatggaatactatgcagccataaaacaggatgagttcatgtccttttcagggacatggatgaagctggaaaccatcattctgagcaaactatcacaaggacagaaaaccaaacaccgcatattctcactcattggtgggaactgaacaatgagatcacctggacacagggtggggaacatcacacactggggcctgtcaggggatggagggctgggggagggataacattaggagaaacacctaatgtaaattatgagttgatgggtgcagcaaaccaacatggcacatgtatacctatgtatcaaacctacatgttgtgcacatgtaccctagaaattaaagtatagtagtaaaagaaagaagaagctactattttcaagtatattggcaaggtttctttttttaaaaacaaatgcaacatatatgtattcaacgaatgtttactctgtattcactaaggtgttcaattttatattgtagagctattttcttagtcctataaaagtgaaagaatatttacagtaaaaacaatgtctgttcttggaagattaataatatataatacactatgtaatttctctttaattaaagatgaaatgatagcttgtacaaactattttttccccagtgaattttgcagaggagaaaatatacaaagaatattcactaacaatgaatgagtagtcacctcttctgtagaagtatgatctatatgcccatgaatttattatttaaagcagtgaataaaaatatagcaagaatttttctggttctttttttgtttggctttgcagaaggttgtgtgattactgctcacaattaaataatcctgtctgaggccatagtgttaaatcttgttgaagaattatagatgtaaggtcagatatggaaataaaagtcttatataaacatatgatatgaaaaaattataaataaaataacgaaaagaagctataaccagacttaacccaaagcagctatagtaagaatattagagaagatgtgtaaatgatctttgaaattactaagattaaatatagcacaaaataattagaaaaggttcacaaagtttgtattactgtgacacgttcccattaccctgaatgctttacagaatgctaggaacaactatttgcatgaagctctaaacatagaatgcccgaaaaagaaaatcaaaatgttaggtacctcccacatatgcacaataactaaacattaagcaacttcttaaaaatgattatttctctgctatttatatttctggtgaatttaagtggctaaaagaacttcatgaaggcttgagcttttatgcctagctacacagcctttaaacttttaggaaagaaaaaaaatgccaaataccttgtatacaacttcctactgttgaatctctttagactttgcttctgatggaatgggtttactctttaaacacagcaaaagtcatttggttctctcctcaaaaattttttttttctgaagtagatgcacttgaactcaacaaatgcatcatttttaaaatgaggttaaaagaaagagaatatgttattatagaacaagcacatttagaatattatgttttgaaggattgtcacatagtgaagatttttcttaacagcttcagagtatcagcttaacatttgctctgaggtgaggggtggaatgtcctggtgttagcgtaaatgctgaaatgcattcatttaagagcagacaattggtgaattattagcaatttctatcaatcatttttatagccatcttgagatgcaaagggtgatttctattttgttggaaaatagtaatacatgggataataaaggaattgatgttttactaaaagatactttgtttggtgcaagcttctctggctaactccatcttcagtcaccacaggaagtgtagcacaataaaattttgaaatgcatttttaaaattataattttttctagttgttcagtttcattcatatatatatatggagagagagagagagagagagagagagagagagagataaggtctccttctatcacccaggatggggtacagtgccataatcatagctcattgcaacctcaaactcttgggcccaagtgatcattccacctcaggctcccaagtagctagaactgcaggaactcaccgccatgcctggctgttttaattttttatagagacagggtcttgctacgttgctcaggctgatatcgacctcctcgcctcaagcgattctcctacctcagattcccaaagtgttgagattactggagtgagcccctgcacctggccagttttcaacagttaaagccagaatttaaaggtcaaatctattgccccagggaaagtagaaaacaaacaaaattcagtgaaaacaaaatgttaaatcactggctttctacagccaaagtagaattttataaatctatagtccagagaacagactgaaagtagcagcacattttgtttgcaaaagctagattggttcagaggtaaaagtttctccttttaattcctgaagtgggactttgaatacatcaacagcaaagccttaaggggaagagagtttatgctataatccatcaagcaagaaatgatacactatcaacagtttcctcccctgatatctacatacacaagaaaaagattcagagaagggaagaagagagaaaaagatattaactagtttttctggagaaactgagttataatgcaaaatcgattgaattttctaaattgtcaagattaattctagctacccagtgtatatgagctaagagacttaagctaaatttaattataaaaaaaagtttccatttttgcatacctggctccatagctataaattaaaaacacattacataggcaactacataaatgttcaacaaataaaaacaagaatacagtaatttttctttcccatttacccaacatacatgaaactaaaaagcaaatagaatgcattagtgtgtgagttaattgttgcttatctatgtacttacagaatttgtttgtcaggagtttgactatgatgattggtttccaaattaaataatatcccacagaaagatctaagcaaaaactagcttgagaatacagagtatgcatacagttaaatgtaaaatgtaaagtcccttcttcctctttacctcctaaatcctttcttctgtctcttctttccaaagtcttaatatatgttagaaaatgtagacgatataaaagataaagtacagtccctgtctgcaaaggattcacaatctagtaaccagaaaataaagcactttgtattttattgtcttttattccgcccaatacaatagtcaaaattgtagtcacttggtaattttacaaaagttttgttaaactttaacaaaatttgcccagtttctttgcactgaaagctgcttattctttcgcttttagacagctcgaatttagttgacttacttttgaaaattattgaaagaaaaataaagtccaatattgctatttacaagccaattatcaacaatacttatacaaactctgcagcacttattcacacacaattctatagaagaacacacacacacgaaaaaaaagaaagtcattgaaggcttcatatttctctcaatatgtcttaagtaggctcttgtaacaacttgtgtagttgttaagaaatttatcaaagcttggaaacagaaaaaatggactattgcttgtccttttaatgtcctgttgaacagacattgcaatcaggcccacctggcaaatatctaattctcaaggagtgtgtatctttgttccacttgctattagtgtcgatcaggatattttaaaactctgtaagagttaatgctctttaaaaaaaaatttgatgaccatgtaaatgattcttgttacaaaaagtgttatttttgtagaaaagataatcctaaaggctatagcttcattgctctgtaggacattaaccagttttgtttctaaatgagaaattttattgaaccattctttatctaaattttttaaacaaggcttatcattttagcgcctctcaaaaataaatttttgacacatgctcatgttaaatttgtaaaactcaggctttcaaatttataaaattatccatagactgtacaccttgacttggaagctactgatttttcaattagagtgctatccagaagaaaagatataaagcaaacattttatgttaaatcataaacctacatttaaaatgcagtactacaaagcttctgtaagataacagaggagaaactctaggtgatcttgggtttggcaagaacttttaaaatataacaccaaaaacataattaacaatttttttacaaaaaaatgaatacattggacttcgtaaaaatttaaaacttctactctgcaaaagacacttaaaagaataaaaagatgctgggcatgatggctcatgcctgtaatcccagcactttgggaggctgaggagggcagatcacaaggtcaggagtttgagaccatcctggccagtatggtcaaacccgtctctactttaaaaatacaaaaattagccaggagtggtggtccacacctgtagtcctaactactcgggaggttgtggcagaagaattgcttgaacctgggaggtggaggttgcagtgagcagagatcgctccactgcactccagcctgggtgacagagtgagaccccttctcaaaaaacaaaacaaaaaaaagaataaaaagccacagactggaagataacatttgcaaaacacctatctgatgcacgactggtatcaaggatgtacaaataattcttaaaattcaataataagaaaacagctcaattaaaaaatgagcaaaagatgcgagcagacacctcaccaaagacatacagatgacaaataaggacacaaaaacatggtcaacattgtttatcatcaaggaatttcaattcaaaacaacacatggcccatctattagaatgactaaaatttaaaacactgataacaccaaacactggtgaaaatgtagagcaataagaactctcgttcatcgctgaagagaatgtaaaatgacattttggaagacagtttggaatgccactttggaagaaatttcagcagttgcttacaaaagtaaacatacttctactatacaatcgagcaaccataccttggtatttacccagataaatttaaaacttacgttcacacaaaacctgcacatgtgtcttaatagcagttttatttgtaattgccaaaacttaggtgtaaccaacatgttcttcagtagatgaatggataaactggaacgctcagtcaatggaatgtacaaaaagcgatgaaaaatgatacatcaagccaagaaaagacatgcaggaaatttaaatgcatactgctaatgaaagaagtcaatctgaaaggctacatactgtatgattgcaattacatgtcattctggaaatggcaaagctacgggaacaataaaattcctagggagggtaaaatgtataggtagagcgtaggggatttttccagatggtaaaactattctgtgtaatactgcagtggtgaatacacattaatatacatttgtcaaaatccatagaatttacaacacaaggtgaagcctactgtaaacggtaggatttacataataataatgtatcagtattggttcatcaatagtaacaataaaggatgttcttcaaacattctacattcagtgtcaagtccattttagaccttaaataagcactgttcagcttctaaaataggaataaaaatattcaattacatacattatttacagatgtctaccaacaatgaagtaggaattgtgaacatactacaattttctgagaatataactaagaaaaagtttggtcctattctttccccaagtttctagccttcacacagtaacaccttctggttgtcaactggtttcttggagtttttaacaaatactgtttgagtctctcttcttttccaggcactgtgttgggtaacatatacataagattttgtttaattctcataataattccaagagatagatctgttacatttcatttttatagttggagcaaaatagagcctttgagctgataaatatgttctcaaaattcacaaagttatagtaatttgagtcataactcaaaatcaaggtttatctaacctgctaagtttctataaaaaatgctaaagtctcatctgacttcaagataaggtgattctataattatattattcagctattccaaatgtataatgggaagggaaaatcataggtttaaaatattttctaaattttatagaaatggtacaaaagattgtttatgctatagtaatctatagctgaatgcattataagttttcacattaattttcattgagcataagataatcatctatgcattttagaaggataattttaattctgcaaagcttacattgactatgctctggtaatgttaacattctggatctgtaataaggagccatcatagctagagggaacttcaagtattctagagacatcaccaggaaggtggccatagaagaataaataaacaaatgaagtttagtgccttagctacttagctattctggtgtaggagctaaagtctaagttattgcattttatgccattcttatcctgacaaaataaacaaacagaaaaagtgaaacaaaccttaggcattctcactcagaccatactcttttccatcaactcctctactactgagctttttcatgttaattgtcccattgcttcctctcccacagactgagaacctattaacatctaataacaaagcactgggttaaaaaaaaaaaaaaaaaaaaagaagaagaaatctttcaggatattaccagactgagcatcaggactgtcagcaggaacagacagtagtgagcaattctcccatattatgcaataaaaccattcaagtcttgcacactggatgctaatgttgaatgcctctgttgctcgattgtcttataaaaaaacagtcagtattcaatcgggtattattcctttctcatagttcaaaatacagaacaacttgagtgtccaaatataaaatctgtgcttttggacacagaaaagcaaatcccagtactgtttaaaataaccccctagaggtatatgacacatatagcagaaaagaaaccctaaacaaataaagtacaataaatgcaaatgcacagatagaatgcaaatgtacagataaaattaagaataaatgagttgctgataacctggtaaattttactaagtttttatttattttttcccctcagaataataagtatatacacagctcaattatctttactaccttcgaaaatacagtatctctccacgtgggaaaaaaaggctaacaaaagagaagaagactattagtagatatacgtcttagggaagttcactttcctagtcaatgaattaattttaaagtcaagtacagcattcttttgctgaaattcatttttctcttatattttgctcagaggtgcacaaaaattgtcagaacagatccctctctatgagacaaattctcttcagcatcatttgtaattgcttcaaggaaaccataactaaaaacttgaattttccacaggtatgacaaaggaggagtccatgaggttaaaagcaaacacaaggtatgactttttccatgcccaaatcggtatcattcacaaaatattctgtatcaccctgattgtttttatcatatgtaaattgctataaaactacatggaattggacaacaaattacaaagactaataaaaaaatacaaggcaaaaagatatggcttaaaaggtaccatgttttcaggaattcaatgtggttcatcttacctcagatttccaaaaagtctgtacttattatttacctttccatgaagtttctccatgaacctgccacaaagctttctagaagattctctaacagatcctaatcatagccattctgtaacctctgaacaagatcccaatttcaccagcatcagtaattgttctcttaagagttctctatttcttgatactctctgtaatttttatttatttatttatattgtttcagattcaggggtttcatgtgcaggtttgtgtaatggtgaggtttgggctcctagcatacccatcacccacgtagcaaaaatggtacccaataggtaatttttcaattcttgccccactcctacccttcccccttctggagtttgcgttgtgtgttatttccatcttcatgtctacatgtacccattgtttagttcccacttgtaagtgagaacttgtggtacttgattttctgtttctcagttatttcacttagattaatgccctccagcaacatttatattgctggaaaaatatatgatttcattctttttaatggctgcatagtattccatgcatataccatattttctctatccaatcaaataatagaatacaaagatatgtatttatatactattagctttctaatttaactctgaaagcatatgcaggagccaaaatcttattgaactgaataaactatacttatttagatattaaaagagggatactaaaattcccttttagttatattgaaccagttttatcctaatacatggaatgtaatcaggcaaaataattaatgatgtagtttactaaacttaattttaaaaagtattgaaataacttagtacaattttcaaggattaaaatgttaagagagtaattatattttcgcctcaattataaattgggcatccacatgaaagtgacaccttaggcttctgacatgtattaaaaccttgtaaatgaactcagtttacagcagatctagaaatgtttatgagtaatttaaccacagcttcccaacaattcattggaatagttattaagcattttaaagaaatgagtttatggatgggtagagttagatcaggaaataatagttcccaaattatcaccctcaagcaattccatttctagtaaatagtccccaaattaccatcctcaaagaaattccatttctaataaagaagatgcttttctatgcacacataagtttacagattcatgtcaaaataaaatttaaaccacagctactgattgaagtgaaacaatgattttaatttataatgcaaactaaccattggtaaacacaaataataactttatttaatagaatataacaaaccaatataagcttttcacttataaagtaattaaattacataaaaagatgcttatgacataattttaagtgaaaaaaatcaggctatgtatctattaaataggaccctcatttaaaattcatatatttatttctctacaatatagcatataattacatacattttaagaaaaatatatggaaggaaatttccaaactcctaattgtagttttcaataaatagtggcattatgagtagtttttattttttaaagcattgatatattttccataaaataatattgcatgcagtaatatacatgcattactattgtaagatactattaaaattatactctatccttgattagccattgttattaaacagagaactcttatagctaaggcttagggaactaagcaaactaccatttattaacatttatatattgctgaagtaaatataacattgatacccacagataaagcttaacatccttagttcttccagtattgttttcctctctctctttgcccaccaaatgatagtaattccaaactaatattttctatttaattagtactcatatatatattcacatggtatattcattcattcaatatctctttcattgaataatgatatattcattttaatgagtatttgcagagttcctactacaaggtattttgtgaggtgtagagaaatttcaagataaataactcactgtctttgctttaaaagaactcacagtctagtcgtagaaataagcaactaaagaaatgactccaaggaacatgataaatgccataatgtacatgggtaaacaatgctagaccatttatttttccaatgacatacttactttttccacatgtgtacatcattgcattatgtaccgtgagttgtcccactgggatcagactgatcacaatgtgtatatcttggtctttatgaaaataattttttaaaagtttattgtgtatttacaagttcctgggtgattgtgggagtaggggtggggcaattttcccatcaaaataataagtatatgtttaataggcattgctgacaacagctattaagagtttgaagacaagtaattgacttactgtgagagttattactagagtaatatttatataaaagatattttagtaagagagttttatgttacataaccaatttacaaatattattttatcacatggcttattgtttatattctctttcttttctttgcacattttaagtattttcagttggctctttcacaacttgcaaagtacaattcgtggcctttgtgtacaagatttcagttttgtttagatcagatttatgaaaagagtggcatgaaaattaaaaatcttccctgttaaagataggaacaccaatagttctcttatttcctaattatgtgctcaagaacaaattttttgtctcatacagaaacttggaaagtgaaaattggcatgaatagcagtcatatgcccagcagttacaacaattgcatgggatcagtgtaatgtatctatggtattgtatttagaagaaattcttgccaggactcaaacatgatgaaagacagtaacgcatagaacacacaaccatataataaggatcacagtaggagaaaccagtggacgtactgtaatgaggccagtgataataaaatcaggaagaaaggtaacatgacggcaaaaacactgatagaaatgagaggtacagtatggaaaagatagataaaacatgaaacagaacacttttttttagtgctaagactaaattaaaatcagagaaattataatcttctcttttactcaattcaagatcttgaatgaagatatgaaatttcttttaaaaatgcaaagagtgcagttagcctacatagcttattctccttttagttctaaacctccactgtcagaccatctaatcaaaccatcttgcacaaattcagtgttattatctcagcaaccttgcctggaaggccattccttgcatttaagcatctctgcatgaaaaacagattcacaacatctggtctgatttccttttactttagttttcattttgttgcctctttgattttatttccttttccaatcatgtctgttgaactgaaaatagtaatttcactgatatctatgttctttatttcacttcctatttttagggttagaggtctaccctgttgcttaaggttagatgtaaaataataatctgggtgactataattacccttgctttcttcatacaatttcaaatgttgacataagctttgttttcttatagtattattcacaccagacacctgagttaaaattgactgtgaatattttctcaatgctgtgtatccatgggctctgatttattttcctttcctgcatctggttgcctcttgtgtcttctgcactagtgaattttcaacattttaagaaagaaactgatcacttagaacaatattattttaacagaaaaaaaccacaagagatatataatattatagcctgaatgataaacataatacttgactttgacagtcaagagtaagtaaatgcgtgcatatggcaccctacattccatcctaatttattctgtggtatatgcgtgtgaagtgaagatgctatatattataaaatcacattaaaggaactaaataagaactggactatttttctcacacttactctgtcatcagctatcaaagccaaaatgcaaaattcctttgttccttatcctactatacagatctatgctgtcatctaaaaaacattgctgtataagacctaatatcattatattttcaatgaatagttatatgtagtgaatttaatcatgttccagtgatactgctttctctataactggcttatatgacatatgttcagctctttaagtgttaatttttataatttgctgtcaggtgccaagaaagaatatatcccctgatatggataatgtcacttctctgtcccaacaaacctaaatttatgccacttgtttataagttgtttatgtcaaaattatctccttgtcaaaacagcaaacttagaagatgaactcctaaatataataataatttacaatggcttaaaaaaattaagatcctaaaggcatacacatatgcatattcacacagacatatatgtgtgcatacatacatatgctttttatagcctattaaatttagtatttataagaataatcctgaagctaagaagctgataaaaaatgaaaacaaaacaaagaatcaaaacatgtttacaaagaaaatataaaaaatagaaaagaagaatacaaataaaccaaccataaggttcaagagaattaccattaatatcctacagatttgtcactatgctttctggcagccaaggcaaaagagaaacataatctgttggaacatgagataattagtaatttttatcatttgctttttatgtaacttaaatattctctttgtcaagctcttttgccccagtggatagctttgaagagcatatattataaatgggttattgactgaggggcctaatggcaaatgaaatcaatatacccacactaagcacttcaagctgtcgatattggcatgtgtgagaaagagtgatatatatagatatagatatatagatatatacacataatacacatattcataagtggcagctctatttccacctctctcccatgtcaattctataactgcatgtcataggtaatttggaaacaaaatctctggtagctttatccctctcttccctgctataatataaacttgtctcatcaagaaatgtttgagctgactcactttacttatttctttcaatagatagatagctatatctatcaattttattttattgctgattattcaacttttgatacctattttctcttccaacagcttcatataaaatcaaggaactctttgacttccctatgaatgaatatgccttactagtataattgggtgtgtcatatacaaagacaacacagacatagaaataagcctggtacctactgtctgataagtactgggagtattctgaattggaaaatggggactatgatcattctgaaaagaccacaggtatgtcataatatagagaagcaatcagataaagagaggcattaacatatagataaattatgtggccttattgttgtttgactaaattatgagtccttgagtgttgttttggctttgctgcttaccagttctataaacttagatatagtgttaaccataaacttgcatttcctcattaataaaatggggttaataagatttacagtctctgagacagttgtaagaattaaataaaaatatacatatagtccgggagcagtggcttattcctataatcccagcacgctgggaggctgaggcaggggattgtttgaggtcaggagtttaagaccggcctggccaacgtggaaaaaccttgtctctactaaaaataaaaaaattagccatggatggtggtgtgtccctgtaatcctagctactccagaggctgaggtgcaagaatcactgaagtggaggttgctgtgagccaagatcgtgccactgcacttcagcctggtgacagagctagactgtgtctcaaaacacacacacacacacacacacacacacacacacacacacacagcatagtagctggcatttagtaggcatgcaaatattgattgaattttgattttacttttgcaagttggttccatcattaaattattccatttctttcttttttttttttttttttgagatggagtcttgcactgttacacaggctggaatgcagtggtgtgatcttggcttactgcaacctccgtctcccaggttcaagtgattctcctgcctcagcctcccaagtagctgggattacaggtgcccaccaccacacccagctaatttttgtagttttagtagagacggggtttcgccatgttggccaggctggtctcaaactcctgacctcaggtgatccacctgcctcagtctcccaaaagtgttgggattacaggcatgagccaccatacccggcctcttttattttttagtggtaaatagaaatttagttgtaaatagatagctccaccgatagtgaggttaaaatgctcaaagtggaaaatgctcatgagacaaaataataactgatttcatctcacatgaatgtgaaatacctcagataaaattcatttgttcaatataatggttattatttcatgctgtattttatattactcataattcaaggaacataagaaagtaatcactaacccaacagatatacaatattaaagagactgtactgaattaaattagttgcattttttattatgagaaccattgattagatgcatagagtttattaatcctctggctgttcaaccctctttacctgtatatttccctgctgactgtgatttccttgaggaaaaacactttgtcttcttcatttattaaatgttcagtaccaaaaagagtgtcaggaatacaataagcgttcaataaaagttgttcaaatgaaccaatatcatacattggctttttcttacatttttatttcattaattactttgtaaattattttcagtttactcatatgtcaatatattaacagttaacagagacctgaaatattattgagatagagcagggataccactttttaaaagcctatggatctcaatcatggacataaagacaaatgctgagtttctaggatggaaattctaggaacctagttagtcctagaaataaataaggaaaataaggaacttgttaaacaagaagataatcgtagcctaaaacaacagccaaggaagttagagttccagagatgcttgctttctgcatagaaacttatggtaacatcttaatgtcactgagttgtctttcagaaacttggacccccacagggaaccccccacctaagggatccactggcatgaagacctcagataaggggaagtgaagactgaactttaatcatcatatttgttccaagttttttcccgagggccttggagaaagtcactccccctacctagttaacatttttctactcactccaattcttaaacaaacttctctgccttaaccaattgcaaatcagaaaatcgttgaatctacctatgacctgtaagcccctgcttcaagaaatcccacccttttaggcctaaaccaatgtgtaacctccatgtattatttatgattttgcctgtatcttctgctttcctgacatttacccttgcctttagacaaccttgtgtgcaagccatcaaggagatcaggatttgagcatttagctgcctggtcctccttgcttggcaccctgcaatgaaagcctttctttctatcactatcctggtgtagatatctggtatattagtccattcttacacctctataaagacatacctgtgaccaggtaattgataaagaagaattgtaattgactcacagtgccacatggctggggaggcctcaagaaacttaaaatcatggcggaaggtgaaggagaagcaagcacttcctacatggaggcaggagcaggggcaactgccaaacacttttaaaccatcagatctcatgagaactgactcactatcatgagagcagcatggagggaactgcccccatgatccaatcaccttccaccatgtccctccctcaacacacggggattacaattcaagacgtaatttggggggagacgagccaaaccatatcacctcgttttactgcacagggtgagcagaccccagtttggtcctaaaacggtatttgcaagacagctactgtacaatccgcttcattaataaactgcccttgcaaaatcatgacagtaagagaaatctgacatacttgactccatcttgcttctgacctctaagctgtgcttggtcattcctgggcatcagccaagctaactttgcgaggaatttatagtttaactttgaaacaaaaatgataatattccttccctaaaactaactcctccttgtttggagactgaaactgtctttgtaagactgagaggccacaagatagatgtaatttctaaaatcgcttactgatcaggagttatgtggtcaggagtcaagatttgtgaccttctcaattgctcctacagataacatcactactgtagaacctcagatttttttttccagatgtttttcagactaaccccaactggactcatgactcttgaatttactggtcttgtggcctcactcagaggcagactcagtacctgaggaccgttttctacacctttatgattttatcctcaaccaatcagtagcacccataacctaaatccttgaccaccaaattgtccattaaaaccccctaacttccaagccttcagagaggctgatttgaccaacagcccaggttctcttacatgggccagcttcaggtcaattaaactcgttcactactgcaatgctgtggtctcagtagtttgattttgtttgtgcagcagacagaaagaacctgttacatgattgactaaactcctagcgcatacttattgagattctattgtgtgctgggcacttggctaatttcaaggtaaagcgtaacagtactttttaatgtcctgactgtcttgagcttaaagtcctttaagagaaagagatattaaattaaataataagtataaaagtaacaacactttgcctaatgttattttagagaacaacttatgaatacattcacataagatgtttaaataagacactttaggtcagacttctccaacctgcagccctgtggcccaggacagctttgaatgtggtgtagttcaacacaaatttgtaaactttcttaaaacattatgaggtttttcctgtgggttttttttttcacatagtctatcattagtattagtgtattttatgtgtggcccaacacttcttcttccactgtggcccagggaagccaaaagattggacacccctgctttagatccatgaaaaatggttaggggcagaacattccaaagagaggggagatgtgggagaagtaagcgtgatatcctaaagccagggcgagtttggtggaattgtataatcatctcctgcctttgccctaaggccagggtgagtttggtaggaagaaatacagaagagttaagcaactatctaaaggatgctgtttcaatagtatgatcaatcagagtttaacattataatggacacagaatgagtgtctttatacagattccagtgaatttatttggactctaaaaatgtttagagtcaaataaccatgattgcactccttgctacacagctctggcttagatctaatcaaagtttttgatagactgcttgacacagaaaactatggttgtggtgttaaattatgtgatttatattaaataagtgacctgatgtctagaacataatgtgttctcaataaatttatttattaacaataaattgcgttaatattccaactaataaattatttaagaaaaatatgtcgaatagagtgctaaatgattgtagtcaactaactttaaacagtgcatctaatttcagtgtttcctttttaagattggctcaaaatgaggtacactgacccccatcattgccatttgcattcatttatatccagtgttcttctcttatatatgagtaatataagaatcctatatatctttctaacttgaaaccacaaaaacatctcctgaacttttcctctggtggtttgctttgggtagcactaccaactcaatttcctattcttttgctgcatatcatatttgagccatacatcataatgtacttgactcagatgtctggtgttcctgtcctatgctgcactagcttgcaaggtcttgctttttcttgacaacctgcctcttaaaacagatttcaaactaaacctcctggttttgtaatttgatccaagtctactcccttggacagaatatcagtaacaggatttgccacatcttttcctttcagccatactgactaccagggtggaaatagtcatattttgaaagcagcatcctttcagactgctttgtccgcttatatatacattttaactctttagtttcactccacagtggaaagagagaggcaaaaatgggtttctctgaaattgctatcagcagtgttatctctcttcaagaagaataaaaaaaggatcttattaaatggcagttaatgacaatgaaaaaagggatctgagaactaatgaaaataattttgaggaatattctctaactatatgcattatcttggctcccaaagaagacccacctccacttttgaggaccatcatttagaatgggcatgaaacataactcagtggtttgatgaagaagtgatgattgagattctttcatctcttcatttttaggcactgtttttcatcaccaccacaaagaataagaatggaatacaaaatactgtgggggtttttatgttcattgaaaagctttttcctgtccaaggtacttgttctataagctttcttgctgcctggatttccagtgttccaaggaaattttcaaaatgtatatgaatttgttttccataccaatgcctgagtcttaaaccaaaaactatatgaagaaaagtctttattgttataataataagctgatgttgaatacttgtacatccaaggaattcttcatatattattagttccattaatcttccaaatgacacaaagagataattagtatcattaccttcattcttatcaaagatatagagacaaacactaatcaagcaacctgctcctagttcaaataccaatatattaagtggtatagagttaggattacatctggacaattcaactcaagagctcttgctctaaaccacttctccatgctgccactcttgtataattatgtcattataagaatatagatagtataatgatatagataatttttccatgactatttagtgaaataaccatacttatatcttcctcatagcaaaagcagatcatttcgatatgttttgatttcttaagttttaaaaggtttctgaataaaattttctttcaaaggattttatttacatagaactaattaatttacccttttattaaacactatgaattttctcttcaaagggctcctctgatactaataaatgcctatcctccgactttccaagaatatcaaacaccagccaacagatttatgtgatagtggaaaacacccaattagcttcggtagaatgctttcttaaaagtgcatgtattctaaccttgtagggaatttaaacaactgtgcttaaaagaaaaaaaaaaaaacaggaaaggaagatttgagtcaattcatcatttttattatgtactctcaactcgacccaaaacacatctaaaaaaacctatattttagtgacatttactactactttgccactccacttttaaagcagcctatgtgaatatcaagtggatgggcctgtttctgtacaatatcacatactataggagaaatatctagcaccgatgataataataataataatttaaaaactctgaacactgctgtttgttagattactccagatatttgaatattccttttctttcttagttctttaattagctgtggctttgatatgagacatatatttatttgaagctaaaagcccactttcacaacttttacatattttttttttttgagacagagtctcgctctgtcacccgggctggagtgcagtggcatgatcttggctcactatcacctctgactcttgggttcaagcgattctcctgcctcagccttctgagtagctgggattaaaggtgcccaccaccatgcttggctaatttttgtatttttaatagagacggggtttcaccatcttggccaggctggtctcgatctcctgaccttgcgatccacccgccctggcctcccaaagtgctgggattacaggcgtgagaaaccacacccggccaacttttacatatttttaaatgttttcattcattatttgcagttctgttctaacgcataaattatagtccttcctggtatcaatgcagagtttgttctacaaccccaacggatatcaaaatccacagatgctgaagttcctggtgtaaaatggcatagtatttgcaaataacctacgtgcatcctcacatacacttgaagtcatctctaaattacttataatacctaataaaatgcctacacatagcttcatctgcacagattcgacatagtactcaatgtacagtcaaattcaagttttgctttttgaaaatttgtaaaatttttattttcaaatattttttatccttagttggttgaatgcacaaatatggaacccatggatgtggaaatccagttgtaccttttaaatctccattttttatacaattcttattttccaaatggtggccttttttctctccttcaactataaaattatagttcattaaaccatttatttattttcatagagtatatgtcatattttagtcacaaaacctcgaccacatgacagaaggggcacctaatcattctcattggcacacaaggtcttgttaaaattataaagtagacaaatattctcttcagtatccttctatctttatatcatcttttaatgttccttcttccaaacccaaaattttaatcatccttaagctgtacaaagtatcctacctaggtcagccataaaggtcttcctgatatataaatattcctccaactttccatttattctttcaataatactcttactctttagtgaatatagccttggcaatcaatgtttggattaaagaaattcacactaaaatgtcaatgactgtaattcagatgtctaatgagtacattaaacattttaaaagaacagtgtataaaacctagctgaaatgaatatataatttatacactggaatggagagatatttttcaattggagagttcttcatactaatctttttctatatgagcaggccacaaccacacatatctcattttcttgacagaatcctgatggcttaagttgaactagaatatttgaaataacttcaaagagcattggcatacttttttgctaataggtacagtataccaaaacaaaattattaaatttctggagttatcctatcagccaaattatttttctatcaagtccacttctattgacattttctgggtattctacatatctctcatattccaaatagtgaatctgcctctagaaatatggctaataaagatggcttcaaatcaaatagttaacctgcctctagaaatatggttaatgagggtgggttcaatgggaaattcctgggaaagtctgagcaatgagaagtggtcaaagagaaattttgggatttgagaatttagattgctctaactttgcttcatgtttttggtctacttaacatgccttctgaattttcacttcacctcatctcatcctcttcaatctaattctacagagaattttctaactgttcccaaaaaaaaaaaatgtctttttaagaaggatagagatgaacttgggaatcttcttggttcaatagttactgtggggaaaccaggagagataatataatcataataaaataaatatagccaaacatagtggtgcagtatgatgaatatgacatctattatcaagtctgattttgtggaattttaaattggaaatgctttgggaaatccagaactcaacggatatactctgatggcagtgagaccataactatacaataggtcacattgtcttctagctgaaattactaaagagacatttagtttatgtattaaacacaaaacaagacaggatcgataatatttttatagttttaatagttaggtcaacatctagaacttaaaatgcaacatttaaaaccaagaacctgattatatagaattagaaaggtacaatcagggaccttcacttattccttatttttctcctaaggaagtcttttagagtgttctgatactgccagttctgctctgggaaatctccatactcaggaagcaccaagtgccctagacctttcccaattctctctccctaccagttgcgttttctactccttcagtggcctggcttgctccactgttattctgattaagtaatctgtgctaaaagcaagcaataaacatccagacaaatacatctatatttttaaaaggactttctaacatgaatgctctaattacaaaatgttgcagtaaatctattcaggaaagctttataagtaactaaatacatttaaggatggctgttaaataatcagatcaaaaagataaaaaagatcagccttgaccttggaacaaaactttggtagaataattatctttcaggtggagtcaagattgcagaccagcctgctcttcacagagtattctaatcttcagatagaaacactcactctcttccctctagtagttccatcatactttagtacctactcaggcctacttctagaaaaaccaaaggggcatttatttggtgaactttgcaacccagtaccaaataaagagtatgctagtcccaccctgatgttaggccctggtactagcaaacctaagcttctgtgccttggccccacgcttttatcatgcacaactgtttctgtggaatagagtctacctctgatcctcagtccttgagatgaggcaattctaaatactgattgccccccactcctgacctttccctctgcctttctgcatattaggtgtatattggttctctgtcactgggtttcccctgccttctagaataatcataaataatctttgtcaggaccctatcacagatcatcttcccatcttttgcctacttctcccattaccagacacaaggctccatctgccagagatgtactgttcgtgtttggaatgcgtgctgtgtttctaaggctctttctcatcctggtgttggtcataaagtgcctgtgtctcttaaaacttacaccattagcaagcatttaaaccagcggaactcttaaaggcaattgagccctctcaatatatagaagagtatagagatctaaagagtgaagtgaattacccaagatggcataatatgtaactggcaaagctgtgattagattaatttgaatttcaacattcaacacatatttagcttctctcaacttcaatttcttctgtcaatttgaaaataataatgtcctatttgctaacagtgtttgaaaattaagaaagacatgttaatatgcctaaaattatttttctggcataaagtaggccttgagtaaataatgtgtcctgtgttcacattttttcctcacatctttggtaaaatcattgattcttaaagtatagaccagaatattaagaaaaataatataaagcaagttatgtttaggactaagttatctaaatgcttactgtaatggagctattcagtatactcctttaatttattttgattttgtgtttttctttgattttgtttttccttctggtacataaacactatcaggagataacatttttatcattactatattatataaatatttttagaaactattgtcaatatagtaattatgaatatgataattaccatgaggtaattttttatataaatatggaattcaaaaataaatttaacaaatatttataaggtttaccattggataaagataatgtgggtgcttgagacacagtgctgaacatgaaagacaaagttcctaagcaagagagtctacattttattaaaaataaatgatgacaaaccagcaagtagataaggactataatttcagacagtgataaatactgtaaataaaataaaatgaggaaaataactaacaacaaacatggtggagttcaattttacatgagtgtcttttagattggttctgagacacagcttcttgtatgaagaactatatgcagagttcctccaggaaacacacccaaaaggaaatgaggaaggaattgtgcaaaaagagaaggtgacccactgagccctcaaatgacattccgaggagctctgaagcctgtaaggattctaccaaattggggcaaggagatgacctatccccatctccgtcagtcgctgatgaaagccatcacttgaaagggtataactttgggcctagaagtttcctacggcaaaattgtggatccaagtacaagagtaattatcacaatagaacatgaaatctaagctgagtaagacaggaaacaaaaacgtgaggaatgaaaaacatgcattcgatattccagcaagataaaaagctaatttggcatgaaggattagagaatacataatcagaaagataataaagtggtggtcagaaaatagcatcttaaaagagagattctggaaaagaaaaatatacttggaataataagcacaggaatggctgactacaataatgttgaagaaaaagatcattaaaaatgaagaggccacaaggttgagaggccaaggtattaaataggttggtggaacaaatgtgagctgcacagaaagatagcttaaaaagtagtagaagggaaatcagagagccaaatactattttttttttttttttttttttgagacagagtctcactctgtggcccaggctggagtgcagtggcatgatctcggctcactgcaagttctgtctccctggtttacaccattctccttctcagcctcccaagtagctgggactacaggcgtccaccaccatgcccagctaattttttgcatttgtagtagagacggggttttatcgtattagccaggatggtctcgatctcccgaccttgtgatctgcccgcttcggcctcccaaagtgctgggattacaggcattagtcaccgcgcctggccccaaatattaatttttatttaatgtgagccagtatcttttttattgttcctggaatattatttggtaaaacttgaaaaaaaaatgaattcaattaccaaatagtttaggaaacacttaggtgaaagtcacataggtgtaataactctaggatttcttgaagtgattaacactttatattaattttaagtatccaaaagaaagataacatacatcaagttttataaaattttcagtgattatatcacaggaattgcaatataagtaacatgttgaggaaatgctaataattcagagtagcaggtcacaagtctttgaaacaggatacaacttatgagtactctatcttgtaaatgcacagacacacacacattgtatacagttttatgtagttagcacaagtcttggtggtaatccatagagcctacattacaaacctctactctccattcttgctggtaatatctggtccatgggtcagcactattggcaccccttgagaacttgttgtatatccagaatctcaggtaccactccggatttactggataagaacctacatttttaaaagattctcagatgatgtgtatcacattcaagtttaaaaagccctgcactagaaggttacatagttaattttcacactcacaaagaaaaactgttttacattgttagagaattactatattttcaaacagtgttctgaaatgtctctgaatatttataatgactcaaattggccttaaaaacaggtgggaattagctctcttaatattttgtcacttttataaaacaaaatatggtaacatggtattaactattaattttatagttggtacaagcaatagagcttgaaaaggtattttcttgtgtcttaataccactaatgtatgatttataaaggcatggaaatacaatctcaggagtcttaatatttccttagaagattaaacagccatgtaaatccattatccagaaggttagacataaatgtcagttcctgagtgtcccacaaaggaaagtgtggattcttaataacagagaggacacaaggtctttccttgagagatttatgtctgatcacaatttcccacgtttaaatatccacaatcaacaataggtacaactttgtttgccaaaaaagacttttaaaatatcaaatggggagatacagaaaagaatataggacaatattttctgtgcattaaatcttcacagataaattctactacttgatataatcagtccagtccttccttccttacagatatatcttttaagagaagaattagtaattattttattctcctaaatttattcttcttttttgtttgtttattggtgaaacaaaaggattattaaaacacttaaatatattagtatgtttaaaacaaatgctctggttaggtaggttagttaggtagttcaaaaatgggttttgaaatgggcaccttgggaggcttcaggatggctgactagggagcattttgtacttgctttctccactaaaaagagctaaaatacccagtagatattagatcatccaagagagaacactggaatccaacaaaatagtgacaggcaatatctaaagtaaggaatgggagaaggaagcaagcagcctgttcagcctggattgactgagagcctagagagactccccaatagagggaaacggtaggtgagagatgctcagcagcctgcattttcatcatagactcctatagtcctagccacgggagagtcctcaatactctcaggccatgaaactaacatagggagttgcaagaagattgtattatggcagcttcccatggaggaagcttgaatatggtcatggtccttcacattccttgtgacctaagcaactacagcaagatgccattttagaactttgcctgcaacagactgcacactgtcctggaacccaggaatgctgaggctaatgtgcaagagaagcattaggctgctgctcccagggcttaggcacaagtgaccttgggccactacactctgatggagttgcaaccagggtatgggatgccatctttaggactgaggtgccagcaaggtgccattctagagcaccatccccagcaaactgcacactacctgaagcccagtggtgctgaagctgaggtgcaagagaagtgatgggtactgcctggggtttagacacaagtgaccacaggcttctccacccaaggctgagcaagggtgccaccaaggctgtggtgcaggtggcatgcatgctccccacctgctgtcctaggccatcatcactgaagctggtaccaccctcaacccccactggcagggcagcagggcagctactatagcctcccactcaagcattccacaatgacttggggatcaccccgctcctgactaccatggccagtgcctgtacatgccatctgggggcctgaagataagccagcctagcccaggtttccccatcatccccatgccacagcatacagtccaggggccagggaatctcccagtttagttcaccactgatgacatatgaccactcctctcggggacctgaggttaggcctacccacacagcagctactaccacaaattaccacctgcaggcctggacactgaccttcccagaacattacagttacttccaatgacagcatgcaccacaagggacctagagggttgtcacaccactgccactcgcattgcctacgccatattagctgcccatggacccaagaacccacttacctgctcagttcacagctgccactactgggctttgagtaagccacctgaaggaacaaaaattggcccacctgtatgacattatggggcatatgagcaggcactctcagcccactgctgcaaccacaggagctcaaagactggtccacttgacctctgagtcccaagcaaaactgcaccagagctttcctcaataactggaccctaagccaccaaggaagtctcagatatcactggcactgtttgtagccaaaaaaatcaagggagactacactaattcatgtacctagaattgaaaccagagttccccacccaaccaacaccacagattcttcctcaaaaaaagtccttccctgtgaaagcaaattgaaaaagttagaagaagcaactgctacatgagatgcacggatatcaatgtaaggacacaggaatcatgaaaaagcaagaatatatgacagctccaaaggagatggaattcataaaatcctagtaaaaattcaattattgattctaaataatttcagtgagatataagagaattctaaaaaaacaaaacaaaggaatcagaaaaacaattcaggataagaatgagaaatgtaacaaagtgatagataacgtagaaaagtatcaaacagaaatcctataaatggagaatcattgaatgaattacaaaatacatttaaaagcttcaaccatagactagatgaagcagacaaaataatttcacaacttgatgacagtgttttataaataaccctcagacacattttttaaaaaaaaagaatgaacaaagccttaatgatatatgggacagaaaaaaaagtgataaaatatataaattattggtatccaagaaggcaaagagagaaagagtttaaaaacctatttaatgaattaatagaggaaaatttcccaaatctagcaagagatttaaacatccagatacagagtcccagcagtcaccaaacagacacaatacaaaaagttcttcttcatggtatactatagttaaaatttctaaaatccatgaaaaatagagaatttttttttttaaaaaaaagcaagagaaaagcatctagtcacctataagaaacctccatcagaacaagagaaaatttatcagtagaaaccttataggccaggagagaatgggataatgtattcaaaatgctgaaagaaaaactgcaagctaagatactatatctaacaaaattatccttcataaatgaaggagaaataaagtctttctcagacaagataaaactaagataattcatcaccactagactgaccatacaataaatactcaaagaactcctaaacatggaagcaaaaggacatttatctacatgaaaacacacaaaagtataaaaaatggtgaagcaaacatacaaatgtggaaaaagatagggctcaaatactatccctacagataactaccaactgcaatgacagacattaagaggaaaatcaagaacaaagaatatacaaaccaaccataaaacaattaacaaaatgacagcaataaaacctcacatatcaataattactttgaacataaatggattaaattcttcacttaaaagctatagactgaatgaatggattttaaaaaaatgatccaactacatgccacctacaagaaacacactttacttgaaaagattcctatagactgagagtaaataaatagaaaaagatatttaactctaacagaattcaaagtgagcagaggtagctatactcatatcatacaaaacagacttgaagccaaaaacagtaaacaaagacaactaaatagtgataaaaggaccaatctagcaagaggaaataacaattctaaatatatatgcacccaaaactggaacacccggattcataaaggaaagattactaaatctgaaaagaaagactccaatgcaataactgtgggggaatttaccaccttattctcagcactagacagatcgtctagaaagaaaatcaaaaaagaaacattgaagttagagtggaatttagaacaaacagacctaacagatatttatagaacattttatccaacaactgcagaatacacattattttcataatcatacagaatattctctagaacagaccatctattgagccacaaaagaagtctcaacaaattttaaacaagcaaaatggtatcaagtaccttctcagatcacagtggaataaaacaagaaatcaataccaaaaagaaacttggaaactatataaatatacaaaaattaaataacatgcccctgaacaaccattgtgtcaatgaagaaatttaaaaattttgaaactaatgaaaatgaaaacaaaatatatcaaaatctgtgggatacagctaaagtagtactacgagggaagtttatagaaataattgcctacatcaaaagtagaaatattacaagtaaataatctaacaatccacctcaacaaagtgaaaaatcaagaatgaaccaaaccaaacattagcaggaggcaagaaataataaagatcagagcagaactaaatgaatcagaaactagaaaaacaataaaaagcatgaatgaaatgtaacactagttttttgaaagtataaacaaaattgaaaacattaaaaaaaaaaaaaactacgagctagactaacaaagaaaagagaagacccaaataaactcagaaataaaaaggagacattacaactgatacaacagaaatacaaaagatcatcagagactatcacggaaaactgtatactaacaaactagagaatctagaggaagtagatacattgctagaaacatacatacaacttaccaagattgaatcaggaagaaatagtaaacctgaacacaccaagtagtgaaattaaatcagtaataaaaagtctcccaacaaagaaaagcccaggtctggactgatttactgctgacttctaccaggcctataaacaagaactaataccaatctttcccaaactactccaaaaaattgtaggggactgatttcttcctaacatattctataaagccggtatcattctgataccaaaagcacacagggacacacacacacacacacacacacacagaggtataggtcaatatctctgataaacataaacacaaaaaaccccaacaaagttcaagcaaactgaatttaacagcacatcaaaaaaataatacccaatgatcaagtgggatttacccaagggacacaaggatgttcaagatatgcaaatcaataaacatgaaacatctacagaataaggaataaaactcatatgctcatcttatagacaaagaaaaatcttttgataaaattcaacataccttcatgataaaaaaattctcaacaaactaggcatagaataaacatgcctcaaaaaataaagtccatatatgtcaaatccacaaatagcattatactgaatggggaaaagtttggaggccttttctctaagaactggaacaagacaaggatatgtacttccaccattcctaatcaacaaagcactgaaagtcctagccagagtaatcaggcaagagaaagaaaaggcatccagattcaaaaagagaaagtcaaattgtccctctttgcagatgacatgatactcatatttagaaaagtcaaaagactccaccaaaaaacccttagagttgttaaacaaattcagttacactacaggatacaaaatcaacatttttttaaagtagtatttctatacaccaataatgaaatagcaaaaaaaagaaaaagcaaaacaaaaacaaaacagaagaacagaacagcaatcccatttccactagctaccaaaaaaattacataggaataaaccaatgaggtgaaatatctctacaaggaaaactataagaatctgatgaaagaaattgaagagaacacatacaaatgtaaagacatcccatgttcatggatcagaaaaaaataatagtgttaaaaggaccatactccataaacaacctaaagactcaatgcaatccctatgaagacactaatgccatttttcacagaatagaaaaaacaatcctacaattcatttgaaaccaaaaaataaccagaatatccaaagcaatcctgagcaaaaataataaagctggaggcatcatactacctgacttcaaattatattacagggctataataaccaaaacacttggcattggcataaaaatagacacatacccaaatggaacagaatagaaaactcaaaaataaatccacatatttacagccaattgattgttgacaaagcaccaagaacatgcactggaaaactgaggttttcttcaataaatagtgctggggaaattgaacagtcacaggcaaaagaatgaaactgaacccctatctctcactgtacacaaaaataaactcaagatggattaaatactcaagtgtaaaactacaaactataaaactcctagaaggaaacataggaaacgcacttccaacagtcgtctaggaaaagattttatggctaagacctcaaaagcacagacaaatggaacaaaaatagacaaatgagactatattaaaatcaaaaacttctgcatagcaaaggaaacaatcaaaagagtaaagaaaccacctgtatgggagaaaatacttcaaactatctgacaatggaataatatccagagtatataagatactcaaacaattcaacaataaaataagaatcccattaagtaagaagtaggcacagaacattaatagataattccgaaaggaagacatgcaaatggccaacaggtacatggaaaaatgctcaacatcactaatcctcaggaatatgcaaatcaaaaccacaatgaaatattatcttactccagttaggatggctatttttttatttttatttttctacccaattgaacagagagtgtctattattaaaaacgcagtaaaatatcacatgctgacaaggatgtggagaaaagagaatgctcatacccttttggtgggaatgtaaattagtacaaccactattaaaaacaatatggaggccgggcacagtggatcatgcctgtaattgcagcactttgggaatctgagacgggcaggtcatgaggtcaggagattgagaccaccctggctaacacagtgaaaccccatctctactaaaaatacaaaaattagccgggcgtgatggcatgtgcctgtagtaccagctacttgggaggctgaggcaggagaatcgcttgaactggggaggcagaggttgcagtgagccaagatcatgccactgcactccagcctgggtgacacagcaagactctgtctcaaataaataaataaataaataaataaataaataaataaataaaaaacaatatggagatttctcaaacaaactaaaaatagaactacaatatgatccagcaatctcactgctgggtatgtattcaaaggaaaagaaatcggtatatcaaagggattcctgcactcacatgtttgttgtagcactattgataatagcaaagatatagaaccaaacttagtgtccattaacagacaaatggataagaaaacatgtggtatatgtatacaatggaatactattcagccataaaaagaatgagagcctgtcatttgcagcaacatggatgtcattatgttaagtgaaataacccaggcacagaaagacaaattattgcatattctcattcatatgtgggaactaaaaagattgatctgataatggtagagagaagaatgatagatactagaagctgggaaggttgactgggttggtagcggagggtgaagagaggtaggttaataagtacaaacatgtaattagataaaaggcataaattttatattttgacagcaaagtagagtgactatgctttacaacaatataatctatatttcaaagtagctataagaaaggacttcctaacccatagaaataataaatcctcacagtaatggacacttcaaaaactttgacttgataattgtgtattccatgcatgtaacaaaatatcacatgtaccccataaatatgtaaaatattatgtatccataaaaagtgaaattttaggctggatgcagtagctcacacctgtattcccagcactttgggaggcagataatgaggtcaagagatcgagaccatcctggccaaaatagtgaaaccctgtctctactaaaaaaaatacaaaaattagttgggcttggtggtgcacgcctgtagtcccagctactcgggaggctgaggcaaagaaatggctgaacccgagagggagaggttgcagtgagccgagactgtgccactgcactccagcctggatggcagagcaagactctgtctcaaaaaaaaaaaaaaaaaaagaaaagtgtgtttttaaatttctaagagcttcataataaatgtgatatatatatatatatatacacacacacacaagaaaaaaagaattcagaattacagggttgaaatgaatcctgctgatatcaattctttgtagaaataccttggacatggattgtattttttccaaatgaaattcctacaaattgccatttctggagtcttgacttcatacagtctataaacacaccattcaatgttgatatttctcaacggatccttagaagtaaacattgcacaaatatattctttactttataatcctcaagtttgcatgtaagtaacttattctgctttagttacaatcaatgacttttgcagcaatttttaatgctgatcacaaattgctcaaaatgaaactaataagatttgaaaatatatattaatatttcctcagtagctcttgctaaatgaaataggcccagtttcttacagatgtctcagtgaatcatcagttttttatcacttaatatttttttctatgaccactccagtttctccatatctctcacaataaaggagcatgtatgattctcaaatcatgatttgtttctaacaaaaggatataaatattctgtctttcatgtaggtctattatatgcatcattgatgatctttttgtttctttttcaaaacaagaagctatttttttttcaaaacaagaggctgtttttctattgttgatagactcttacagtgaattgtatctaccccctcttctggcatgcaactgtaggatgaattggttctagagaaatgctatgtttatttttcaacattgcagatatcgctttgattttttccatatcaatctagtcactgaactgctgttgtattttgagaaagatgatttttttttctttttttcttgagatggagtttcactccaccacacctggttaatttttgtatttttagtagagatggggtttcgccatgttggtcaggctggtcttgaacccctgacctcaagtgatccacctccctcggcctaccaaagtgctggaattacagacgtgagccaccactcccagccaaatttcatttttaaaaagaagtttgctatgccaagaatagctcaggaggtaggggggcagctttaactccttcaatccattaatcaaccactactacacctggtggtagttttacagccactccctgtccaactccaactctcatcttctcctgtacagaaaatctagggctactaggctatatatgtatatacatattcattaagaatgataattctacttggtcatgatgtttaaaagttttaaaaactttaaaatacgctgtcagataagatttgctttgtttttcatgatttcccattacatatatgtttatatgtgaagctggcctataatttttttcttctcctgactgctgtggatgttaaaattatactaacaaatttaatcatgttctttatatcgtatttagtcttaaaataatttgtaaaatatgggaataatatgtttcttgaatgtttggtagaatttgacagagcaggagcatcactgtcttggacaagcactatcattttaaagttccccttgatcaaaaaccacctaaatccaaagggcatcagcctaatggctaaggtcagcatgaacataaaccacaaatgacatctcgaaccagaaacattccaaccctaagataaatccctcccaaaccagagacatgccagccctgaggtaacctcctctctgcccagagagatgtttagccccaaggtaacttcccctctgatcagagacattacaaccccacaataaacttctccccgacacgaaaacattccaagcctgtgataagccctcttgccctaaacacttaaatactctcagtctgtaagagagaatgctcctcactgaaatcggccagaagcccctctcaggtttattctaaaaaataaagttgtctttggctgttgagctgctttttgtgtttctttcctctttctttaactcttacagaatttgcttgggaaaaacatccatgtctggtgtctttggccagggccaaaggtggaagagttaatgttgttattactactagttcaatttattgaccacttggcaacttactcaggttttctactttacttgtctattttattaagtatatttatttaagaatattttatttcatgaaaattgttcatttcatctaaattttccagtttattgaagctgcattcctaaggtttttcacagtattctcaaattctatttatgcactactttatttacagtatgagttctccttcacagttaaatattccctgtattaaaaaaaaattattcagtcctgcaagggctttgtttattttactaaattttcaaagaatcagctttaagtactccatatatttttgtttattttacattaatttcttcacaactttttatttttattttcttctactttttctggattaactctgttgttctttccacagttttcagagataaatgcctaaataactgtgtccctttttcttagttttaaattaaaaagtttaatactataatttccacagtcattgcagatttagacgcattcagttgcattccacaggttgtgaaatgaattctcattgtcttgcaatatatttctaatttttcattattttttcttttacatattagatatttataaataaatttgttttcacacataattttctgtatttttattgctgatatctaatttaattgtattgtgttgagataatgtagtttatagtgacctcacttttcgaaacttgaagagactttcttcctttgttacataatatgtagtcaactttcataacactgtgtgtgtgaagagaagatacagtctctgtttgctacaggggtattaattaagactttgggatgacttgttcaaatcttatatatcctttttaaaatttttatctgagctttcaatttctgatagcattgtactcaaatattctatcatgaggctgaggcaggaggatcacttaaatccaggagttcaagaccagcctgtgcaacaaagcaagacccatctctataaaaaattaaaaattaaaactcatttttccatcatgagtttgaacttatctatttctccctatgatttggttggttctgctttgttctgaagctatctacaaataattgtgaattatatactgtgtggattgttctttttatgaaaatatattgttatttaaaaaaatcctctatagatgtttttgccttaaattctttcttctgaaattaatattttgacacaagttttagtatttgcatagtatatctatatttaatttttctgtctttttaaaagatattttcctataagattagcagttagtttttttaatctaatataatacatttaatattttattagaaaactaataaatttacaatgagtatgattattgaacatatttaaactgatctctatgatcttgttttagtgttctgtttagaattccttctttattgtttttaggggaggatcttatttcttgcttttttgattttcatgtgctctcttttttccttttattaattgtgtaactgtacacacactcagatacgcataatttctgacagagattaaattttagtatgtcctgcctaccaactaaataagacaagaatcttagcatatttaaagtactaatggaaccttcctcttccttctcccaagttctttttcctagaattttagttttacctatatacacatttgtagttttaatgtgctacattcttcatataaagatatatatatatacacacacacacatatatacacacacatatatattcacacacatgctttttatcaaagtttaatgtatacaatgttcataaagtatacatctcacagctgtactgctctataaactttcacaaaccaaccacacatatggaaccaggactgagattaagaatacacaacattaccagctccccagaagctccttcgttccccatacagacccactgctctttttccaaggatgaccacatgctgacttctaccagcataaaattgttttttgtcattttgtactttatatcacttaatcatctacaatgtattttttgtattttttattcaacccattatgtttgtgagaataatttgtatcatatgactgtttcattcattttcattgttttgtagtattccactgtgtaaatgcaaggcagtttatttattaattcaactgttgatgaatatttactacttagagctattatggtcatttccgtatttgttctttttccaacttttggctagtacttgtcttttggtgcacatatatgctttctattgggtgtatacttggaatgactgtgtcatagggtactcagttattgttttaattatactgttaaagtattgtccaatttaacttgtttttaaaaaataaaactgtagatttatttaaaggtagaagtgaagtatattactgatacactttcaaaagctattgattaccgtgctttcttttttaatttactcttcttgctgaagaaatactttgtatttgtggattgtaaactcctcattttttgaatatttgaaaatgtctctattttgctttcactcttaaaggatagcttagctacaagtacatttctaggctggtagtgattttcacataaaacttaattgctttgttcttaagaagttaaaagccaatcttttttttttcctatgcaagcaatctgtttttctttctagtagcttttaaattgcctcttaccattaacttctttctttattccatgatataaccagttaaggattgtgtttattgacctgtttggccctcaatgaagtctttcaatttgaaagatcatcccactcttcaattctataaaattatcagccatatttcctctgtctttaaaaaaaaatgcttattctttgtgggattcctttgatacatgttataatttctcaatctcttcgccaaatactttattttttcatatatattttaaatctgttttttctctttgtgctatatatttcatgaattcctcatttatatcattcaagtaactaatattctgatatttcatttaaatttactttgtctattaatttctttaaattttagctttttagtgtcattctctcaaaggcccttttgtcaatatatacttttgttgatgttgtttgattttctatcaaggacttccagttttaaaaattgtaactctaccctttagttgcatacagtgtgctttgctccaatatccctccataactgagaaaattttgaatcatggaggtaaacacaagcaaaaactccacattggagcccaggatacctttggttctaatttcttctcactgccatgtgtttcttgatttttatccttgctacttattttcttttaaacttttttttttgtatttctatatggactcacagtactatcttggcttatattctgttagttgtatttgtattttgtactagccttcccctaagcttccttacggttggaactgtcttaacatctatagggtcagtatctgggcacttcaaactatacagtaggcactgaagaaagattagtgattagacaaatgaatttttgcaatgtgtataatgtgtttatctaactagaggaaatgtacccagttttctattggtaacatggacatttgaagtcatttatcatatttttgctcttgtaaacagaggtggaacaacaataagccatttcagcatatgagtgatatctgcactatgacataaatcctttatagacaagcaaatgctgagagattttgtcaccaccagacctgcccgacaagggctctggaaggaagtactaaatatggaaaggaacaaccggtaccagccactgcaaaaacactccaaattgtaaagaccatcaattctaggaagaaactgcatcaactaatgagcaaaataacaagctaacatcataatgacaggatcaaattcacacataacaatattaaccttaaacgtaaatggactaaatgctccaattaaaagacacagactggcaaattggataaagagtcaagacccatcagtgtgctgtattcaggaaacccatctcacgtgcagagacacacatgggctcaaaataaaaggatggaggaagatctatcaagcaaatggagaacaaaaaaaggcaggggttgcaatcctagtctctgataaaacagactttaaaccaacaaagatcaaaagagacaaagaaggccattacataatggtaaaggaatcaattcaacaagaagagctaactatcctaaatatatatgcaccatataaaggagcacccagattcataaagcaagtccttagtgacctacaaagagacttagactcccacacaatgataatggaagacttcaacatcccattgtcaacattagacagatcaatgagacagaaagttaacaaggatatccaggaactgaactcagctctgcaccaagcagacctaatagacatctatagaactctccaccccaaatcaacagaatatacattcttttcagcaccacaccacatctattccaaaattgaccacatagttggaagtaaagcactcctcagcaaatgtaaaagaacagaaattataacaaactgtctctcaaaccacagtgcaatcaaactagaaggcaggattaagaaactcactcaaaactgctcaactacatggaaactgaacaacctgctcctgaatgactactgggtacataacgaaatgaaggcaaaaataaagatgttctttgaaaccaacgagaacaaagacataacatactagaatatctgggacacatttaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggagatagagacacaaaaaacccttcaaaaaatcaatgaattcaggagctggttttttgaaaagatcaaaaaaattgatagaccgctagcaagactaataaagaagaaaagagagaagaatcaaatagatgcaataaaaaatgataaaggggatatcaccaccgatcccacagaaatacaaactaccgtcagagaatactgtaaacacctctacacaaataaactagaaaatctagaagaaatggataaaatcctctacacatacaccctcccaagactaaaccaggaagaagttgaatctctgaatacaccaataacagactctgaaattgacgcaataattaatagcttaccaacaaaaaaagtccaggaccagacggattcacagccgatttctaccaaagatacaaagaggagctggtatcattccttctgaaactattccaaccaatagaaaaagagggaatcctccctaactcattttatgaggccagcatcatcctgataccaaagctggcagagacacaagcaaaaaagagaattttagaccaatatccctgatgaacgtcaatgcaaaaatcctcaataaaatactggcaaactgaatccagcagcacatcaaaaagcttatccaccacgatcaagttggcttcatccctgggatgcaaggctggttcaacatacacaaatcaataaatgtaatccagcacataaacagaaccaaagacaaaaaacacatgattatttcgatagatgcagaaaaggtctttgacaaaattcaacagcacttcatgctaaaaactctcaataaattacgtattgatgggaagtatctaaaaataataacagctacatatgacaaacccacaaccaatatcatactgaatgggcaaaacctggaaacattccctttgaaaactggcacaagacagggatgccctctcccaccactcctattcaacatagtgttggaagttctggccagggcaatcaggcaggagaaggaaataaagggtattcaattaggaaaagaggaagacaaattgtccctctttgcagatgacatgattgtatatctagaaaaccccatcatctcagtcgaaaatctccttaagctgataagcaacttcagcaatgtctcaggatacaaaatcaatgtgcaaaaatcacaagcattcctatacaccattaacagacaaacaaagagccaaatcatgagtgaactcccattcacaattgcttcaaagagaatgaaatacctaggaatccaacttacaagggatgtgaaggacctcttcaaggagaactacaaaccactgctcaaggaaataaaggaggatacaaacaaatggaagaacattccatgctcatggacaggaagaatcaatatcgtgaaaatggccatactggccaaggtaatttatagattcaatgccatcccctcaagctaccaatgactttcttcacagaattggaaaaagctactttaaagttcatatggaaccaaaaaagagcctgcattgccaagtcaatcctaagccaaaagaacaaagctggaggcatcttgctacctgacttcagactatactccaaggctacagtaaccaaaacagcatgatactggtaccaaaacagatatacagaccaatggaacagaacagagccctcagaaataataccacacatctacaactatctgatctttgacaaacctgacaaaaacaagaaatgaggaaaggattccttatttaataaatggtgctgggaaaactggctagccatatgtagaaagctgaaactggatcccttccttacaccttatacaaaatttaattcaagatggattaaggacttaaatgtcagacctaaaaccataaaaaccctggaagaaaacctaggcaataccattcaggacataggcatgggcaaggacttcatgtctaaaacaccaaaagcaatggcaacaagagccaaaattgacaaatggcatctaattaaactaaagagcttctgcacagcaaaagaaactaccgtcagagtgaacaggcaacctacagaatgggagaaaatttttgcaaactactcatctgacaaagggctaatatccagaatccacaaagaactcaaatttacaagaaaaaaaaaaacccatcaaaaagtgggcaaaggatatgaacagacacttctcaaaataagacatttatgcagcctacagacacatgaaaaaatgctcatcatcactggccatcagagaaatgcaaatgaaaaccacaatgagacatcgtctcacaccagttagaatggcgatcattaaaaagtcaggaaacaacaggagctggagaggatgtggagaaataggaacacttttatactgttggtgggactgtaaactagttcaaccattgtggaagacagtgtggcaattcctcagggatccagaagtggaaatatcatttggcccagccatcccattactgggtatatactcataggattataaaacatgctgctataaagacacatgcacatgtatgtttattgtggcactattcacaatagcaaagacttggaaccaacccaaatgtccatcaatgatagactggattaagaaaatatggcacatatacaccatggaatactatgcagccataaaaaatgatgagttcatgtcctttgtagggacgtggatgaagctggaaaccatcattctcagcaaactgtcgcaaggacaaaaaaaccaaacaccgcattttctcactcacaggtgggaattgaacaatgagaacacttggacacaggaaggggaacatcacacactagggcctgttgtggggtggggggaggggggagggatagcattaggagatacacctaatgttaaatgaccagttaatgggtgcagcacaccaacatggcacatgtatacatatgtaacaaacctgcacgttgtgcacatgtaccctagaacttaaagtataataaaaatatatatataaaatcattgtattaatctgtgaaatatttttaaagaatgttcaacctgttaatatccagttagagcaaggatgtagaaaaactagtacaatattaaattaataaaaatatatcaaagcaaggaaaagtttgtgttttgatctagtaacttcattttttggaattcgtaaaataattctggatattgagaaatactttattgaagtatggtatttaataataaaaaacaaatttagaacaataaaaggttaagaaaaatataatttattcagttaatggtatagtttaaaatcttaaaagtgattgttacaaaactaaattgtatcaaaagctaacctactcatccagaagaaagccacaattaaattgcaacatgaaacaatacttttagtatacaaatattatggcactaaaacagcgatacgcattttttaaaattattattatactttaagttctgggatacgccaggtgcggtggctcacgcctgtaatcccaacactttgggaagccaaggcaggtggatcacgaggtcaggagatcaataccatcctggctaacacagtgaaaccccatctctactaaaaatacaaaaaattagccgggcgtagtggtggcaggtgcctgtagttccagctacttgggaggctgaggaaggagaatggcatgaacccgggaggtggagcttgcagtgagcagagattgcgccactgcactccagcctgggtgacagagcgagaccatctcacagaaaaaaaaaaaaaaaaagttctggtatacatgtgcagaacatgcagctttgttacataggcatacttgtgacatggttgtttgatgcacccatcaactcatcatctacatcaggtatttctcctaatgctatccctacccttgcccccaacccccaacagggtatgtgatgttcctttccctgtgcccatatgttctcattgttcaattcccatttattagtgagaacatagggtgtttggttttctgttcctttgttagtttgctgagaatgatggtttccagcttcatccatgtccctgcaaaggacagcaactcatccttttttatggctgcatagtattctatggtgtatatgtgccacattttcttgagccagtctatcattgatgggcatttgggttggttccaagtctttgctattgtgaatagtactgcaataaaaatatgtgtacatgtgtttttatagtagaatgatttatgatcctttgggtatatacccactaatgggattgctgggtcaaatggcatttctggttttagatccctgaggaattgccacattgtcttccacaatggttgaactaatttacactcccaccaacagtataaaagtgttcctatttctccacatcctttccaccgtctgttgtttcctgactttttaatgattgccattctaactggcatgaaatggtatctcattgtgggtttgatttgcatttctctaatgatcagtgataacaagctttttttcatgtttgttggctgcataaatgtcttcttttgagaagtgtctgttcatatcctttgcccactttttgatggggttgtttttctcttgtaaattcatttaagttctttatagattctggatattagccctttgtcaaatggatagattgcaaaaattttctcccattctgtaggttgcctgtttcctctgatggtagtttctttcaccgtgcagaagctctttagtttaattagatcccatttgtcaattttggcttttgttgccattgctttggtgttttagtcatgaagtccttgcccatgcctatgtcctgaatggtactgcctaggttttcttctagggcttttatggttttaggtcttacctttaagtctttaatttatcttgagttaatgtttgtattaggtgtaaggaaggaatccagtttcagttttctgcacatggctagccagttttcccaacagcttttattaaatagggaatcttttccccattgcttgtttgtgtcaggtttgtcaaagatcagatggctgtagatgtgtggtgttatttctgaggcctctgttctgttccattggtctatatatctgttttggtaacagtatcatgctgtttttgttactgcagccttgtagtgtagtttgaagacaggtagcattatgcctccagctttgttctttttgcttaggattgtcttggctatatgggctcttttttggttccatatgaactttaaagtagtttttttctaattctgtgaaaaaagtcaatggttgcttaatgggaatagcattgaatctataaattaccctgggcagtatggccattttcaagatattgattcttcctatctgtgagcatggaatgattttctgtttgtttgtgttgtctctgatttccttgagcagtggtttgtagttccccttgaagaggtccttcacatcccttgtaacttgtatttctaggtattttattctctttctagcaattgtgaataggagttctctcatgatttggctctctgtttgtctattataggtgtataggaatgcttgagatttttgcacattgattttgtatcctgagactctgctgaagttgcttatcagcctaaggagattttggggctgagatgacagggttttctagatatacaatcatgtcatctgcaaacagagacaatttgacctcctctcctcccacttgaatatactttatttctatctcttgcctgattgccctggccagaacttccaatactatgttgaataggagtagtgagagagggcatccttgcctgtgctggttttcaaagggaatgcttccagcttttacccattcagtataatattggctgtgagtttgtcatatatagctcttattattttgagatatgttccatcaatacctaatttattgagagtttttagcatgaaggggtgttgaattttatcaaaggccttttttgcatctattgagataatcatgtgtttttttttcattggttctgtttatgtgatggattccatttattgatttgcttatgttgaaccatccttgcatcctggggtgaagctgacttgattgtggtggataagctttttgatgtgctgctggattcagttttccagtattttattgagaattttcacatcgatgttcatcacggatattggcctgaaattttcttttttttgttgtgtttctgccaggttttggtatcaggatgatgctggcctcataaaatgagttattttatgataatttcttttctattgtttgaaatagtttcagaaggaatggaaccagctcttctttgtacctctgatagaatttggctgtgaatctgtctggtcctgggcttttttttggttggtaagctattaattactgcctcaatttcagatcttgttattgttctgttcagagattcgactttttcctggtttagtcttgggagggtgtatgtgtccaggaatttatccatttcttccagattttctagtttatttgcatagaggtgtttatagtattctctgatggtagtttgtatttctatagtattctctgatggtagtttgtatttctgtgggatcagtggtgatatcccctttatcattttttattgtgtctatttgattcttctctcttttcttctttattagtctggctagtggtctatctgttttgttgatgttttcaaaaaaccagctcctggattcattgattttttgaaaggttttttgtgtctctatctccttcagttctgctctgatcttagttatttcttgtctcctgttagcttttgaatttgtttgctattgcttctctagttcttttcattgtgatgttagggcgtcaaatttagatctttcctgctttctcctgtgggcacttagtgctataaatttccctctaaacactgctttagctgtgtcccagagattctggtatgttgtgtctttgttcttattggtttcaaagaacttatttatttctgccttaatttatttacccaatagtcattcaggagcaggttgttcagtttccatgtagttgtgcggttttgagtgagtttcttaatcctgagttctaatttgattgcactgtggtctgagatactgtttgttattatttccatttatttgcatttgctgaggagtgttttactttcaattatgtggtcaattttagaataagtatgatttggtgctgagaagaatgtatattctgttgatttgaggtggagagtttggtagatgtctattaggtctgctcggacctgagctgagttcacatcctgaatatccttgttaattttctgtctcgtttatctgtctaatatgacagtggggtgtaaaagtctcccactattattgttttggagtctaagtctttttttaggtctctaagaacttgctttatgaatctggatgctcctgtattgtgtgcacatatatttaagatatttaactcttcttgttgcattgatccctctaccattatgtaatgcccttctttgtcttttttatctttgttggtttaaagtctgggttatcagagactaggactacaatccctgctttttttttttttttttttttttttgctttctatttgcttggtaaatctttctcaatcccactatttttagcctttgtttgtctttgcatgtgagataagtctcctgaatacaggacacctatgggtcttgactctttatccaatttgtcagtctgtgtcttttaattggggcatttagtcaatttacacttaaagttattgttacatgtgaatttgatcctgtcatcatgatgctagctggttattttgcccattaattgatgcagcttcttcacagtgccgatggtctttacaatttgatatgtttttgcagtggctggtaccagtttttccttgccatgtttagtgctttcttcaggagctcttgtaaggcagacctggtggtgacaaaatctctcagcatttgcttgtctgtaaaggattttatttctccttcacttatgaagcttagtttggctggataaaaaattttgggttgaaaattcttttctttaagaatgttgaatatcagcccccaccctcttctggcttgtagggtttctgccaagagatcccctgttagtctgatgtgcttctctttatgggtaaccccacgtttctctctggctgctcttaacattttttccttcatttcaaccttggtgaatctgacaattatgtgtcttggggttgctcttctcaaggattatctttgtggtgttctctgtatttcctaaatttgaatgttggcctgccttgctaggttggggaagttctcctggataacatcctgaagcgtgttttccaacttggttccaatctccctgttactttcaggtacaccaatcaaaaaagtttggtcttttcacatagtctcatatttcttggaggctttgttaattccttttcattcttttttctctaatcttgtctttatgctttatttcattaagttgatcttcaatctctgatatcctttcttccacttgatggatttggctattgatacttgtgtatgcttcacaaagttctcatgctgtgtttttcagctccttcaggtcatttatgttcttctctaaactgcttattccagttagcagttcctagggagacctaggggaatcttttatcaaggttcttagcttccttgcatttggttagaacatgcttcttttgctcagaggagtttgttattacccaccttccgaagcctacttctgtcaattcatcaaactcattctctgtctaattttgttcccttgctggcgaggagttgtgatcctttggaagagacattctggtttttggaattttcagcctttttgagctgctttttcctcatctttgtggatttatctacctttggtctttgacgttggtgatctttggatggggtttttgcgtgggtgtcctttttgttgatgttgatgctattgctttctgtttgttagttttccttctaacagtcaggcccctcttctgcaggtctgctggagtttgctggaggtccactccagaccgtttgcctacgtatcaccagtggaggctgcagaacagcaaagagtgctgcctgctccttcctctggaagctttattccagaggggcacctgccagatgccagccagagctctcctgtatgagatgtctgttgacccctgctgggaggtgtttcctagtcaggaggcaccgggttcagggacccacttgaggaggcagtctgtcccttagcagagctcaagctctgtgctgggagatccactgctgtcttcagagccagtagacagaaacgtttaagtctggtgaagctgtgctcacagctgccccttcccccaggtgctctgtcccagggagttgagagttttatttataagcccctgactgtggcttctgcctttctttcagagatgccctgcccagaaaggaggaatctagagaggcagtctggctacagaggctttgctgcactttggtgggccccacccagtttgaacttccaggtggctttgtttacactgtgaggggaaaactgcctactcaagcctcagtaatggtggatgcctctcacccacaccaagctggagcatcccaggtcaacttcagactcctgtgctgacagcgagaatttcaagccatggagcttgttgggctccatgggggtgggatccgctgagctagaccacttgactccctggcttcagccccctttccagcggagtaaatggttctgtcttgctagcattccaggtaccactgaggtatgaaaaaaactcctgcagctaggtcagtgtctgcccaaacagctgcccagtttcgtgcttgaaatctagggccctgggagtgtaggcacccaaaggaatctcctgatctgtaggttgcaaagaccatgggaaaagcaaagtatatgggccagagtgcactgttcctcaaggcacagtccctcatggcttcccttggctaggggagggagttacctgaccccttacacttcccgggtgaggtgatgccccaccctgcttcgggtcaccctccatgggctgcacccactgtgtaaccagtcccaatgagatgagtcaggtacctcagttggaaatgcagaaatcacccaccttctgcattgatctccctgggagctgaagaccggagctgttcctattcagccatcttctattcctcatgatacacatttttaatataatggttgtaatctaattataactttataagataaaatacttataaagaaatacttcataaagtacaatatatcaaatagtactatttgtatttgtataatgagattataaatttatattttctaatctttttcttaaaaaaaggatactatttacatcatcacaacaatgaccctatgaagaacacacattaaaaaagctgataggttagcatgataaaaaataaagatttgaattttaatcacaaattttgtagagagtagttgttacctgaggattatgatacagaggttagcatgtgcatatttctgtagattttggttttcagattctctgacttgtgatctcaaagattccttatgataaataaaataattaagcaaatgaaaaatgaagcaaataaaaatggtaatataactttttacatagcatgtatgttacacattagatatagcataatagactatttcagaggaatatccggctaataaatcaaaatagtaattatataaatggtttaaattaggtcactggagggaaaaataaaaatcacaaaatagattcatttttacctcaacaataaacgagttcatcaatatgttacactaggttatgaaggactattagatcatatataagggctgtttataaaatgtcaacaaaaaaatcaaatcacaggtttttagaagtagaagctggtcaatacctcaaagaaaatctgtattacaactgaaataagaattaatattcttcccattaaatcacaaagcctttttatttcattcctataaaatcacatgaatgtgtaattgaatatcacaatcctttataacctcaggcaagcttcttaatgtctcagaaccatactctgttatcagtttctcatattgatagcatttatgttattgccagcttgggctattaaaacagtattccaataaatattattgttcacatagcttttgcaattatatctccactttagatatttgaaggtgaaattaatgcgagccaaaatgggctcaatgtgactgtcaggaaaaatgatatctttgtaatataatcaatttttctttgattattagtacagttgagcatatatatgtttatttatataaatcagggcatttcttaatatattcattttctatttcagatttgcctatttttctagtgaaatttttttattgatttgtaatattttgtatataaaacctgaaacactttaaacaccatatgtgctatatgcatggtattttctctgtgtctgcagcttatcttttcacttaatgtttatgttatcttcttcatatcaagttttaaatgctgacaaaataaaatctgtcaaattttccttagggcctcaagctcttacgatgatcaaaatgaccaatctttagtgacttttgtaactatacactacccatctgactccagattatatgcttttaaccacttcactattcttgtttgaaacttgagaatagggtagtagttaaaagcatcaaatctggagccagattatgtaggtttaaatcctggggcaccctcatctgactagctctacgacatgaaatgagttactcaactttcctgtgtacagtttcttgtttatcagttgagtaaatataattaaagagattagattagggcctggcacacaataagtgctaaataaacatttgttattatttgttccctccaaacatgtctgtttctctaagtagatgtttttgtataaattccaacaatgtgatgtttatatcaagattttattccatttttctcatttattaataactgtaagtgagttcctactatgtacttctctggcaccaagccaggcacaaaaaacagagtaattaataaatattagggttgggtgccatggctcacacctgtagtctcaacacctgggaggccaaggtgggagcattgtttgaggccaggagtttgagaccagacttagcaacacagcaagaccctgtctttacaaaatatttaatcattttaaaataattttaaaaaatcaacactaatggttgcttttctgatggtgcttgctgtctaatacaagaaagtaaaattgtaatgtgacaattgacagaaaagaaagataaaaatgttatgatagattgatctgttcaagactggtaagttgctttcctgaagaaataatgcttaaattgaaatataaggaataaataaaaatttctctggagaaaagggaaaggaagttcatttgtacaaatttagcaaggtaaaattaataaaattacattttcaatttattttgaaattagccttgcaaatacgaagtaatttttaagcaaaagttctaaatattgctttgctattccaagactaaataattaagaactcttccaattccagttatttgtgtgaattacataatgcaaacatttgtaaagaacagattgcttttagaaagtctgatcttgaatttatttttcttcgtttactctcttgcagacatatccattgtatgctttcaaaacattcttatatttttccagaatataaaaacactgtgtgcaaatgttcaatatacatgtagctggaaatagataacatttgggtggatggcaatctaatgtatacaaagagtagattcacagctgtgtatttgccagattagaaataaggctagacttctgatttctggagaattttggtaaagcaaaatataagagaaagaggtttagacttgttcagtgctatctaaaatagaaactcttgcagaaaaagaattacatttacttaatccatcctttccataattattcacactgaaactactgaaatagtatgtaaaatattaatagtacattgtttgaaaacctatacagtcaaccctctttctcctggggttctgcatccatggctgcttctgtattgaacacgtacagacatttttcttgtaactatttcctaaaaaatatagtataactatttacacagcatttacagtatattagttattataagtaaccctgtagcaatttaaagtatacagggagatatgcataggttatatgccaatagtacactattttatataaggaacttgaacatccatggattttggcatctgcagaaggtcctggaaccaaccccccatggataccgagggatggctgtataatatggattaggtttttttttcctaaagttcttcaaaagctcttgacctcaagctttttaaataaaacctacataaaatattctcaattaaaataactgtaaatatattttggagcagtacaaattgcttggcattttacttttaaaacctaaaggctgaattctatgttaatagattacaacataaaacagattcacttatatgaaacaagcaagttttttctcatattgtttgcaccaaagaaagttgcattgatgaatagaaaaaaaatagctttattcccctacttcctcaacacaataagaatgaaagacaactaaaattaaacttgtggtggagccaagatggccgaataggaacagctccggtctacagctcccagcgtgagtgacgcagaagatgggtgatttctgcatttccatctgaggtactgggttcatctcactagggagtgccagacagtgggtgcaggacagtgggtgcagtgcaccatgcacgagccaaagcagggtgaggcactgcctcactcgggaagcgcaaggggtcagggggttccctttcctagtcaaagaaaggggtgacagacgtcacgtggaaaatcaggtcactcccaccctaatactgcacttttccaatgggcttaaaaaacagcacaccaggagattatatcccgcatatggctcagagggtcctatgcccacagagtctcactgattgctagcacggcagtctgagatcaaactgcaaggccacagggaggctgggggaggggcgcctgtcattgcccaggcttgattaggtaaacaaagcagcggggaagctcgaactgggtggagcccaccacagctcaaggaggcctgcctgcctctgtaggctccacctctgggggcagggcatagacaaacaaaaagacagcagtaacctctgcagacttaaatgtccctgtctgacagctttgaagagagtaatggttctcccagcacgcagctggagatctgagaacaggcagactgcctccttaagtgggtgtctgacccccgagcagcctaactgggaggcgccccccagtaggggcagactgacacctcacacggccgggtattcctctgggacaaagcttccagaggaacgatcaggcagcagcatttgcgggtcaccaaaatccgctgttctacagccactgctgttctgcagccaccacggctgacacccaggcaaaaagggtctggagtggacctctagcaaactccaacaaacctgcatctgagggtcctgtctgttagaaggaaaactaacaaacagaaaggacatccacaccaaaaacccatctgtacgttgccatcatcaaagaccaaaagtagataaaaacacaaagatggggaaaaaacagagcagaaaaaccagaaactctaaaaagcagagcacctctcctcctccaaaggaacacagctcctcaccagcaacggaacaaagctggacggagaatgacattgatgagttgagagaagaaggcttcagacgatcaaactactccgagctacaggaggaaattcaaaccaatggcaaagaagttagaaactttgaaaaaagattagacgaatggataactagaataaccaatgcagagaagtccttaaaggagctgatggagttgaaagccaaggctcaagaactacgtgaagaacgcagaagcctcaggagccgatgcgatcaactggaagaaagggtatcagtgatgcaagatgaaatgaatgaaatgaagtcagaagggaagtttagagaaaaaagaataagaagaaacgaacaaagcctccaagaaatatgggactatgtgaaaagaccaaatctatatctgattggtgtacctgaaaatgacggggagaatagaaccaagttggaaaacactctgcaggatattatccaggagaacttccccagtctagcaaggcaggccaacattcagattcaggaaatacagagaacaccacaaagatactcctcgagaagagcaactccaagacacataattgtcagattcaccaaagttgaaatgaaggaaaaaatggtaagggcagccagagagaaaggttgggttacccacaaagggaaagccatcagactaacagtagatctcttggcaaaaactctacaagccagaagagagtgggggccaacatttcacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaagcaacaaccggtaccagccactgcaaaaacataccaaaatgtaaagaccatcaaggctaggaagaaactgcatcaactaacgagcaaaataaccagctaacatcataatgaacaggaccaaattcacacataacacttaactttaaatgtaaatgggctaaatgctccaattaaaagacacagactggcaaattggataaagagtcaagacccatcagtgtgctgtattcaggaaacccatctcacgtgcagagacacgcatgggctcaaaataaaaggatggaggaagatctaccaagcaaatggaaaacaaaaaaaggcaggggtcgcaatcctagtctctgataaaacagactaaaccaacaaagatcaaaagagacaaagaaggccattacataatggtaaaggaatcaattcaacaagaagagctaactatcctaaatatacatgcacccaatacaggagcaaccagattcataaagcaagtccttagtgacctacaaagagacttagactcccacacaataataatgggagacattaacaccccactgtcaacattagacagattaacgagacagaaagttaacaaggatacccaggaattgaactcagctctgcaccaagcagacctaatagacatctacagaactctccaccccaaatcaacagaatatacattttttttcagcaccacaccacacctattccaaaattgaccacatagttggaagtaaagcactcctcagcaaatgtaaaagaacagaaattataacaaactgtctctcaaaccacagtgcaatcaaactagaaggcaggattaagaaactcactcaaaactgctcaactacatggaaacggaacaacttgctcctgaatgactactgggtacataacaaaatgaaggcagaaataaagatgttctttgaaaccaacgagaacaaagacacaacataccagaatctctgggacacgttcaaagcagtgtgtagaggaaaatttatagcactaaatgcccacaaaagaaagcaggaaagatccaaaattgacaccctaacatcacaattaaaagaactagaaaagcaagagcaaacacattcaaaagctagcagaaggcaagaaataactaaaatcagagcagaactgaaggaaatagacacataaaaaaactttcaaaaaattaatgaatccaggagctggttttttgaaaagatcaacaaaattgatagaccgctatcaaggctaagaaggaagaaaagagagaagaatcaaatagatgcaataaaaaatgataaaggggatatcactaccaatcccacagaaatacaaactaccatcagagaatactattaacacctctaagcaaataaactagaaaatctagaagaaatggataaattccttgacacatacaccctcccaagactaaaccaggaaaaagttgaatctctgaatagactaataacaggctctgaaactgtggcaataatcaatagcttacaaaccaaaaaaagtccaggaccagatggattcacagcggatttctaccaaagatacaaagaggagctggtaccattccttctgaaactattccaaccaatagaaaaagagggaatcctccctaactcattttatgaggccagcatcatcctgataccaaagcctggcagagacacaaccaaaaaaggtaattttagaccaatatccttgatgaacattgatgcaaaaatcctcaataaaatactggcaaaccgaatccagcagcacatcaaaaagtttatccaccatgatcaagtgggcttcatccctgggatgcaaggctggtttaacattcacaaatcaataaatgtaatccagcatataaacagaaccaaagacaaaaaccacatgattatctcaatagatgcagaaaaggcctttgacaaaatccaaaaacccttcatgctaaaaactctcaataaattacgtattgatgggacgtatctaaaaataataagagctatctatgacaaacccacagccaatatcatactgaatgggcaaaatctggaagcattccctttgaaaactggcacaagacagggatgccctctctcaccactcctattcaacatagtgttggaagttctggccagggcaatcaggcagcagaaggaaataaagggtattcaattaggaaaagaggaagtcaaattgtccctgtttgcagatgacattattgtatatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaagggcctcttcaaggagaactacaaaccactgctcaatgaaataaaagaggatacaaacaaatggaagaatattccatgctcatgggtaggaagaatcaatatcgtgaaaatggccatactggccaggtaatttatagattccatgccatcctcatcaagctaccaatgactttcttcacagaattggaaaaaactactttaaaggtcatatggaaccaaaaaagagcccgcatcgccaagtcaatcctaagccaaaagaagaaagctggaggcatcacactacctgacttcagactatactccaaggctacagtaaccaaaacagcatggtactggtaccaaaacagagatatagatcaatggaacagaacagagccctcagaaataatgccacatatctacaaccctctgatctttgacaaacctgaaaaaaacaagcaatggggaaagcattccctatttaataaatggtgctgggaaaactggctagcgatatgtagaaagctaaaactggatcccttccttacaccttatacaaaaattaattcaagatggattaaagacttaacatgttagacctaaaaccataaaaatcctagaagaaaacctaggcaataccattcaggacataggcatgggcaaggacttcatgtctaaaacaccaaaagcaatggcaacaaaagccaaaattgacaaatggggtctaattaaactaaagagcttctgcacagcaaaagaagctaccatcagagtgaacaggcaacctacaaaataggagaatattttcgcaacctactcatctgacaaagggctaatatccagaatctacaatgaactcaaacaaatttacaagagaaaaacaaacaaccccatcaaaaagtgggcgaaggatatgagcagatacttctcaaaagaagacatttatgcagccaaaaaacacatgaaaaaatgttcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtagtgattccacagggatctagaactagaaatatcatttgacccagccatcccattactgggtatatacccaaaggattataaatcatgctgctataaagacacatgcacacatatgtttattgcggcactattcacaatagcaaagacttggaaccaacccaaatgtccaacagcgatagactggattaagaaaatgtggcacatatacaccatggaatactatgtagccataaaaaatgatgagttcatgtcctttgtagggacatggatgaaactggaaaccatcattctcagcaaactctcgcaaggacaaaaaaccaaacactgcatgttctcactcataggtgggaattgaacaatgagaacacacggacacaggaaggggaacatcacacttcaaggactgttgtggggtgggggaaggggggtgggatagcattaggagatatatctgatgttaaatgacgagttaatgggtgcagcacaccaacatggcacatgtatacatatgtaacaaacctgcatattgtccacatgtaccctaaaacttaaagtgtaataataataaaattaaaaaataaataaataaataaaattaaactttaatgaccttttgatctactctcatttaatctgcttttatattcctcatatttggcagaacccacaataatcagatgagattggctaagagtaaatccatatgtctctttctttttgaaagatttactagttcacatttttaaaaagttagaattagaaattttagtcattagaaagtaatgaagaaataatgacacccattggagtaattatataaaaaaagcaaatgtaaaaatcctagaaaatatatgcccaataaaatgagaatgcttaaaaaaatgaggaaaaaatgccgagcaaaatgagagatgagggacataaattacaaagtaaaggtgctggggggacattcatctacattgagtgctgaatccacagattacgggaaaaatcactgaaaactgcattatccattttttggtgtttcttggtgctgactggaaatctgtaatgtatgtagatgccaaccaacaaagaaacaagatgggagaagagtaagggaacgaacacgtcaaataccacaggcacggtgctggatcctttacagacattataatgtggtcaaaattacatgaaacaaattgtcattttgttttccaattgtttgatttttggcatttcaatacttgaaattaaaaatgcttttttattgttaattttagcttcataaataatgttagtaaaatatttcaaatgagtgcctttggaaagctttttcaattccaggaaaggctatgattttttgccttctataaattataaccttcagcaaaaggtagtaactactgcattaccaaagggcactcatccagaaaatctggattctggagaacaccatcatcttagaaaaaccatttaatgactcaaagtccggcaatatatcttttaaaataataccacataataaagaatattaatcagacatttttctagcaagaatacatgcatttcttttgatcttctacatgaaaatgcacatactggatggacaaatgacagtaaaatactgaaaattctaacttcaaaatgggtttcatttatcaatagaacataatattggctttgattttcagattgcctactggggaataaaattaagttatcatattctccatcagagatcttagtctaagttcataattttttttgaggtaattgtttcaataattatttttttaactgaccttcaaaaagtgaaatcttctatcattcctaacttccattctgcagtttagagagtaatgaaagcagttaacatccccacttaccccagataattgtctaaaaaatcccagccaaatatgtgaaaaggacaagccatttttagaaactcatgtaatttaaatttattttctcatttgatattttgcagttatgtttaagtcacatgctagaagagttttggtattttttccagaaaataaaaacactttgtttggagtactaacataaatatagctgggagaaataacctgtaaactgaaagcaaatctaatctatataaatatcagtttgttgttctgtttcccttgtataatatagtaaggctttagacctcactttactatactgatgttaaggggtcaccatacagcaaaacactaagcattttacatttcagctttttcagaaataacgttgtattcatttcacagtgaataagaagataaggatgatatcaaagaacatcacagaatataacaagaaattgcattttacaataggtaagaaaatgttccctagaatatttacacttaaaagaaaaatcttgctccattgatataacatctcaaggaagaactagcaatagaagaaaattgtgctaaactttagaccctgttgtagcaatatttaaaatgctgcctcatttcctcacaagctagagatgttactttgctccaacttattatttcttctttttcaagtaaatgttgctgaaatagatttgtaaagatttctgattaacccaattactttaaccccaactcactcttcaagacacaagtctaacttttttgaagataaagtaacataagactacaaacatttttccggttttagcagttgccaaaattgtgatcatgggccaggtatttgttctttccatatctcagttgcctccaatataaatggaacttaacaatagtagatatcatctatagcttttgagtggattcaatagcacgtgtacacacacatacacacacatacactcacatacacttaaagactatgccttcacatagtgaaggcaattgccttcgtgtgatagtctttaagtaaatctaaccaatgcttgattgcaataatgattaatagtggtagttttagttgtgtgagttaagacaagatgatcacgtaagtagctataacaaatatttagtgaacagttactatgtgcaagacactttttatgcttgacacgtgtcattttatttaatcatgtaacaacacaataaggtaaatgttattataattatccccattttatggataaggagagctgggatacagagattgagacagacaaatgaatataacaccagagagaaataagagagacctgttttagaaggcaagaaaacaagttaggaaataaaaacgtatctttcagatgctatataaaaatggtctagattcgaagcaatttgttaatcaagtgtaaaacataagggtaattaatgaaaataatattttcatcattagttttaagtttttaaaggtttttaagtatgttaagtattaagtatttttagttttaagtatttcaagtagttttaagtatttcaagactttaagacaagactgattttttggactcctagatacataattatgtgagttaaaattgggattatccatttttataagaaactactcaaaaattaaaatataaaaattttggctgctagccaatccaaaaactttcaatccttttaccatgtcataaagcaaatgctaactcctacttcctaagcatcccgacagggccaaactcttcatgctttcaaggatgttatctataagcatggtccacaggatagtttaaaatttctgattctgcttccaaatttgaactgcactcacatctcactcactctcatctcattttccccagcactttcttctccctcatcttcctatttctgaatggttccctggccagttctccagccaaaaagcctttggttacctagttttgctaaggactttcacaactgaggccaagtggcagtgtaattgcctgatgggtttgtatgatagttacatttcttctatatttttattttcaacttcagtagcattgagaaatttcatattagtatatttatgtgcaattggcattctttatattctattcatatcccatttatattatttcgtgtactgtattttttccattagactttttgtcaaggcagcctgaaacctagtaatgataataaatctgtgaccccaagagggtgggatgaacctatattacttttatttctcttgtgtcttcctggtgaaattgcctttacaaaaattatgacagtgaaataaatctgacctaagtgactccatcttgcttctaacccccaagctgcccttgcacattcctgggtgtgggcctagctaactacgggagaaacttagtttatggcctaactttggaacaaagatgataacagctccttcttggacaaaacccctcattgcttggagatcagacttcctttgtaaaactaacaaagtagccacaagattagaaattatttctcagaaatcatgcagccagaggccacaagattcctaacttctctgttcctgtgaataacattattattgtaaaacttaaggttgatttttgaggtattttttaggccctgccttctgatggaccaggtggtgccacccagactggtaaaccaacttacctgatctcacggcccccaggaactgactccatgcaagaagataagctttgactgcctataatttcatccctgacccaactaatcagcattccccatcccctagccctgtgtctgccaaactactcttaaaaatccgagcctctggctgggtgcagtggctcatgcctgtaatcccaacactttcagaggctgaggcaggcggatcacgggttcaggagattgagaccatcctggctaacacggtgaaaccttgtctctactaaaaatacaaaaaaaaattgtcaggtgtggcggcatgcacctgtagtcccagctgcttgggaagtataggcaggagaatcacttgaacctgggaggcagaggttgcagtgagccgagatcgtgccactgtactgcagcctgggcgacagaaggagactctgtctcaaaaaagaaaaaaaaaaaaactgagcctccaaattttcagggaggctgacttgagtaataaaactctggtctcttgtttagctagctctatgtttattaaactctctattgcaataacactgtctcagtagagcagcttttctgggcagcagacaagataaacccattgggcaattacactgccacttggcatcagttgtgaaagtccttagcagaaccaggtaactaaagccccagctttttggctggagatccggccagggccagggaaccatcagaagtaggaagatgagggagaaagaagtgctagggaaaatgacactgcaatgttgattgtgaacccctggcatcaactccaaaccatgcttatgtggatctgaatgtaatcagcctaatcgaaggaacagaccacctctcaggtcagagactaataaccactaacattggacacattggaataacacagcaaatgctttaaaaattgaactgacattggaaccacagacaataggatgctagatgtaattatcaactgaacttaagcatgttgattgcctgataaaacaacaatataagcattctccatagaaggtaaacaaagcctcttaatataatattaaatacctgtagatactttagtaggcagaataatggctccaaagatacccagattgtcatcctcaggacctgtgaatatgttaccttacatggcaaaaatggatttgcagatgtgattaagctaaggacctaaagatagggagcttatcctgaattatctggatggatccatagtcatcacaggtgaaagagagaggcagaagagtaggtcagcgtgatgagttgtgagaactcaaccagccattgttggtttggatgatggaggaaagaggccaagagccaaggagcacacaaaagtgggaaaaggaaatagattcccccctgcagtctctaggaaggaacacagccttgctgacaccttgatttagtcctgtgtaactagacttctagactgcagaactgtaagataataaatgtgtattattttaaacaactaagactgtaacttattattgcagcaataaaactgaaaagtcttttaaatgccactaaaattgataagactctagcaagattgtcaaagaaaaaaaggagaaagccaaattacaataatatgaatgaaatagggaattatcaccatagcatcataggcattaagaggatactgagagaaaactagaacaattttatggccataattttacttcttaaataaaaagaaccaaacactttaaagacacagattaccaaaattcaattaagaagaaatatatactctgaatatttttaaaaccatgaagggacttgaattcataatttaaatcttctcaaaaatgtcatctttggtgatgatgtcaattgttagtttctaccaaacatttagaagtaatgccaactctacaaaatctcctccaaaaaatagaagaggtaacactttccatttcattttatgagaccagcattacactgatatcaaagccaaagatagtataaaaatgaagatgaaggaggaggaaggagaggaatgagaggagggagaggagggggaggagggggaggaggggaagaaagggggaaaaggcggaggagaggaggaagaggataaaaaaatataaacatcatatattagcatgtgtgtatgtatgtctgtaccacaaccaaatgggatttattctaggggtacaagtctggccaatattttggcatcaatgaaatctgtattaatagtctaatgaaaaatgtaataattatttctttttttcaggaaaaatatgtaaaattcagtgttcattcattatagaaattctcagcaaagtaggaatggtaaggaacatcctcaacctggtgaagaacatctaagaaaaacctgtgactaatatcatacttaatgataaaagaatattggcttttctcttaagattgggaacaaggcaaggatgttcactctaacttctcccattcaatcttgtgctagaaattctaactactacaataacaattttaaaatataagaaataaaaacttaaaatgaagaaatataactgtccctatttacaagtgatatgatcatctacatagaaatcccaagaaatccacaaaagactcgtcaacccaatggagtgcagcaaggttatagtgaggtaggagaccagcaggacttattcctggtctcaacaggatgaagtgaagaaaccagcaagaatcagtagatgacaacagaaccaacctctaggtgtccccactgctcatcagcataagacactcccaccagtgccctgacagtttacaaatgcccagcaacacccagaagttactggccgttttctagagagttctgagtaacccactccttaacatgcatgtaattaaaagtgggtataaatactactagccaatagtccacatgctgctactgtggatgctcaggctctgggttagtgctgctccacaaggagctgtcattctgcggtacactgacacttcaataaataggctttctttcaccactagctcactcttgaattatcttctgagcaaagtcaagaacccttctggactaagccccaattttggggctcacctgccctgcatcaacaggatacaagatcaacatacaacaaaacaattttatttctgcacaatatgaatgtaactataaactgaaagtttaaaagaaataccatttacaacacctcaaaaatttggtataaatctggcaaaatgtgcagaatctgtatgcagaaaacaacaaatgctgattaaaagatatcaaagggccaaataaattgagacatatgatgttcatagattgaaagactcaacatagtaaaatgccatttcttcccaaatttagatttattgaaattccaaacaaaatcccagcagaactttatagatatagataagccaatttgaagattaatatggaaattcaaaggaattatcatagctgaaagggttttgaaaaagaagaataaaattggaggaatcaccctacctaaatttaaaatttactgtaaagctactgttatcaagacaatgtggtatagatcagctgatcaataaagcagaagatagtctagaaatatatggccaagtgaattctgtgcaaaataatccaatggggaaaagacagtctttgcaacaaatgatgttggaaaacctgaacatttatatgcagttaaaacaacctgacctggagtttgagaccagcctggccaacatggtgaaatcccgtctctactaagaaaaattagctgggcatagtggcacatgactgtaatcccagctactcaggaggctgaggcagaaggatcatttgaacctgggaggcagaagttgtggtgagcctagatcacgccactgcactccagcctaggcaacagagcaagactccatctcaaaaaacaaacaaaaaacacaaacaaaacaacaacaacaacaacctgacctaaacctcactttatccaaaatttaactcaaaaaacattatgatgtaaatatgaaatgaaaagccatggaactttttgaaaaaatcagccaggggtggtggctcatgtctgtaatcctagcactttggcaggccaatgtgtgaggactgcttgagcccagaagttcaagaccagcctgggtaacatagtgaaaacccatctctacaaattttttaaaaattagctgggtgtggtggcatgcactggtagtcccagctacttgggaggctgaggtgggaggatctcttgagcccaagacgtcgtgtctggaatgagctttgattgtaccaccccactccagcctaggcatcaaattgagaccctgtctcaaaaaatggaaaaaacaaaacaaaacaaaaaaacctttacaacttggtgttagtctaagagttcttagagataatagcaaaagcacaatcaataatttaaaaacagatcagttagattttgtcaaaatgtaaaacttttgctttacaaaagacactattaggaaaatgaaaagctaaacttcaaaattggagaaaatattttcaaaccacatgtctaacacagaacttgtatccagaatatataaagcactctcgaaactcaataaaaagaaaacaaacaactcaatttaaaaattcatgataatatcaaaaggctggtgagaatgtgcagtgactagaacactcctacattgctgttgggcactctcttgtttacacttcccatatgcctcagcaatactattcctgggaatttactttagaaaaataaaatttatgttcacagaaagatatgtacatgaatataaacacagctccattcataattgctgaaaaacgaaaacaagccaaagttctagcaatcaaagcctgacacatttgactggttaaaaaaaaaagtttatgttatatttagacagtttattacttagcaaaataaaatgagcaaaaatgccagatacccaagccccttatctcaaaggatgacactgaaacaaaaatagcgagtaatgtgatgatgtatcatcagtagtgggagcaacctgctgctgcagatccaattgcatcttgcagataagcagctttatactttgcagttgtgcccaaataacagagaggcagagagcctcaggcctcttcaaaacccatgaagtgatgagtaactgtctcatggcagcctccttggaagataggtagagggggtaggctcttcaaagcctcccacactctcatgttccaggaatatctcagagcattttaccaaaacttagatcagctgtagttaagccttggccaaatagcctctctagagacatgcagggaagatgtttatcataagcccagaaacccctctcctgggattagagagaccttagggagtgaaaaatgttgatcacacaaaacaattgtatgtcaatgtttgtaatagctctattataatcacacaaactgtaaacaatccaaatgtctttcaacaggtgtatgaacaaattttggtacattcatatcatggcatactactcagctctaaaaaggaaagaattattgatatactcaacgccataaatgaaatcactgtgttgtaaattctagatttgtatttcatttaatataatttcttcacttttaaaaagtgttaaacttatattttcttttgactattgaggtaaaatatacgtaacacaaaatttatcatgcaagtcatttggatgtgtacaattcagtggtattaagtgcattcacattgtttcacaaccatcatttctattcctcttcagaactttttcatcatcctaaactaaaactctgtacccattaagcaacaactttccattctcccctccccagatcctggtgaccactattctattttctgcctctacggatttaactattctaggtgtgtcttattagtagaatcagacaatatttgtccttttgtgtctggcttatttcacttagcataatgtcttcaatgtttattcatgttgaagcaatcagaattttattctttttaaaagctgaataatagaccattgtatgataagccatattttgtttaaccattcatcccgtgaagagcatttgggcggtgataatcttttggatattgtacataatgctgctgtgaacattggtgtgcaaatatctttttgtgtcctggctttcaattattttgctcacacagttggcccttgaacaacatgggtctgaactgcatgagtccacttatatgcagatattttcaataaaacttacactgaccattcctgtccctcctgcctccccttccacttcctcatcttctcccagagacagcaagaccagctcctcatctttgtcctcctccttagcctactcaacctgaagacaacaaagatgaagacttttgatagtccatttccatttaatgaatagtacatatatgttctttcttattattttaataacattttcttttctctagctttctttaagaacacagtatataatacatacaacatacaaaatctgtgttaaatggctgctatgagtaaagattccagtcaacagtgagtatgtgtagctaagttttgagggagttgaaagttaaatgcagattttcgactgcacacgggtcagcaatcctaacccctgaattattcaatgatcaatcatatacctagaagtaagatttctgatcagatagtaatctatgatgctttttacagtggctgtactatttttcattcccactggcaatacccaagggtttcagtttctcgacatcctcaccagtactttattttcttttctttaaaaacaaaataacagccatgcatcacttaatggtgggaatacattctgagaaatatgttgttaggtgattttgtcattgtgcaaacatcatagtgtgtacttacacaaacctggatggtatagcctgttgcttctaggctaaaacctgcatagcatgttgctgtactaaatactggaggcaactgtaacacagggtaagtgtttatgcatttaaacatatgaaaacatagaaaaggtacagtaaaaataaagttttataatcttatgggatcattgtcatatatatgttccatcattgacttaaacactatcatgtaatgaatgactgcatttagtaattatttatttatttttttaatttcttatattgttattgaaacaaaattttggttctttattttaaatggaactcactttttgttatgatgtaaatgacagatctaacatttttttcttccaaaatagacagccaattgccaaaacaaatatattatttttctagaattatccaaaatgctacctaaaattcctattccaaatggatctgattatacgttctgtactgttttccatagatctatttgattatttttgtgtcagtactatactgttttaatcatgatggcttttatgcttagtttaatagctggtacagcaagccttcactcacactcttctgtccaattgttttaaacagtttaatttaatgctgccctcaggctgagaaacttgtgccagaatgtaaattaagtacagcacttactataccatctactttacctgatagcaagacttttttcacaaattaactggtgcattgacctatattctgacacattctgataatgaactagttaaaaaataaaacagttcatgtaagttgcgatgggtggactgcacttgagttatattggtttagacttcttggctatgggtaatctaaagccagggaaccatgcttgttctagaaggttttttccccctgccctcctacccctcctaactttctatagcatgcacatccctgcaagtccctttcttgcattttctctctagtgtttctgatgacttttctcttcccatgctgcagcccatagagcgactgagcattaggactttctgaagggcttaggcagcatggaatcccataaaatctctggtatcatctctcacttaccaactagttaaaatttcatcttcttcctgagtggtgcaaaaactattctgaaatcaaattatgcattctttcttgctttattacttatagtttaaactctggctccttggaactcacaaatcttttttttctctcaagaaagttcactttttataataaaggcttgttttagactactgttgtggttattggcttaaaacattattcttgtagattttttaattcctgaagtttttctcagtcttttaggaaaaaagaaaaaacacaaaaatgtgttcaatgttagagtctgcttcgatctctacttatggttgaagtaatgaagacagagaagttgtagcatgggaaaataattatagtctggtaaaaactggtcattagaggagcctggagttgagggaaggaacaagagaatacaagtacaaagtagacatgcttgcaggatgtgcgcatttccccaggaatcactggaaacatttttggagggtatctgataaagactgagcattgtgtactcataatagatgagttatggatagtcagaccatgctagatgagcccgaaagggaagggtgactcctcagggtaaagaagttacagatatttgaattgcatgggcagtagaaacttacatgcagcatattattttaaaacagttcatttattcatagctattataaattgcataataaaaagaagtaaaaagtgaattggaagtatgtttctgagtgattaggtaatatatttcctacgaaattaacaactgatgagtagaagaggactcaagtagtttcggatccatccctgcttcttgggtagtgcgtcaataagactcttggcaggacacttcttaagggattattaggtgtcggtgcttataatcagcatcttatataataaggagatatcattatttcacatgtagagcttcagtttgcactcacgttatatatatatgtatatatatatatatatatcaagtggaatatattagtaatatttcaaaagtactgcaaatatttcctcatttcaaagagtgctcttctcttccttctactgctgaagtaatatccttgtatatctccaattttttttttttttttgagatggagtctccttctgtcacccaggctggagtacagtggtgtgatcttggctcactgcaacctccgcctcccaggttcaagcaattctcctgcctcagcctcctgagtagctgggattacaggtgcgtgccaccacacccggctaattttctatatttttggtagagacaggtttcatcatgttggccaggctggtctcaaactcctaccttgtgatccacccacctcgtccccccaaagtgccaggattacaggcatgagccaccacgcccagccatgtgtctccaattattaattctagaaaaagataaaggcttattttatataaattccctccatatagataacctttttatccctcagaaaatgtacttataaaggagcagaaatggggcaaaatggtttcacatgctacttattgacaggaaaagacttaaagttggggtggaaaagaggattcaatatcatgttacacaattcttcataagatttagtttgctttttcttggaagcacagattaatttggagtcttttacctttacatatggatttcaataacctttttttattcttagtgtataaaattgcctgccatttccctcccacaagtaatatcattataattttaatctaattagtttgcctacatacttgcattccttcatcttcttcctattccatttattaatatcattctttcctctctttattacctattttgtcataggaatatagttcaatatcaagtcagcatttacctgacaatgatactaaaaataataatacaacatttcttgaggacttattagctcccagtgtatatgttaagcatcttacaatcttacacaaattatttcatttcattgtcaaaacaactttataatatagatactaatagtatatttcatttatgaggaaactgatatttaatgatggagtagtatcatcaaggtatcacataacttgaaatggaagaatcaggatatgaactgtctcagttcacagtatcattataaatttaagtgatattttttaacttaaaagtaacatttatctcctataaacctttttattttctgaagtgtttttaaggatagttttctaaaattaaagttcaaaatgaaataattcatttacattcttggaggaggaatgaacgataggcagtttattaaattgatatttcctatcaaaattcttttagcttccatgttcatcttcttttctgcattgctattacttctaaatgatatagtcgaaatgatattctttcaaatttgaccgagtttagctatttatccactgaaaaatctcttgttgaaatttgatgtccaatgttggaggttgggccttgtgggaggtgttgagtcatgggggcagaaccttcatgaatggcctggtgcccttctcaaagtaaagactgagctcttgctctattagttcctttgagaacggattgttaaaaagaggctggcatctctctccctttctgaaaccatgtgatgcctgctccccttcaccttcctccacaagtgggggcagcctgaggccctcaccaaatgcagatatcagtgccatgcttcttgtacagcctgcagaattatcagctaattaaacctctttctttatcaattacacgctctcacatattcctttatagcaatgccaacagactaaaacaaaattgagaaacttcccaaatagatcactctgggctaagttgtcagtagaataacatgcagaaaactttaccagtaaaactgcatagaaattaccagaaaaacaataatatatgaaaaatcatttccatgactaaagtaagctacaaaagttatgagactcatgtataccctctattctggaaagaaatgaaataatcccctatactgatagggcagatcaggagaatcagccattccctcccttgctgcagcctcgtcaaaaataggtctaatgtaggctttgggagagcttaaagtcagaacagagaacgatgctctggcaaaagaggcaaaccatgtggtctgaacagagggagcagtcactttccaattttttttttttttttacaaataagcgtaagaaagaaacaagtttcaaagacagtagggaagaggaatggatatttaatagcttggtctcaggaccactcaggttccatctacaaattgtattgttggcatttgattaaaacttacttattactttttaaattaaatgactttattaatatgtctattttagatactcccaagagttacgggaaagggaaagtatgttcgttaggcaaaattccatgaaataaatccctagggaactttaaactttgtttcagttttttccaatgaacatgtattattttacaatggaaaatttcaactaaaattatttccagtaagatcataataagtctaaatttttcaactaaagaatctaaatgtagttgttattcagcaactactcttcctcctgctaggtttaatgctactggatcaactcaatcttttccacaatattgtcactcatacttgcttctttctgtgagtctttattcccttgacatagttgctatttcctcctccacagggagcaactgtatctcaggcagttacaaaatcaaaaattttctgtcaaacagcaaaatagggttgggcacggaggctcacacctataatcgcagcactttgtgaggtagagatgggtggatcactagaggtcaggagttcgagaccagcctggccaacatggtgaaaccccatctctactaaaaatacaaaaattagctgggtgtggtggtgcgtgcctgtaattccagctacttggaaggctgaagtataagaatcacttgaacctaggagacagaggttgcagttagctgagatcatgccactgcacttcagcctgtgtgacggagtgagactgtctcaaaaaataaaaaaaaaaacaaaaacacctcaggaaaataagattattaaactggaattaacaatttgtctcttacaggctaattggaatggagaatttttctgaagttggcggccagcctcattaaaaaaaaataagatctcaacttttaaacataagctctctattcagctagattacaaatatgaacttgtaaagtggtaatgctgattttcttccttagttccatatggtaattagtaatgagagtaaatgaaatagggtgcggacatagacaaatgatagcaaaatttcagaaacaagagactgcctaatgattaaaacagattttaaagctacagctataccacaaataaattgcctgttagaagctaacaaaatgtcccaatagatacattgtaaaacttaaccacacatagaacatagtgtgtgacaactcattttaagatttagtgtaacagtgactgatcaccaaacctaatgagtggtacaccatgaaatatccctcttgggggatcactgtgagtgtccttaaagggaagaaaatctcttctgagacttgtagttggttataaaattttcaaatgtttgaatcagtgttcagacttaggatcacttttgatgtgacaaaatacattaggtctatctttcagaaattacccagcactttgacccatgccataaaatttctatatcacattagaaagtcccattaggatacattgcagtgagaatctggttaagacctgcactgaagcgtgtttttcaatcttactgtacatgagggcaaatttttacttccttgcctctgcaatgctgaggcaagttaatttttacagccaaatctcatgtcactggtctactggttgagaatcagactcaggaagcacatcctgtgcattctggactgacctgctacaagaccctggtgacttgccatctcctgatgggaaaggaaacatcagatggatactcagaacatcactgggcattagtgtggttcctaaccagaattttgttcaatctgcacatggtccaagagattatctgatagggatcccacagaattgtgagattttaaaactgaaaggaatattagaaatcatatagtttcacccaaatacattatagatgtgaacaaaatttattgaatggagatagtacaatgagacaacatatctacatgtcctttgtgatggttaattttatgccacagtactcagatatttggctaaacatgtctggatgttgctgtgaatttatttttaaattgaggttagtttttaaatcagtacacttgagtaaaacagataaccctccatgatgtgaatgagcctcatccaataaattgaaggctctagaaaaatgactgacatccccaaggaagagaaattttggccaaaagcctgccttcacactggagctgcaacatcaactcttccctgggtcttaggctaccagcctaccctgcatattctgggcttgccagtctccgaaattgtacaagtcaatcccttaaaataaatttttctctctccacccacctacacccacacacacacatacacgcacccacctatacacacacacacacacacacacacacacacacacaatctattggttctgtttccccggagaactccgaccaatatactttcatccctgcaaggacctctcatcacagtaagtcattgaaaatccataacgtgacctataaattcctcatgatctgactgctggagacccctctgacttagtttactaccatttcccccctcactcattgtgtccagcaacactgaccttctgggtcagtttctatgttgagcttttgcatgtaaccctctcctgtggaatttccttccccagcaagagcacactctttcatttcactgaggtctctgttcaactctcactctaaatcctcacaacacaagtgggatttatgagctagtagcattgacatggcccaggagcttattaaaaataaagaatttatcacagatcttatcctagacctactgaatcaaaatctacatattagtaatatgccaggtgattcatgtgcatgtcaatgcttgaaaagaatagatgtaaagtgtcacctcccattgctctttggctctttgcctgcttcttcttcatggcattcattactaattgacattatattattttttatttacctgttgattgactgtttctctcactgtaaatcctaaatggcagggattctaatctcaagactggaatctgacctagcacacagtaggcatgcaatagatatttttactaactgaagaaataaatgtcaggcttggcagaatcttctttctcattgtgttttatgtctatagcattctttatcaactctatgttcctttaactcctacttagaatttaggtctcagtcaaggcagtgcttcttttgggaaagtcttttttgatccctccggtggtgactgggccctttggtgtgcattcatgcactgactcatcacagcacttaaaacacaagagagtaggtcctccatgaagaattaatgagtgaattcatgctggtcataacaaataattcttgactgaccactcaacatcctctacttgctcctttctatgcaatgactgatttttgtgcagatatctaatatcctccaatatgctgtgctacaaaccatatctcttacccactcccagggagtatgatctgacttgcccaagacaaaaaatggcagtccccttttccttgccagtgactggtttaagaacgggcaagtgctacagttctcattaaggagagaggagaccatgcccaggttcttagggagaggcacaaaataaggcaactcttttctccctctgaaaacttttgttgtgtatgtgtgatatcagattactataaccatcatgctaatagctattaagatgaagccaacccgcataaaagggtttagaaaaaacaatagcagagaagtgaaatcagaacttagattgtcctgctcttggactttgtatcatagcgtatggtaagtgaaattagcattgagttatttgaacctggaagcatcattttactttggtgatatgagtgtaaacttaaaaactacctccatagtggttgaaaagcaaaagtaattattagtctctgttaatgtacatattttcttttttttccccaactagaaaatttaatagtagtaggaggatcttcttagcgtaatagtaagtaacagacccttaaatttataaaacttatttgttactagacattaatcaacaagcatttactaaacgtataactattatactataatagagaaaatagcgattttaattttgaagcaaatcaagaaattcttatttgttgttggctgtccgaaggagcatgtttaggtcacttagttaaattctttaaacagtgatagaatcagtaaagatgttgaaatatccaaaatctatgatctccgaactcccaaaagaaaaaggaattaattgcgatgtatttcaaaaagtaagtgtacagagagattacaccaatttgttatctgactaaattgttgcaggactctgtgtaggaacagtacatacaacaaggcatcttttaaaggacagagtatttcctgaactacatattaatgttatttagacagattttttaaaagtttgatatgtacatcaatataaaatttaaaagggagtcatgggtgggggaaatgggaaaatgctggtcaaggtgtacaaagtttcatttaggtagcataaagaagttctggagatctaatgtgcagcatggtggctataattaatgatattgtattgtatctttcaaatttgctaagagagaaatcataacttctcagcacacacatgaaaataataactatgtgaagtaatgtatatgtttattagcttgattgtagtaagtattttacaatgtatacgtatatcaaacatcatgttatatactgtaaatataaaaaatatttgccaattataccttaataaagctgaaaaataaataataagaagcacttataacgccacagtccagagataatcacagtcgaattttctggtattttttcaatagttttatatgcatattttatgactttaagtataaatctaccacaatttaatcttcccatattttttgatatatattttgtttgactattataaatagtactgtaatgaatatgctttgcataaaactttaaaaaataaataaaacagtaaaaaagaaatataaatgaaaggagagtcaataaaaacctggatccaatgcacaaatgcatggtggcatctattaattcatttaatatttattaaatagtttgtgccaggtattgtacttgacacagggagtacaatggtgaacaaaactagaaacagtctctgaccttttggggctcacatattcaagaaggaaaacacttaaatagtaacacaaacatatgtttgaaagtatgaaaaaacattactggaagctgtcaaggaattttcaatgagtgcagaatatttgaaaagcttgagatataaaagatgaacagaagttgtaaggtgggagaagagatatctgagacaaagggtagagaataagcagaggtcctaaagtaggagcatttttggagtcttgtggaagtaaatgatttttttcgctgtaacccagagaacaagagtggcacaagaaaaatatggaagtatagtaggatattggaccctgaaattgtttgcaaactatgttaaatgtatgttatttatcgttaaaaaatagtgagatatctacttatattaagcagagggtgcaaggggtgcataaagaggtgagactgaagtctgtgcatgagaagttcaaatttgcattttagtataccctgcactacagacactgaaatacagataagcaaaaatggatgtaggtgcaccagttgagggctgttattgtgattaaggtgaaggataatggaagctttaactatgatgatagtaaaaaatgagagaagtgaacagaagagaaagatatctaggaagtagaatcaataaaatctggagatgagtttaaaagcagggtagcactgaatggaggcagatacgagacttaattgaaaacataaaacaggaagagaggaaatgagggtagtatcttttcttctatgaagtttgactataaaataaaaggagaaagacaatgagatagcttacatctaaaggaaattttgtttaagtgagggagacttgtgcatgtttaaaatattttgagaaggatccactttaagtagtaaaacacacatgacatataaaaatataatgaataaagtaagatttttgagaccaaaaatcaggaccagagtaagctggaaacatgggctttggataggaggaacaacaattcctctattggaactggaagaatgcagaatatattataagtgctagattttattgagaatattgctgtttgctgttgtttttaatctgtaaattaagagacaaggccatctgtcaaacatgaaaggggaacgcacgaacaggaagtttgaagactgtggagaaggtttgaaattgtaattgcaaggagtcaacatgatcagaatagacaaaatatctataggatttgtagataagatgaggttcaaatgagattggcaagcattaatttatagcaatgtcaatctgcctgttgtgctttgtctcttgaagctcttggccacctggctctagacatggaaaagtggatagttggaatcatccaagatggaagcatttgaatgaagcattctaaagcagttataaacatggattttggtggaaacctgaggcattcattgtattactcaaggagaatgggtagactaataaagaaaaaggaagaatatattagagttggacaagccagcaaaagagacagataagtaggtagaagtaggaagaaagccaagagagcctattatcatgcagaatgaaggagagaaagcaagaaaggtcactagtcagccgtgtcgatgtgaaagggaggtggaaaccagcactgaacatttagtaattaaaatgtcattaattctcttgaaaagaatagactgcatgaggtaaaaaaatatgtatatctgaaggactaaagtctgagcaagacaatttcaagaaacttgtactggaagaaaaaagtgagagaagcttgccatcaacttaacttttaccagcttaaaatggattgtttgttattcttccatctgaaaatttaaggatccagataaaatggaaggagaaaaaacggtcatcatcaaactgctaataatgataaattctggagaggaaatggcgttggaaatatgcaacatcccccattgtttattgtccatggttctctgttccttgaaaactgtcattgaaaaaagtagcattttttgtaattataaagtcaattaaaaattctagaatgcttctaataatttgacactttatttctagtattatctctatcatatttttataatgtatatctatgtcttacaacatatatcaatgcatatctagtattattatatctttcttatttttacaatgattcataaagaatacagctatagtaggcattccttcaaattgctcaagactgttttgatttctaacttaaatttaagttttcaaaagttcttcagcatattgagatgtttttgtcttctttttagcacagctaaaatattgcaaaatccctttctaagctaattttccattaattttccatgtggatatgagtcttttatgttttgttttattttacatcaacaattttcacgccagtgaattaaatacagctttttatttcactgctgaatgttcttcagttgtctgtaaaactgaatacattaaataatttattataatttaattaacaacatatgcttacctagtgacatcacatataaaggtcggctccaccgtgaaaatgctccaacttaagacatgctcagaagtcattttaaattttggttgtttttattgttgtttgactattcaattctgggtgataaataaaacgctttcccatgctgtccttacactgattatactcaagattgctttctacctaactcaaacaaaaccccccaaaacttacaaatatatattggttgctgaaaatgctcatacactcaatttgaaaatattccaaatcttttatgggttagacttttgtttcttgctcaatttcacactgacgtgtgtaaaagtattataagcatttgctatttagttcattatgggcaaaacagcagattgttttgtattttgaaagcatcctccctgggcttttaactaatctctcaatcacatgagaaaagctaaagaaagaataagatgctagcctatatacacatcatagaagcttgaaattggccaagtaccttggcagaaagaagggtgcttttattctagtgaacagaacaaagtagaatgaatttagatttttttttttaggagagaaaagtgtgatttacacaggaagagccatttcgtccaggtttgttgagatttgggcagtgtgttctacagcaaagacatctcccctgtagactctggaacattctgtattatcctataacagatgatcagccatatggtgaagggggaggaaaatcagggatataagaatctgctgtactagtagatgcatgaatgagaaaacaaaggttaaagccaaatttggggactgtggctggttttctcattttattttagagattttttattgagtagcacttcttggcatatgccaatatatttttaaagttatatttatgtattaagttttcttataaaaatatttttaaagttctctacaataacaaaattgagataaagtctcacaatttgttataatttggatacctctgaattattaaaattaactataaaaactcaaaaagtctagcgtttcagagatgttataaaacattttgaaatacttacatgaaataatctaattattccagtatgcaagttcctgctggtagtaggttagtaagttgttttagaaatctacagtaattctttcaaaacacaaaaatatagtgtggtagtaactcatgtaattttacctcagctgtttaaagtcaaaccaacttcaacactatctcaatatgttatgcaatcattcatatagcctaagagataaaaaaaagttttataaaatgacattggtagaaaagagatctgacacttgcctcccactttgcaaactttctccatgtttttggtatttatttatttaattaacatacaaattgtagatatttatggagtacagtgagctgctttgatacacatatatagtgtaataataaaatgagagtattagcctatccaacactttatacatttatcatttctttgtggtgagaacattttatatgcttaggctttgtgtccccagtcaaatctcatcttgaattctaatccccataatccccacatgtctagggagagacctgatgggaggtaactggatcatgggggcagttctcccatgctgttcttgtgatagtgagtgagttatcatgagatctgatggttttataagaggttcttcctgccttgctcctcatgcttctctctcctgccgacatgtgaagaaggtccttgctgcccctttgccttctgccatgattatagttttctgagacctttcaaccatgtgaaactgtgagtcaattaaacctctttcctttataaattatccagtctcaggtatttctttccttttttattattatactttaagttttaggatacatgtgcacaatgtgcaggtttgttacacatgtatacatgtgccaagttggtgtgctgcacccattaactcgtcatttacattaggcatatctcctaatgctatccctcctgcctccccccactccacaacaggccctggtgtgtgatgttccccttcctgtgtccaagtgttctcattgttcaattcccatctatgagtgagaacatgcggtgtttggttttttgtccttgtgatagtttgctgagaatgatggtttccagcttcatccatgtccctacaaaggacatgaactcatcattttttatggctgtatagtattccatggtgtatatgtgccacattttcttaatccagtctatcattgttggacatttgggttggttccaagtctttgctattgtgaatagtgccacaataaacatacgtgtacatgtgtctttatagcagcatgatttataatcctttgggtatatacccagtaaagggatgttatagcagtgtgagaatggactaatacaactttcaaaatcctctcttctagctattttgaaatgtgcaatacaatatagttaatcatagtcacccgtctgtgcaatagaacagaagttattctgtctatctaactgtaactttgtagccattgacgaacgtctctttattgattccttcccctctacactccctagcctctggcaaacactatgtctatgagatcaacttctttagatttcacatatgagtgagatcatgcagtatttgtctttctgtgactggcttgtttcactttatcttccagattcattcatgattttgcaaatgacaatatttcattttttgaatggctgaatagtatcccactgtgtatgtataacacattttctttacccattcatccactgatggacagttaggttgattctaaatcttggctattgtgaatggtgttgcaataaacatgggagtgcagatatctttaacactgatttcttttcctttggatgtatacccaatagtggaaatgatggatgatcccatagctgtatttctaattttttgagagacttacattctgtttttcataatggctgtactaatttagattctgagtaacagtatgtaagtgttctcctttctctgcatccataccagcagttgtcattttttgtcttttagataataaccattctgaggtgaagtggtatctaattgtagttttgactgaatttccctgatgattagtgatgccgaacattttttcatatacttgttagtgatttgtatatgattgtatatggtgtttcttttgggaaaactctttccagatcctttgctcaatttttaattagattgttttgttttgctttgttttttgctattgagttcagttgagttccttatattttctggatattaaccccttgtcacaagtgcagtttgcagacatttactctcattctgtaggttgtctccttattctcttgactatttccactgctgtagaagagacttggatacccatgtcttctagtttcatgtaacttaagttgttgatttgtttttgttgtctgtgcttttgaattcttgaccaaaccaaagtcataaggcatttggaaaagtacagtctcttcaataaacagcactgggaaaactggatatccacatacagaagaacaaaactaagctcttatcttttaccatatacaaaatcagctcaaaatggattaaagacttaaatttaggaccccaaaaatataaaactactagtagaaaacataggggaaatgctttatgatattggggtcatttattttttctcttgtacatttgtttaagtttcgtatagactctggatattagacctttctcagatggataggttgcaaaaattttttcccattctgtaggttgtctgttgctctgataataatttattttgctgtgcagaagatacttagtttaattatatctcatcaatgaacccattaaaaagtgagcaaaggacatgaacagatacttctcaaaaaaagatgttcatgtggccaaaaaacatatgaagaaaagctcaatatcactgatcattagaaaaatgcaaatctaaactacaatgagatatcgtctcacgccagtcagaatggcaatcattaaaaagtcaagaaacaaaagatgctggcgaggctatggaaagatagtaatgcttttacacagttgatggaaatgtaaattagttgaaacattgtggaagacattgtgacgattcctcagagacctaggacaaaaaacactatttgacccagcaatcccattactgggtatatactcaaagaaatataaatcatcctattataaagacacatgcatgcatatgttcattgcagcactattcacaacagaaaagacatggaatcaacgcaaatgccatcaatgatagactggataaagaaaatgtggtacatatacatcatggaatactatgcagcaatacaaaggaatgagctaacatcctttgctgggacatggatggagctggaagccatcatccttagtaaaccaaggcaggaacagaaaaccgaacaccacttgttctcactcacaagtggaagctgaacaatgagaatacatggacacagggaggggaatgacacatgagtcttatcagcaggaacgggggatgtggggagggagagcatcagaaaaaatagctaatgaatgctgggcttaatatttaggtgatgggttgacaggtgtgacaaaccaccatggcacatgtttacctatgtaccaaaactgcacatcctgcacatttaccctgaaactgaaaataaaattaaaaagtgagagacagaacacaattgacaacagatttcaatagtatattttattacatttttgcaacagcattcttcttggcttttccttcaaaaatgattttccaaattttgtactgagataattaaaaggcaattgagttttttctaaaatagttgattaaaacttgtttccattagtgtttatttttgttatgtatttatcttatttgttaaataatgaaaactatttactttttatttttaatatgtattattttataacatactgcagaaaaatatatttcatcttcattttataattcacaatgttatataaaacctctctaccaagttctgtcataaatgagctgaaaaatatcagaacatttgaagctgtcttctgctatgtctaatcttaagcatccttagaattgattattctctaactagtttgatattaatgactccttagagtggcagatttttctttgtgttatttcattgatatttgtgtttggtgtcaaattagcaagaaatctagatatttttctcatgtcctcctaagtcacattccttgtcactgactatcaaacattcaaaatgtatccattatttatgttaatatttaactctttctccaaataaattcctgctttgatatagtctgatattttattacaattggcttgcagataactttttgttgattttatcattcatctttataaattatatttcataatctatgacattaatgtcagtactctgttatttaaccaataaaagtaaagatgatgaaagataatatatttgatatacatcaatttttatttctacaaattttcctttgtgttatttgaatttagaacatttcaactaaaatggcatttctgggccttatcaatagtttgactaaatttttgaaatcttgtttgtatttgggtttatcttttgaatcttttatataatatttcagagcttttaaaatgttgatgtatctatcatgcaaaaattggacagaaggggttgtttttgacagaatctggcttagaggaagtaaatttgggaatgcattaagtttaggtttagtgagttctacttatgtggttgacagtaatttcaatgaatgatgtagaaatggcttccaggaatatttctacgacccactctgaaaattcactcaaactcatggcaggagagtacagaaacacatatcgtattgtaatatgaatgcattctacaaccccatcaactccagcaaacacaaaggaatgtgttgatggaggggaaggtatagtttatagtcatctttataggtctgcagaagcatttcttgcctggatcttagggcaatacaaactataacttcacacatcaggaggcccttcatatcacaaatactcacataaaatatttgttagataaattatgggcaattctcaaccaggatctacattcacagctgatatagtgcaactcctaactttaaacatccactctcataagtaacatcaacaggccccagggaaatacttctcatatcttgccttaacttctcgaaacaaaaggtagttaattttgaatgccttcaagacttgtgtgagtcagacactgcttctaagttcataaagtgtttgaatagataaagcatttaggtaaaagaagaaacaaattaaccaaatagtcaaatcttcctttcaagtagcaataatgcaatagattcttacataatgcagcattattttccagcaatgctccagcatgcacttttattctttgttctatgttccaatttgttgtttctaggtattcaaaaagttgtgcagtatgcccaagatgcaggctaagaatgatcttacagtattaaataatggacctgaatcttaaatttatgtacatgtgagtgtctattggtagtatgtgtgaagtatatctttacactgacaatgagatggacactaaacatttgaattgcaaacagattttacacttgaaaatatttaatcagatttaataaaatcttcaagaatattaagcatgttcagctttattaagataatttttattgaaaattttgaaatacataattggtatttttaattgaataaataattgaaatattttaaggactatattattttaaacatgtgtaaactaatttcatatgtaaacaaatttcactgtatgaaatttaaatttttgatgaaaaaatatagctaattttttaaaatttggaaaataatcatgcttttaatcctttagatcattattagtaataaagcttaacgctattacaattttatttcaacaatgtaactagtaattttgcaaatataatgtaattaaaataaatttcatgaaatatataattatttagaaatatctatgtcattttattcctcacccaacatccactggcccatctactgtactcccagacatgcagaataatgataatatttagtaattggtattctgcagatttttagttatatataattcatagctgtacacctgtgatttcttgctaaacagaatttttcaattttaaggtagatgaatttaccattttcccccttatagataataattcttatgtctggttaagaaatttttttcctaacccaaggtcataaagatattcaccttttttatttcctaatattatatagattttgtttctttatttagatctttatgtagaattcgtttttgtacagtttttgagatttgcatctagttacattttttaatatttctagaatcatttattgtaaagcctaccctttcccaacatctcataagaaccacctctattatctatcaagtctctacatatacttgtatctatatattggctcttaattctctttcattatctatattcatattgaagtctatatcctcaatttgtatgccagtaccacacttccttaaatactaaatctcatgctggctggtagggcaaatatgttcaaattattgttctacctcaagagatttttggcttttattgactctttgtactttcatataaaatcttagaataagccaatcacttttcacacacaaatcaaaaacatattgtgatattaatttaaaattctttaaatcaatacacaaatttttggaaatgtgacatctttacaatattaaatattataatcatataacatggtctattagcccatttattttttaaatgtctctaccagcaccccttagtcacaaataattatattttctttcaaaagtgtattaaaattgtgaatcataagtactttgaaattaaataaaattcaacacatatgttgatctcatactatattgtaagtgttgtggtaagacaagagtacggaaccaaggaaaggcatgcttattatgacagtgttttttaggtgtgtttttaactgcatcatttttgagtattgtttattctttttcgaaatactttagctgaatttgttatctggtttgtgttttatgtgccctacaagatacttatatcaatcgaacatctttctgcacattctcatcaagagatcaacagaaagacttcaccacaagataattaaaaataccaaagcattcacacacacacacacacacacacacacaccccagaactttcaactcagcccagattatgcaaattattaagtaaagctaatgaactgaaatctaatatcaatctggaaatgacaggctaaaactgaagctgatttagaaaacaatcccaaatggaaaatagatctgtttcaagacagttttcatttccaaagctatttactccttgtttgagtaaataaactagagaaattcaatttcttctctatttctatagctcatttagctatatatctcacagttgtagtcattttcaaactataattctggaggtggcaagatagaacagtatgttcctaactatgacttacttatttaaatttaagatttatacttttcttggaaattatgaaaagaagtaaaattatttatttgctaacttgatgttcccagctcctctaatcaatcatgtatttctgtgtcagtgtatttctttcagtacttttcatttgctcttttaattattcattcacttatttaactagtcatttattctttcgacaaataggcactggatatatgtcattataaaacagaaacttagcctctgtgatcagagactttacaatgactccaatgatattacataattttcagatgttggcaaaataatttatttatttatttttttttttgagacaaagtctcgctctgtcacccagtctggagtgcagtggcgcaatctcggctcactgcaacctccgtctcacaggttcagctgattgtcctgcctcagcctcctgagtagctgggactacaggtgcgtgccaccatgcccggttaattttttgtattttttagtagagatggggtttcactgttagccacaatggtctcgatctcctgacctcgtgatccactcaccttagcctcccaaagtgctgggattacaggcgtgagccaccatgcctggcctaatttaaatattttctaagtatacttaagtattattgcagaggcatgtcataacctttgaatttcatactaattcatgaatgaaaactgacttctaacaaattcatagattaaaaactattctcaaagcatacacagtgagtaaataaaggagaacaccaaaattagaagagaacatagaaaaaattccatgcagttcacaaagtttatatgtataaattggtaggcgtaaaggtatatgtctgtatatatgagtatatgtgtgtttgtgagagagcaattttcactacaaattcagggttactgtattaaaaattcatagcactgagagggtatttaaaaataaaatacactttacagttttttaatgcaagtttcccattaatttgatttgctgtagattatttaaaaatcagatattattgacaaaactaaaaataaatgaacaaattcattattcatccattcattcaacaaatacttactaattattataagtatatgctgttttaggtattgggtatacagaaacaaagcaaaaaccttattcccttgtttcttttttttttttttttttttttttttttgagacggagtctcgctctgtcgcccaggctggactgcagtggcacgatctcggctcactgcaagctccgcctcccgggttcacgccattctcctgcctcagcctcccgagtagctgggactacaggcgcctgccaccacgcccggctaattttttgtatttttagtagagacggggtttcaccgtgttagccaggatggtctcgatctcctgacctcgtgatccacccgcctcggcctcccaaagtgctgggattacaggcgtgagccaccgcgttgtttcttgcattaaaatatcaaacactaaaaataataagtaatagttgttatataatcacgacatggtaggaacgacatgtgttggtccacgttggtccattttgattttatctttaaacagcacagcaacacaggtatttgtatacccatgttagaaagatatgaggatgatagtttttacatgcttgaaagaaaaaaaaagagagacatgagaaaataaatatcaatagggatgttatttttcatccaaattaggtctaaatttatgtgtatgtttttgtatgtattgggggaggaagatatattctagctgaaagtaagatttttgttaatagtttgaaagaacttcaaaatgctaacaatttttaacatctaagactggaacttaattttatgtctaacgcagactgtccctttgtgctggaaaaccaacacagttgagcatatcatattgaaaacaagtattcattgtttttggagaaaaaccaaaaacaatgtaacacgaaattctgactgaaaacttaactgttttgttttctaaatgtaaattgagtatgactatctttaactaccagtacctctaataactaaggcttactgagtgtagggcattttactgaggctttaaataaaatgcctcatttaatcatgacactatccctccacagtttttacagacattggatagatgaagaaaccaaagcttaggggaatttcagtttatcattggccgcactgcttttaagtaggagatttctgagctgatgcgttaaaccaatatattataataataatattcttaagataatatttcctttgtacaaagtatgcactaacaattcagtttacctgtatacgattgcttttttttaagtaaatatatatgtgtgttcttgtctgaacatttttcacaggaaaatggacatcacagtagtcaaaaacttcagcaaatgtacaggcctagtttgttttgttttgttttgtttttcagtcaactgaagaagaaattgtaaataaattagtaggatttggtataaaaacacagctcagttgggattgttgatgatatttaaacacagacaaaaaagcttttgcaccactttcctttgtgcaatgtgggaattaaggaggagggcctggtccaggggttgtttcatcctaaactgatggaaatcccaggaaagctaagcccaatggaatagcactctcatgatgaccagcatccagtgtggagcacaggagaggttggagataaagaaggacgttttcctaagccaatgagacagcactgtcagaaacagtctgcagtagctgggggaagacttggaggctaactatatttttcaacagacttgatggttattctaatagttaagaggacagattctgaatttgcacagcttgaatgcaaagtcttccctacttattattgtatatccttgggcaaattaattaatattttggagaagcagtttcttcaactcaagattgtggaaaacaagaatgtttatttgtactcctgagagaattaaatatcctgattttgataaagtaattagcatcgcacccaacacagatgaagtggccaagaaaacttggctttttttttatcattattatagatgtacatgtatgatttgtggccatgagctgcagcttggcattacatagaattgagggcaaaataaaaatattcatcctctggcgatcttcatttaactaagttttacttattaaaaaattatcaactacaatctcaaaaataggttcccttacattttagtctggctgataaaagagtaaaattttaaaaagggtctttatttgttgtctttacctcctacacctctattcagctttgagagatagagatgtaatgtacatgatattggagacatggacactggtttattggaggaactctgcagttcacggaattcttgcatatgttatagatcaggaatatgttaatttgtccctgaaattactctaacaccaatggcaattctcatccccactcacccttagaaatcgttaagactaagccagatggggctaatgaacactagtttccattgccaagaattagattaacttaaaagaagagaaaaaaacttaaaaaaataagatctatctgaaaaagtcactatgatattaaagactactctaatttcctcgtcatactgtactacaatactttttccccactttagtttattaaatgatgaaaaaggtaaaaaatgagaactacctctccaaggaagtaatattactctattttccttgtggttgctataagtatattagcacccttggagaccaagttaagcaaaataaaataaacaaataaacaaaaaccatgttgctaatgcaaccaaagctcctggaacttataaaagaatctgtgtccaaaattttgtgttcttatacttggaaaggaaaagcatgaagtatcattttaaaatatttcagtttatttttcttcttcaagaagcaaactacactgctagacattttttttcaaaatgttcaaacaattaaaactgttccaaattttctttgaggaagtaatttcagtttaaagttttaaaaatagccaaagaggataagtgaatgcattggtttacaaaatttcattttttattttatatatttgaaacttgtatattttaggatataaaaaagagaaaaagagaaagaataaaggagtgtctgaaaacatgcatggacatagtgtagtcccttctgagaagcaatatgataatgtgaaaagtataaaacagagaaagatatgcaatcagaaaacatgggattggttcaagaataacccttactgggaatcagaaaaactatataaataaaacctgagtgatagtgactacaacatgatgaactgcaactcctttaaatcagtaaccgaaaacctcccaaaaaagaaaagctaaggaccaaactcgttttacaaggctagcattacccacataacaaagtcagaaaagggcactgcaagaaaaaaacatatataggccaatattcctgataaatatacatataaaaatcctcaacaaaatactagtaaactgatttcaaaagctaattgaagggatcatgtgctatgataaagtggggtttatccctgggatgcagatgcaaggatgattcaacctatgtcaatgaatgaatgtgctacaccacattaacagaatggaaaacaaaaactatatggttatatcaataaatacagaaaatcattgacaaaattcaacatcttttcatgataaaaatactcagcaaattatgtataggaggaatgtaccacaacataatataggccatataaaagaagcccacaaaccccataatcaatgaggacaagctgaaagcttctcttctatgatcaggaataagaaaagtgtgcatacttttgccaattctattaaacatagtactggaagttgtatttaaggcaatcaggcaagaaattgtttttaaacaaaaggtatccaatttataaaggaagaagttaaaatatcactgtttatagataacacgattttatatatggtaagacctaaatttttcacacttgaaaacaacctgttagaaataaaaaacaaattcagtaaagttacaggatacaaaatcaatatacaaaaattagttgtgtttctctacgctaacagggaactatccaaaagataaattaagaaaacaatgtcatttcaacagcatcctaaagaggaacatacttagaaatatatttaaccaggaaggtgaaagatctgtttactaaaaattataaaacattgatgaaataaattgaaaaagacacaaataaatggaaatatgtaccatgtacatgaattggaagaattaatattattaaaatatccatactactcaaaataatctatagattccatgcaatttctatacaaattccaatggtatttttcacagaaatagaaaaagcaatcctaaaattgacacggatccacaaaagaccatgaatagccaaaggaatcctgagtaaaataacaaacctagaggcatcacactatctgacttcaagatatactacaaagccatagtaaccaaaacagcatggttggcataaaaacacatggaacagaagagacagcccaggaataaacccatgcatttacagtcaattgactttcaacaaaggtgtcaagaacacacaatggggaaagaacagtctctctaacaaatggcactgataaaactgcagaagaatacaattaggcccttctctcacaccatatacaaaaatcaactttgaatggattaaagacttaaagttaggatctgaaactttaaaactaacacaggagaaagctctatggtgttagcttaggcagtaatttttcagatataaccccaaaagtataggcagcaaaagcgaaaatataaaaatgggattacatcaaactgaaaatcatttgtacagcaaggaaacaacagagtgaagagacaactgtggaatgaaagaaaatattttcatatcatacatctgttaaggagcagatatccaaattacataatgaactcactgaactcaatagcaaaatacaaataagacaatttttaaaatgtacaaaaaaatgaatgggcatttctcaaaagaagacaaatggctaacagatatatgacagaatgctcaacatcactaattaaggaaaggcagatcaaagccacgataagatattaccttacacctattaggatggctgttaccaaaaagacaagagataagaagtatgggcaaggccatggaaaaacgggaagctttgtacactgttcgtgggaacgtaaagtgctacagccattatggaaaacagtatagaagtcaaaaaaactaaaaatagaactaatatatgatcccacaatcccacttctgggtatatagccaaaggaattaaaatcagtattttaaagagaaatctgaactcccatgctcattgcagtgttactcgcagaagccaagatatggatacaaccactcatcaacagacgcatggatgaacaaatacacacacacacacacacacacacacacaaaatgaaatatcagtcagtcttaaaaaaagaaaatcctgccatatatgacaacatacacggacccgaaatacattatgctaagtgacataagctaggcacagaagggcaaatcttgtatgatctcacttatacatggaatctaaaaaagtctaattcatagaagcagagagtagaacagcgattgccatgggatgggataaaggaaatgaggtgttgcccaaagggcataaactttctgttataagacgaataagttcagggaatctaatgtacagcatggtgacgatagtaataatactctgttgtttacttgaaatttaataaaagggcagattttttttttttttttttttttttttttttttttttttgagacggaatctcactctttcgcccaggctggagtgcggtggcgcgatctcggctcactgcaagctccgcctcccgggttcacgctgttctcctgcctcagcctcccaagtagctgggactacaggtgcccgccaacacgcccggctaattttttgtatttttagtagtgacggggtttcaccgtattagccaggatggtctcgatctcctgacctcgtgatccgcccgtctcggcttcccaaagtgctgggattacagacgccccaaagtgctgagattacaggcgcggagccactgtgcccggcctaaaagggcagattttaagtgtccccactccccagccgcctggcccaaatgctaattacaggtggtaatgaatgtattaattaatttgattgtggtaatcagttcacatctacatgttatcaaatcatcatgctttaaatcctgaatatatacaatttattatttgtcaattaaatatttaaaaacaaaacaaaacaaaaaaccttgcaatctcctgccaacagttaaacaacacaaactattcttcaccagtgtgttcaaatttattttgataacaagagactaaagtaaacgttaaatttacttaagaaatacctgaaaagagattttggtaaatactctttaaaaagcttggtggctgtctcaaaatccatctggaaaatcttcagaaacattttaccaggaattagcaaggtaagtgccgtaaaccaacctcatccaacagaagtatttgtgtatatgggtagaaaatcactgccatcagcagtcagtctgtgctcatcctcccatagctctgacacaaaattatactttaaaaagtttcccttcgaattctgccacccctccacatacttattaatatttattagcaagcaagcaaaagtcacttatacaatctttctataaattgacaaattcacagatctctgtcttttgatgcaattagaccataccttgtatgataaatcacttgaaataactatagcaatattccaaataaatgatttcattacctttatagttagcgataagaacctagaaatctccctcatgcatggacatagatgagttagagataaagcctaggcaaggctatctttgcgatagtctaactaatctatataccttgaattccacttattttaccagtgagagcccacttctaaaatccattatactaattaacaggccactaatttcaccaatgaaaacccacttctttcattttgctaattgtaaatgcctttggtgttgatcaaagataatgataatggaatggctattagtagttcctatggagtgagcatttcctgattagaatgccagtgtgaattcctgattaaccaaatgattgtccctacagtgcagcataaaccatttatacttaaatatcactgtctttaagttgaagtttttcaaattaagttataggcatcataataataaaaatattttaaacagctgtctaatagattatatatgagtaactggcacatgggaagaggtcatatgaaacatcataggagctagagatttttttttaattgatcatgcctctccaaaaaagcctagagcaaggtaggggaaagataaaattaagaagacctaaaaaacattttaagaactttacatgcaaggacatatgatctataaaagtagacttttttttttggtgtgtcaaagataaaagggtagatagggaataatggattataaatcattgagaagtaagtgaagttcctattgaaagttgaagaggagagggatttcagtcattgtggtttatccaggaaaaattaatttgatctttggagccgagaagacagacgtagtgaatcaaagactactacatacacagggtgcattgacgaaccaaggttagatcactcatcagaactgactgatatctactcgagagtttgaaaaaatccagaggtcagattatcaaaattttactcagaagctattaacctagctttataaacaatcaatgggacagagtaaaagcagctgtcaattcatctcttgtccataaacagttcatgagagagtttcagttacatttctaaatattccttggataaaaggacgttaggaattgattgaaggacagctaaatagctcaagtattctgtgtgtttttgggttgtaactcatgaaaatagatatcatggaagaagaaaaaataaaggaatggccaactggaagaattacagaaattataaaggggaggaaatttaacgcttaaagaataaaaactagtcactatttcttcctcttgatactccccaacgttatgtacacacacacacttgcgcatgcacacacacacttgtgcatgcacacacacacgtgcacacacacacaaacacacacagagctaaagaagcttcctaaatgaagccttccctctcctttactctttcatgaggctttaggtatacttatctcatgcaagttatgaagaactttgctgtgctgagattcaactagatacttcaggaaggagccagagtctccaaacccactggattctttgttaatgactggcaattacaggatgctggggcaagggattatgaaagtcagacgtagactaccatcacctactggtccaacttgtcccaaaaacttggaaaacttggccaaaaggccttctatttattgaaaaatgcctgcaacactctgggcatagggaatgctggtttccattttttgagtaaacaatgttggcgaaggcatattattgtcagcatagagtaaagccaatttatttcgatagtttctatcgagtgggaattagaaaaacggatgacccctttgtttaacacatttatatggataaacatatctattcaaattctagactaactttggtgcctcattttgtggggtctcttttctgactttggacacagccataacctctgaagcctttaccatttaacttcttaattttatattttctgaattttagctatttaccctactagaatgaattatataatattttttcataatatttttcacatagcaagtatgtcacatttgtttaatacacatcatttcaagtttgtaagacaaaagttgaggagcaatatgacatcaatctttaaaaataaatatgatgaagaagagacaagaacttgttctctcaatttgtaatgcttgaagccttttaacctgaaacagatcatcttccaacatataaaaagaagactatttaaagatagtgtaagcaatgcatgagcttatttttctatgatcttatacaggttaaatctgtaaccctattatcagagaatttatataagttcatgaaccagagataatttattagtgaggcaacaggagatttggggaacatttctacagtatcattagggcagttctcaaatgtgtcagttctctcagatgacatttctctgcccacttgaactcatgtggtagcagggccatgggaaattaaatgcagccaaaatagcaattcctagcagaagcatgtgtgtagttcgcatcttctctttacctggcctctatgcatgaggaagcaagtttcaagatatagtcttcatcagtatgggtctctgcgtgactaatacatgctgacaccccttgctgacctccaatgaacaacgaatatatgatgtagtgagaaataaaccttttcacttttcattttaagctgctgacatgtttcattatttgctaccaatcctttaatccagcttgtcccacatgatacaattctccaaatcttatgttactgatatcttgaaattcctcaaagccctttaggccctcaagtaaatggctgagggtaacagagaagaaatgcaattgaagagctgttccaggaccttagacatctagaaactcaaccatagccgctgcactttaatctattttatatagatatttatgttgctctcaatccatctcctccataaaaaattgtacaccactattgctagggatagatcttttagtctcggcctataatagcatatcatgttttattcattctacacatatttgataaggcctattgcaaacaaagataggttataaggtactgtagaaaatacaagaagaaaaaggtaacatttcttgttctccagaaccatataatccagctgaaacagtttacaaaatttctttcaaaatttctccagatggagtggaagaagcctatgaacttttaacatatttatttattcccaaagaaatgcacagaattaaatgtaatgaccattttatttttaaaattaatattctctgaaaaaaccctacatatttgcccatgagaaattagtactaatttcagatctcctatatgaagtcctttttatttcagaatccttttgcctgctcttttggtaaatagacatccttaaatggattagggaaaaatttgtctttttgtatctgaaggaggcaaaaggaattaaaataggatttcaaaaggtagccaatttcaaaatcaggcaggctaattttgttataaatagagtaattaaaaggattagaaaaagtgcttccctttgttagactgacactcttacaataagatgtgaacacacataagggcaaggaagtgtgtcataagtaccattagtggccatgatatcagtctctttgttttggatatcctttttcttcatccccattttagtcttctgagtagaatctatccatcatttcaaattctctctttttttaatgtttcctaatcaatccaccagggattgttcttattgtccctctgtacatatgaacacttcagtggttccctagttgtttcatgtgttttagcctcctttcctcaaacagaaattgatttgttacaaactcccatttcctacttttctcaatgtttcccacaagaaaatcttgactatacctaacacattgtaatcctctacacaccatccttttttgcataattcccttcatctcttaatctagaaacccagagaagaaaatacacttattataggaggcccaatttctagtgaattcatcatcttctttatgctttttgtttttgttttgagacaatgtctcactctgtcacccaggctacagtgcagtggtgcaatcatagctcactgtaatcttcaactcctgggctcaagcaattctcccacctcagcctcctgagtagctgggactacaggcgcacgccacaaggcccagctaatttttttttttttttttggtagagacagggtcttgctatgttgcccaggtcaccatcttctttgctgttcatgctcataaatgatttaaacttctattgtggaagtctgttgaagttcaacaatgatagcaatcacttatattttccccatttttttgacaacaggaagtggattttcctttcatttctccagcaccattgttattccctgtggttctgcaaaaataactgaaaatagttctacatcaacatcttccagttctctcagaattctggaatgtgatttgtctagcctagaggcttgaagtcatttaaagcagcaggtaattttactataccaccaattgggctttgattcccttaagcatagttattatactccatctagtttaaagatcattctccttgatagagaaggaagaaacaaaataggagttgaatggttctgcatttttttcctgtcatctgatttctcaccatctggcctaaacagttgggtttatcccttccttgttcttctttgacatgaaaggggactttcatgaattgtgttgaaaaaagaattgaaaactactgtgaacataccaaattgaattgaaaagcacagatcatatctagggaaatgtagtgagaatattactaattgctagatcaaatttacaaggaataaggagacaggaatgagacaaggagatgaaatattcatctggaacaattaaaagatcaatggtgatacaattacaaaacaggaaactaatgttctaaccaaagcatgttttcttcttcaattaataataatacagtgtgctgcactatataaaacagctttataatgtcagttgcatttcttttgcaaaaccacaatgcaggacagaccaaagagatggatgatttgcaacaaaggcaatgcactgaaaacaggagcttttaatagctttctaaactcataagagctgtaaaaatcctcttgaacctacatccatctactctcccaaagaatatgctaaaaaggttaagaaagcggtaatttaagtctcccttgtcatttaattctttgggagtctgtttgtgaactttcaaatctacctggcacttttaatttttttgttgttgttggggagaagggttggctaacatttaactacagtattttttttttttttttttttgagaccgagtctcgctctgtcgctcaggctggatggagttcagtggcgtgatctccggtcactacaagctctgcctcccgggttcacgccattctcccgcctcagcctcccaagtagctgggattacaggcgcccaccaccatgcccggctaattttttgtcttcttagtagagacggggtttcaccgtgttagccaggatggtctcgatttcctgacctcgtgatccacccgcctcagcctcccaaagtgctgggattacaggcgtgagccactgcgccggccttttttttttttttttttttttgagactgagtcttgctgtgtcacccaggctggagtgcagtggcgccacctcggctcactgcaacctccgcctcccgggttcaaacgattctcctgcctcagcctctcgagtagctaggactacaggcatgtgccaccatgcccagctaatttttgtatttttagtagaaatggggttttgccatgttggccaggctggtctcgaactcctgacctcaggtgatccacccgcctcgacctcccaaagtgctgggattacaggcgtgagccactgcgctgggccaaactacagtattattaatgcaaaaagtcccttcacggagacctgaagacataatttgttgctcaatagaaatccagcattttaaaaatccagaaaagaaaacttggtccgattaatcagttgaagattaaagtaatgtgtagcagatactgccaggtggtattccagggtattagaccctgttcattccatactttcacagagacagtagaaaacatagtaaaatttccaatatcataaatttcccttgtagaagctatggcttatcattcttttatttctactaaaaatattcacaagattgtgtctaagttttgtgcttgcattagcaaagaagtatgacattgggtaataggccacccacagtaatatcttccaaactcttaagactggtagcagcaaaggagtagaagatagaagagaaattgtctcacctgacacagaaattgttgagagtttggaagtttaggacataggaaatgtaatgactctacagaatggaaaagggatcaagccatttatttttaaataattttgatttagagtcaaccaataccgttgggaggattctatgccacagtcactctgttatgcactttcacaaccactgtctattacatttcaaaaattatcctgtcacttaggaattatcactcccattttacagaagaaggaatcaagggatgttaagcaattttcccaaggccaaatagttggtgagagagcacacacgatagaatgtgatttcccttgccagttgagggactacagctccccctcattgcgtattgaacgcagaaaatgcagaggggaatgggtgaatggtacccacatttcatgttgtatcgccaacccaccaatcagtgccaaatatttgccattgcacaccccatcagcctctagttaaatgtatctatttatcagtatattaacatattcaccacagtagcatggcatatgcataaaccactatgacttagaagaataaaattattctttggctagcccataaactctcagagttctttatacatcccaccgccttagcagccaaactccgggattattttataagaggagagaaaagaaaccaaattttatctgaaaaaaatcagattaataaatgtaaaggaagctgatattaaactttattttaaagatcacatatagccataacgagatataggcttgaacttggtgtaatcaaagaggcattaatttaaaggaactatggctaagggaaaaaaaaattctattgtttatatattttgttagtatctggagatacaaagatcaatgtagtaatcaatgacatagctgtgattccttacagctcacttatcaatatcataacacaaaagtatctacgtaattgggaagtttagctaagctttattgtagaaaaaggaaatacatactggaagtcattttggggtgttgttgttgttgttgttgttgttttgagacagagtttcactcactctttcacccagcctggagtgcagtggtgcagtcttggctcactgtagcctctgtctcccaggttcaagtgattctcctgcctcagcctcctgagtagctgggattacaggcgtgcaccacaacaccaagctaatttttgcatttttagtagagacagggtttcaccatgtgttggccaggctgatcttgaattcctgacctcaagtgatctgcctgccttggcctcccaaagtgctgggattacagctgtaaaccaccactcctggcctggaagtcattttgtttagcttatttatagaaactatttccaccatgcagtaatgacaacaatctaaggaaatgtcctaacaaccatattagcatagagtgatagataaaaagatattatttttattttctatatcattttcacattctccttcagttaactgaacatttagctgagcaatatatgtcatgtgtcatatattgcatgattaaaaccttttactctaaggaaacaggttttagtatcaccatatcgaacatgaaaatcattctaataccaaaatgtcaaccttgattttttaaaattccgtagtataatctgattaataggtgtcataaggaaatgactgaactattgggtacacaaaataatgttctaaaagttgtattttaaaacgatatatctacataaagtgtgacaatataattatttccagtttgattaaatgctataatcactatctcattactagaataatgaagaaaaaatatagaaatattatcacatgatccatacgagaattaaattaagtagacattacataaaccagaagattcttacgcaatttcaaagttgtcacaaataaattcaggtttgaaggacaataaagaagtaatgatgggaaggaaagcttgataattatagcatggttgctatttatttattcagtgtaaaggatcaaagaaggaattgtcttagtattctcctacttcactgaaacaaaacttttagttgacagtgaacacacgacaaaggaaatcaatttaacgacctttattgaagcagtactggatacaaggtattgtgctaggtcgttcagaacaacggtgaataatagctatactagtttgtcagtgcattcataacacagtatcactgattgatgtggcttaaacaacaaaaattcattttctcacatttctggaggctagaagtctgagattaaggtgttgaaagggtttgttttctctgaggtctctctccttgactgacagatggctatcttctccctgtgtcttcacagggtttccctcaatacatgtctgtatcctaattccctcttcttgcaaggacatcagttatattggattgaggctcatcctaatgacctcattttaacttaattacctctttaaagaccctatttacaaatacagtcacattctgagttacagggggttacgatgtcaatatataaatttgggtggagacataattcagcacataataaagcgttcttgccctccaagactttcaacataatagagaagaaaatatataaaaataactatcatagaaggcagaaagtgataaaagttatagtgcacagtcaaaattattaggatggtgcaaaagtagttgcagtttttgtcatcactttgatgacaaaaactgcaattaaatttgcatcaacctatataaaacatagaaaatgactggataattaagaaaggtttaatggagaaagtagttttctaggatgagatttcagcatattgagataaatataatgaaaaagataggaaacaacaaattaaaagaaaacactgtatagggctaatttttcatttaattataattcatttcaccatattgagataactgtagtggaaaggataggaacaaacatgattagaaaagagcactgtatagggctaatgtttcatttaattataatcaaactgtactctgattgacatggcatattttgtatttaagacaataaagatcatttgactgctgatagaaaagcagaaatagaaaatcatgttttcttcagttttcaatgtaaaatacaccacaggccaataaccagacaaataaaataattctccaccatcttccaacatatcatttgtatttatggacatttttcagaagaaataaaatagggagaaaattagaattgtaccaatcataagccagaagaagacatagataataaaagtccactagcgattggattgtccttttaggaaatctatctatcaaaaatctatgcttatagctctttgttcagagggtcagttcccaaatttatgtgctacaacagtattttaaattctttcctgtaataaaatgtcactgagattttttttaagtagaaatgtgatattttatcaccatggagtacaatgtaagtttagctgcctaactcattattcttagtcctgcttgaaaagtaaatcatatttctgacaatgacaacgaaatctcaattttgattacttctgttttaaaagagcataggataatagtaaggaacctatacaaaataccattttaatatttatagaggggaaaatactgaatttttatggaattataataaatatatacttccttatgacttcttacacgtgggtcactggcagataaacttaatatttacttactacctaaaacatatgacaattcaatggtgctcagccaggttatattaacagtgtggcaaaagtaaaggattttccttttgttcatacaacttatccaatggcacattcaagtttttctcctctactattatggcaataatttaggttcatgtcagcaaatgtttgaaagacatataaatcccacatttcgtatcacttgttagtgtctaattaagcagaaaattttgagttcagtgaattacaaaatgaaatttaaaacacatcagattttacattaggtaataaagatcttggcacgtaaacctttagcactgtgggaaatgagcttcatcttttacattggtgaaaggtgcagagtgatcattctgtgcaattacacagctagaagaagccttgatttggaaacagtgctataccaaggagaaaatcacgttgcatagttgtgcttaatttttgcagtctaactagaatagttatgctacatacatacatctggctttgctctaaagcctatgttgggcatctctgaaacataaacagagtaaattttgcccttgatcactttggacgttactcctgtaaaaatcatatacaagtttatttgagtaaaacagatttaattaaacaaatgtttattaggcatctgcggtataccatatattgtgtaaagcactgcaatgaagtaaaacctaaccatctgtacaaatccacagttgtcggttcttctctttctttgacttcattttttactaatctgatgttttgcttgtttccccctacccattcccacatgtaaattttcttctagaatcctactaacttctggtgggagaggaaagagcctcatttgccaccaaaaccatatataatctaggtcaaaaggatttttatattgccttattaaatcatgcaaaattatccagctgtgtttgcatggacagccaaagaggaagggacttcagcttttgttcattatttgatttaacagctgaataagtaacaaataaaaaactaggcttaacagtcaggtaaatatttttcctgatttagaaaggttccagatggaaaaacttagaattatgatctaaacatggcatccatattttgacattaaaaaagatacagaaattaatttgagaggaaaaacaatttttttttgacacagggtctccctatgtagctcaggctaaccttgaactcctgggacgacagggaaaatcaattttaatagagaacaataggctgaccagactagaggatatataaaactaatatcattgttatttattgtcttagagaatttgagcaattaaggaattctctgtgacagttaatattatgtgtgattatactagccaaataccttccaagtggagcaataaatgagaaaatatctatggaactcctagagatcttgggataaatggttccacacattaacagttgcatttccttttttttttttttttaacagagtatcactctgttgcccaggctggagtgcagtggcacgatctccgctcactgcaaaatctgcctcccggcttcaagcaattcacctgcctcagcctccggagtagctgggattacaggtgcccgccaccatgcctggctcatttttgtatttttagtagagatggggtttcaccatgttggccaggcttgtctcaaactcctgacatcatgatccacctgcctcggcctcccaaagtgctaggattacaggcgtgagccactgcacccggccaatagttgcatttcttaagaaaaaaagattttaaaagccacaaacaaaagtaaaaaacaaaactcacacatacactatttattataaatccataaaaaattcagctattcaaaccaaaaaaaattgatactagcaaattataaatttatttagtgaaatagtgatagtataaatatatatcatgctttaataaagtattttaattaatccagtcaccacacatgtttttgctaaatatgacagacagaagataataaaataataattggcttaccaccctagataagttttaattattccatggtagttttacatactttgaatatgatgttagcttaaaattcagtggttgaaaacaccttacagaattttaaataagtagattttctgatctagtttaagaagaaagggtcaagtcacaaggccaaggctgaatatctctaccttcatgaaatttcccatatagttaggtgaagagtatttatatgtaatttaggtatgaaacataaagtacataaatcactatcaagacagtgaatgcatatttgcaagtaaatattaaatcatggcatgggaatttaatgttgccatgtcaaattatttagatacacaaaaaggacgtatttttctttcctcccatgaccattttccacatacagtattacaactgtgcctgaaaactatgtttcacctacaactgaaagtctctgaagttgattaaattataaggttatgggggattgtagggtagttggtctggatgtcagtgaatattttaaaattaatatttataattaagacagattttatgaagtgtcaaatatatcattttttctggtttagaattttaatagttatattctactgttagcatgtggcagttactgccctaatgcgatgaaagcctgaaatctcaaagccactgattccctacaagaaaatctgacagagaaaacaagcatttgcaaaattatttataaatgaatgtaaagtgttaacttatttataaattcctggtaattacacattttacaaacttatgaagaaccagattgaaatttgattattatacatctgtaattactatagagatgaatgaaatctatcacagtgaacatggattatgttttgcatcttatttggattgtcatgtaagtctttataatgagctactaattgccaatatatgaaatagtgatcacaaattcaaataacaatgaagaatgatgaggtttcaaagactggatgtcacagaattactttgttgatagaaagatagccttggtgtctttcccaacagaacctattttaacacactgtaattatcaggtgagggcttgtttcccccattagactatagatctcttgtgaataagtccagtaggctttatccaccatttcatctctagagtgaatagtaattgctcaataagtatttgttgactgacacaataaatgattaacttgtcaacacgaaagtgttcactgggcacttggcttcaaaggcattcattccccccatactatcaagattgctataaagatggcagaacagaatatcatttaaatcttgttgtcatgcgcctgtgagaaacttttcagctttagctttgagttttcatatactcagagtaagaatattctattgcctgagggagattctgattattttgatgccctaaatctcctaatccaatagatggaaaatgtctgtcatgcagatttgcttatgaaggggcaaaggctttcatcaaaatctttagtactaaaaaagaaaaatagtaaaaacctgagaaaggtaacacaggggacatcaattatacatgtaataacaagtatgagaaaagttaagactcagtaagacttcaccgtaagattacattgtgattctatatgctctaatcttttatggatgcttgaaatatttcagaataaaagtatttttttaatctagctatcctttcctcacactcaccaacaaaactggaatgaaaaatgacataaaacttcagaaagtattattctattagagtctgaccctgggtgataaaggtttaggtatttttcattttcacaaagcattttttaaactgtattactgagattcacagtcaagtgaaagaatataggataatcacaattcttaggtgagtttcaggtactgatatgtgttggtctggcatgatctctctgttccccaggcacagactcatctatgtcacttggctttgcaccctgacatctacttctcctattcaatatgtattttttattataaatgtttaagaaaagtagagatcataaaatatagaaaataatctatctacctcaataataacatgcactttttttcccattggattttgctctaatttttaaaggataaagcattgtagataacactgaagtcctatatgaactcttcctcagtctcgtacctccctctctaaagttaatcactgttatgtatttgatacacatggcatttatgacatcctactgtccataaaacttgctcatccactcaatattactttgaaaatttctctttttaacatatgaaactagctcatttgtcttaactactgtgtttgctgctatttgctcatttccccattgatggaaaaaaaaaactctataatgatcatacttgtaccgggttttccttatgaatatgtgcacaagtttcttcaataaacctagagggggattcctggcaacataacccaggtgccacatattgttattttgttcttcactgagattgtaacaatttacattcccagaagtattgtatgagcatactcttttaagtatatcacatctaataattgaaattatcagattttttttacttttaatatctgatagtcatgcaccctagctcttaagataattcttcagttattttggttaactatatagtctattattgggacaggttgaacaaaagtgctccttaaagagatttatctttctcatactggtttaaattttaacactggcctgccaataatgttagtaataacagttatcttttactaggccactcaatatgtcctagacactattcaaaacatttaaaatatgtaatttattcaattcttccaattgtaaaagaatgtgagctctaaggatgcagagagttttgtctgttctactggttgttctatctttaaaacagtcctatcacctagtaggtgctcaccaaatatttgttaataaatgagtacatgaataaataaattatataattaacattttcaaagaggcatttagggagtctgagtggttatttcccaaagagcatagatttttgtaggaaatgacagaattatctatcttcaagcatacataactccctccaaaaacagatttttttttttaagatggagtcttgctctgtcacccaggctggagtgcagtggtgtgatctcagctcactgtaacctctgcctcccgggttcaagcaattctgctgcctcagcctccctagtagctgggattacaggcacatgccaccatgcctggctaatttttgtgtttttagtagagacggggtttcaccatgttgaccaggctggtcttgaactcctgacattgtgatcctcctgcctcagcctctcaaagtgctaggattacaggagtgagccattgcgcctggcccagatttttctttttctatgttccacgtagtctctaaagagaaaattcactatcttcctgtcaaatctataagaattactttagcggtgaaattttagtaagaacgataggcagtttgtaagaacataattctttttcttttaaaattatttcttttttaattaacaaatattagttgtatatatttgtggtgtacaacatgatgttttgaaatatgtatatattatagaatggctaaatcaagcgaattaacatatacatcacctcacatacttaatcatttttttatagtgagaacatttacttgttctctcagcgattttcaaactgacaatatattgttattaactatagtcagcttgttgtataatagatctcttgaacttattcctcccatttaactgaaattttgtatcctttaaccaacatctccccagtcctctccctttaccagcagtccttggtaaccactattctactccctgcttctatgagttagactttttaggacaatgtaactcctagatgcattttaaaaacacgtagaacttgttcacagcacaggctctggagccattctccaagcaaaggtttttaccggtttgttaaaattccccaggatgctttctaagtccctaagtctattgcaacaacaactcgtaaaatcagatacatgattcctgttttcaaatttcctatctagacccacttggatagcaagattgatgctgttctcaccagcctaaagccccttcagctctagctgaaatctttgttctctcacaatgcccaggaacatgtcttgggctcattggtaggtaggaacgtgctgtgtggcaaggagaaaatttccctgtaatccttcatctaatctataaaatatcctaaaggattcaccatattaacgatttttcctcatccaatttatactgattataggtggttagagttgagatacacccctaaataactgaatacacataaaattgtgagacttcctttgactctctattgctttgttgaaagtctttgtcaatatatctggccattgaaaataatatggtttattaacaatgcacatacactcactgagacaattctaagcaaattgtttataaacagtatattttatcattcacagcctttgtcagtacatagcacatgcatctgaagtatttagaaactattatattgttatgcaagtctaaaatgcaaatccttagggctatttactttatcagtaagattattaatcattactctagctataccttaaagttatagcaaaaattttcaaatctgacttattaagacagtcaaaaaaggactcccagttatggcttttctaaagatctaagtcataatactcaaagaacagtcctgcagtctacttattgtttattcaaatgaaagcaccttaagtgaacttacctgttagtacatgaaatgatgtgtgataaattccagttgacatgcccaaactactcttcagtcatgtaagtacaggcagtaattcaaaacataattaccaataaagcaataatggattactttggggaagcctattcaatcatttctgaatacacactttctctctgtctttcaccatgacctacataaagccatgtgtacatttctcttcagtctccacaatgatccctgaacaatatactgtaacatgaaaatgtaatcacagatgactcaggggaaaaaaatcttacagctatgaaatcactgtctcttaattttagtcaatgttatagaagatcctggctgcaagtcatcactggcctgtcctgacaaggaagagcttcttttctcggtaaatggaaacctaggttattcggcttgagctaggatgcagttatcaaactggttctcaccttcctattgtaacatcttgaatgtgtcagtcatgtgctttcattttttggagatagaatggagaaaacgagggaacacctgttttatattggatttactttcatttctaagggccattaaggattatttagcactacatcacttacttctacaagaagttggcgtctggagatggtgttctaaaaactgataaagtatacaacgttactatttaaaatttcagatggcttactgtcttagcctgtttgtgttgctataaaggaatatccaaaactggataatctataaagaaaagaggtttatttggttcacaattctgcagactgtataagaagcatggcaccagcacctacttctggtgagggcttcaggctgcttccactcatggcagaaggtgatggggagccagcatgtagagattacttggtaagggaggaagcaaagggtgcggggtgccaggctctttcaaataacctgcccttgcaggaataaatagagtgagaattcactcattaccaagaggattgctccaagctgttcatgaaggatccacacccaaggcctaaacacctcccattaggcactgcattcaacactggggatccagtttcaacgtaatatttggaggggttgaatgtccaaaccacagcacttgccttttcctatggaagttcaggaccctatatgaagccatctgttgactttttaagctcagtaccaatcctgatgtagtctgtgcttcttttatactggccaacttgctgtccctcaaacccaccttgaattttcacagtttttccctctttatgggaggcttttccaattttctaaaggttcaattcaataatccagctgaacagctgtttctttaaaaatatttcctcagtatcctgacagtacagcagcattaattgtaaaagattttgtttacgtaacaaatacaattcttttgaaatctgattcatatacaccagattgtgagttctctcaaagcaaattctgtgtatttttcttcattgtattttctttcattccccagcatactgtcttgcacataatagatactcagtttaattttatcaaaatcattttttcaggaaatgattaacaatctccaatttaaaagatatatttgtattgaaccacttcatggcttgatgcttttaatcaaactaaattttgactaggtataggttgaagaataatgtataagtgcaatgtatggtaataggaaattggttataattatattgtataattaatatttgcatagatacatactatattggtcatcttttatcccaactcctattaaataaatatcatattgagatttaatagtgcttagttttgatgcagttaattttaacattttgctcttgctaacattattatgtgttttttggcatcagcttatgaaagaacatggaaaatcaatttattttccattttctttgtcaaatttagattaaaactttgtagaagccaaaggtcatgctcactatgatgtcatggacaaaaaggcctttgttattacattttgttcatttttctctttttttctttcaattttacttgacacataataagtgaaacatatttatggggtaccaagtgacagatacatgtatacagtgtgtgattataaattcagggtaattaaaacattcatcacctcaagtcattatcatttgtttaatgagaactttcaaaatcctctcttctagctttttgaacatatacaataaattattaactatattcaccctacagtgccatagaacactaaaacatattcttcttatctaactggaactttatatgcattgaccaacctccctctatcctccttctcccttactgttcccagcctgtaataaccagagttctactctttacttccatgagctcattgttttgctcctacatgtgagtgagaacatgcaatatttatctttccacgtctgacttattttacttaacataatgtcctccaggctcatccatgttaccaacgacaatatttcattttttaaatagctgaacaatattctgttgtgtatatatatatatattacattttctttatttattcatctgttaatggacatttaggttcattccataccctggctattgagaatagtgctgtaataaacatggcagtacagatatctctttgctatgctgacttcctttcctttggataaatacccagtagtggcactgctaaatcatatggtggctctgtttttagcattttgagaaacctcaatagtattttccataataaatagctgtactaattaacattcccactaacagtacataagaattccccttactccacatccttgttagcattttttttaaatcatttcctttcatttagattctgtggaagagtttcttgggtttgtttcttaaataactaataaaattatattagtgatgttgagcataataaattcttacaatctgatccaatctttgtccaattaagagtgtggtggtgcaggagcagctcttgttttttttttttgttttgttttgttttctgttttttttttttttaacaatttcgttgactctcagagtctaagacttcagggctgggacctttgtccagcctgcacggtagagtgaggctgcctctcccaccaggcattgggatcctatttagaaacggcgttcacttcagaaggtactttttaactgctcagtttttgactattttaaatagtttgctgaaaactcctgataacacttgcagctcttgtttttaaagttgctttcagtttgagtatggtcttaaagacttctgttgccacactcctggtgcaacagcttccctatatgagccacaattttggtacttgccacttttataatgtataaacttctgggactttgttatatataattttatactactttaactgtggctattttccttttttaaagctttcatatctgagtgagaagatatggtgtttgactttatttttctcttatttcacttaatgtcatccagttctatgcatgttacagtgaatgacaggatttaattatcctttatggctgactagtattccatgtgtatatataccacattttctttatcaattcaacctgttgttgaacacgtaggtttattccatatcttcgctcttatgaatagtgctgcaataaacatggggttgcagatatttctttaatacaatgatttcccttctttgggatagattcccagtagtgagattgctagatcatatggaagtcctatttgcagttttttgaggaacctccacactcttctccatagtggctatactagtttatattcccaccaacagtatataagagttccatttcttctgcatcaacaccagcgtttgttatttatttttgtctttttgataataggaattctgacttgtgtgagatgatacctcattgtggttttgatttgcatttccctgatgattagtgattttgagcatttttccatatatttattggctatttgtatgccttcctttgagaaacgatgtccagataaatcactcatttttaaattagattattgtttctgtgctgttgtttgagttcattatatatcatggatagtagtcccttaccagatgaatagtttttaaatatcttccctcattctataggctgtaacttaactctgttgactgtttcatttgctgtgtagaagctttgtagttttatatagtctgatttgtctatttttgtttttgtggtcttaaccataaagtctttgcctggatcagtgtcctgcaacatttcctttatctttttttactagttttatagtttcagtctgatatttaattctctaatccattttgagttgattttttaatgtagtgagagatggtcttctagtttcaatcttctgcatatgaatatccagttttcagagcaccatttgttgaagagggtgtcatttttttcaatgtatattcttgacatctttgttgaaaatgagttgactgtaaatatatagatgtatttctgggttctctatcttattccattggtctgtgtgtctgtttttatacccataccatgttgtttttgtttttgttactattactgtgtattatattttgaactatctatattatattttaactaactatattatattttgtactatcgccagttttacccttttggcttggtattgcattgggtatttggggtcatttgtggttccagacaattttaggatgtttttccatttctgtaaggaatgacagtgttattttgataaggattgcactgaatctgtagactgccttgggtgaaatggtcattttaacaatattaattctttcagtccaggagcatggaatgtttttcaatttctttttatcctcttctatttctttcatcagtgctttgtagttttcattgtagacatctttcaccttggttaaatttatttctaagtgtctttttttgtagctactgcaagtaggattgcatttttaaattctttttcacctagttcattactggtatataaaatactaattatttttgtatgttgattttttttatcctgaaattttaatgaattcatttgccagttttaagagtattttggcagagtcattacatttttctatttatgagaacatgttgtttgcaaagagggacaatttgacttcctcttttccaatgtggatggcaatttcttactttctttttcctaattgttatgtgctaggacttctagtactatgttgaataagagtagtgaaagtgagcatccttgtcttcttccagttcttagagaaaaagcttccagtatttcttcattcagtataatgttagccatgggtttgtcatatatggtctttattgtgttgaggtatattccctctatgcctaatttgttaagaattttttatcataaagggatgatgaattttattaaaagatttttctgtctattgagataatatgtttttaaaattttatattgttaatgtgatgcattacatttattgatttgcatatattgaactatccttgtatccttggaataaattctacttgattaggttcattatgtttttgacgtgctgttgggttctattttctagtatttggttgagggtgtttaaatctatcttcatcagacatattggcccatagttttctttttttgttgtgcccttgtctggttttattatcagggtaatgctagcttcacagaattaattaggaagaatttcttaatcctcaattttttggaatagtttgagaaaaaatggtgttagttatttaaaagtttgctagaattcattagtgaatccatctggtcttggacttttcttttttgagagactttttgttactgatttaatcttcttatttgttattggtctgtttgattctgttcatttttggttcaatcttggtattttatacttgtgtctaggaatgtatccatttcctttatgttttttaatttgttggtgtatagttgttcctaacagtctctaatgatcctctgtatttttgtggtgtcagttgtaatatctcattgttcatttctgatattatttatttaggtctttttcttaatctatataatagtttgttgatttggtttacttttcaaaaactaacttttttcatgaatcttttgtttgcttttttgcctctaatttgtttcattctgtgctgatctttattatttattttcctctattaactttgggtttggcgtgttcttgcttttctattttttgaggtgtatcactaggttatttgaaatctttttttttttatataggtgcttattcctttaaacttccctcttgtactattttttctgtgttccataggttttttggtatgtcttgtttctgttttcatttctttcaagaagtatttaaaatttccttcttaatttcttcattaactcatttgtcattcaggagaatgttgtttaatttttatgtatttttacagtttccagtgttcctcttgttattgatttctaattataatccactgaaacctgagaatacatggtataattgcatttttgaaaaaattatttagagttgttttgggcctaacatagggtctaccctagagaatgttccatctgctgatgagaagaatgtacattttgtagccattggaaaaaatgttctgtaaatgtctattaggttcatttggtataaaatgaagcttaagtacaatgtttctttgttgactttctgtatagattagctgtgcaatgctgagggtgaggagggtgaggtgttaaagttctcaactattattacattggtgtctctatctctctctttaactataataatatttgccctatatatctgagtgctctggtgttcggtggatatatattaacaattgttctttcctcttgctgaattgattttttaatcactatataatgacctctgtgtctttttatctttttatttttaataaaagtctattttgtctgatataagtttgctacttttgcacactttttgtttgcatttgcagcaaatatcttgtttaatctgttctgttatagtctatgtgtgtttttaaatgagaagtgagtttcacaagcagcaaatagttgggtctcagttttttaattcagccagtttatatatttcaattagggaatttaaacggtttacatttaaggttgttattgataagatgaggatttattcttgtcattttgttagttgttttgtaattgctctgtatagccttagttcctttcttcttttattatttttgtggtttggtggttttctgtagtgataaaattttattcctttctttttctcatttgcatatctgctttaccagtgaattgtatactttcatgtttttccttaattgataggtaacatctaccaatgatatagacacatatctgcttttgcttaattgatagataacatcctttcgctttcagaggttggagtcccttaagcatttcttgtaggttcagtttaacagtgattaattccctcagtctttgtatgtctgggaaaattttatgtctccttcatttctaaagaatagctttatggtttatagtattcttagttgaaagttttttcttttttttattccagcaatctgaatatatcatcctatcctctcctagcttgtaagtttcttctgagaaatctgctgttagtcggacaaagataccctcatatgtgacttgatgctttcttttggtgtttttagaattccctttttgtctttactttgacaatttgactatcatgtgcctcatagaagacctttttggatttaatcgatttgggaacatttgagctccctatatctagatgattatctcccaagagttggaaacttttcagctattgtttcattaaataagtggcctatttattttctcactgcttttccttctggaatttctaaaacaggaatagactatttgtttgcatagtgatatcccatatgtcatgtaaacttttttcatttttattcttttttctctttttgcctaattcgcttatttcaaaagatctgtcttcaagatcacaaattatttcttttgctttatctagtctattgttaaacttgagtagggtgctttggctttgtttctgggagaatgcagtactgtagtcaccatatgatttcttcagcattagtccaatcagtagtatctatggcttcacagtgtcttatgctctagttgttcctgaaagctgtgatgtgactttactggagatggggcctccaggcaagcagtccttggatccctggggagtgcacacgcacctctggtggtacacattgcatggaccagttctcaggatcctgggtggtacacaaaggtacatagtggccctgttattgctgggccaagtttgctgggttgtgatggtggcacatcccagacagggcagtccttaagccctaagtggcacgtttggggatcagtgttcatggcagtaggtcacaagcaagctggtcctcaggcccctgggcattgtgtgcaggcacatgatggcccaattgctgcagggaacaaggtcactgtcatcagggaaggtggctctcaggctcttggaagcatgtgctttggatttctatgtcctggggagagcctccctgacgtgcaggactgcctattccctgggatttaggtctctgtgtgggctcaggtaacagagaccctgtggcaccattaggttcagctggtaatgtaacactgcaaccttctgggatggtgtcgggggatgtaggctgtgcacctgtgatgtggagatgcagcagcaattaggccccagggcaggatgtagtctggtgtgacacttgttagtgcatttttgatggcattgaaagttaccttggtgttactaagccaaggtcaaagaacattgtgatgattaatgctgaaagttattttttcataatttgaagattttttaaaatattaatcctggggccaaacacattaaaggaattaagaagaaataaatctggaaaattaatgtagacacagaatttaaaatgggaataaatacttttacacattcagcaaatacctattaagagacttcaggcaaaactatggaagtaagaggtcctattaagattctacagcaacttagggaaaagaaagttacttgaactggcgtagtagcagtgaatatgggggaaaagtgaacatatttaagaaaaatttaaaatatagaataaaacacatcttcaactatccttcaatactacagttcactaaaggtcaatgtgatattataatcagaacactccacaataagggaataacattgctaattctaatttagaagtggtcaatctctttttcagaaaatccaaaaaccattgtcaatcgcttccaccaatcctcatttgatctccaccaccacagttcttttgcaagtaatctcttccactaccttttactcattgttcaatttccagtacctttcatgggatttagcactcataattatggaatattaaataaataaacgaaggaataaataaaagaaaggttgtatttttacaaacccttatatttaatcagttcttagtaattgttgaatagttcttatggtccaaatcattcatcccttctatcaaagtttgtagctcatgatgagtcagtttatgcaaactgacctctgaaaatatatgtttaactatcatgagacatttgttgatggtatgaataatttttaaatgatcattgaaaaactttcagttttaaatatataactgcaatggataaacagaagacatttgtcattagagatacccttatttcaagaatctttagtcaatattggaccattgaatcatactaaaacataattataagcaaatattttaccacatgtgatcttcctctgtggtaataacaaaaaaatagtttaaagtctaagagtcctttaccattgattttaaatttttatttgtatttacattttaatgtagagagagctgatattctgagaattcacacgttttcacaaatgattcagaagaaaatggaaatctgttttggacccttattccctatatctatctatctatctatctatctatctatctatctatatggaaaatagtctctccctctctgtctctctctctctctctatatatatatatagtattagtattgactcctgaaagaaagcccatgagaggttaaatgcttataaaaaatttgaaagtaaaattttccctaagtaattcacaacacagatacgctaagaactaacttgtcaattgatctacctgacaaaagaggaaccagaagtctctgaatacaaaacaacatatcactctaaaagatcattgtattagtccattctcatgctgctctaaagaacttcccaagactgggtcatttataaagaaaagaggtttaattgactcacagttccacatggctagggaggcctcaggaaacttacaatcatggtggaaggggaagcaaacacatcctttttcacatcatggcaggaaggagaatgagagcccagtgaaggaagaagcctttataaaaccatcagatctcgtgagaattaacctcactatcacaagaacaggatgggggaaaccacccctgtgattcaattatctctacggggtccctcccacaacaacatgtgggaattatgggaactataattcaagatgagattttggtggggacatagccaagccatatcaatcattcttcacaagtaccagataagttatttgctattaaacacatctgtaacttttctaagaaaatctgtcccctacagaagatgcaagattgtgccaattctcatcacagctattcaaactatgattaattatctggaaaaaaaaaaaaaaaaggtaacccatctattcattggttttattttggacctacagcatctaggctggtacaaaaaagatctagagggccagctagattctttctcttttgtttgactgggaaaattctgagagaagatgccataatctgtgggagcagatgttgaaaaattatgatgttacaaaaagatcactggtaaagaatcatggctaaactaatataagataagcttatgaaggcacagaaacttgagagagcagtggaaaccactcagtattttaggcaaacatgtctgcttgactgtttaatggccatttctctttttttactaacaaatctctgattttgtttgtgtagtaagtgactagtaataaaggttaaattgtggctggtctaagcctagtgttcaattagaacctgtttattccagctcacaagagccgattctatgcatttcgtaccaactcagagttcagtgacatcacattggtagcttaaaacctgcaaaggtgggggtatttatgccacagaaataaacaaatgctacaaattaggactaccactccctctggcttctagtcagttgttaatcacttatcagcaccctctaaactcatcttggaaatctaattttcttttgccggtaattggctcaagattgagagaggaaccaagttttgacctatgacaagtaagagaaactgatgaaaatcatctgggaaagactttcttctctaaagttaaagctgcaagccagcttctttttccgttttaaattgtgttgtgtaatgtttggagatgcaatgctttaagatgcaaccaagagggaacatgaacagaattcagagatgcttacacattaataaccttgaactgggccgggcaaggtggctcacacctataatcccagcactttgagaggtcaaggcgggtggatcacaaggtcaggagttcgagaccagtctggccaatacagtgaaactccatctctactaaaaatcaaaaaaattagccaggtgtggtggcacatgcctgtaatcccagctacttgggaggctgaggcaggagaattgcttgaatccgggaggtggagttgcagtgagccaagattgcgccactgcactcaagcctgggtgacacagagagactctgtctcaaaataaataaataaataaataaaataaccttgaactgtcagaggcatgtgaatcagaacaactccatcttgaataggagcttggtaaaatgattttgaaacctactgggctgcattcctagacagttaatgcattctaagtcacaggatgagataggaggtcggcacaagatataggtcataaagaccttgctgataaaataggtttgcagtaaagaagccggctaaatcctaccaaaaccaagatggccacaagagtgacctctgctcatcctcactactacactgccatcagccccatgacaatttacaaatgccatggcaacatcaggaagttaccctatatggtctaaaagggggaggcatgaataatccaccccttgtttagcatatcaccaagaaataaccataaaaatgggcaaccagcagttctcagggctgctctgttaatgaagtacccattctttcatttctttactttctcaataaacttgctttcactttgcattgcagacttacccccaattttttcttgcacaagatccaagaaccctctcttggggtctagaatgggacccctttcctgtaacagaaatattaccaaccagggcaaccaaaatgcagaaaatcatgagcagtccaccatgggcatagaaaataatgtgcgttttctgtacagaatttaaaaataataattaaacatattaaccatcagtctactttttattatcctcctgtacggacaattctaaataatgttagccatgaaaatatccctctccacatagcttaactgctcctacccaagtcctccgtttgctagggctagtaaccctaaagccaagtatatcaaacatctaggtatatgagataaggaagggtttttgttatttaagtaacctttacatgagttttctgtttcttgtttatgttttgaactgcttaagttgtccatgaaaagaagcagatccagaatatcggtatatcaggttaatctagcactaaagggaaaaactattaattcctgctttaaggacctacaatatccctggatcccaggcctcccccagctctaatcatgcaaagattggtaaattatggttccccttgttgcatgtccagagtattctccctatgtgctgtcagtattactatgctaaactacctctacattgatgaatgtaagtaggttcctttgccttttaaccaaaagaaccgagaaacagaacctactattcaacagtcaaattacaaaaggcttttccaatataaggtgttgactgaatttactttgtgaagtctatatgaaggagatagcaaatagacaaaaatatgcttaatgttgttcataataattaaaattactgtttaaatgttaccaaaagagcacataaatgaataagttcttgaataatatacaatcatgcagaaatatgcagccaaatatgtgtaaaaaggcaagtaacataaatatgcatatatacatgcatgatacacatttgaaaatataaatatatattagaaaaatggtgaaaggaaaaaaaatcagttagcagtgattattattcctgagtagtggaatcaaaggccattaattttttttcccatacattttctatatttccaaagattttgattctataaaaataaagtagtttaaaaatatgtaattagcatacatttcattttcactaatgtatcatgaaaatatagttggtttctggaataatttttcattatgagaatgtatacatacatgaaagtaatgaagtcaataggttagactggaacaaatcaggtaactttaaaaaatgaagttggatattcatgagaatttgcattttataagaaagaatattatcacattccaagaaaatccttctcttacaaaaaaggaaaaatgtatatataatttattttagacagaggattactttttgagagaataaaaaagacgaaaatgtgttcacttctttgttcttacaacacaaacaaaacttgaattatgcttctgaggatattgatttatgagtatcttcacaatcctgtgggatattattctaatttgtgatgagataataatctgggcttcacatggaatctcaaccttgtctgttgtagttagatatttagacttgtttgtttaattctttagattagcactgtcaaatacatataatggttgttgaattatcatattgcatctgtgaaaggaaaataaatcttggagccccaaaattactaagccaaagggaaaagtcaagctgggaactgcttaggacaaacctgcctcccattctattcaaagtcatctctctgctcagtgagataaatgcatatctgattgcctcctttggaaaagctaatcagaaactcaaaagattgcaaccatttgtctcttatctacctatgacctggaagcccccttcccatttctacttgtcccacttttgcttcaatttgttccacatttctagactgaacctttgttcatcttacatatgttgattgatgtctcatgtctccctaaaatgtataaaactaagctgtgctctgatcaccttgggcacatgtcatcaggaacttctgaggctgagtcatgggtgcgtgtcctgaactttggcaaaataaacttcccaaattgactgagatctgtctcagattttgtggttcacacatttcaaatcgatgatgttttctcactaatatgtttttttccatgaggggagaaaaatttggttggaaaagaagcgcagggaaatcaggatttatttgaaaatctaggaaaaacctaagattctaggtattattttctaatatgttttggccatgaataggagtttcttttatagactcagtgtaaattgttaaatttaaaaagattacaagaggtcaggctcataatcccagagtagaccatggatgacacaactgctgctaatacatagcaacatattgcatccaaaaatacaatcaattaaatgtttactggattaaataaaattaatcttatttagtattattcttttttttttttttttttttttttgagatagagtctagctctgttgcccaggctggagtgtagtgacatgatctcagctcactgcaacctctgcctcctgggttcaagcaattctcctgcctcagcctcctgagtagctgggattacagacgtgagccatgacacccagctaatttttgtatttttagtagagcgggggtttcatcatgttggccaggctggtatcgaatccctgacctcaagtaatccacctgcctcggcttcccaaagtgttggcattacaggcatgagccaccatgcctgtcccagtattattctattttataaaattgacaagagaaaataaacaaattaaaagaataaaaacataccagatacagcaaggaagtcatcaatgcttgtaatgtcatctacggcttcagtgaggacatgtatatgattctcccatgtacgcttgtacatttccatggtgtttttgaccgcttgacttttgggtcttgcagccaaagcaagtgcagcattaataatctataaagataaggattgaaaaaattacctattggttgcaatgttcactatttgggtgatgggcacactaaaagcccacacttcaccactatgcaatatattcatgtaagaaatctgcacttataattcctaaatatataaaataaataaaaaatattaaaacaataaaataaaattaattaaattatactcattcatgttaaacataaaaaatggaatttaaaaaaatctgtaaagatgtagaacatttactcagtgatttatttcaatacattaagtgtattaaaattagattatttaaattaaattatggttaaatacattcatcatcgacaataggaaaaacagtaaaatgtctccatatatacagtttatattgaaaagtacaaaacgttttatatttattagtataaattatataggtataaataataatttttatttttaaaattttcctactccctctattattgcagagtgagttttttaaatataaactttgttaccataagctccatcaagttcaagacacttttctaagtgatgatatcaggcatttaatcaatccttaactgatgattctggtaatttaaacatgccaatccagtcttttttacattattaactggtgagaaatggatgcctttaacagatttttttttcaaattagtaaacaaaaagaaatcagaaagaaccaaattaggactgtaagttgaatgcccagtgatttcccatggatattcctgaaacattgcccttgtttcaggagagaaatgagcagaagcactgtaatggtgaagaaggacattctgttgacacattcttgggcatatttctgttaaagttttggttaattttgtcaaaccactctcaaagtaagcagatgttatcattctttggccctccaggaagtcattaagtaaaatgcctttagcatatcaaaaaactgttgccataacccttgttcttgactggtctgtttttgctttgactggatcacttccaactctcagtagccattgctttgattgtgatgtcttcagaattgtacttgtaaagccgtgtttcatctcctgttacaattcttcaaagaagcaattcaggatcttggtcccacttatttaaaaattccatcgaaagctctgctgttgtctgcagctgatctgggcaaaatggtttggatactcattgagtggaatgttttttcaactttaattttttagtcagaattgtgtaaactgaaccaattaagatgtctatggtgttggctattgcttgtgctattaatcattggtttccttcaattagagcatgaataatataatatttttttaatcacaaatggatgtggatgggctgcttctgtgagcttcatcttcaacatcatctcatctcttgttaaaataagttatcagtttgtaaactgaagatttatttggggcattgtctctatgaatattttttaaagcatcagtgatttcatcattcttccactcaaactttgccataaatatgatgtttgttcttcaattttagcagagtttatgttgcctttcataggggtttgatatagtttggctgtatttccactcaaatctcatcttgaattgtagttctcataattcccatatgtcatgggagggacctggtgggaggtacttaaatcatgaggacggttacctccatgctgttcttatgatagttgagttctcacgagatctgatagtttcataaggggattttccccttttgctcagcacttctctttcctgccgctacgtaaagaaggacatgtttgcatccccttctgccatggttgtgagttttctgaggcatccccagccctgtggagctgtgggtcaattaaacctctttcctttatggattacccagtctcagttctgtctttattagcagcattagaacagactaatatagggctcttttcaaactgatgtctctgatttttaacccgtcaaactagatcctgtccacgcacgttatcacaagttagcacaagtttatttttgtgcaaaaatgttgaattctatgcataattttttcataaaacacattttcagtaaaggttttgaagacctctcatacaatgacaacaataaaaagaagctttttctactgaatatcctaaagactgtaccttaagtcacttcctgtcaccacattattggaggtagaagacggaaaaaattagttgcctgagaataatatatttaaatcctctttttttgtttcttttctacaaaagaggaacatattaaattttaaggaaacacactaactttagaaataactactgtgcagtatgccttgacttcagttttagagttttattaacctattaacttacaatgtaccttcgtgtatactgcagtggctctggtccctggtgtttcattgttcttgcaattggacagctacgtacacatgtggttgtactgaaattatgccttcacagcaaagtatacttttaaagtactggtgtaaaaccctcagtggagatatgaagttatgaatataagacaggctacattttataagaatattttcagttctgctgctgatccaatttatctgattcaacactgcacactatgaagaagctttatcctacttgactcttgtgatatttagcttaaatctaaaagaagacacaattcagaagaattcttctaaccctctttagggcagaaaaatgttcatcccaatgtcacactcctagaattttagccatatatctagagaaaataaaataaccattcttaaatcttcttcacgtaaaactaaagcttttttttaaaatgaattatgttgctttctgaggcattttgtttctttaaattatggttgaaatatttacatgtcggtcacttgaccctgataattatctagtctgtcagtttacctttgaaacagtctcttttgagttcgggccttattatatcttaactgggccattctagtagccttgtaggtttctacttccagtctctatttgctcttagacattctccttaatgcaaacacatttctttctcaaatgccgaagtgatcatgccccccacttgctgataacctttgataaaatcctagttgactaaaaacaaacaccatatttcttttcagtaattcatagtctaaaaccgtccccaggttggtccttacctacagttcattctgctgtaataatcttactcattttagtctttgttccagccacagttttaagctccatttccttatcacaccactcatctttgtacctctgtgactgtttttagagctgaatctgccttaatgcccttgctccatccctttttctgctctactccgtctcaggaaacatttttcatacttaacatatccatggaaatatcaccacatactgtgaagcctgtttaaaaaatattttgtccatataaataaatagtagttattctattgcatgattgctcgtacacatgtctattcctgggtaatgagctccattataggagggactatgtattattcatctttgcttcttggtatactaaacatgttaattaccataaatgctatacttacaaactgtccctaagagaaactattctgctcgcagcccacactgagaggacagccacaggagggcaggtttggtattattttctcccacttcaacactatttaggtcataggcaggtacccaattcaagaagagttaatctgttggctggctggtgatggttatgaggtttgacataaaaagttgtgttgtgttaatcaatcttgaaaatttgaactagaatttatggagaaatcattagttagcagtcaagatcaaagctgaaagtttctgtaaagagcagccatcttataaaatcagaaccagagggggccaatggaactgaggctacaaggaaactagagccaaagtgcaaggaagaagaaactgtaaatagactgaacctataatgtttaaaaagaaaaaaaaataggccaggtgcggtggctcacgcctgtaatcccaggactttgggaggctaaggcaggcggatctcctgaggtcaggagtgcgagaccagactgaccaatatggagaaacctcctctccactgaaaatacaaaattagctgggcgtggtggtgcatgcctgtaatcccagctacttgggaggctgaggcaggagaattgcttgaaccagggaagcggaggttgtggtgagccgagatcgcaccattgtactccagcctgggcaataagagcaaaactccatttcaaataaaaaaaagaaaagaaaagaaagaaagaaagacaaaaataaacaggcaaaagcaaagtgtggagtaaaataagccagtgggtggcaagaggagaatggggaaaatatatcaagagagtcaataacatcaacagagagaaaatgatactcagataaaagaaaaaaaaagaactaggagttgactgtttttgagagtatcctattttggattacaaggccacagaaatgctaataacgataataataaaatactaacaaagtccatactttgcatcatgcaccactgttccaaacactttctacatattcacctaatttttttaacctaatttttacaccacaatgaggtaggtaggtgttgtcatctccattttcaggtaaggttaccaagttattaaggagaagttgtcaacttgacctagacttcatgctcttaattgccacactgtactctcttctataacaatattatactaatttatgatgctgtgagtaagtgatgatccttgaaaccataaagccatcactgaaggaaacattacaatgcctggtgtaaagaaaaacaaaagagagagagtgtgtgtgtgtgcatgtgaaagagagagagaaagaatatatatataaaattcgctaagttaaccatttataaaactcagtggcattaagtacattcacatagctgtgcaactatccatctccagaactttttagcacatcaaactgaaattctgtactcattaaacaatagcttcccattcttccttccccctagtacctagtaagctctattatactttctacctcttttgttgactattctagatacttcgtataagtggaattatacaacatttgttcttttgtgtctggcttatttcccttaacataatattttcaaggtttattcaagttgtagtatgcatcagaatttcattacttttcaagattaaataatattctacagtatgtacatactatgttttgctcacccattcatctgtcagtggacattgggttgtttccatattttggctgttgtgaataatgctgttatgaccattgttgtacaaatgcctgctcaagtcttggcttgcaattatttggggtatatgcccagaaatggaattgctggattatatgacaatttttttaaaaaggggtctcactctgtcacctatgctggagtgtagcggctcaatctcagctcacagcaacttccacctctcaggctcaagcgatcctcccacctcagcctcccaagtagctgggaccacaaatgcgcaccaccacacccagataattttttgtatttttgatagagacaaggtttcgtcatgttgcccaggctggtctagaactcctgagctcaggtgatctactggcctcagcctcccaaagtgctgggattccaggcgtgagccactgtgcgaagactgacaattctaaatttaatttatgaaatggccacattgttttccacagaagttgcaccattttgtattcatatctgcaatgcccaagagttcctattttttcatatcctggccaaaacttattttctcttttgttttttcttttaatcccaaccatcctaatgggtgtgaagtggcatctcattgaggttatgtttgcatttccctaatgattaatgatgctgaacatcttttcatgtgcttattgacgaactgtttatcttctttggagaaatgtctattcaagtattttgcccatttttaaattgttttttcttgttgacttttaggagtcctttacatattctggttattaatctctgatcatatatatgatttgtaaatattttctcccactctttgggttgcctcttccctctcttgctaatgtcctctgatatacagaagttttaaattttgatgaagtccaatttttttttccattttttgtgcttttggtgtcatatgcacattgccaaatctgatgtcacgaagtgtcactctatgttttcttctaagagttctatatttttagtcactatgtttaagtctttgattcattttgagttaagttttgtatatggcacaaggtggggcaaacttcattcgttgccatgtacttgttttcccagcaccaattgttgaaaagactatcctttacccatagaattatctgggcagccttgtcaaaaatcatttgactgtaaatgcaagggtttatttctgggatatcttttctatgccatttatctatatgtctgtatcacactgatttgattattgcagtttgtaatgaattttgaaattagaaagtgtgaggcctccaaatttgttcttatttttcaagattattttggctactcaaggtcccttgagattccatatgaaattgaggatgtgtttttttctatatgtgcaaaatacattgttggtattttgatagggattacattgaactggtacattgctttggttagtattatcatcttcataatattaaattttataatccatgaacatatgatgtcttttctgttttttatgtcttctttaatttctttcagcaatattttgtagttttcagcaaaaactacaaaggaaaagacattcaggtaaaagtctttcacctctttcgttaagcttattcctaggcatttcatttcgtatgatgctattattaagtgaaattgttttctcaattcccttttcagattgttcattgttcgtatacaaagacacactgatttttgtgtgttgattttgtattctactgaattctgttattagttttaagatttgtgtgtgtataatcttcaggattttctaaatataagagtatgtcatcactgaacagtgataattttatttcttccttctcaatttggataccaccaaaaaaatatataagtttttttattcgtttaaagttggattttgtcaggcaagtaaaaagaaaggaattaattggattgattgaggttataggaggagtacacagaactccaaggaactgctgaaagcactcaccagcctccttttaaatggggcttctgttattccaaggacattccctgcccacgctcgctcataagggctgtgtttgatcctcatttctctttcctcatagaggcctgtccaaattagctcctgttagaccctgtgcattaggttgtctgacaccccagaccaaagccagtttagttagcttcagctggtcccattctatcttctttaggcttctccccatttttactggtatatatggccaagacctcaacatgcttcaggctaagcttcctcatatttttctattaaatcagatagacaacttttactacattctaaactcatttaccttgggaaacccttgaacatctaaactacgttcagaatatttaggattttcagactgtctcaagattttctttgtgtccctctaggtattagaagcttgtatttacaggcatctcatttgtacagacgccttctaagacccataagagactctagaaatgtgttcacattgtcatttattctagtaaaacctgccacaaatagttttgggatccagctaaggggaagttgagttgaggatacatttagtttgtgtttagtgggtaatttcaggtgttttacagtcacttccctatattttttaccaccttcatacttgtggtattgacatcggatcatgatagaaccaatagagactttgcctgtcctaattatatgtgctctcctttctgaaacaccccccaaacaaactatgctaaaacaaagactgaattatcttctcagtttctacatagaaagtgacattacaaaataacttgttgtcattttagaggtgatcaagagtgtgcagtgaaagacagaaaaaaagaaaagaaaaaagttttatgagggtgtatctgacacatcatttatacaaatgtattatttttctggattttgctatattttgatatttgacagcattttaaaattagtatctagttggtttttgttttctaaataaatattcactttttcttaaggccctcaaaactctgtatactttaggctccacacagcctggcctatcacaatcaatgtattatttatttattataatttttttgagacagagtttttgctcttatcaagcagactagaatgcaatggtgcgatcttggctcactgcaacctccacctcccagattcaagcaattctcctgcctcagcctcctgagtagctgagattacagatgtgtgccacagtgcccggctaattttgtttgtatttttagtagatatggggtttcaccatgttgggcaggctggtgttgaattcctgacctcaggtgatccacccgccttggcctcgcaaagtgttgggattacaggcgtgagccaccgagcccagccaaacagtgttttttttttgttttttttttttaataaaaaaacctatcttctgaaatgataaaatgaacacatattcaactgcaatatttttattctttacagagaaaaatgacttctttcccttcaccttccttttgatgtgacagtggttttcttcaaaaaagttattttgcttttactatatgtgtaaaaatggaagaatagtgtaggagttataaaaataacattactgaggacctgcaatgtgccgggcatgtttctaattacttgatttgtattgtttttcatcccctgagaaagatcttatcagtatctccaatgtgctgacaagacaatggaggcacaaagagatgaaataacttgcccaaaattatagaagaaactctagattggaagccaagaggctcaagttaaagtttcactttgctttaaactgattttatgcccataaaaaaagtcatattacctctccaggacctattttcacagaaatacatgtatgcatacactgaggtggggtgtggagacagggtttgaattagctcatgccttagaggttcttcagattttaacatttgatttaatgctgatgtatatacttctcttgaaagatttctaaaaacaattacttaaaaggtgaaaataaatctacgtaatttaatttttcccagagatagttcaatattggcattgatacaaataatcttaaaaattttacttaatataacaaaagcactttgtggattaaaaagatgatttatatgtagtatctataggtctgattacctcagtggcacggcaagtagagaaaattaaaataactagatatatgatgcctcgaatacatctaaggttgtatgtgaggtgaatttatgtaacaaccacttaaattggtaacatcatcataatttcagaattctagcaactggagtaatggcatcaaattcaatgctctaactctgttcatccttttctcagttgcttaaatgatgttctactactaccaaatatttctcactttctacgtagtttttccacatttctttattttgataactttttctattttacctgctctcatactatacttcatctatggcaaattacctttacacttcaaattacggcatgtaatacttcccaccatgaatctccatgtcagaactttatgttaaatgataaaagcatttcagagtaggggagggtgtggtgctgaggagacctaacctgccatggactccaggtttacaattaatgaaactgcattcaactttggcctcacaaccttttttgtaatcttcttactccatgaagggatgatccctgcatgatgggatcactcacacggaaacttctcacaagactctcatttgccttggataaacgtataagaaaccaagctatcctattctaggggttaaaagtattttttaagaggagaaggggacaaagtttatttctgggaggatagagctttctgtgaaagtatatgccagtataaattttcgtatctcataaaacatactgctgaagaggaaaagttcaacctaggactatttcggttatggaaaatgtaataagtgggaaaaataatgctcccgggaggtctgtaaaaggcaataattccacatgaaaatcaaaacatttattttactgtcttttacactaaatattaagattggacaaccttccaaattaaataagtaaaagaggaaaagaatataaaatgcattgcttgtgatgataaaacaaaatcaccaatacgtagggtttgtagactaataaaaatagaatttggagtgaggactcccattttaatccagctccagtacttagttttgtgtggttttagacaaattgcttactctctgagcctcaatttcctaatctgtaatgatcattaaaatgcttgttacaaaggttgttggtagaattaaattagattatggtttgttcgtttgtttgtttgtttttgtgagatggaggcttgctctgttgcccagactagagagcagtggtgcagccccaaaaattcaagcaatgctcctggctcagcctcctgagtagcttggatgacaggcacttgccaccatgcccaactaatttacaaatgattgcttctataaagataatttgaaaataaaatacaagaatgctttagggatttaaaagaatactatacacaaatatatatacacacagaatttacaattttgttgaactcaacaatcattttaatattccaatttttttaagtctgagttaaataaatataaataagaaaaattgaatctacacacaattttttagggttttcctgtaacataaaactaaaataagagaaaaattgccttaaaactatctgataccaataacacatattacagtttaaagtaataaaaatactttaactggcaatgatgaaaaaataaatataggcaacagagattttttgatccattataatttgctactcagagatttaataagtttagaatttggagtggaaaaaaattggtactatctcccaaatcatttcagttcaaatggagaaatttaaaatgaatttaatatttttgccaaatctcctttttttaaaggacttttatgtcagaaacatctacaaagtttctctttaatgtaccatccaatttcatatagacataaagtcaaaatgtaagctattcattaattgccaaagtgtgtttcatataataagaggttggcaaaagttaaaaagaaaaaacaaggcctggcgcagtggctcacacctgtaatcccagccttttaggaggctgagggaggtggatcacaaggtcaggagatcgagaccatcctggctaacatggtgaaaccccgtctctactaaaaatacaaaaaattagccgggcgtggtggtaggtgcctgaagtcccagctactggggaggctgaggcaggagaatggcatgaacctgggaggcggagcttgcagtgagctgagatcgcgccactgtactccagcctgggtgacagagcgagactccgtctcaaaaagaaaaaaaaaaaaaaggcatgtatttgaaatgcctgacagcttgggattagacatattctttgtagacttggattcagctttggttttagcactaagaagagttcacataacattaagaaatttaactttcttaattgtcaaatgatttttgctctgtgtctaccatttatctaagttagagagcataagacaggagaaactcagaaaatatttcactttaagtgttctaagggagaaaagtcacgcataaatattcaataaaggacaacacgtatatgaaatctatgtaagcaatgttttccctgagttgcaagggcatgttaagaaaatatgagtacaaggtacaaatagggtcgaaatagttagggttgacttctctttctcattcctctctcattgttcatgctcttgcatggtctccttctctctccttctgatgggttcctagaaattttattaatatccttgacctagtattttgacctccaagatactatgtccactgccacaaccccactctacacgatcattatctctcagtgacaactgaggtagctttagttctgttcctagccactctctacaaagtgatatttccaaattactaatttcacaaaattcctgcctcctcttttatcataggatcaaagtcaaagtacttaatttagcctaaggccctgaaatatttggcccctgtttatttctctagcattatttcctatcagcacccctcgatttccactcttctttgtctaggggcatttgtctatgcttttctttctgtagggatttacctcttgttaggtaactccaatttatccagcagggctcacctaaagcattattttctcacgaaaactttattaaatctaggtcagtttcctagattgtcacggttgagcatttatcacactacctcaaatatatcaaatctaggtcaggttcctggattgtcgtgggtatttatctcaatatctcaaactttatcaaatccaggtcaggttccatctagggtgagtattgatctcactatctcttctcattaacgagatgttcattagagtgatcatctgatgaatgactaatctctactttccattgttataaaaaagcagtgatcttaatgtctttatgttattttcccagggtacgtggaaagtgccaaatagaatccctcttcccatgtaaccagggctccagtctaaggctccttctactttgcaagcctactaatttattaaaggcttttcccaagtgatcaagtctatccctacagcgaactcttataccagtagctatggtgatgaaaatatgtctatatggtcaggtatggaggttcacgcctataatcctagtgctttgggaggtccaggtggaaaaatggcttgaggacaggagttcaagaccagcctgggcaacatagcaagaccccatccttacaaaagagttaaaaaattttttaatgtacgtatcattttattttatttataactctgcagtcacaaaaaatagggccactactaaagtgcatattcaacagcaaagtgttcatcaaatatccatattaagctattctaaagattattccaagtgaatcaccaggctttccttgttgatccatcctgtgctcaactctagtgagtctcgagttagcaaaaggtaaacattaaagtgtgatttcccccatggaactgttatgctcaaaaactgaccattttgctatttcttcagattttaattatattacttggttagctagaggtcagaacaggaaaataagaatgaattcaagctggaaaggccatttagaaatactgtagcaattttaccacacatttaaggtaagaaaagctctataatctatttaaattgacctgaaacaaagttctttattaccagtataggtggtagattaaaaatagagtataataaaaatagtcagatgctactattaaaagagaatattggattttcccaactaggataggattttataaaaatcatatatatatatatatatatatatatatatatgtatatatatgatttttatcatatgtatctataaatcatacatttatgtttatatatataaaagagaaataaaattccctgagaatagaataatgtctttcttaaattagaagctttgtctatagtttgggcaacccaatctttgtatctttttattttaatcagtcaaattggtaatatataaaattattcagtaaattatatcatttataataatttaataaattatagtatttactgaatagcaaagatcattgggagtgattagaaaacataaattaactatacgaacttcatgaattactatattaaaattaaattatttattttctaaagttatgaagtattaaagtttggaaagaacatattttccattctggaaatggaaaaaaaagcatgttttctcattaaataattacaaacatttccatttaaaatttactactctattggagaattcttcttggcctcaacagattgcaaaaattgctaatgtttatttcattctccaggacctggagtccttaattgctgatgcatattcactggcgcatgcaaagtactgcagtgatgcactacttattgtaataattacatattaaagaacctatggcctacattcagtcagactcactttgtgagtttacttcttaagggggaaaaaaaaaaccctgaattaccagttacaaaatgagttagttgatagacaaaaattacccaaggaaaacataatcaataatatacactggaaaagagctcctctttgttgagcacagatctgcaatttgtaatttaaagtgttatttattttgttcagggcaggttgagctgtaacatgccgtgtaagagataaatacggctatggttcttaattacagactttaattcaatgggctatgtatagaaccaggaataaggtactactgtttcctgggagttggactatgtaaattagattgagtagtaggacacaaagctatgaataagaaggaattatctccggggaaatataggtgacaaacctacaatggcttttagcatctggcaggttctatttgaagagctaatgtcattctatgtaatggattaggaagaactggatgcactccataatgcaggccaagcataatttccatgatgactgagtcttctaacatatcagacactatagctgccttcaattttctagtctcattttcaaccctgtggtgagggatggggagggagaagtctgtatttctccatagtcagctgaggctacagcagctgtgaaagcaggatttgagggataattaacatgtagaattcatagaatcatgaccagttgaatgtgagagataagaattatgaaggaatcaaggacagtctcaaatttatggcttgatgatttaattaatgattatttcagtgatgaaaataaagaacacaaaatatatggtttgggtgagcaaaattattagttgagttatagacatgatgaaattaaaatattgcagcaaatctatgttgagatacacagatatcagaaacaaaatctggggaagaaaaatagatttttagagtcattgacatagagagctatagattgttgttgaaacagggtgatggattcagtaccaggaggtgaaacgacatgagagagagagagagagagagagagacagagacagagagagacagagagagagaaattaaaaaaggtaatccttgtggctcacacctgtaaacccagcactttgggaggtcaaggtgggcagatcacctcaggtcaagagttcgagaccagcctggccaacatggcgaaactccatctatactaaaaatgcaaaaagtagctaggcatggtggtgtgcacctgtaatcccagctactcaggaagcagaggcaggggagtcgcttgaaccccggaggcagagattgcaatgagccgagatcacgccactgcactccagcctggtcaacagagcaagactctgtctcaaaaaaaaaaaaaaaaagtaattccagtattcatgaatgtagacaaataaagaaatgcatccaaaaggaaatgctcagagtagtaataatctcaacaagaagatcatggtcaataggatcaaatactgaagactagtcaaataagacaaagaaataggggttcctaaattttggtacttatgcagatactaatgcctttaacagagaagttaaaggtagaaaacctacaacagtagcctgaaagtaacatgatgagaaaaaaatggatgatagagtagattatttgtaattgaacctaagtttatttcataggtacttattcttcattgagcgttgcactaaattatacactgtagttctttgtacctctctctttctctctgtcaaactctctctcttctattatacaactgggtatataggaaggaattttatgtatcctaaaatgtttaaagtgacatttatgcggtgaaaataagcttcactcttctgggtcaactgtgaaatagcataaaaagtccgaggttaaattagaagcaaagcattttctgtcaaacacagtttttactgaaaaaaaaaaagacttacataaaatatataactatgggtggctcatttagttgtatatggcagaattttttctgtcctctttccaaataactcgagtggtttcttcagtttgacaaatagttataaaaacaagtttgcagcataaaagaaaaggtggcaatcagctcctgcacaaaaactgattattaacttaaacaagtcatagaaactaatggtcaggattgcaattacagtcacaaagaccagaccacatctttatgtcagagggcatagagttcactcacattcaaggttcaatatgtttgaatacaaacacaagatgggtgattacacagaacccagtccatgaggtgacttcattcattaaccttggaaaatcctccattgaaattagacttttcttagtttatcgatgtttatgtgagataaactcaaggcaaacttgtatgacctcaaccatttcccttgtcactcaaggaaagggaattatttatttattaaattataaatgtatttataataattataaataaattgttataattttatttttaatttatattttatattgttataaataaattataacaatgaaaacattcacaatgctttaagaatggagtcttagccaggtgcagtgctcacccctacagccttaatactttgggaagccaaggctggaggatcacttgagaccaggatttgagaccagcctgggcaatatagtgagacccccatccatatgaatttttttaaaaaacttctctgtgaagttactaaaatcagcaaaaatgggttaatattctcctcaaagcagaaaaaaaaagatctccatagttcccaggtttttctttaagaacttttactatattgaaaggataaaagatctgtcattcctcagagcatatcacaaagttatcttccaaaaacaccctccacaccatcactacatggcataacttccctatcatgaagtagtaaagaatcaatcatagatattttcttaacattggataacacactgtttctcagggactgtctgcttaagggttttctaagacactatggcctcattgcctgaaaacaaccagttcctcactggctactctttaataacacaattttttattttcctttttccctccctcttcatttaattgatgtgcacaggagagcagataagggtgatgttcggctagtgatcaaaaaaatatttttgtcataaaaatcaacagaagcctctattctagcattttcaggtggtggtttcagagtctttcgggtaattggttttcttggactcagcaaaggcagacttgctttttctggggaagatatatttccagaggttagtgcttgtaaatctgctgttaggtgctggtatatttagtgactttggatctatggaatttgaacttgagaagtccttcctgtggcaaatttaaaaatagagcagcgttgcaacaaacataaccaaaaagaaagtgcttgcctttctgacagttcagcttgagtgcttccagagcagatagatacgtgactctcctgaatcaggcatttgagactttactgacgaaccttttaaataattatcaaaaggtcacttacatatgctgttagatagactaaccattgaaagcatgagaaaaactgctgattttaagtagtctgttgataggaactgctgtggatttaaagaaaagataaatgtcttctgtcacaatactgtcttattgtaaacaaattctatcctagctagagattcactgaacagaaaaggagcatttttagagacagttaatgtatcaggtttaactgattttcataatggtgtttttaaaaaattttccctagctttattattttatgattttctaacttatcagtatcatttgttcacacattaccatctatcttacctaacctgtagaacttccgttcaagtaatatggtgtatgttaaatgactattgttgtcatcattgctgttattgtcataattatattactcatagagttgtttaaaaccttgttgttcaaagtgtcatctgctgactaatacgacattggaaatgagtctcaatcatcaaggtttattagccagctatagtgtacatccggaaaaataggagccacagacacttttgtttttccaaagaggctttatgtgggtatttataaatttccttgaagtgggagagggcaggtagaaagaggggcaggtgagcaggaaggcaaatggctacattcccatgagacttgggttagtgcccagtaaatctacatttacataagattaatgaatgtttgaagagaaaaagagagtaaaggaagaagaaattatgcagatgtctctgggtaggtggaggaatgagtcttgacattgttctgcacctgggaagataagctcatactggtctttatcagtgtgaaatccaacagactttagttttaagagctagacttacattgtagccctgaagttacaattggcattcccttgtttatatgagaggccagcaaaaattttacttttgaatgatctatagggacagtccttttagatgcttgaggccttttaccttcccatggggatctggctaaagaataatgttagtgacagctattcatttggaagagggtgtggcaggacaggcttcattctcctttttgcataagaagtttagggttcctgagattttaaattttttcctttacaaaaaacatcagcatcacctgggagcttgttagacatgcagaatctcaggttctaccccagacctactgaatcagagcctgcattatagaagaaccccaggttattcataggcacattaaatatttaaaagtactaccttaaagggataaaattacttaggtaaaatacctataatagtcctggtcaatgtttgttaaatgttgtcttccctccctaactcagaaaatggattaactcattttctgtctatcttagaaagctgaccttcttttgtttgttatcaccaaacattatcatcataaataacaataataagaagaggtattacatccttactgttataaacattgggaatataagtacaagctatgatccctgaaatagaatatataatctatttaggatggcaggacattttatagaaagtacttaaatatgaggtatctatgtagaaaaactaattctctgtctatgaaaaatagcatcccaacaaaatgactagatagctggaacagtctcacttgaaatacaggcaatttgttgtacatgaaattcactttggaagtttctagtttagacgagttaacttctcagaaagttagatggttatctgtgagatgagcagaaactgagggacagtacaggaggaccacttggccactgattgagagagacttgccacatgtatctgctatcttggacagaaaagaaacaaaacagtttctgtaatgagtcaaaaactgaaagctcttagcctggatgtcctgaagtgcagaaataaagttgagccgttttttcatgtaaactgccataaacgtgagcataaaaagcagtatctttaggtcccctcccctcccctcccttcccttcccttcctctttctcttcctttctccctttcttcctttcttcctttcttcctttctagtacagagccaggcacctagtttaaggttatcagaaatttgggagagccagggttgggtctaggtgagggctgacaaaagaaccgctgcattccaagttctagtccatgaattgataagcctgtatctaccttttacagagctttcaagactgtatgaaattagatgttattccctctcaggctttatcttttaaaagggatggtcttcatgtgtgaattcttccaactcattatattccttaactttacgtaagtcttttccatatccactataaaaaaagtcaaagtatagcaatcagatctacatggaatatttgcggaatctgataacctgctttgagtttttttctctcaaaaagaaaaaaacctgttaataataatcaactattttagcccatttgtctgcatcaatttggtgatttcaatggagaatctacagggatgctcaggtgcctccttattgttatcccctgttcaaatctcatcattgtataggtgtggcttcaattattttctcttaagccaacattgtatttataccaaaggaatctgacttgtttcatttctgctcagtcttccagagctctaaatacttcctcaaatttaattacatcaatttggcatctccctggtgttttcattctgcactttctcttctggatcatttgcaagaatattcgtgtattagaaactcaacaattttttttctgtcaagtaaagtcctgattagccttccattgcttcccttcatctgagctacttccatatatgattaaaatctttctcagtataagaagtaaagttcctatattgaatgcatttctcaccaattcctttactaatctattaaaggattttaatgtattgttaggtaaaatgttctacagaaatcatccaagcttttctctataatgcatgtttctttagatattgtatgatactaaaacttgaaagtggtctggtcttgacattctacaaagtcaaaatttattttttctaatagataaactcttagattgtgaaacatgcacttaccccaagagagaagtctcctcattcttccccttactactcagtggattctaactttacaacacgtaagagatttatactattaaatagctgttaaagactaatttaagaaacttccatatgtctgtaaagtgtttttgcaatgcgtatttaaaacttgaaatttgcataaactaaagagcttttgcacagcaaaagaaactaccatcagagtgaacaggcaacctacaaaatgggagaaaatttttgcaatctgcttatctgacaaagagctaatatccagaatccacaaagagctcaaacaaatttacaagaaaaaaacaaacaaccccatcaaaaaatgggcaaaggacatgaacagacacttctcaaaagaagacatttatgcagccaaaagacacatgaaaaaatgctcatcatcactggccatgagagaaatgcaaatcaaaaccacaatgagataccatctcacaccagttagaatggcaatcattaaaaaatcaggaaacaacaggtgctggagaggatgtggagaaataggaacacttttacactgttggtgggactgtaaactagttcaaccattgtggaagacagtgtggtgattcctcaggggtctagaactagaaataccatttgacccagccatcccattactgggtatatacccaaaggaatataaatcatgctgctgtaaagacgcatccacacatatgtttattgtggcactactcacaatagcaaagacttggaaccaacccaaatgtccaacaatgatagactggattaagaaaatgtggcacatatacaccatggaatacaatgcagccataaaaatgatgagttcatgtcctttgtatggacatggatgaagctggaaaccatcattctcagcaaactatcacaaggacaaaaaaccaaacaccgcatgttctcactcataggtgggaattgaacaatgagaacacttggacacaggaaggggaacatcacacatcagggcctgttgtggggttgggggaggggggagggatagcattaggagatatacctaatgtaaatgatgagttaatgggtgcagcacaccaacatggcacatgtatacatatgtaacaagcctgcacgttgtgcacatgtaccctagaacttaaagtataataaaaatatatacattaaaaaaataaaataaaacttgaaatttgcagactttaaaatagaaattctacttttagaaatgtattctaatgaaataactaaggtaaacattgaaatttagcttaaaaaggctacagtattttttaataaataaacaccatatagtaaattaccaaaatgtatatccactaagtaagttagagtgcagaattttgtttgtttgtttgttttttcttgctgtgctgcccaggctagagttcaatggcgcaatctcggctcactgcaatcaatccctgcctcccaggttcaagcaattctcctgtctcagcctcccgagtagctgggattacaggtctctgccactgagcccggctaatttttgtatttttagaagagacaggtttcaccatcttggccaggctggtctcaaactcctgacctcgtgatccacccacctcagcctcccaaagtgctgggattacaggcgtgagctactgcacccgcccagaatgcaggtttttaataaaatgctatgcagccatgaaaaattacattaaacaatatttaataacatggaaaggggtttaagttattttaagtgaagaaaaaaataaattaaaaatatatgtgatacattttatagagacaactacctacacagaagaagctgaaaggttatacaccaaatattattcatcatgatttctggtagagaaattacaagaaatttctactttaaaatttttgtattttttaatgaattacatttctaaagatagtagaaaaaatgaagctctcttagagctgattcaaaatctttcctattagaacctctgttcatctctgaatcttatttcaattataaggaaagctgtgaatagcttgtaacaacatccaattcaccattgtgagttaattttttaaagtttcttctcccactgtatatggtgaaataggtgaatgtattaaaattgctaaattttgctttttctgaatttagctaatccttcttgagatgtgtgtgtgtgtatatatatatatatatatatatatatatatatatatatatatttgttcttcagcatttttctttattttattctatctccttttgagctaaatggatgacctatctgccagctccattagtaattttatttactgcttcagcctttgaaacaagttaatgcagaagattgaatagtattttagaatttacttcacacagtaatgtgactcaaggcttcattggctattatgtcccctttggcattaaatattttaatctgctaactatgacagatacaggatggccaatttcccagtaaatgtattagcctcctagtaaattaccctttcccaccttataccatgcagcctattaacctataaaatcccttctcttccaatataggcaagatgtcttaactgaagacttaatgttgaacacatcctaaagcttgagaagaccttatttcagagggttgggaaaggaaaactaatcattgcaagcaaactttaagttgctgagactacagatgtcactttggttcatttcctattaccatcgtttgatgaggatatagcccaaaaaccaagctagatgagtattttaataaatgtggactgagattgctttaacagaaaatataagaaatttctgtgtttttagtaatatatcctaggttcaaattaataaatctcttgattattctgtgccttaaacttgtatgaccatctagtcgtaccatttgagcaaataagttaccacctcaggaaaaatgaagtcagcactcaatttatatctataggataattgtgttttgttttgcttttatcttaagcccacactctagtaaacaaaagctatcagaagaaagctttgtaaaatattacagattgtgttgttaaataatactaagaactttcttgcatttcatggaaaagataatgcatattgtgtacttttcattattttaaatgtgtctaggaccaaataaaccaacggtgttctctgtccttctactggtttgggaaaagatttatgtaacaaaccattatcttctagttagaaatcatgaaagatgaggactgttgttcctgtaattaatcaccctatagtagaactctctcacagtgacttaacaaaatacacttatgtatgaatcttaaatatgcagaaggaatactaaagttgaacgggtaggatattttatcttcttttaagctttcatatggttaaataaaacaaaaattaaaagtctataaaacagaatgtatagctttacaaataattataaccaatacccaagttgtggaaaagaatattatcataaattacacacccttatatgctaatttttctttttaatgttaccgcataaacgtccctttctaaacagtataattttatttctttctgaaatttacaaaaacagcagctttatttcttgcttattttagtcaatactacacttgtgagattcatccagattgctatatgtacctataaatcatttattttgttgttccttttttcattatataaatataacacaaatccattctactgtcaaacatttggattgcttctaggaaattacaattaatgctgctattaatattttctcattcctatatgcatcagtgtcttcagattatgtgtctgggagtggaatggttgggtcacagagtgtattaacttttcatttcagaagacaatgctaaacatgtttctaaggtgtccatactgatgtagtctcccagcaacatatgagtatttttgatatttcacatcttcaccacttgatattgtcaatcttttaaattatagccattctggagagaatacagttgtgttttttattcggagttaccaataactaaagagattattctgttttctatatgttcattagatatttgggttttgtcatttgttattagtatatttaagtcacttgcccattcccaagtggttagcttctgtctttgtatattttgtatatctatatctacaaacatatacgtatgttttatctacataaaattatgtatgtacattatatattatatatttaaatataatatatttatcttctggatataaactcattgtcagttaagtattttgcaaatatatttttccatgtgaaggcttatactttcactctcttatggatgtattttgataaacacaggtccttagttttcatgcagtataattatctcctgtttatttttatgtttactactcttatttcctattaaaactttttcatatcccaagcttatgaagatattctacactatcttctaaaaacatatgtttttgctttcacttttaagttactaatccacatggaattggtttacatgaaagatatgagggagaactcaaatttcatttactttcacatgcatgtaattgtcacagcatcatttactgaaaagaatatattttccccacttttgtagcatcaaatcatcatcataataatcataataataaatgtatatttctgtatttttattccatttgtttatccttgattcagtacaacatggttggatcagtctgttttcatactggtataaataactgcccaagactgggtaatttataaaggaaagaggtttaattgactcactgtttagcatggttggggaagcctcgagaaacttacaaatatggtggaaggtgaaggggaagcaaggcaccttcttcacaaggcatcaggcggtagatgtgagtaagtgaaagcaggggaaatgccagatgcttataaaaccatcagatcttgtgaaatcactcactatcatgaggacagcatgggggaagccaccctcatgatacaattacctctacctggtcccactcttgacacgtggaaattatggggatcatggggattacaattcaacatgagattttgggtggggacacagccaaaccatagtcatggtcttaattactttatttttatcagatttgatatgtcccatggagtaattccttccatgttacactttgtttctgtcagagtagattatactgcaataacaaagaattttaaattgcagtgacttataacaacagagctttttgttttgtttttcttgctctctctagttgtccattttgggttgtctggagaatatacttgatttcttctaattctggagcccacactgattgaacagctactctcttgcacatattgctaattaccttagcagaaggaagtagatagagtgtggtgaattattaattggctcttaaatcttctagccaggagtcacaaatgtcactttcacatttcattaacaaaacacgtcacacgaccactcatcacctcaaccaagaggagaaaataaaatattggatagacagcactaatgattaacctaatcttttaaatgagtatataacttattcttgttcctttgatttttctttctttcttttttttttttttgagatagagtctgctctgttgcccaggctggagtccagtggcccattcttggctcactgcaagctccacctcccgggttgatgccattctcctgcctcagcctcccaagtagctgggactacaggcgcccgccaccacgcccagttaattttttgtatttttagtagagacggggtttcaccatgttagccaggatggtctcgatctcctgacctcgtaatccaccctcctcggcctcccaaagtgctgggattacaggcatgagccactgcacccagcctgatttttctatatgaaacttcttattaatttgtgaagttcataaataaatattttaaagattttggttggtattgcattaaatttataggtcagcctaaggttatttgcaagctttaaaatatttggtcttacaatccataaacatgaccatagttagattgagaaatacagatatagatttcggtcttcacacatgtttctttcaattatgatttttggttttctgcatacaggtcttgcataactttttgttacatcatttcttagtatctgatttttttttttttttaagatggagtttcactcttgttgctcaggctggagtgcaatggtgcaatcttggctcaccacaacctccacctcctaggttcaagtgattctcctgcctcagcctccccagtagttgggattacaggcatgtgccaccatgtccggctcccattttgtatttttagtagagatggggtttctccatgttggtcaggctggtctcaaactccgaacctcaggtgatccgtccacctcggcctcccaaagtgctgggattacaggtgtgagacaccgtgcctggctgtatttgatatttttgatattattgaatatattatattttataaaacttcattgcttatatcttttttctagtacatagaattgcaattgattttttaaaatactgacactgtatccagaaactggctaactcacttattaagtattataatttgtctttgcattgtattttctctacattaaattatttccaattcttcctctttctgttctttttctcatatttcatcctcaattagaatctctaggacaatagaaaagtgtgattgtaaacatctttattttatttccaattccaaaggaaagctttcaagtatcattattccattagatgttatagatttttttgtcagatgtcatttatcagctgtgaacattttccattgattcctaattggctaaaattctgattttgtcagatatttttctgcatgtattcaagtgatcatccaatattttagtattttgtaaattcatatgtttaattaaatcaattaaaaatcaattacaacaattgatttttgagtcttacagcaactttgcacttcctgaaaaatatgtatctttcttataatacatttttaaatgtttctagttggtcataacatattatccttttatatactattggatttttttgctaatatttattaaggatttttttgcattcatattcacgaagaatatttctctgtaatttttataatggaaaggttttgctattaaaattattctggcttaaaatatgacttgcctttctccatttttttttttttttttttttttgtttgagacggagtcttgctctgttgcccagcctggagcacagtggcgcaatctccgctcactgcaagctccggttcccgggttgacgccattctcctacctcagcctcccaagtaggtgggactacagtacaggcgcccgccaccacgcccagctaattttttgtattttttagtagagatagggtttcaccttgttagccaggatgctctccatctcctgacctcgtgatctgcccgcctctgtctccaccaaagtgctgggattacaggcgtgagccaccacgcccggccgcctttcttctttgaatgtctaattgaattaaccagtgaaatcatcaccactatgagattttttgtaataaccccttttctatttctgatattgattatcgtttttattattgatctgaatagttagaattttgtcagttttgttggtctcttcaaagtgagctgttccctttctcatctgttttctatttcattgatttctacttttgtcttcactgttttcttttacctgcttacttgctcacttactttcaccttgttaaggtgaaatcttaggactttagttttagattgttctccttttcttatataagcatttaaagctatgaatttgctgctaagcattaccttagcttttcctacaaattgtaatattttatattttccatgtcattcagtttgaaacattttctaattatcttgtaattttgttttaattcatgaattatttagaagtgtgctgtttaatttatagatattgggtgttttcttagatatctactttgatttctactttaattatgttgtggtcagagtgcacacctcgtatgattcttttttaatttattgagacttatttatggcctggcataggatctaatttggtttatgcactatgcacatgtgcaagaatgtatattttccagttgcatatactactctattatactaataagataaagacgtatctttaatgtcttcattgatttttgtctaaatgttctatttattgctgacgtagaggtgttaaatttactacaattatgaaattgtctatctcttaaattctatcaatttatgctccataaattgaggcctattatcaggcacatatacctttataaatgttatgtcttcctgatgaatgcctattttatcatgataaaatttttacaatctctcattatacacattgtcttgaagtctactttaactgataaactatcccctcaattctttttatgtttacagattccatgatatatcattttctttttacttaccttcagtctgtctttatagatctgtatctttatacttgaagtagcttagagtaaaatcttattttattttatccactttggcattctctatcctttaattggaatgcttaggcaagggatatgcaaaataggctcacaggccagccacctaatttagcaaaaatcgttttaaattggacacaaccgtgaccattcatttacatattttctatgactgctttcatgcaaaggtgattagctgagacagacaccatatggcctgcaagatgaaaatatttactctttggccctctaagagaaagtttgccaactgctagtttacatcattagcactcactgtaattactgatgtggataattttagatctaccgttttattattattttgttgttcctctattcccacttctttgttttctttttgattatttgaatatttttattatctcattgtaatttctgtctactggctgacttttttttaatctgttgattttctgcttataaatctctgatttttttttcagtttgttctagagattacaatatgcatatctaagctgtcatggtttactaagagttaatattgtattagttaatataaaacgtagaaatgctgctactttataaatccttttgccccattgaattttaggttatactttattgcttttatatacattgaaaaccccaccagataattattttttctttattaagtgaatttaaagagaaaaataactgttttctgcaattactctaatatttaccctttccaattgttctcaagacatgacggaaggtccagatatcactttggcatcattccctttcctttagccttttgttagccaatgttcggggcagatctggaaggtaataatttttctcaatttttattttacctcccttcctgaatgatatttttagtggatataaaattacggcttgacagttctattctttaaaatgttgtttccctgtcttctgaccttcattttttctgatgagacattctcatcagaaaaatcttattcaaatcactgcattcctgtaagtaatatacgtatcagtttcctctagctgttttgaaggtttttcttcatcttagagttttaggggtttatgatgtgtctatggttttctttggttatactgtttggggtttgctgagcttcttgatgctataaacttaagacttccatcaattcaaaaaaatttaagaccactgtttcctcaacttctgctccagtcactctcttgtttcttgtattgttacattagtaattccttttgatattgtcttataaattatcaaatttggaattacgtcttgtgtgtgtttgataaaatactttgtaacatgtggatcttgtaatactctgaagaatgttgatatttttattttagtaggcatttaactcaagttccgtttgtaagttctgttttaccttctgagaatgatagggattaaatttcagtttagctctcagtaggtttgatgtactgttttggagctgtccgtacatgcatagctcatggtgatcctgaaaattgtacaggttcattcacgggattagggaatcttttcttttccttttttttttttttttttttttctgagacagagtctcgctctgtcgcccaggctggagtgcagtggcgctgatcttggctcactgcaacctctgcctcctgggttcaagctgttctcctgcctcagccttccaagcagctgggattacaggcgtgtgccaccacgcccggctaattttttgtatttttaggagagacggggtttcatcgtgttagccacgacggtctccatctcctgacctcttgatccacccgccttggcctcccaaggtgctgggattataggcatgagccaccactcttggccgggattagggaatcttcttatcagactttctctatgctgggatttcccctcactctccagccttctggagcttttctttttggttctctagacagaaacatgagagttgtattggagttttagccaaagagaccattaccaccatctatatgatgctttacaactgggcccactttggggagcaatccacaggagagcatttcaaacacacacatgcacacaacaggaaaatcaaccctgtaaaattgcttctccaagtctgtactctcctccaaagttgacatgctttttctgcttttccaattaaagtcaggtagtcatttttgcattttgtcagcatattcagttctgatccatgagacatatggtctctagtgagcttacatcaccatgccaaaactaaaactgctattttctaatggttctagactccgatattttgtatttttttctagggattttgtatatgtgtttatttcagaggttggagtataatttttctttttgaaaggactctttaggtgcactaaaattttttatatatctctgaaaaattaaacctttatctttatgaagtgactatttctagcctcattatttttttccttgaagtctatcttctctgatattaatatagcttctctgggcacattttcctttttttccgtttagcctattttctttgatatttgttaaaaaaaattctgttcaaaaatctattttctctgatagttgataagtattttaaaaatatgctgagtgatttttttgcactaaaatcaattttctttgacattaatatgtttttatgcatgaagtctattttctctgatattggttatttattcatttattttgctgccttaaattctattttctctatactagcagtatactggtatttaatatgcttaatatttgcatggtatatattttgtaatccttttatcttgaaaattctttatcctcatgttttaaatatagtttttaagtagtatggtttttatcttttaaaaaatgagtctgacaaactttgctatatgactcattttttaatacatttatatttggtggaattactggcatggctgaattcaaatttaacatgttggcatacactttatactctatatttgtcctaccaaatatatgtttattttattttttgcttccttttggttgatcattgttattgttgtacattgttttccacagtaagtttggaaatgaagcatatctttttttttttcagtgattaccctagaagtgacaacatgaattattcaccaagatctaatgatgaacaatacttttctttttttttttttttttttttttttttgaggcggagtcttgctctgtcacccaggctggagtgcagtggcgcccatcttggctcactgcaacctctgcctcctgggttcacaccattctcctgcttcagcctcccgagtacctgggactacaggtgaccgccaccacacccggctaattttttgtatttttagtagagacagggtttcaccttgtgagccaggatggtgtcaatctcctgacctcgtgatccacctgcctcagcctcccaaagtgctgggattacaggcgtgagccactgcgcccggccatgatgaataatacttttactctccttttgaacaataaaaggtccttcaatcaattaatcctatgttttgccaagctgaattataggctatttttgtcatatattttattcaagttataatttaaatttggcaaaacattattattattttattgtgtcactgctcatttacctactttttgttactcctcatttttttcccacacagagtcatttttcttctgtctgaaaacacttcacaattttcctttgtgcttgtctcctggtggtgagttttcttattttctttctgaaactgttagtcctccatctggaagaatattttcttgagatatgtaaatataaattggaaattattttctttcaacagattgaatatattataaaacatagttcagcttcccattgtttttgttaataagtagttgccttttttcccctgaatacagatattttatctttgatttagctttatacagtatatcagtgatatgtcaaaatagggatacatttttatttatccaccttgaaatttttttagactctttaaatctattatctactatcagtgtggggtaaatcttagtcataatttttaaaaaaaataattctttttgcctaattctctctgttctccttctagagattccaatggcaaatatgccagaacttctcctatttttaatagctgttactctttcttttgcattccagtcctttgtatctttgcattttttttctggagaataccatgcagcctatttcccagtcctctgtttacctgtatataatattctatttagcccattcactgagttatcattttcagctatttttacccttctaggatttctatttggtccttttaaaaaatgtagtaaatgtagtatatcactttctataaattacagtttccatattttgtctttttatctcattaacagaataagtataggcttcttccttctttcttcattgtttccttcctgtcttcctcctttcttcatttttttcagtctctcactgacactgttaatatctggtgtccctgttcttctactttttggttattttttctctgctattttttgttcctatgaatttagttttactgcatacttggctctctgattatatgttggatattagttaaataacaattgtagaaataatttcagatctgggatgataattccatttaagggattttcatggtgttctgggcattattaacacatgactgtcttagtccaagttcagggtgtggaaattttcatgatttctcaaatgacttgaaaaggggttctagtcagcgtagtctggtttcattttgcttcacttttattcttacatgtagttcttcaaggtcccagccaaaaaacaaaacaaaacaaagttgtggtgatcttccctttggcagttccttgtttagacttttgcttcaaattcttgagatgttgccaaaagttctgttcatcctctcaactgcttcttccagaactgcaaatgccattagattaaggttgctaaatgttaaaaaaacagaatgcccagttacgtttacacttaagataaaccttaaataagtgtaagtatgagaatgtcccatgcaatatttgggacatacttaatacttaaaaataatcactgttacatgaaattcaagtgtaactgtgcattccgtattttatctggtacctcaggccaaaagtgaccaaaatgactggactacctcctgatttccattttaacctagatcttagcccaggcccgcttcactgttcggttagcattttgatgcttttaaggtgatattttaagcaatattttttccagctattttagttctcttcatgagaagtttagtccaaattacctagtccaccatcaacataatcaaaaggctaatattccattttcttggtggctttaacatcaaatataccaaaaattacatcaagaagcttaaagatagctccctgacactgaccctggaaataacttttggacagtacagcaaacaagagcacaaataaacaagtggaactatatcaaactaaatagcttctgcacagaaataaaaaagagcaataaaatgaaaatgcaacctatgaaagaaaaatatttgcaaactaggcatctgataaggggctaatatccaaaatatacaaggaattcacgtaactcacagcaaaaataaaaaacaaacaaaagcaaaagcataagcaaccaaatagacattttcccaaaaaggcataaaagtggccaccaggtgtatggaaaggtgctcaacgacactgataatcagggagatgcaaatcagaaccacaatgagatgatatctcacacctgtaaggatgaatattatacaaaaaatgaaagattataagtgttggcaagggtgagcagaaaagtgagcccttccacactgttaatgggaatggaaatcagtatagccattatggaaaagaatatggaagttcatcaaaaaattaaaaatagaactaccatatgatccggtaatccctcttttggtatatatccaaagaaattgaaatcagtatcgcgaagagatttctgtacccctatgtttattgcaactttattcacaacagccaagatatggaaacaacctatgtatctgtgaatgcatataaggaaattatgatatatgtgtacatatatcatatatatatacacacagtgaaatatttagccttaataaaggagcttctgctattttcaacaacatgaatgaacttggaggacattaagctgagtgaatgaagacatatacagaaagcaaaatactgcatgatccacttatatgtgaaatacaaaaatgtcaaatacatagaagccaaagagtagaaagctggttatcaggggcagaaaggtgggggaaatagaggaacattggtcaaagggtacaaagttgcagttatataagatgaataggtctagcgatctaactttcagcatgatgactataattaataatactcttttataccaaaaatttctgagagaatagatttcaggtgctcccagcaggaaaaccaatggtaactatctgaagagaaagatctgttaattcacttgactgtagtaatcaattcattatgtatatcaaaatatcatgctgtacaccttaaatatatacaattttattaaaaagtaaaaaagtgttagcatttaaaataatacaactgcaattttttttcattttcatagtcatatctttgtggctactaggtgcttattaagcattgctttcatgacttgctcaattcagaactaagcatctgaaagaacatacattctctattttttgttgaattgaacaacgtgctttatatgtgtgcatattgggaaaaggcacatatgctacaaaatggggaaaaacaatatccatcattatttctagcatatcaattttctataagttctctgaaatacaggtgacaccataaacaaggcccaataaagttgttgactaaatgactactataaataaatgaccattatcaatttcccatgtatcattcacacaggtgatgataatggtgtcatcattaactattccatacatgctctgatatgataacacaaaaattggtatataccatgttcagtctctggtcaaaaacattgtgaatatattaagcatgcttcagtgagggtttgttaaaatgatgacaaagacagaataatgagtgaattttaccatttccaagggaattttctgcaacggtaggatttttgtttctctcaatatcccatctgattgatcacaatgtctaagtgaagtaacagacaggacttcgtcatttctggctgctcacacataagtatactcccacaactggagttcctatatttatctccttacttggttttcagaattgttgagctcctccttttcctgattatgcatgaaatgttcttagtctttctttttcataagacactaagccttacaatattctgattatctgattctgattaaaaatattttttacatcacttttttcctgttaccaattttgagttggttttatatgtttcatttatttctggtgattaaattcttgtagaaatagtcattagatataacagttcactagtaattgagtctgtggaggtatttccagtatatatatttaaaataattatgaccttcaaggacaatcatactccttacccttgaaaatgacatggtcagtgatactggaatgccagagaactgtgaatagaaggtgtaaaatgagagaataagcactggggaaaactgggatatggataagcacatgccatcatttggaaaaggctgcaggtacatttggacaaagcagctaggtttctgggcttgacctcccagatcctgctgtcagacatgaagccttcagttatgcttgtaagagccatctctccggttgccaactccaatcttttacaaaaagctgaagcacttctactttctatatgaataatggttttaatttaaatgtctttctttcctactcttgccaagattttgttcatattatcattttcttttggggaaatggcaaaaaataacttatactctttaaagaggtatattgggtattggaaatctttgacacttttctgggattcactgatggcctgcaggactctagatgaaaaatttaagtagtacttttgtcttataataactaggtatcacatattgcataaattcctacatggaaataaaggccaaaatgccctgatattgatggtttctacttcattatttttcacaccttgtgggtgtgcacaagtatgtttgtgtgtactgatttgtgtctatttcattattggaataagatagataaatattttaaatatatgacaaattcatcaatgtttatggtacacctgtcagcaagagtctgaaaaggagttgaaactgctgtgggggaaatgactggttatgactaaaacctctttcagggtagagaaaacatccaatttcacattcacagttttaattagtatctattcaaatctcactaaataattctatcagtctctcttggagctgctgatccaaatccaaatgtctttttatatttcaccctaattttagaaaagtcactaaaaaacaacatggtcttcactcttcacatctgttccataaatcagtaaatggcatcatcatctacctatgtgagcaaaactaaggattcatctgtgacaactccttttccttcaggttcttatatccaacccaaatatctctcatatctatgttcatttttcctttgcaccagaacctccctacaaatattagttattacctatacaaatcatctccttctagctattcttcttctccttgcagccaatcagacccttctccactctgtttctattctgcagtgactctgatacttttaacacaaatctggtcttgctccctttcttaaaaataaggacaaaaggacttgacatggctacaaggccaggcatgatctggtttttacccacccctcccaccctaacctacaccatttttttcctcacttgttctcaatgaggcacaatattgcctccttccagaggacattttgcaatgttgcagcttttttaaattgtatcaactctgggttgggtatttgcctttagcatctagtgagcagaggtcagggatgctgctaaacatcctacaatacacaggaacaccccccacacccacctccaattagcagctgagattctgcttcatggagaatttggtgtacaacattgagtttctttcagtttcttatgccaccatgcaccccccgctcgggtatcacgacagacttttatacatgctcatctctgggtctgaaatgttctttcctcatttactgggttagcatgtactcatcttttagaacacagtttaaaccaccaattcctcagtgatcctcttctaccctcttgaccaaatgaacatctctccatcccacgccacccccttttaagctcttataatactacatagtaattcatttttagtgtttctcttatgcaattttactttcactgaaataatatttgggaagtgtctgtctccacttctacatcataatctatttctgttcatcattgtatcctagtgcttaatctgacgctcaacacacaataggcacgaaataaagacaagtgggaagaatggagagaggacgggattgcatgactcacagggatttctcagaaatggtggttagagaaaaaagccataatatgcttttcatctttgttaaaagtgtaaactcaacaatgagaattactccttaatatttctactttttattaagctggtcataataaaaactccttgtgttccatcttctaagcaaaacacagcaggaagattttgggttttgtagtcagattattcaggttttgaatttggagatagaaacgtgagcgaattttataactttttgagtcttggttttcttatctgtaaaacagtaacctacctcatggcactgttgtcataattgaattgcctacaaagcacttgattcataatagttgtacaataaatactttagtagctattattccactgataccaaagctaaacgagtaagaaaatttgtctctgtatcttgcaatgtatggttattgcagaaggtgttgcaacacaggtatcaagagttcacagctacaccattgctattgttttatcatgacttttttgtacttttatcatttgggaatctacagctttatgtcctagcctatttgcaaagctaaatggatattagtttatgaattcattattccaaaaacttcattatattctcggtcttgatctataatggagtgtggtatgaactgaatgtgtcctccaaaattcatacgttgaagtctaatccctaatgtgatagtatttggaggtggggcctttgaaagggcatgaggttggagccctcataaataggattcatgcgtctataaaaaaagaaatgagagagcttgcctgctctctctctctctccctctctctctgactctcttttctcggccatgtgagaaactagcaagagcacagccatttgtaaaccagtaagtggaccctcttgagacattggatctaccaacaccttgatcttaaacttcccagcctgtagaactgtgggaaataaatttttgttgtttaagccagccagcctaaggtaatttgttacaacagcccaaactaagacaaggtgactctttaaaaaaataaaaataaaaactttaaactcaagaaaaagaaaataccagtaacatcactacaagttaaacattaacaagttataaaacagagttttacaggaattttatctttttatctaaaatcaagaggagtagaatcctgaaatttatcaatgtacttcatctttaaaattctttttgttcctttgacatacaatgcacaaatgtactgagagggcaagacaatgggcaaacatactggaaaaactgtatttgtgaatttgttacatctaacaattattattaaatgtttaccgtgtgccagacactatacttagtaccttacatatattgtcttaattaatgctcacaggaaagacatatcacaggactatttctcacatttttatcggatacattaataaacttgcccaacatcacttggctagtacacaataaaaccaagttctatgtaaagtgattgggtaagaaggatctaaccaggggaataaaggagaattacagtttgcaaagatgagaccagggttggatgatactcagtatcacaagagaggaagttaaaggactctgatgagaggagacattcaaaacaggaagcaaggagattgtggacctggatgaacagactaaataagcaaaggaaaatgctgcagggctttaaaaactttacctaatggaaacttttgagaaatctttagcatgagagtgaccataggatttatgagaatagggatttttacacccatttttttgttgtttgcatgatctcaaatttcacattatcctacatgatttgaattgctctatattgtcaataacctttagtcaggttggcaatatacatcgtgacgatggtttgtgagggggagatcaaagataagggatcgagtaccacatatgagatggctcagagaagagagaagataacaggtgagaggtaacagctaagtatgattagaagttcaatgaatagaactaggagtcagaaattactatgaaaacctaaggcctggagttttgtaaaaatttatacacacgtgcatacatattagcaaagacataggacattgtgcatctcacagaatgttggtgctagaacaggtcaattttactgaaatctcattgttcaaggaaaacttcagctaacagcttgactttgttttcatatataaggtaactgacaaatttctcttatttacattctctttaatccttattttaatcatataaatgtaaacattattaccctcatttcaaaaagaagaaactgagctcagataggttaagccaactggctgatgttcacacacctaagcagatagcccagctgagatttctaactcccaagtccagctttacttttccagcagcacgtttatctcctttaagtaatgctaagtcctcctctatcctttactctttgagagcctataatacaatcatgtgaggaaaattttaaaagaaagccaccaaaagcacaagcaattttactatcctcgattactcaatatttaagactacattaagtgatgtcaggtagataagagccttgcccagtggtctgagcatagaatatactcagttttatttttgtggttgtcattggattatgctaatatgtacagatcaaaggtaattttaggatctcttttagtttattgattgtaaaatagtctaataactatatttattattttataaaataatacttttaagtatataaatattttgttctaagaagtttgaagcatttcactggaaatatctttatactatttgttcaataaaaccaattacagttcatcctaactccaacatagcataactcctattaatgatcacttttattgcatttcaggaacattaaaataatttttcgtgaaaatatgtaatataagcctgacccacacattttaagggaggatggcttcatgaatacatcatcaattcctattgctttttatgtgtcagtgtagaactgtcactgccaaagaacagcaggtgaccacatagcactcaacttcccttagtgttctatagactgtagtatctttgtaattgcaaagttaataattatattaaataatgcagtatagaataaccactgcttttttctttcaaatctctatcattagtaaatatcagtcatacatacattagtcaccacagctgtttcagattggagcactgttttacaaaaagagaaacaaatcaaatgaaatagccatttctcctttattttgcaaattacagaagaattaaaagtaattctttttatcaaagacttctttttctctatgaatacaggcataccaaatcctgatttggttttctttgctgaaaatatgctgtcattttgcaattcacttaaaaagattaaaagaaaaagttgttccattacagaaaaaaagattttttaaagatataattacataatctctttgctagttgtttcatatgagaaagaaaaataaatcttggggcccccaaaatcactaaaccaaagagaaaagtcaagctgggaaccatgttgggcaaaccctcctccgattctattcctacataagatagttacaaagataaaaggtctacatacccccctcacaatttgcccacaaggaaattccttgtggacaaaggacagacagaactaagtcatccctctgctcaaatgagacaaatgcacatctgattgcttcctttgccctattgtttcacgaagccagactaagacataagtgactattccaataaattgtgtattcagtgaaaggataatcagaaactcaaaagaatgtctcttatctacctatgacatggaagccacctccccactttgagttatcccgcttttccagaccaaaccaatgtacatcttatatatattgattgatgtctcatgtctcccgaaaatgtataaaaccaagctgtacctccaccaccttgggcacatgttgtcaggacctcctgaggctgtgtcaagggcacctccttaaccttggcaaaacaaactttctccattgactgagacctgtcgcagatattttgggttcacaatactctcctttataggaataatcgatacagttttatgcgcttataataaggaaaagacttcgccaaaagttgtctacttggtgctatgttcatatttccagaactgaaaagcagagttaaataatgagcaaagtccttattgctgtgcctgtgacatactacagatcttgcctctagccaggacccataatgagcagatgtacaatggccagactaccaggaaaggcttcagtgtcatacaggtttcagcagggctatggtctagatggctactcttccctgtttacctcatgggcccgcttcatccagattacaattctcttcccctagcttctccaagcctctctgcaaatagaaagtgatgatgccattgggatttgattgccccattgcttaactactggttggcaaataaggagtgctagatcatttgttaagtgagtcgacaagtgagtcacatgtgaatgctgaggtcttctctttctgattttgaggggacttgaaaagcacggactctttcattctcagtaacctacttatgctatcatatcctgacaaagttaccaaaagtgccttttccttgaaggacataaaaggtgaggaagggacaaggaagagaactaacatataatactgagcttgaattatttgagctaggcaatttatggatgctaattattcgacgtttacaataaattagtgggggaagggttatttgtattttattttttcaagtgaaagaaatgagttgctcttcagttaaggcacttgctcaagtcataaagctagtaaaagtcagaaatagcattagaacctatgtatctttggctatttccactgggcagctctgcctttcgtatgcatatacaggaacgaaaaataccattctaccttccttccctttgggaaaatgcattccaagtttcaaattactgagtcataaaacaataattgaaatatttcacttccttataccaggagcttcttggagtaatgacattgtaaaaaagaaagacacaatctgtaaatatttattatctaaagccaataaaattgacagcacctataaaacaatcacttcaccaatttgttgttaggtactacttgatccaatggagatactgagtttttactgttctagcaccattttacgttctgggaatacaaaggatacataagagatggagagagaaataagtaaaatgtgtaggtaacaatgagacagatgtcaagtaatagctaatttatataaaatgatgtgggaactgagagatgagggccatggggctcaagaagagaggccattagcaatgtcagggaagctgcacttagaagtaatacgtgagacggatcttaattaatattccataaagggaaggataggggaaatataattaaacagacttttaccgaacatcaaatgaagtagggaaaacctgaggcagagggtgaggaaaactcacagcaggttgaaggatggcaggttgcctgctgcagctagcatggagtcgcgcctgaggttgctgcaattcattctccagatctctgttttagcgacataaactcaggaaagtttttcagagccccaagaatatgtcaggtctctcaggtataggctttccgagctctgagctccttcctctcattgcactgatctctccttgtgaataaacattttcattatttgattgtttgctccctctcccacatgggcagaaaacattaggagaaaaggagatctatctggtgttgcttttcattatatcccagcacctagtattgtatctgacatattagcagccactgaaaagaaaaaaaggaaatgaggtaaataaatgttgaaagaaatcctgaggtcaggacgagtaggttgaaaccagaacgctaacggattcatagacattgttctgtggagagtgggaaacactaaattttatttattgactttcagtgggaggaaaacataatcggggctgtttttaaaagttagctttggctgcaatgtggaggactggtaactaagagtagagcctgcaggcattaaatgaatgtttcagtattctctccaagagataatgaagtcccaaaatggaacagtgataggacttggagaaatgaagaaagacacgagttgcacatattcaaatgcccaggatttggtgactgatgggggagtggcaaagagaggaatcagggatgattatcactagtgtcctagatcatgacaataaatataaaactgcttgaaatttaaagaagagaaactggttcttctcaacaggaacattttgatggtaagtctgtgcccagattgaaatgcagcttagcttacataattgaaataatcacgtctgaagtattcaaacaattcaaaatcaaacgcaaaagcaattttcatgaattgagtgggcgtatttatttttgagttgaatgaaaatgtttttgactagttgacacatggtaagaaaaataataacagaaccaagtatatgcagtacaatgtgaatctccttcccatcgctgtctccttgtcctcttcatgctccaagaggcaacccctgctactaggttcctgtgactcctgagtaggagtctggctaatcatccaaaaatgtcaaaagagaaaccaaggtgaatttctttcccaagctgagatttgaaataaactgctagaagttgtcactgaatgtggatattagcaaataactttaagctacagaaacatcacagatttctgctttactacttttctgaatttgtaaaacacaaagagagggagagaaaaagagaggtggagaggtgggagggagtgggctagggtgagggcaagagcagggagcggggagaagaggatggtagggggagggggagagagaggaagtgggagaaaagggacaaagggaaggggagggggtagggagaaagaggggaagggggagggagggagggaggagtggggaggggtttaggtggcttttgaagtctaaagttcatttttcaatatcactatcactcaatattatgaacagggaactcacaggcagttgacagacacaggcaaggaatcatatgattagactaatcagtggaaggtgcaatgacagaggatggcatgggagcctatgaagaaagagatgatgtttctgtatattatacattctccagaaactaagagctccaatagtctatcgagacttcatttccctggcctggcgaggtggatcacagatgtaattccagcaatttgggggccaaggcaggagaattgcttgagcccaggagtttaagaccagcctgggcaacatagtgagaccctgtctctgtgaaaaataagataattagctgggcatggtggtacatgcctgtagtcctagctattcaggaggctgaggcaggaggatcatttaagcccaggaagtagagactgcggtgaatcattattgcatctctgcactctagcctgcgtgacagagcaagtctctgtctcggggaaaaaataaaataaaaataaacgagagagagaggaaaatttcatttcccttaacagcgaagggcttcactaaaaacaaatttatcatcctgccattttactaagatattgttttcacacatccccctttcaggtcattgccactcaaccatgttcaatctttaccctcctcatctctgagctggcatccatccatcttggttgatgattttttccagctcagagactcagtgccccagcacagcagttctccaagttacaataataaacttcatttgctcttctgactactctgggtcctgaaaatgttataactgacacagttgcagagccatccattggaacaactacactaaaatatagagattgtgttcaaacatgtatacttcacatttacagtaattactatggctttactttcatttgcttctctcagttttccttcatcttgcaacaagacaatcaagaaaaagcaggtagtaggtagcttctaacagaagaacagacaaaagagagcataaagaagatattagccaagaagtgatgcttgacatttttttcaaatagaaatctattaaggaccttaaaaaatcatctattatagccaaactggtgcctaactgaagtagtagctgagagtgcttcattgaaaatcaattagagtccaacctgattgtagacagtgtcccttcaacaaaactgacaagcattctatctctactttgataacatttgtatccaaaatgagaaaacactagagaaatatgaaaataaggcaatttcaatgtatgagttatatcccttaagttcatggatgacattaactaagttctgacaccaatacccctagggtgtctttatttcactcccccttctggaaatgattgaataatttataaaggatatatcttgggggtggccacttctacttcctgagctgcatacagaacataacatttttagagctcagaattgggttcaccaccttccattgcacagttaaagagactgcagtccaagaagggtaaggggtttgcctgctgtcacaaagctagggagcaatagaaccaaagttcaaatccagcaatgctggctgcaactctggtatcttctttgcattcttctgcttgtaccaaatcagatgttagcagaaacgcatggaatcctaggaatagtaaacaaagagaaactgataacaggacaatttacatacatggggcagaatgacaaaggaaaccaacctgggaagcgaagtctgccagggctggcagcagagaaagcctttgcttcctatctctacatcctaaaggaatgaggaggaggaagagagaagtaactgaaatccagaaagtactctgactatagcaaaggatctgcaggagctgtggccttggaaaggaacatgccctctgataaactgtggctttgtcaggaagaagctagagaataaaagctagacatcattttgctcctggcctctaatcacctcctagtgcctctcattagccttgcccaaccagaagccagagaacaaaggaggctgccccatcgatgttctcctaggaccataggaggagagaaaggggatgtggagggacaaatggaaaatattcagccaatatttcttagctgcgccagccttttgctttgcaatttagtcttccttaccctcctctattttctttcattgggacaaacattatcaaggttaataagagataatggcccatgtaaaaagagtattgtattcttttatggactttatctaaaatttactcaaatataacagaatcctgtagatgaagcataatatgcaacagatatactttgcaatatttaaaaatgattaatctcaaaagtaatcatctcagtactatgactcattagctggaagaaaacagtaataacatgttttgtgcacagaacaattttaattaataagcaggacatatttattcaaaaattataataagacattattattctcagaacatgaactttgatggtaggtgttagcatcctgttgggtcccagagaatgcacttctggatattaaacatgatggctttgagacctcaaatatatcagcttgtacagtcagctattatctacactgacaattgtttatggctacaaatcacccacgcttgatgtgatatctgaaagtacctcagtaagatattatgagcaatatcaggagtgggtggtgtaaaagtcatttcagtaataaaacagtattcaaagagttgattcaaaaggcagagccattactaataaaaataatataggtagatatttgttaaatgttttctttcttttgaagggcaatactatgaaaggagagtgagcatagggaagttgtctgcaacctctgagccacacacctttctttggtctaccacatatctgtgcagccattaagaatgactctcatctcttgcctttccaaaatgaggtgtaagagaagtcattctggtatagacaggagatatgttaccaaaacagtccaatggacccttttagggatacttcagttagaagttttagctctgtgtgggttcagtgtctctccacattacccctgagacctaaatcccacagaaaatcttaaaggcaatagatgctagttttccttatacctttcaaaaatatgatttgttttgttttgttttgttttgttttgttttgacagagtctcgctctgtcgcccaggctggagtgcagtggtgcaatctcagctcactgcaacctctgcctcccgggttcaagcgattctcctacttcagccttcccagtagatgggattacaggcacatgccaccacgcacagctaatttttttatttttagtagagtcggggtttcatcatgttggccaagatggtcttgatctcttgacctcgtgatccacccacctcggcctcccaaggtgctgggattacaggcgtgagccaccgcacccagccgacaaaatatgaatttttaaagaccaaacacatcagaacaaaccagctaacttgacttttaaaaaccacttgatttcacacaggtctcagatggagcaaaagtaaaaaaaaaaaaattaaaaaataaagacatcccacttgaattctagacaaaattttatattatctaatggaaatgttttttaaaccacataaactgatgagacatatcctttatcctctgaaagaaagaagaaaaaaacaatatttactagctgaacaaaatgccttgagtgaaatatctgtgagcatacatttttaatttcctaagatgaaaacagttttgagcaaggagctctcaaaaaaatgtcctgatgttctcctaatacaccaagaaataaaatctgtcaaagtgctgagattcttataggttttggtacatgttcccagttgatttgatctggctccagatgaaacatattatttaagcaagatagtaatcaaggtaactaacaattttaaaaattacttcaaagcatatactaaggcttgactagtgtgtatttattctctttccattatttctagacggagaaacaatttcattatattttaagttgtatcgaagcatttgttctggaactttctgatgcattagcagattctacctttaatatagtcatatgtgtaggtgtattatcatgcctgctagaccagaagaagtgaaagcctgaattggttatcgcattcccttttggagattaaaaaatagcattacaactatctgtgttgcatttcaagctaaacccatactttcatataaattgtttcacttggtctacataataatcctgtgaggaaaacagggcagcaattactgccccatttcatggatgaggaaattggcttagaagagttaagtggcttactcaaaggcacatggctgagcagttatggacctctgactcataactaagcccagttcaagaaaacacgtatttattcagtgttttaaaattatcaccctaagtcttttgggttcaaggtagtatacatatggcagactaatgaacaaaaagaaaagtaacatttatacagtatttattatacaagagtccctctcataagaactttatagataatagggtcattatagatttatctcatttaaccccatagcgaccttgttaacagtgagataaatctgtaatgacccataacaaccttgttatgcagttaaataagataaatctataatgaccctatgtcattgtcacgtcacagatgaagccgccgaggcacaatgcagatgattaatttgtatagaatcactgacgcattttttaaagaaattaaacaattaattagtgtgtattcatactagttgtacatatttatgaggcaattttgattttagagtccatgttcttaaccactatacatatttgcctccagagattccaaaacttacggacatcttttcattatgctacacagtctcccatgagcagagtatgaaaaaaatccagatatgaggccgggagtggtggcttatgcctgtaatctcagcactatgaggggttggggcaggtggatcacttgaggtcaggagttcaagaccagcctagccaacaaggtgaaaccccgtctctactaaaaatacaaaaaatagctgggtgtgggggcacgtgcctgtaatcccatctactagggaggctgaagcaggagaatcgcttaaacccgggaggcggaggttacagtgagccaagatcgcaccactgcactccagcctggttgacagaggagactctgtcttaaaaaaaaaaaaaaatctgaatatgaatctaagcaaacatatacacacaaacaggcatacatacctagacaaactatatgtctatctctacatctacctatctatacatacaccttatgctgagggtcttgaatatgattgataatcacattctgtgtggctaattgcatttaggccaggactcaaaaaaaaaaacaaaacatgaaataaaccaaaataacctagatgagtgagaaattctaagtttgaattttaactggggaggaaaaaagataaagaaaacttcacagattggaggccacttatctccacatttaactttcaaaacctttctcaaaatatctttgtatttaaaagaatccatcagtctttgcaaagagaggagagaaaatagacttgaggaagatgtttccttctgtgtgctgtgtgactcaggacacatgcttcttctgtgcaatgctttaccatcatctgccaaagacgtgtgtgcaaatatcagtcttgcaaacagacaatatttgcactacattgaggctaacctgccatctgcttatcagatgttcggagtccaaattgtacagttttccttgtgtttcccctaatgaaaaatggaatgctggggctctgattacaagtgtctgtgcacaggactaatactacatccctaggtagagtaatggaaacagtgcatctaggggaaatggcttatatattgacattgtttaaagaaaacagaattattttctgtggctcaggttcacatgaaatataaacctcctagttcactaaagtgtgatatatttttctcaaaatttggagaaccactgatgttctggacaactgtatttcagtgttaggcctagccgaatatatcaactaaaaatgcaatcacagtgaaaaattctaatgatatgcattatttctgaataagcaaatgccagaagcacaatcccaacatattatgaatgatgtgattgactaccagggttgctcgcagcccatagcttcaggtaacacagctgtctcctcccattaatgagaaaagagatagcattttctgtttaaaattaataactgtaacactccaggattataggaaaaattctaagtgtttcacacaaagtgcttcacaaaattttactgaagttcaacaaaatcattatataacaaatacatatgagaaattcttctttatggcttattctattgaattgcctattcatttttgccttcccagaatccacaattttcagcaagatgaatatgagcagaaataaaaatgccctttctatttaataccccctgctttcaattaaaagaaaactggttagtcatttagtatcttagaatatttcttacttataatgaattaggcattaattatattcttctatataaccaaaacaattttttagcaatggacaacactattattttctaattcatgttactttttttaagcatgcctttgggcattggatcactatcagcaatgtgcagagaatatcatcatcctttgaaaagctgtactactgatgtactttacagataaatagtaaaaatgtttaatgtacacctaaaacacaattgaaataaatgccatttcaggaatttgaaagtgtgttgaggttaccaagattatctgtgatccttttcaaacagcaataatttactcaaaaggctgtcatgtctgcttacaagactgtgcagatagttgacatagatgaaattagtattaatatattcattttaatttctacccatttactgtcttactaagggtaatttaactcagaaatgccgtcataatagggtgataatctgataatccggggtgcagtggaggcagggaagaaaggaagaaaaaaggaaaaacaatgacaataaatggcacaggcaagaagaaagcaataatgtaataattactaccatgttttgttcaattatcaccgaaaaatccagaaagatatgaaaggtgagcaaaggttctaccatgtttttgtaaagaaataaaagctcactgaaatattagggagaaatggaatcaaaagtaccaatgaaaaaagcaaaaataagataatttaaaaagaaattagaataagaaaaaactaggaaataacgttctttacatgtgaataatttctttttggttgagttgtaaatcacatatctgttattcaaaaatatttcctgattcatttgaaaagaaaacatattgaaaagggatctaaacaaaggttgtttttttttcccctctttaaatgttgctacctcaaacaagctgtaatctgagtattaaagtacaaaacacttaggaaatataattttccatgattactttgagcttcctgtaagtgtaacagtttttttactacagttttcctctctaaagacagaaatgcaccgtatgggcgcaaggatgctcatgccatagcctatgctcaaaagaggattcttagtctacattccagattcagctggagtctatattaactgcatccattcttttaatgttggccatcttgtatgggttggatgtcccaagaagccacttaactatgggtgtgattgtctattcaagaacctagaaaaaatggtaaactggttacataacaaataacacatcttgatctaagttgagaggactggagtcttctagctatattatttgaaaaaatgcaatcatgatttagtgacaaattgaatagcaacttcattaaccagaatttgactgtaaacccatgcaccgtcctagccagtatctcttttctccggaagagaggcatgggaggaggggagagaaaaaggtgagctatactactttagagtcttatgctagttctgtgaggtaaatgtaactactatttcctttatttaacaaacaaaaaatgaggctcaaaaatttaaacaacttgtgccaaagtcacagaggtaagaaatactagggcaggaattgctcccatgtctgtgtacctttaaaattcactttgcagctgcacagctgataagtctgctcagaagatttaaattataagaggaaaaaatgccttgcatccctggcactgtgcctagttctttccccaaactgaaaatgatacttgcaattttttgagccctcaccatgtatctggatcatttcaattaatcttgacaatgctggtcaagggactattattagtctcattttgaagatgaagcttagagaggtaaaataacttgccccatatcctacagctggtgggagacagagatggcattctcaccagctctctctaaactccaaagcctgtgctcttcccatttattccattctgctttctctccaggagtcttcataataactctgagttcagcagctgttttcaatgaggatataggctcaaagcaaatacaacataaccggtacatggttagatttctaagcctcttgccattccgccttgtggacaaggacatcaaatacaatgaaaaatgggtgccccgcaaatcaatacatctgttctttaatacctgtgatcacagctgtgaaataggcttaatacacagcctgaaaatattgttgtgaaaataactgtgtgtttggctgttaagtaaagttcagctggacacatgatctagtaagaggtgctaggctgctgcatgcaaaggaattccattagaaaagacagagaggtatgggaggaaaccgagcacaaagcagtgtgtccattgatgagagaagtcactcccacttcgcccacagatggtggcattaataaagatatcttgtacaatccaatgatgtgaatctcaatcttcagcatggataagaatcactggggagcttgttaagaatacagttttagtgtcatctcacctaagattctgattcaattaagtctggggtggtgcccaggaacctgaattttataaacatcccagctggttttttaattattattactattggtttctactttattctaggtttagtggttacacatacaggcttgttacatgggcaaattgcgtgtcactaaggcttgatgtatgaatgagcccatcaccaaggtagtgagcatagtacataacaggtagccttccaatccatgcccccccaccaccctccccaatgaagcagtctccagagtctttgttcctatctttgtgtccatttatattcaatgttgagcttccaattataagcgaaaacatgtggaatgtggttgtctgttcctgcactagtttgcttaggataatgacctccagctacatttcatgttgctgcaaagaacatgatttcattcttttttatggctgtgcagtattccgtggtctatatgtaccacaatttctttatctggtccactgtcaatgggcatcttggttgatgccatgtctttgctattgtgaatagcattgtgatgaacatatgagtgcatgcatctttttggtagaatgatttattttcctttgggtgtatacccaatagtggaattgttgggccaaatgatagttctgtttcaagttctttgagaaatctccacactgctttccacagtggctgaactaacttatattcctaccagcagtgtataagcgttcccttttctctgcagcttaaacagcatctgttgtttcttaactttttaataatagctattctgactgatgtgagatagtatctcatagtttgaaatttaatttctctagtgattagtcataatgaacattttttcacgtatttgttggccacatgtatgtctttttttgagaagtgtctcttcttgtcctttgcccacttttaaatgcaattaatatatttttgcttactgatttaagttccttacagattctggataataggcctttgtcagatgcacagtttgctaatattttctcccattcagaaggttgtctgtttattctattgatagtttcttttattgtgcaaaagctctttaagttaattaggtccttcttgtcaatttttgtttttgttgcaattacttttgggaacttagtcataaattctttgcaaaggcccatgtccagaatggtatttcctaagttttcttctagggtttttattgttttagttctacttttaagtttttaacccatcttgagttaatttgggtatatggtgaaaggaaggggttcagtttcaatcttttgcatatggctagccagtgatcccagcaccatttattgactagagggtcccttccccattgcttgttatcgtcaactctgctaaaggacaggtggttgtaggtttgtggctttatctcagggttctctaacctgttctatcagtctgcctgtttttgtacctgaatcatgctgttttggttactgcagccttgtagtatagttttaagtcaggtagtgtaacgcctctggctttgttctttttgcttaggcttgctttggtgattcagtcttttctttgattccatatgaattttagaataactttttctaattctgtgaaaaatgtattggtactttgataggaatagcatctaatatgtaagttgcttttggcagtatggtcactttaacaattctgattcttcctatccatggaataggaagaatatttttccatgtgtttgcattgtctctgatttctctcagcattgttttgtaattctctttgcaaggttctttaaggtccttagtaagctgtattcctaggtattttattctttttgtagcttttgtaagtgacactgtgttcataatttcgttctgagcttggacattattggtgtatagaaatgctactgatttttactcatagattttatactctgaaactttactaaggtcatttatcagttctagaagccttctggcagaatctatggggttttctaagcagagtcatgttgtcttccaagagtgagttagacttcctctctatttggatgccttttatttctttgtcttacctgattactttggctaggatctcctttactatattgaataggaatggtgagtgtgggcatccttgtcttatttcacttctcaaggggaatgcttccagctttcacctaattgctatgatgttggctatgggtttgtcataaatagctcttaaaatttagagatatgttctattgatgcctaatttcttgagggttttcagcacgaaggaatgttcaactgtatcaaaggctatttctttgcctattgagataatgatgtggtttttgttggtaattctatttatatggtgaatcacatgtattgatttgcctatgttaaaccaacattgcatcccaggaataaaccctacttgatcaccgtaaattaactttttgatgtgctgttagattcagtttactagtacttcattgagaaaattttgcatctctgttcattggggatattggcctgatatttttctttctttttttttttttgtttgttgttgttgttgtgtctctgtcacattttggtatcagaatgatgctggcttcaaagaataagctagagaatcccttctcaaattttggaataatttcagtaggattagtactagctgttttttgtatgtctggtagaattcagctgtgaatccatctgctctaggcctttttttttttttggttggtaggctttttattactgattcaatttcagaactgattattggtctgttcaggattttaatttcttcccagttcttgggagggtgaatttccaggaatttatcaatttctttcagtttttctagtttgtgtgcatacagctgttcataatagtctctgaggattttttgtatttctttgagatcacctgtaaagtcacgtttttcatttctgattgtatttatttggttcttctccttttattaatctagttattaatttattatttccctaaatagtcacaaacctaatttgtcaagttatagctcagttgcattacaaaagaagttcttacatcaagtattacagaagaatcagtagtatttgcttgggcagtacatgccatcagattatgaatggattataaatgcaaactgacgtgtgacttttaaaataccatgatctatccaatttgaaagagaccattaaagtggagatttcaactcctaccactataactctaaagtatgatctttactttggcagaatattacagacttagaggtattgtttttatcacttggttttgtttttatccatagcaaagccttcaataatatttcaggccacagagaaaataatacaagtttttgcattgttgatacttcaaccaagatagtcattcttttaatgtaggtctgctggtgtcaaattattttattgttccttcatctccgagaatttcttgatttctcctttatttctgaagagtatttattactggatataggatcctgagttgacaaaattttttctttcagcacttcaaaactattgtaatttttgctggcttccctggtttccgatgagagatccagtgtcatctgaacgttcttttttccacagagaatgtgatatttatttctgactgctttaaacatttgtctttaattttcagaagtttgtctatggtgtgatttcatgtggatttctttgggcttatcatgtttggggtttgcattatagtcccatacatttctgaggttgtgttttgtttttgttttctttaaagtctattttgtccctgttgtttacattgtgtaatttctatttgtattatttttcaatggactggttcttttctctgtctcctctgttcagctattgagcccatatgttgactttttaaattattattttattggttaatatttttagttctaacatttctatttcattcttctttgatttctttgctgtaacattctatttttttattctcctttggtgacattcttcccctttgcttatttttatttttaatttttatggctacataattgtacatattaatggggtacatgtgctatcttgatatgagcatacaatgtataataaaatctaggtaatttgaatatcgattatctcaaacatttatcatttctttgtgttgggaacattccaaatcttctcttcaaccaattttgaaataggtgatattttttcatttgttcaaggatgtttatgattgttcattcatttttatgatggctactttgaaatctttgtaagataattctaacatcgctgtcatctattaaatgtatttttttattcagcttgagatcttcctggttcttgatatgacaagtgatgtttgaatgagatggagacattttggttattatgttaaaagactatggatcatatttaaaattctggatcacatttctgctttagttggcttcttctgaaactgctttggcagaggaagaagagggttgcctcattactgcctggtgagggtaatctttaggggtaaaagtggttctcagttacatggatgaattgtataatggtgaagtctaggatattagtgcatgcattatctgaatagtgcatattgtactcaataggtagtttttcatttttaccccctcaccccttttaagtcttcgatgtctattataccacttggtatgcctttgcatacccatagcttagctcccacttataagagagaaccttcagtatctcgttttcaattcctgagttacttcacttagaataatggcctctagttccaaccaagttgccacaaaatacattattccattctttttatggctgagtagtattccatgataacatacatcacattttctttatccactcatcagttaatggacatttaggttgactgcatatctttgcaattgtgaattgtgctgcaataaacatatgcacacaggcatctctttgatatattcattccttttcttttgggtagatacccagtagtgagattcctggatcaaatggtagatctacttttagctttgagaaatctccatactcttttccatagaggttgtactaatgtgtatttccaccagcagcatataagtgttcctctttcaccacgtccacccgagcatcttttggggatttttttttttgactttttaataatggttattctggctcgggtaaggtggtatacattgtggttttaatttgcatttccttgacaattagtgatgttgagcatttattcatatgtttttgaccatttgtatattttttgagaaatatctattcatgtcttttgtccacatttcagtttttaagttgtctgtttactgtaatgattatttattttgctgtgaagaagctttttagtttgagtcctattcattatttttgttttgttggatttgcttttaggggtcttagttataaattatttgcctatgctggtgtccagaagagtttttcctaggtactcttctagatcttttatggtttcaggtcttagcttcaggtctttaggtctttagtcaaggtaaagttaatttttgtatctagtgagagacagagatccactgtctttcttctacatgtgactatgcaatttttctagcaccctttattgaacagaatgtcctttccccgatttatgtttttgtatgttttatcaaagatcagttggttttaagtatttggctttatttctgagatctctattatattccattgatctacttttataccagtaccatgctgatttggttacgttagccttgtagtaaaatttcaagttaggtaatgtgatgcctccagatttgttcttttcgtttaggttgctttgactatttgggctattttttggttccatgtgaattttaggattgatttttctaattctgtaaaaaatagtgttggtaatttgatagaaattgcattgaatctgtagattgctttggagtgtatggtcattttcatgatattgattgttctaacccatgagcaaagaatgtatttccatttgcttttgtcatctacaatttctttcagccgtgttttatttttcttgtagagatactacacctccttggttaagtatgttctagcatattttatctttttgtagctactgtaaaagggattgagttttttatttgattttcagcttggttgttgttgatgtatagcagtgatactgatttatgcacactggttttgtaatgagattttgctgaattcatttatcagatctaggagtcttttggaagaatccttagggctttctagatataagattatatcattggcaaacaaagataatttgactccatgttttacaaatcgaatgccctttatttatttctcttgtctgattgctctggctaggattccctgtactatgttgaatagaagggataaaagtcagcatccttgtcttatttcagttaataggggaaatactttgaactttttctcattcagtatgatgttggctatgggtttggaatatacagctttaattatttagaggtatgtttcttctatgtctagtttgttgagggtttttatcataaagtcatgctggattttattgaatgctttttctgcatctatagaaatgatcatatatttatttaaaaaaattctgtttatctgatgaatcacatttattcccttgaatttgttaaaccatctctgcatccctaaagtgaaatccatgtgaatatagtggattatttttttgatgcgctgttggatttggtttgctactattttgttgagcatttttgcatctatattcatcagagatttggtctgtagttttctcttttttgttaagtctttcctttgctttggtaccagggtgatactgggcttgtagaatgtattagggaggattctcttcttctcaatcttttggaatagattcaatcgaattagtaccaattctttggatgtctggtagaatttggctgtgaattcatttggccttggactgtttttgtttgtttgcagtgttttggtttttgttgttgttgttgttgttgttgttgttgtttttctaaattactgattaaatctcactgcttcttattggcctcttcaggatttctagttcttcctgattcaagctagcgggggttgtatgtttccaggaattaattcatttcctctaaattttctagtttgtgtgcatagagctcttcacagtagtcccaaataatcttttgtatatctgtagtatcagttgtaatatctccattttcatttataattagtcttatttggatcttctctcttcttgtcttggttttaatctacctagtgttctaacaattttatctttttgaaggagctattttttgtttcattggtcctttggattttttttgtttcaattttatttagctctgctctgatctttattattccttttcttctgctagctttaggtatgtttttttcttatttctctggttccttcagatgtattgttaggctgtcaatttgtgatctttcagaattattgatgttggcattttgcactataaactttcctcttagctttgcttttgctgtatcccagaggttttgataacttgtgtcactgttgttattcatttcaaaaattttttaaatttccaccttaatgtcattgttaacccaaaaatcattcaggagtagattgtttaatttctatgtatttgcatagttttgagggttccttttggaatcgattcctagttttattttaccgtggtctgacaagaaacttaatatgattttgatttttaaaaatttattgaacttatttagtgacctatcatataatctatcttggagaatcttccatgtgctgatgagaagaatgtatattctgtagttcttgggtagaatgttctgtaaatatctgttaggctcattttttctagactgaaatttaagtctagtgtttctttgttgactttctgctttgatgatctctctagtgctgttagaggagtgttgatgactcccactattattgtgttactatgtattttcttttttagacctggtaggaattgccttatgaatctgtgagctctagagttcggtgcatataaatttagacatgttatatcttcttgttgaatttatcctattttaattacataatgaccttctttgtccttttttaatattgttgctctaaagtctattttatttgttttaagaatagctactcctgcttgcttttggtttccatttgcaagaaatgtcttttttcaccccattagcttgaatctataagaatctttacatgtgaggtatgtcttctgaagatagcaggtatctatttggcttgcaaatttttaaaatccattctgtcagtgtgcatctttttaaagtggagcatttagaccagttacattaaacattgagatgtgaggtgctgttctagtcatcatattgattgttacttagtgactttgttttcttcatattgttattgttttataagccctgtgaattttatgctttcaggagtatttattctggtgagtaacaacaacttgtttcaagatttagtattctatttagcacttctcatagagctggtttagtattgacaaattccttcaccatttacttgtctgagaaaaactatttctcctttatctatgaaagagttttgctggacacaaaattcttgaccaacagtcattctgttcaggagactaaagataggaccccaattccatctggcttataaggtttctgctgagaagtctgcagttagtttgattggttttctgttataggttacctgatgcttttattttactgctcttagaattttttccttcatgttgactttagatagcctgatgagtatatgccttagtgatgttttgtttttgcaatgagtctctcaggagttctttgaccttcttatatttggatatctatgtcactagcaagtccagggaagttttcctccctggaaattttcctcaaatagacttttgaaatttttgctacgtttttctccctcaggaatatctacaattcttatgtttggccattttatataatccacatatttcttgagactttccttcttcttttaattcttttttgtttacttttgctgtgctgattgggttaatttgaaagccttgtttttgagttctgaaattctttcttctgcttggtctaatctattttaaaagcttttcactgcattttgtagttgccgaaatgtgtagtctttcatagaagttctgattggctttcctttaaaatatccatctctttagaaaagttttcattcatgtcctgaattaaaaaaaattatgttggttttcaactttatgttaacttaataatcaacttttttgaattatttatctggtattttatgttggttttcaactttctcttatgtctccttgattaacataataatcaactttttgaactctttatctggtatttcaaagatttcatcttgatttggatccactgctggagagtcagtgtgattgatttttttgagttgtcatagaacaactcaaatgttttttatgtttccagaattgtttttatggttccttctcatttgtgtaggctatttcttctaattattttaaaattagtttttgattcaattgggtttaaaaaaattttcctccttgaagatgtgactttaacatttatagtttatttacacttagtttcagctctgggtggtttcaagtggcaaagactgtatgagtttcttggttatagagaatcattgtgaagtgtctttctcagatgccggttgtagtggcagtgggctgggtgtgtgagtaggttcactgtctcctaaggggctggaatggcagaggtctcatgaagcttattttgttccccagtggtgtgcacctttaaaagtttttcttccagcattttattcaacgggttgagtagttcaggcttcaggccagtaggaggtgcccacagataaacacaggttgtggctaaagcgggtgggtaaatgtaatatccaacgattggatgaagtcccagctttgacagaggcagctggcaaagctctccgtgaaatacactgaggtcttttcatggggaagtgaaggagccaccccagctctccttccaggcaaagcaggaaagcaatccacctcccagtcacactgctgacctggtgttctagcttttcagatcaaacaggtatctctttctatctgcaagaatgctgatgttccctctaaagaagggttgtagctctacctcttgtgtaagtctgaacctgtatggcacacttcctgtggatagttaccttggagtgttccagaaagtctgtctacagatgcatccatgctgagctcccatgagagaagccccagctctctgcagtgttgggtgaggggaaaaagaaatcaccttctcaaacctttcatgagcgctgtttgactgttggggtagagctgcagactttccccactgagcccagcactgcacttgtgtctctcccgaaagaaacttctcacaagtgggaagttaagggactcaaggcccatggtctgctttcttttataccatgggatgctcccttaatgtggttcactactctttccccaaaaaatagtagtccctgaaagccaggctattctgaattctactgctcctctaggtctagctgtccagtggggctgccacagttcaggctgtactggagaatatctgcaagggatccagtgatgtgaactgtcctctagtttcccagcaccaggtgccagcattacctctgatgggggtgggtggggagtgacacagactctgagattttcttggttataaatagctttagtgttttggttttctcaaatgccagctgtagtagtagtgtattgggcacatagacagactcaagacgtcctatttagctaaggtaatactggcaatggcaatagctgaggttgcataaaagtttttggcttcctgagtgctgggttattgtttatgcagatgttttaatgggctgtgccggttggcctccagccagtaggtcatggcttgtagaaaagcaccagctgtggaggtagtggtagaatttgtgcttgctttatgtcactcaggggaggtattcctgtgtctcaggtaggtaatgggtagggccatggagctcccaaacatccctgtatattgcactgtgctaccagggcaggtggaggggcaaagctgggtatgggctaggtcaggcaactccttgctctggctcctcacatgcaggcacaagcagcggccccagtgaggatcataagtcaattccttggctactggggtaatatttcagggagtagcacagctgcctctgttgcacagaagaatccgcatgggatgcaggggttagcaagcagcagtaagccccactcagctcccatgcacttggcaaggcatgtatcccactcataatgttcgctaaaagcagcaggctgggttccaggtagtctgtacgtagaactaaaaactgccccaggccataagccgtcccagtggagaccagtgaaaccacagctttcaggccgcaccccttctggtctacctgtgaagcaggagtgcccagctcctgcgcccatggctatagcaaacttactacttgcccctcatttctggccaacagggtttatcctcactcaaggttataatctcatatctcagatgggagcttctctcaacctgtgactgcagcttgagttagctggtagacttctgtgaggtcccctgtgaggtaggatcaggaatggcttccctctgtccttgctggagtgtgaaagtgcaggcaatgtgcatcctgataccgcttcttctcaccccatcactcgctaaatcagctccagcactgggtagtgttaagatctgcctccatggcctgaattgcccggctctccggtgggagtgtgtgtcacggtggcagtctctccccctctcacacactctggagactcacagttttccatctggttcacagtgtaggctgctgtttcttctttcaaagggtctgtagtttctttcagtttttctgttaagttcctgtgttgcttcttagaaagaagtgcacattgtgaatctctgcacactattttgtctttccaagtgggagaggcaggctaacaatgcctccaaaccactgggccattttaaataacacataggccagattttcagttaacacaattcttaaaacacctgcaacttagcatgcttctatttgacatcatttgggggtctgttacattatttgagaagtctgctgttagtctgataggttttcctttataggctagggtatgcatttgaagactagttagcatatccactctatttcatttatctaattatcccatcactctcataatccaaaagtcagacacgaagaaaaggaagaataccagcatatttggatgggaataaaagacaagaaatttcttgagcatcaatattaggtgcatgaaatcttgggtaatctaaggtacaaagtaggagttggacttttgaggatggacaaggcaaaaattcattacaattgaacctaattataaggatattgccaagatattgctagtgggagtacagtggagataaaagaaggtctctgtgtctgaagccaacatcagttaaagtgcctttggttataaaaacccaaaatttaactcaaacagactagtaattaaatacatttgttaactcaggtaacagaaaaattctagttttgtttcttaagtaaggatagatctgacagctcaacaatgtcatttaaaatgtatcttgtttttcttttcccttgatttacattgtgctttctgagtttcactttgtcctgaagttggtttcctttatagttataagagggcttccagtgattcttaggtttataagggtcattggtcacatcacatccagagagagggggatcaaggagaagatggggataaatagaggagaggggaagcagaaaaaagaaagagggatgaaaggggtgggaagttccctagctagataatgaaattcttctatttcactttgattgtggcaatatatatccatgcccaataagggagttggtttgggttaatcagtacctgcccctaccccatgaaactgagaaagtgaaatagacatgagaaaaaccaatagtgttttctacattaacattttctctttactataaacacccatggttgttcctctacatatcattgtgcatcaacatcaaggagcttcccctcccttgggttagaaaaccagtgcacatatttgactgggtttaactcatcagtgataaaagcacctattcctttttacaattttcaagagtggaatatacagtcttaagaaatggcatacaagttgagatgttgtcatattaacagaaataatggcagctgtttaatctgttctaaaacatatgatttaacatgctttgactcatcatttgtttccattgctttttcccttagataagatcacttaaaaacagtgttaatcagataaaaggaaggaccatcccacacatttcaatgggaaaaaagccagtgggctcagtgtactgtgatatatgaattgtttttgtgattcccatcataaacgctgccttaactgtgttatttttttaactataaagtagaaaaaaataaattactttgctcttaaggagtataaagaaatattgaaaggagtaagattttttgaaaaaaagtttggtagcctaaaatatgtttagataatattgaagtttgtgaactgctaattcaatggtattgtttcaatcaaattataatgtaaaatatctgttatgtgtttaaagtatgttttacaggtataaactaagttgaaggcttcccaaaatagaatattaaatctagaaggaatattagacatctagtccaaatctacccacttacaaaggagggactgaagaatctgagagtttaaggttcaagtgacttgcttaaagccacatcattaattagtgaaagaagactagagcacccatttccagactggaagcccactgctctttcttggtttgacatacatgaaatatgaaatcacccgtaccagacaactggatactggcaaaatacatgttacatatttcattttgagacaaaagtgaaattcagattatcctaccatttatcaaagtgtataattaaagcaacatacatccatctagatacaaatctgattatgattcggttaaaacagtctaaaaagtgaattaggaaaatatacaacaatgagaaaaatgaggaccatgaatcagaaagccagctttacatttgattcagtgagggtaatttcatttattaaaattgctatggcatttatattttaacatagtcatgtaacatgtgaggataatgttaaaaatagttatagtttgccttatttctagagggagaaaaaatacttttcagtagttctaaagagggagaaaaaacagtattagaaaaattataattataaaggccataaaatatcttcctaactgataatgcatttgattaatagagggagaaaaatggcttatatatgtgcagatataaaaagagatggcattgctaatatatctaaggcatcaaagttgtttgtggaatctataaacacagggacttagtttttcacacagagtacaatttaatacggtttactgagtgggagtggttttaaatgataattattttcctgtcttctcttattaagaaaatcaaaacaacagttttgtcccattttgctgacactggtttctgtagtgtgatttctattgaagcgggaaagaacagaacatcatctgtatcattttaagaacttgagttgtctcctagaattgtttataattgcccttgcaaaagagagcagcctcagcaggttggaaaattaccaatcagtcaacaagtgtttattgaactccagctatgtgttcagaatagtactgagtggtatataaaacatatttttccccccttggggactttcagtggaaggaagattgttgggaatattatcaacgcacatggaataaagagcaattaagtaccttcataattaaatatggtctatcagtgcaattacatatcagaaggaaaagatatcattttgaataagagcagcctgaaggcaacatgagagagataataaaatctcaaaatcattaatgatggaaactgctttacttgatcactgttcttaaagcaacccattcatctgttggctgctctgactctagaagagatgctcttgacattgacctgaaacttacccctcttttacctccagctatccacccatctttagctaactctcagctgttccagccctttcctgtggtggaattttaatgcagcaataatattcccacatagtattctctctttatcctgtcagcaatgataatgatgccatcctgatattcatcatttttttgctctatactttgttaaaatccccttaaatataatattcagaaataatacaacactccaaataagcattggcgagttaataatacacaggaaaaaaatctttttcttgatctgaacactatatttctttaactacagaataagagtatgttagttttattgcccgtatataaccctatcagctcatattgagttttagcaagttttatttgacctctcccatgaattgcagtcaagcaaatttgtaaggacttataaatacaagcgatgaatttaattggaatgtagactttatagttattgctgttaaatgttccttgttgatttctgaatcattattctagcttggcaaaaaaaaaaaaatggtgactcatgactcaaccatccataacattagcttttcctcctgaatttacattaaccacaaatttaataaattagatatctggtttttcaacagacctatacaataatacttttcataggattgttgtgagaatacaaataaaataagatcatgaaaaaagtatttatcacagtttttaggaaacagaagttccataaatgtcagattattttcctttcttcaaaaaatatttgaaaaggacataagcaagttcagaatctccttcaggataaaatttacctacttaccaaaaccctttgtgtcaacctcctacaatgttccccaattgtactaacatccaacctccacttttccatcctggtcacaaatatataattgaagaccacattgataaaatgtatcattgtatcagaatgtatatgacagatagaatgcatatggggagtcaaaacatatagaattaaataaacataggccagtcctctacagagttataagcaaaagctgagacacagaaatataattggtaaatttaaaagatgaagggatggatatatgttagtgtgggttgaagaatggtaatttgtgctgggttttaaaacaataaaaggagatgggaattgatacagaaagcaatagcagccactggatgactttatgtcaaggtttggcagaaagaggtgggagacaccaaagtgtctgcacagggtaaatatattaggcatataagttagagaagactttcatggaggtaggaggtaagctactgtaataatagaggccagaagcaatgaaaatctagtttgaaataatggtaatgataaccgagtaaaagttgtgacttctgaattcacccattatggacaatgaagaagaaggcaaattcaataattttcagaatcatgccactaagaaatttataagacggaaaggaaagaacatttgagccatattatggaataaaacaaatttaatttttataattttcaatgtgtggggctttgaccattgcatcagcattatgtaagaatttattagaaaagccaattcataggatcttgcttagacatactgaattcaccaatactggtgtgttggtgatggtggcagggcagggtgagaacagaactaatctgtaacgttgaagatttctgacttttctgatttttgtactcccaccatggccagtttcaagtcactggtgacatagagttgtgaataaaagtgcacattctgctccccagactctctactaggccactcatgcacaccactggctccaggtgaatctgtagtttgcatcagaatcagctggatgatgatcaaaacacagttggaccacatcaccaaagtttctgtttctttagatctagggtagggcctcaatatttgcatttctaagtttccaggtgattttgatactcctggtctggggaccacactttgaatatcactactttaagtgtcccttaagccaccttatttagaaatttaattagcatacagagccgtaattgccaaagtcacattgaatcaaagtgtttttattacttctgtttgtgaccaaaatccaaaaaagcagtctcaagttctcatcatacttaaggtctcaagcaggaattgccataggttaaacatatccttcttgaaactatttccttagtgttccactatccacaatctcgtgattctctttttccttctttggctattcattctcagttgttttctgtagattactccttccctgatagctgaattttgaactaggcctcattgctttccttttctgatggctgaatcctccctctatgttatattatccctatcccatccaatggttttaaatatcaaaatgttaacaactccaagttttcctgcctaaagttcttctctgaacttcaaagtagaaatatctcttccacctgacacttccatttgggtatctgaaacaatactgaccaaacggaatttgtttctcccctgcacctcatgacatctcctcaaatctttcccagctcagtaaatggcaacactatccactgtgatgctctgacctggaaccccagagagtctacacctcatcttgcccttttagcacattctacatccactaattcctattaccactctttccaaaacattttctcaatgtgacaagtttcattgtttccacaaccaccacctttggttagtccactatgattctttcccagacaatttcaatagcttcctacttccatcttgtacccttataatccatttgtcatacagccatcatggatctgattaaattcttcctgttttactgcagtacccttagaatgaaatctccttccaaagcatagccctacatgacctggtccttgccctatcttccctattccctactcaagtctgcatctcttcattcaaacaggttgcagtcatcccatctggatgcttttgcatttgtttcttctgcctgaaaagctcttctcctagaattgtacacggttttttcctttatgctataaaactgtcaattcaaatgtcaccatctgtagcaaggcatttttgttttttgcacacagtccttttctatttcataatttatctgattttcctgatatggtagcatgtagtatggtaggcaacagtatggattataaagccagatcatctaagtatgaatcttaactcttgagcttctttctctaaattaggcaagttacaagaatcttttgtacttcactttccttatctttaaaaatgtatacataataatatctgccatataagtttattgtaaggattaaatgagttaatatataaaaattatttataactgcatctggcacatataagaactacatgcatgttagcaattattatccacaattatctcgtttgagtgatatcagcgagattgtggaactggagatcccagccctcaacccccagaagaaacaacaattttaacaaacacccatggtcaaaaatacctttatgtgagctcaagaatccagctaagattccactgttccagcatcacagtggaacgacaacaacaaccaaaatccaagaatagacgcattaaaaagcacaagaaaaacaatttcactttacctatctcaccaagtgccaagagagacccataaaagatgcatttagtttgaatgtagactttatagttattgctgttaaatattccttgttgattgattgatcttatttattattattattattattattattatttgagacagagtcctgctctgtcacccaggctggagtgcagtggcgcgttcttggctcactgcagcctctacctcccgggttccagcaattctcctgcctcagcctcctgggtattacaggcgcatgccaccacatccagctaatttttgtatttttagtagaaacggggtttcaccatgttggccaggctggtctcaaactcctgacctcaggtgatctgcctgcctcagcctcccaaagtgctgggattataggcgtcagccaccgcacccagcctgttgatttattttttaaaagagacagtcttaatctgttgcccaggccagagggaagtagtaggatcatgtgtcactgcagcctcaaactcctgggctcaaatgatcctccccccttagcctcttgacaagatgggactacaggagtgcaccactgtacttagctaatttatttatttatttatttatttatttgtagagacgggtttcactgtgttgcacagactggtcttaaactcctggcctcaagtcatcctcctcaagtcatcctcgacttcccaaagtgctgaaattacagatgagagctaccatgcccagcctccttgttgacttttgactcatttttcaagtgcagcaagatatggtgactcaataactcaactgaccctcgtcctacaatttctctcatgaagaaaagtgggagcagcttccttccttccaaggagacccacttctgtctcatcccacccagaatactaaggggattagcaaaatgaaataatcttggggacactaggaacagggtaagggggtaggggccgtggcagcctgtatgaatatctcaacaactggccataaatcccactggctggttcatgatggtctccactaggatctctacccatgacccctgtggactcccccagctaactgatatgtattcccaggattccatgcccctcaactaaaatggttagagccctgctgtctactacatatggtaccctatgctcacccacagacaaaacattgagcctttgcaagacagcatgtgcaagctcccaaagatggcaagcaaataccagcagctggcttgactctgctggattgggaggagtcatactatattaaacaattcaggacactgtcttaaggaaaataagtgagagtctcttagcaacaagcctggctttgcatgatcaagagaatatacaaaatctaaatacttacctctttgaagagaaaagagaaatagagtgggtgcctctacatacaaaaaggtctgaaagacccccaaaatctccaacggggctgactggtcaaggtttttctttcctaatatcagacagtaaacactgaaggagatgactccttcttcaaatgtgaagacaccatcaaacagcttcaagaaacacaaagagtcaaagaaacgcaacaccaccaaaggaacaaaataaagttccagtgactaatcccaaggaaatagacatctaacaattgtctaacaaagaattcaaaataattgttttaaaaaagcacagtgaaccaccagagaacacagatagatacctaaataaaatcaagaaaacaatacatgaacaaaatgagaagttcaacaaaaagatggaaacatattaataaaaaagaacaagacaaattcagcagaagaataaaattaatgaaatgaaaaaatataatagtaagcttcaatagcagactcaagcagaaaaaagaaccagtgaattcaaagacagaccatttaaaattctccagtcacagaaataaaggaaaaagaatgaagaaagcctatgggaattatgggattccatcaagcaaactaatagctgcattatgggagccctataagcagcagagaaaaaggcagaaagcatatttaaagaaatcataacagaagtctttccaatctggggagtaaaatgaacaccagatctatgaagcccaaaggattcataaaaaagccttcactgggacacattataatcatattattcagtgggacacattataatcatattattaaaattgaatgacacccatgtctgtaatctcagcactttggtaggctgaggcaggaggatcacttgagcccaggagttaaaggtcagcctggtcaacatggcattttatttcatacatatatatatatatatatatatatatatatatatatatatatatttattaaaaattttaaaaataacaaataaataataaaaatcagttacaagaaactctgaacacagaaagagaaaaacaacttgtcacatacaaaggaaccctcatgagattatcagttggtttttgtgcagaaaacttgcaggcacaggagagtgcggatgatatactccaggtactgaaagacaaaaaaatctgtcaatcaatgatactttacttggaaaagctgtccttccaagaaataaaagataaagacttttccagaaaagcaaaatctgagaaacttcaccaccattagacctaccttacaagaaatgggagttatttaatattttatttgaaacaaaagaaggttaattagcaacattaaatatatgaaagtattaaacactattacaccgctattagacaccgttagaaaagaaaatcagaggccaatatccctgataaatgtagatgcaaaaatcctcaaaaattactagcaaaccaaatttaatagcacattaaaaggaacattcaacatgaagaagtgggatttatcccaggaattcaagaatacataaatctgtaaatgtaatatatcacatttacaaaatgaaggacaaaaaaaataacatctcaatagatgaagaaaaaagcatttgataatatttgacattcttttttgataaaaactctcgacaaactaggtatagaaggaatatacctcaacacagtaaagtccatttatgacaaatccacagctaacatcacactcaatgatgaaaatttgaaagcttttactctaagatcaggaataagacaaggatgcccattctcatcagttctatccaacattgtactggaagtcttacccagagcaattagacaaaggaaagaaataattggcatccaaattggaaatgaggaagtcaaattgttcttgtttgtagacaacatggtcttatatatagaaaaccagaaaaactccaccaaaaactgttagaactaataggcaaattcagtaaagttgcaggattcagaacatatgaagaatcagttgagtatctatacactaatgatgaactacaaatcaagagaataattatatttacaatagctacataaagaacaaaatacttaggaataaatctaactggaaagatgaaagacctggatactaaaaactagaaaaaattgatgaaagaaatttaagaagatataaagaaatggaaagatatctgtgttcaatgattggaagaattaatattgttgaaatatttgtactatcctaagtgatctataaattcactgcaatctttatcagaatcccagtggcattttttacagaaagagaaaaaaactgtaagtcatatggaaccacaaaatacaccaaataaccaaagcaattttcagcaagaagaacaaatctagaggcatcacactccctgattttgaaattatatcacaaaggtatagtaatcaaaacaatatggtactggcataaaaacagacacatagaccaatggaatagattagagaccccagaaataaacccttgcatatacacatttgttataaaagcttgagaaagctacaaagaactgcaacaaatgactgaaatcatacttttgttcaggctttcaaatatttgcctttgaattccatgatttctaggcagcatctggcagaaactgaaataatgattattatttattgacagttgacagtatattccactcagagaggcaaagacttcaatggaaagatagctgtcaactctttattaacatccacaaagcttggttcataggcacaggccataaacttaagtattcgcttaagagaaaaaccatgaattatttctggaatgctgacagacagttttgcagtcatggctgtactattcccttcaatttttggcccatttctcctaggctgcccccatgctagagtttgcttttctatcccagaactcctatactttggattacccatgaaatatttcttgttacacaacaatacattctgaaaaaatacagtaacaccatataagcctctgaaaactcattacaggtgtttttcttttcttcttctactttttttttaattgggtgggaatgagtgacctcaaagtgtcttaggaaatgagttccagtgtttgctttaagtccttcaaaagaaactgcaccataagcaaagaaactgttcaccacagttccttccagacttacaccatgccagtccacatattaagtaactctctggcctccacttaccaccaacataattcaaatatcttcaacatcaccaccaaaaatattcaatagcacctatatgtgagacagagtaagtgtacattctcttaggtcactatgttacctagagctaaagtctttgggaaatgttcacttcttattcaattattcatttttagctaataacttgccagattagaaaaatgacttaagatagtacaaagtcattgttgatatggaaataaataataaaaaacaaagtagacaaaagaagcatatttaacaaccaggctaacacagttgctgagatagaacctcaaatttatgttgaactcacctataataacaacctaaagaggaacacattaagttatataatttatttaatgattaaagatccgatattcagaaaaatggtttttcatgatagtaaattatttaaaaattaggtatattgccctggatcctaagcagaaagttttaatacaaaatattattttaaagaaaataagaacatataccttgaaataatgtaatttttaaaattcagtcaaattgttttttccagtatcactcatgtgcgtgttcaagggaccatatattgctctaataccttgaaatatacacttttatacccaaacaccacccataaaaatcagccttttaatttttagtcaaaagctttgactactagatttttgaaaatattatgccaaaattgcataacacactgatccatcattttttacctgagggagttcctgttaagtaaataaggatgttaaatgatttggcaagaactgtattttaacttcctccccctctttgctgtgtaatcttacagaacccccaaaatctctcttggtatcaaatcttaccaagtatgatacagaaattgtaaagcctgttttaataataaagtgatacataaatgtcaagtaatattggcatcctttctaatggagctaaggccttcaattatgaaatagcaagccctaaatatatgacagtcaaaagcattgcagacttaaatgttgaaaagtaagattcctgggatattttctttatcacgtcttttacagcaaggggtagtagaaaagtctatgttctttggagaattacacaattatgagtaaattaaactctgatgaaataattctaaaaccaagaaaattattagtgttcaaatcctaaagcatttttttttgttctttaactttggagtagtcacctaaaatctctgaatttcttcttctttataatagaatgagcccagtaatgtgtatgtcacaataccattgcaagaattaaatatggtagctctaggaaagtacctgccagatctcagatgcatgagaagaggtcatcttttcctttataaactttcttaccaaacgcacaaccatagcatgcccagaaggtatctacatgttcaaaagcagattcatgactttaatttagcattcaacgagcagaaattgagaaattgaaaaaaaagtagtttattttgtgagatatctaactcatgttgccctccattaggcaaaaagtagaattttattgtgctataagtacagttattttatttctgcataagcatgacagagattaaagttatttttaaaataataaactatgcaatatcatattgatagcttgctaattactagaaacaacatttgactctcaagttctccaaaaccagttcattctttctatggagcaattaccttatagcttctggatctcaatgtagttctgtttcagctccctagaccaagtttctgcacactgtctgttatactaaccatctgtaatgggaggactgcttagactgttttaaattacccttgtcacattctccttgggtaatccaaaatgacaaatcttattttacagaatattgctaacaaacgcagccttagaacagaaaaaaatagaaagtataggatgaaaaaataatgactattggtgtacatataatagacttagtgacattcatgcttaagtctgtttcattgctttttaacactacctttcccagatcgtcgccccaaccagcttatatactccaagaaatctggagtgaactgccagtcctaaacttttaggttcagtgtagatatgaaattagaatactctcttcttgaaaagaaatacagaaaacctctctaaatctaaattaggatgtaggggacactagcattgtcagttatgacacataaaatgagagtgcagagactttcagttatagaactacaatttgtaatcttgattgtagtacaaggaagaggatgaatgattgcttagatttgtataaggtcttttggttggaaaacttgtcatgactgggtatagaagttcttaggatctatgggcatgggtaattttcatattaaccctcaagacaaggttctgggaagaaatagtcagacattctccatttggttaaacatcctactacaaatgacatttcatttcagcctcacatttaaaatgacatttaaaaataatgttatgaacaaaatatttttcagcactaacattaccttctgaattacataaaagtatcttaagttttaaagctttttttaaaaaaactgtttatgtatttaaggttaatctaagtgtgaaccacctacaagtccaggatatcttatttacttactgattaataatcagtgaaagctcatactaatatttagctccacaagcttgagttcactatataaaaacatactttagaaaatgctgctagaattgcttaaaagcctactgcactatgtagattctgaagacaaaaggcaatattgaaaaattaccctgataccaacaccagagagactcaacaaaaaaaggaaaccgcagaccaatatatctgacacacatagatgcaaaaattttcaacaaaatattagcaaacaaaaatcaataatacattaaaaagatcattcaccatgaccaagtaggattcatcccagggatgcaagaatcttttaacatgtgcaaatcaaaaaatgtgatacagcatatcaacagaatcaaggacaaaaaccctatgatcctttcaatagatactgaaaaagcttttgataaaattccatatccctttatgataaaaatcttcaacaaattttgcatagaagaaatatacctcaacacaataaaggccatatgtgacaaacctatagcaatcatagtgaatggggaaaactctaagccttttcactaagacctggaacaagtctacgatgcccacttttgccaattttatccaacatagtactggaagttctagtcacggcaactaggcaaaagaaacaaagaaagggcatccaaattaaaaaggaagaaagtctaattatcctcgtttgtatatagcgtgattttatatttagaaaggcctattataccaaaaaattcttggaatagatcaataaatttagcaaagcttcaggatacaaaaccaagacacaaaaattaatagtgtgtctgcaaactaacagtgatcaatctgaaaataaaaaacaagaaagcagtaacatttacaatagctaaaaatatatatcacacataagaataaatttaatgaagaagtaaaaggtctttgcaaagaaaactgtaaaacactgatgaaataaattgaagaggacacaaaaaaatggaaacatattctatgctcatggatttgaagaattaatattgtcaaaatgtgtctactacctaaagtgatctacagattcagtagaatccttatcaaatattaatgatattcttcaggtaattacaaaaaaatcctaaaatgtgtatggacacaaaagactgaatagttaaagcaatcctcagtaaaaaatgcaaagctcgacatcatactacatggttttcaattgtactacaaagctatagtaactaaaacagtatggtactagcatgaaaaaaggcatatagaacaatggaacagaatagagaatacagaaataaacccacactattacagccaactgatttttgacaagagtgccaaaagcatacatcagggaaagacagtctctttaataaatggtgctgagaatattgtatattcatatgcagaagaataagagtagattcccatctttcaccatatacaaaaatcaaataaaattatattaaaaacataaacataagatctgaaactatgaagcttctagaagacaatatttggaaaacagtataggacactggtctgggcaaagatttttttaggtaagacctcaaaagcaaaggtgaaaaaagcaaaaatagaccaatgggatcatatcaagttaaaaaagctactgcatagcaaagaaaacaattaacaaagtaaagcgacaacctacagaatggcagaaaattatttaaaaactatccatccaacaagggattaataaccagaacatataaggaactcaagcagctcagtagcaaaaacaaagaacaaaaacaaaaacaaaaaatccaattaaaaaatgagcaataatccccatgctaacaccaccaccagtgtgactgcatgcacattcgccagcaggggccccccgttcccctgactcatgctgcctccaccgctgtggtgaatgtccgcatggaggcaggtacactgacacccattagcaccctgctgcagccgatgagcgtgcaccctgccatgctgtggctgccactgctgctgacatacgcggatgaagacagatcctgctgtcaccatactacgaaatgctttggctgacaccacccatcagagagtactgaccagcattctgggagtacctcggccccctagtgtagcagatttctaacctcaaagaaccaaagaacactctcaggtcaccatactactcccccagagttacagcacccagtacaggagctgagagctaagtgttcactccctaaagtcttccagaaacaaagccagttggcagaattcacttcatagcataatcaaaccctcagggtcatcaaataggataaaagcaaaaaaaaaaaaaaatccaaaggtcaacaacttcaatgactgaagaaacattagtccacaaagatgagaaacaaccaacacaagaactccaacaactcaaaaagccaaagtgccttttgtcctaaaaatgaccacatcacctctccagcaggggttctgaactgggctgagatggcggaaatgacagaagtagaattcagaatatggataggaacaaagatcattaagatgcaggagtacattgaagcctaatccaaggaagctaagaatcagaataaaacaacagaaacggacagacaaaatagccagtatagaaaagaatgtaagcaacatgatagagctaaaaaacacactacaagaatttcataatgccatcacaagcattaatcgtagaatagaccaagttgaggaaagaatctcagaggctgaagactagctttctaaaataagacagtcagaaaagaatagagaaaaaagaatgaaaaggaattaataaaacctaagataaatatgagattatgtaaagaaacaaaatctatgactcattggtgtccctgaaagagacagaaagagtataagcaacttggaaaacatatttcaggatatcatccatgagaacttctccaacctagctagagaggccaacattcaaattcaggaaatgcgaagaaccccagtaagatacttcacaagaagatcgctccaagacatacaatcatcagattcctcaaggtcaaaatgaaagaaaaaatgttaaagctgctagagagaaaggccaggtaacctacaaagggaagcccatcagactaacagtggacctttcagcagaaaccctacaagccagaagagactgggggccaatattcgacattcttatagaaaggaaatctcaacccagagtttcatatccagccaaactaagcttcataattgaggtagaaataagatccttttcacacaagcaaatactgatggaatgtgttgccaccagacctgccttacaagagcttctgaaggaagcactaaatgtggaaagactgttaccagccactacaaaaacacacttttaaatatacagaccagtgacactataaagcaaccacacaaacaagtttgcacgctaaccacctaacatcatgatgacaggatcgaatccacacataccaatactaaccttaaatgtaaatgggctaaatgccccaattaaacacagaggggcaagctgaataaagaaccaagactgatttcacatgcaatgacacccataggctcaaaataaaggaatggagaaaaatttaccaaataaatgcaaaacagaaaaaagggaggttgcaatcctaatttcagataaaacagactttaaaccaaagatcaaaaaagacaaagaaggacattatataacagtaaagggttaaatacaacaagaagacctcactatcctgaatatatatgcacccaacacagaggcgtccagattcacaaaagaaagttctctgagaccttcagaatcttaggctcccacacaataatactgggagacttcaatacctcactgacagtattagatcattgaggcagaaaattaacaaagattttcaggacctgaactcagcactggatcaaacggacctgagagacatctacagaactctccactaaaagcaagagagaatacattcttctcatcaccacatggcacataccctgaaataaatcatacaatcagacataacacactcctcagcaaatgcaaagtaactgaaatcataacaatcactctctcaaactacatcgcaatcaaattagaaatcaagcctaagaaattcactcaaaaccatataatccatggaaattcattacatgaataacctactcccaaatggcttttgggtaaataatgaaattaaggcagaaatcaacaagttctttgaaactaatgagaacaaagatacctcacgccagcatctctgggacacagctaagacagtattaagaggacaatttatagcactaaatgtccacatcaaaaagttagaaagatctcaagttaacaacctaacatcacaactaaaagaagtagggaaccaacagaaaaccaaacacaaagctagcagaagaaaagaaacaaatcaatccaaattagagctgaattgaaggagactgagacaccaaaaagcattcgaaagatcaacgaatccaggagttggttttttgaaaaaattaataagttagatagacatctagctagactatcaaagaagaaaggagagaacatccaaataaacacaattaaaaatgacaaaggggatattactgctgaccccacagaaatacaaataatcatcagaaaacactatgaccacctctacgcacataaactagcaaatataaaagatgtggataaattcctggacacagacaccctgccaagacagagccacgaaggaactgaatccatgaacagactaataatgagctctgaaattgaatcagtaataaatagcccaccaatcgaagaaaatgcaggatcagatggattaacgacctcattttaccagatgtccaaagaagagctggtatcattcctcctgaaactattccaaaatattgaggagaatggactccttctaactcattctatgaggctaccatcatcctgaaaccaaaaccaggcagagacaaccaaaaaaaaaaaaaaaaaaaaaaaagcaagaaagaaaagaaacttcaggccaatgtctttgatgaattttgaggtagaaatcctcaacaaaatacctgcaaactgaatccagcagcacatcaaaaagcaaatgcatgatgatcaaggaggcttcatgcctgggatgcaaggttgattcaaatcaatacatgtgatttatcatataagcaaattaaagacaaaaaccacatgattatctcaatagatgcagaaaaggctttcaataaaattcagtatcacttttatgtcaaacatgctcaataaactaggtattgagaaaacatacttcaaaataataacagtcatctatgacaaacacacagtcaacattaaactgaatgggcaaaagctggaagcacttccttgaaaaccagcacaagataaggatgctctgtctcaccattccttacctaacatagtattggaagtcctggccagagcaatcagggaagagaaataaataaagggcatgtaaacaggaagagggaaagttaagttattcctgtttgcagatgacatgatcctatatctagaaaatcccacagtctcagctcaaaaacttaagctaataaaaaaacttcagcaaagtctcaggatacaaaattaatgtacacaaatcactaccattcccatacatcaacaacagtcaagtcaagagccaaatcagaaatgcaatcccatccacaattgccacagaaagaataaaatatctgggaatacaggtaatcggggaggtgaaaggtctctacaataagaattacaaaacactgctcaaagaaatcagagatgacacaaacaaatggcgaaacgtcccatgctcatgaataggaagaatcaaaattcttaaaatgaccatactgcccaaagcaatttatagattcaatgctattcctattaaactaccaatgacactcttcacacaactataaaaaaaactattttaaaattcatatggaacaaaaagagcccgaatagccaagacaatcctatgtaaaaagagtaaagctggaggcaacatgctactagcttcaaactatgctacagcactacagtaaaaaaacagcacaccaaaataaaaacagagaccaatggaatagaatagagtatccagaaataaggctgcacacctgcaaccatctgatcttcaaaaaaaaactgacaaaaaacaagcaatgggaaaggattccctgttcaataaatggtgctgagataactggctagccatacgcagaaggttgaaactggaccccttccttacaccatacacaaaaattaattcaaaatggattaaacatttaaatgtaaaaccctaaccaataaaaaccctggaagacaacctaggcaataccatgttggacacaggaatgggcaaagatttcatgacaaagacactaaaagcaattacaacaaaagaaaaaattgacaattgggatataattaaactaaagagcttccgcacaacagaagaaacattcaacagagtgtaacagaaaacttacagaatgggagatacattctgcaaactatgcatctgacaaaggtctattatctttttttttctttttttgagacagagtctcactgtgtcgcccaggctggactgcagtggtgtgatctcagctcactgtaacctccacctctcaggttcaagtgatcctcccacctcagcctcccaagaagctgggaccacaggtatgtgccaccatgccaggctaaattttttttgtatttttagtagagatgaagtttcaccatttggccaggctgatcttgaactcctgacctcaagcaatctgccctcctcagcctcccaaagtgctgggattacagttgtcagccatcgcacccagccaaaggtctattatctagtatgtataagaaacttatacaagcttacaagaaaagaaaaagcaaccccattaaaaagtgggcaaggtacatgaacacttttctaaagaagacatacatgtggccaaaaaaatatgcaaaacgctcaacatcacctatcattagagaaatacaaatcaaaaccacaatcaaatgctatctcacaccagtcagaatggctattactaaaaagtcaaaaaataacagatgctagcaaggttgcagagaaaaaggaacttagacactgttggtgggagtgtaaattatttcaaccatgtggaaaacagcatggtgaatcctcaaagacctaaattcagaaataccatttgacccagcaatcctagtgctgggtatatatccaaaggaatataagtcattctatcataaagacacatgtatgtgtatgttcattgcagcactattcaccatagcaaagacaaggaatcaactcacatgtccatcaattggcagactgcataaagaaaatgtggtacatatacaccatggaatactctgcagccataaaaaagattgagatcatgtcctttgcagtaacatggatggagctggaggccattattcttagcaaactaacatggaacagaaagccaaatacttcatgttcttacttataagtggaagctaaatgaggaacacagatggacacatagagggaaacaatagacactggtgcctgctgaagagtagaggatgggaggaggaagaggattagggaaaataactaatgggtactaggcttaatacctgggtgacaaaataatctccaggaatagacttcatgtgtatcttttgaatagcctccagtttttgtgtaaaaatacccatgggggggctatgttcctggagcaatgcttcaggccccgtgacatgagcttaccctatgtaacaaacccgcacatgtacccctgaacttaaaagtttttttaaaaaggtcagatagtaactattttaggttaggtggatggtctctttccttgttgtatgaaagcaaccctagacaataaataaaggaactcacatggctgtgtttcaataacagtttatttagacatgttggggaaaaaaaagtcccaaagacctgaataaacatttctcaaaagaagacataagaatgttcaacataactagtcatcaaggaaattcaaatcaaaccccaatgagatacaatctcaggccagttagaatagctattattaaaaggacaaaaaataacactagcaaggatgtggagaaaggggaatgctcatacattgttggtgggaatataaagtcatacggtaaatatggaaaactgtatggaggtttctcaaaaaactaaaagtagaagtaccatatgatccagcaatcccaatgctggatatatagccccaaagaaaggaaatcaatatgttaaagaggtatctgtactcccatgtttattgcagcactgttcacaatagccaaaatccatattttgttaatgaacctaagtgttcattaacagatgaataaataaaaaaatgtggcatatgtgtgtgtatatacatgcacacatacaatggaatattattcagccacaaaaaaatgaaatcctgtcttttgcagcaatacagattgaactggaggtcactatgttaagtaaaataagctaggcacagaaagacaaatattgcatgttcttattcactaaaactgtggatctcatggaggtagaatggcggttaccagaggccggaaagagaataaggggcagtgaagagaagttggttaatgggtacaaaaatagttagatagaaaaagtaagttcaggtattagatagtacagtaggaaaattataattgacaataacttattatatgcttcaaatagctagaagtgaagaattgtagagtctccaacacaaaaaaggataaatatttgaggtgttggatattccaattaccctgatttgattattacatattgtttatgtatccaaatatcatatgtacccccaaaatatatataactatgatataccaattaataaacacacaaataaagaaaaaaataactgatagtaaaaagaatggtaggactttatggtaaaaagtctgcaaggtggagcttcccagtgattctcttttccacaattaggtttacttttcaatttaagggggaaaaaatctaggaatatagcttctggcccctgccctctcctcatttctcacaatgctgctgaaactattctttggttaagatgactgctcacttcctaatttccaaattgtcagtactcatccctctggacttcactggagtatctgtctttgctgatcactgtgctgaaatgctcccatttgctaggcttccagccacacttccctgactttcctcttactttgctcattgttctttttcaggttcctcttccttttctctcccagatgtgttttcttaaggttacgcctttgattcttttatttttattttgctctttagcaatctcatcccacatttatggttctaatcatcacatctatatgaatggtcaccataatctagtggtgacatctcaagttcttgtagttttattttctatcatctcaacctggatcttctggtagtaacttaaatatattcatttctgtcctaaagtgtccctttcttaattttgtttccaatttcttctaatataaccactattttcccaggtactaggctataaacctcaaattcattccctttcacctccatcatcacaatcatctaatttgttttcagtttctgatcaatttatattgtctatttgcaatttgtcccatcttaaaaattcttattcctacatctcttattcagatcctgacttctgcatgtaatattcaattatcttttagcaggtcatgcctctcccttttcccattcagttgacacagaattttcaaatcaatcttccgaaagcacagctgtgatgatgtcactctcctactcaaaacctgtagtacctgtagtaactaaaccaaatctatgaaactgatctaaaccccttcacttggcactaagggctacaacttacctttccacagactatgccctcccactggttcttaagtggggcaacatcactttactgggaggtttatggaaatgtgtgaaggcacttttggttattagaaagactggactgggggaggtggaagttgtgtcttagtgctgattctgagctttctggcctccccagaaaaggttgatccccaccactgtgactgtatcacacaacaaataattgttccacccaaaatccaagggtgcctcctgtaaagaaacaacgtggcttagacagactcaattgtttacttttttcaatttctattacatgtttttccatctccgttgcctagaatgcccttttcgtattttcccaaatgtgcaaatcttgcttctcctttaaggcccatggaaaatgacatttttctgtgggctctccctgtgtcccctgacatgaatccaattctcatgccatttccaccgattcctcccaaacaccacttcctttctatctggataataaattttcaattttgattataaacttaatgtcagcaaggctctacctttattttcctccgtgactagaagaacattgtacaggccagcacagatcctttatgttaatgtgcttaatatcacagcacacaccatgattataaatgaggctgtaaacactttggtttgtaattcattctgagattcttgccttggcctgcatgtgaaactatgctaattctaggctatgtactttaaagtcattatctaattttttaccccactttcccacttgagtttgatggccatgacttctcctccacaaattctgtttcttctgccaggacacaccacctccgattttccttctaataaaacttaggccttaaaattcttatttctcagaactgctccactgagtaccccctaaatccccactccctgcccctgcctcaccctagcttcatggatgctcccagtaggtggtccgtaagtatttgttgaatgaagagttccttggagtaggtggaagaaagtggctgtgtaattggaacaagatacagggcagtgataggacaaaggcacagacatttatttccagtcttagtagctgtgctcatagctgcacccacgcactctctccccacatagataccacaccatcactagaaagaaactggtactaaacttacatttgaaatcaccctagtcagtcttgaggatacaccactcaattattataagctttttaaaaataaaatcacctcatttaagtcttttttacattatgacgcgactgtttgtttccaaagtcttaagagcattttgtgccattccctgaagtgaaaagaaataaattaggcataaattataaaaggcctgatatggcttttacatgattcttaaagaatatggtcattttacattgaatatttgggtcctatattgtttagttgcaaacaaaacatccatcatcatcatcaacagtagatgaaagagaatatgtttgcttcccaaagcttgatacttagaaaattaagtgctttcagttcgcagatatgacaacttctctaccagaaaaacaaataaaaaacccatacaaataagcacatagctttccattttaaagagatagtctaatgctcttactgaagtgtgtgctaaatacatcataacttaatcagaacaagttgctgtttttacaaaatagtcctgtctatgcagagagagataatgccagtcacttcacatgacttgtacttcaacagacaaagtgtcatactgggactttttatcattttgattagaaattgggagtttctacactcccagaaaacaaagaaggaaggggaatagtaatggcttccagcatttacctgccaatgaatataatctgaaaaaggtcattgaggtataatcattcactcagcaaaaatgtactgagtacctactatgtgtcaagcattattcttaggatatatcagcggaacaaaaattcctatcctcatggagtttatggctttccatgctaaaatatgaatacaagtgatctccagtgcatgccctagcccaaatactttgttctttttatatttcacatgcttctctagggcaatcttgactttcttccctacttatcaacacactcaatatatatctcttttagaaattacagattttcagtaacaacttataaaaatattatctctttatacccaaccacatcactgaaaataaattaggtatctctggaagctgttttagccctgtcaggttattggatactacttggtgagagcaacagatagatataacaaagcaatactacatagtgactcaaactagaccgtgattggaaaacttgacttattttagaaccacatattttagaaccacatttctctcttgtgattttggaaaatctaagtacttaggagggtttgcctaattgaatgtgtattcaccacagggaaaataccctaggttttcatcatgatttttgttaattagtgaatcttatttatggaaagaacacttaagaggatctaattcttctacttctcaataatgaaattctctctccaatatttttgtcaaggtacaccctattttgcttttgtttaaacacttccagtaatgaggtgatagctcactatggcttaaaacaacttattctttttctgcctatcctttaaactatgggcccaggactcagcatgaaattcttgatgtggacattcctgtgccaagtatattgaaaatttccttctatttcacaagctaagtatcataaccattttattttatttttcatgtcatatgaataatgtgctagtgtcataacaaggtttgaaggaggcacgtatcacacgtgagcatgaaaatccaatgatcaaacttacactacaaaaagatcaattatttcaatgctataagtcagtccccatatcacgctactgacttatactgttaagtcacctaaattagtacttttaactttctggacttttcaggccacaaatatttttcaaagaagaaggagacacaggaaggagaaggaactgacatagggtgggtatatttttatttttttattagtaaagtaaaaaaatattttttattgattgataaataatttatttgttgccaaaaataaaaatgtaaaaaactattatctactttattatttcataaatcaaatatttctgataaatataaagtagtaaatataaaacctgagaatgaaaagttgaataaatttcactatatgaaaaaaagctaactacactgagctacttttgctatagaccatgaaaatgctttcatagatccaggtttgaaattcattgaacaagagagcaaatgtccctctcaactcctgatgacccatgtgcttttgatgtgcaatcgtttcactatatgctcgtgcaataggttgtatttaagctaaggccctgactttatatttgcccttatttaatttcagcttatgagttttcaaacattagaccattctacctttctcagttttgtgccttacacaaatataaaatgtttactttttcagtattcttccaagtcacttgttaaagtggagcaaggattaagccctatagatcgctttatccttccaccaggttgagtataactgttcacacacctgtagtactccagcaatcatccagatcacatttctctctttcataaaacagacagatccattagaggatctaaggattgggtttcaaaaggcttctagacccacttttcacccaagatttgtttgtgccccccacaaaataccttggtcaactagtcactctccttgtgttaaatgtctgcagtgttgagaaactccaaatcctgtgttctcaataaagtccaattcctgtcaggatagctctgttaaaaaactcttctctatattgagataaaatttgcattcttctaacatctgctcataggttgtattttgcccctcggggcccttcagaacaagtcattcacatcatagtcctttaaagatataatgagagtgattgtgttcctccaggtcttttcctggctaaaaattccctattgcttttctgaggtgttcatatgatatagtttcaactcatgtcactatttcaaatatctctgctaaatatgctccaagtgacaaatcttttttgaagggtgatacctataactgggcaaagctttacagtgtggtcctttgtacacagtaagaaccagaacaactcaattcactgaaacctacgtgaattcaattgtacttaacaaatagaaactcagggccaccctattagctcctcctgacccaggacttaactgactcactctaaaatcaatctagcctatgaattcagatctcatctttggtcagtatctatacataaaatagtcactgtaaaggatttttttctatcagttacagctcaaagtaattatactgtctttttttcatcttattaaaaataagacacaccatattaagaaaaatatcaagaagctgttgccaaaatcatccctgccctctatgaatatagaatgatttatcattctagcaaccttctcactgatttatacactgaacaaatatttattgaacatccaatatatattttatttctgctaggtacaggggatattaatggtgaataagggagatcaaatcactgacttcatgaactttctgtgtgagtgtgttatatataataaaggtaacaaattaatataaaatataacttcaggttgtgatatagactctaaaataaataaatatggtaacataataagtcacagctggaggagtgatttagggagaagggagattgatctctgagaagatgatatttaagctgagtcctcataaagtgaacataaaagaagttgtccaaactgaatccagcagcacatcaaaaagcttatccaccatgatcaagtgggcttcatcctgggatgcaaggctggttcaatatacgcaaatcaataaatgtaatccagcatataaacagaaccaaagacaaaaaccacatgattgtctcaatagatgcagaaaaggcctttgacaaaattcaacaactcttcatgctaaaaactctcaataaatcaggtattgatgggacgtatctcaaaataataagagctatctatgacaaacccacagccaatatcatactgaatgggcaaaatctggaagcattccctttgaaaactggcacaagacagggatgccctctctcaccactcctattcaacatagtgttggaagttctggccaaggcaattaggcaggagaaagaaataaagggtattcagttaggaaaagaggaagtcaaactgtccctgtttgcagatgacatgattgtatatctagaaaaccccactgtctcagcccaaaatctccttaagctgataagcaacttcagcaaagtctcaggatataaaaccaatgtacaaaaatcacaagcattcttatacaccaataacagacaaacagagagccaaatcatgagtgaactcccattcacaattgcttcaaagagaataaaataactaggaatccaacttacaagggacgtgaaggacctcttcaaggagaactacaaaccactgctcaaggaaataaaaaaggatacaaacaaatggaagaacattccatgctcatggataggaagaatcaatattgtgaaaatggcatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcaaggtactggtaccaaaacagagatatagatcaatggaacagaacagagccctcagaaataacgctgcatatctataactatctgatctttgacaaacctgagaaaaacaagaaatggggaaaggattcccttttaataaatggtgctgggaaaacaggctagccataggtagaaagctgaaactggatcccttccttacaccttctacaaaaattaattcaagaaggattaaagacttaaacgttagacctaaaaccataaaaaccctagaagaaaacctaggcaatactattcaggacataggcatgggcaaggacttcatgtctaaaacacctaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacacatttacaagaaaaaaacaaacaaccccatcaaaaagtgggcgaaggatatgaacagacacttcccaaaagaagacatttatgcagccaacagacacatgaaaaaatgctcatcatcactggccatcagagaaatgcaaataaaaaccacaatgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcagcactattcacaatagcaaagacttggaacaaacccaaatgtccaacaacgatagactggattaagaaaatgtggcacatatacaccatggaatactatgcagccataaaaaatgatgagttcatgtcctttgtagggacgtggatgaagctggaaaccatcattctcagcaaactgtcgcaaggacaaaaaaaacaaacaccgcattttctcactcacaggtgggaattgaacaatgacaacacatggacacaggaaggggaacatcacactctggggactgttgtagggtggggggaggggggagggatagcattaggagatatacctaatgctaaatgacgagttaatgggtgcagcacaccagcatggcacatttatacatatgtaactaacctgcacattgtgcacatgtaccctaaaacttaaagtataataataataaaaacataaaaagtaaaaaataaaaaaaaagaagctgtccatatggccatatgtgaaaaaaacactggtgaattaccaagtgcaaacataatataatgtttatataaacttgtacatgtgtacgtgtatttatgtttataagtatatatgaacatgtgtatacaaatatatattagacaatggaaatatttataagtccttatgggatgtgtgtgaaacaatggtagaatttcacaataattgagaaaggatcaactatttaatatatgatggtggcccaaatgtcaacactactaaatgaaatgatctctacctcatgttagacataaaaatatatttcagagggaataaatatctgtatgttgaataataatactttactcttttaacaacataatgtgggaaatatgtgacaaatttgttgatagaatgtcttaacgaggtacaaaaccacaaaccaggacacccagtaggtgctccataactatatattaaaataattaaaagataaatcatatgtttaccttaaagttcttcaaatcttctgtgactgaaaaattatttaaaaaatatttcaaaagacatgggcaacagagatatttttaacaaacctaagcaaattaattacaaaatacaacctaacaaaaatcggaaaattggaaaacgatataagcaagtcaccgaattagaaagccaaatagtcaataaatatttgcaaaaagaatgttctcactaggaatcagaaaattacacattaaaaccaatgagagatacttaatcctcttcagattgaaaaggcattttaaaaagtgataaccttgagcattattcacaatgtgcagagatgaaaacacttaaagagtgttgatgggagtatatttcattcaactactttagagacctcattgcagtattctgttccctctggagtttcatagaaaattgacatcagttgggagatctcagctgcaggtcctctagatcccacttttccagcttgttcttacttgttaatcaacattaagtccaaagaagcagtttccttcacagtttccttaatattcttagagatgaaattgtcagcaaggcaaatcaataatttaacacatgccctactttttgtagactgagaatctcaggagacgtccagagacttaaagtccctaatctttgttatttttctcatccttataacatttgtggtctttattaggaagtatccgtattatatcctgcttcttctcagataagagtgtttaaaatttctctatgtgtatcttgattcatggcttcaaaaccatttgtcatgtagaaataattccctaaaagtgtgtcactcttcagattttaagaaacatctgaattaccgacaagaaaatatttcttaacttttttcaaaccgataccttctttgataaaagaaaaaaagagtcaattctttcagctgatttgaaatttcaaaataaataattactaaaaataaatcaaatcatttggacaaagcacctttgcctcaggagattccaatatggccacttaaagaatgtcagtctttttctctactctctttttaagaatcgccttaggacaattctgtcttccatgcttcaaataaacattttggctgggcacggtggctcacgcctgtaatcccaacagtttgggaggccgaggtgggcagatcacttgaggtcaggagttcgagaccagcctggccaacatggtgaaaccccatctctattaaaaatacagaaattagccaggcatggtggcgcatgcctgtaatcccagctactcaggaagcagaagttgcagtcagtcgagattgcgccactgcattccagcctgggcaacagagcgagacctggtctcaaaaaaaaaaaaagaaaaaaaaatagtgtattttcatatgcataaaagcattaggaattatatataattttacacacaaaaagtaacttagttgtcatacctgtggacacaaggtttccaaatgattggctgcaattttgacaattttaattccatcttcatttgttgacatggaacaagcaagatttgccaccttaaatacaatccaaaataatggaaattattttagattagcaaggaaatgcagcaacacttatactgaacaagaacatgtacacattcatcaagaatctcaatgacaaataacattctcaaaatcatcactggtatctattttatgaaagaattcagagaatctattaaagcaaataacaataaaaggacctagataattgtttaaaatgaggagagactagtgagagaatcagtaaaccctatacagtctcttggtatcaacatctaacccataataagaagctattgtgagactggaaaaacaaaagtttatctgtggattgaatgctaataggtttttggaatctcatatgattgtgatttattttaaatttgtaattggtttattatttcccagaggtctattactcatatttaagttgcattaagtatgactgtatctttatacattttgtttgcatcaaatatactacaaagctgaacaaatacaagataattaacttcttcctgctcttgattttccactacaacttcatgggcactgtttgacattcctgcagtgcatttgattcaagcattagtgacacccaaatttctcttatattattgcttttgaaatttacattttcttccaacaaaatgagtgctgttttaattaccattatgtccatgacctaaatccaaggtttacaaatactttcttcagaccatgaaagagccatgatgaagagtgagaggttattttcccttcctctgcaccccactcttgttcaagattcttcttactaacacagtaaggcttatggacagaggcaatgttttctctgatctacaaaatatctcattgtctttatcattgcaaggatttactttatctaacagtaatttttctaacttttaaaatatctctgtcagttgttttatactttaacgcattgcagtttttcctgctaagatctaaaatacatccagttgcggagaaactacgcattagccacatgcagtggaaataaacaacatatgactttggatcactattttaaaagtaccacaaaatgttatttaaatggatttacagtctttgcttttttataacatttcttttaatatgccaatagtgaaataactcctcggttttcattcacatataatgaaataacagccatacattatttaactgtggaagggcattgctcactttattaatgtacatggggatggcttacttgaaaaggtcttttgttggcttgaaggtcacaatgcctcaactttcataatttctgacacataattagcacatttgtgagttgtttgaaaagggcaacagtttctgtgcccctttccactccccaaaccccaatcactaaaagtgaaacttgacagtctaattgctttaatttgtattatattaattcacactgcatttgcaaaaaatactgacctgtaaaattgagcactgtttgtttaaagtaaaaaaataaaaataaaaataaaaatcattggctcaatgtggtcaaattagaagaatgctggttaacccaaagcttagaaattataaaaaactggccctatgtagatacttttttattttacttacttatatttactgtatcctcattttcttctttttccttttgaaagtatacattcttcttctggatatttgctggccaccgaggcttattaaaagccaattaagtgactgacatagtatagaaattatgttaaacacagtgtgtgtttatattagcagaattaattttatacaaccctctaatgaaaatacaacacaactgaaagttgtgttttctactcaaagttttctgctcagtcatcatactaacactctttttgtcttcatgtattctatgcctgcacatacttgaacttctccttaccagaactgttctgtcaaagttactaggtaatagagtatatttcaagtcatgtgcagttttagtgctattgtgtacaaacaaggtcgaattttaagataagtaatatctgtgacaaaacagaaaagtgttagaaataaaatatctttacatttcaaatttgaatgattttatgacatattttctaatgttacatcagtgtgtgaataaagccaaatttcttctaatgatgattcttcctaaattctgcatggctctttagtcaagtatgttcccaagaacagtagaaatgtaattccctgctggtcaaagaatacagcctgcaaataagatgttctgtaaaaatagttttagatatttggacatttgatatcctttgtgtatctgcgcaaaatgtgggcaaagctttgttggtattcataagatctctgtagaatgtttctgctcactgagggaaacaaggatatcgggagtttttggagacaaacagatttgggtttgaacccagttcctacagttaataagcttctgattatgagcaagatattaaattatttgatcttgttttgtcacctataaaatgagtatgataatgatgacctcactgggatgctttgagaattaaacgagataatgtatggggagagtctgaagcctggtggccctcaccatgtatgaattgccttccatttaatctatctctcaactaatggaaagaaaaagaaaagaaaaaaagaaatttcatactctcagaggttttgtagaattaaagccttaggagcctaaagaaatttaacaatatgtctgacccaagagccacaaactcaaatgctttcaagagccatgcaggggatgggatacaaacattgagtctagattgaactcagtagtaggctggggttgtgggtccccagacaaaatgattatgtatgccctactgaaaggcattcattaaaacgagagaaatgaaaggaaaaactcaatgtcttagccaaactaacagtctgttggcttactttagttcacaggtcaccattttgtgacatttaaccccactctctaatcttatattgtataaataagaaaacaaaattaagcagggggatgaaacatactcaaaccaaccaatggcagggcgactattaactagcaatatgtgtatgtcctttttgctaccctgaagaaagtcttgaaaagcattctggcattgaaatgattgaccagactttttattggtattttgctacatccttaaccaagtctacaaaaagcagaatctaaattatcttaaataaatgggacaaaaggtagttatttaaatttacacatttattgaaaagaaaaacctgggacaaaatgttctttcatttttatgaaagattaaattacatccttaaaataattaccaatattgtaataatttaaaaacaaacaagaagtcttcaaacagggatatgtgtcttgttatgagaggagagtgaagttttttattagcatccctctcttgcagctctttccttcccaccattccttctgccctctaaaatgtatggtatattctaggccctttaaacatggctgaccttattgccctatttgggctctaaaaaacattgtagatgagaatgcctagccagacaattcctcagctgaacaatcatgttaatgtttgttcccttccttctggttcctagttcaagttcattttatttacttatttatttagagaccaagtctcactaggtcgcccaggctggagtgcagtggctcgatctaggctcactgcaacctccacctcctgggctcaaatgatcctcccaccacagcccctcaagtagctgggactacaggtgcgcaccaccacacctggctaatttttgtattttttgtagagacggggtttcgccatgttggctaagctggttttgacctcctgacctcaagcaatccatctgcctcagtctcccaaagtgctaggattacagccatgtgccatggcactgacccctagttccagttctgtatactagttagtatgtttctgtcatgatttccatttgctggactttgagtcttttctttcactcagcagagaacatagtatccttcactccctaacccatggtttcaggtgagaaattccctgttgtggagcctggccttgtagaatcctgacacctaggctagttctgtccctcactctctatcaaggtcaggaggatgatcaggcttgaaacaaaaggatgagtcaccagtggtagagccagggacggcaatgaaacagatattttgagatggaaaattttttcaatgaccctttaaaaaagatctaccatactataggttaagtctgcttttcatcattactttgttctaatctggtaaagatattctattttaaataaattgaatatcagagcatggtatgttttaacgttctagtattaagttttatctgaaatctcaggggcactggtagtgttctcagtcatcttagaaaactgaaatgaaatcattgttaggaatgagtacactatttggacagctgcttatcacatatcattcagtctgtcaccaagaagttcccacacaggtatttacctgtaatatgatctctccagaacacgaagcaaaccttgatgtttgctgagattttcattgtcacacattcattgtttatatattgttcatatagttaattgtaatatcatgtcaccacgtctcctagctctcaatgggggagaaaggtcactgtctcattttcatgcattttcccatctggcaattggtcatgcaactcttgtgtaaatacttccagaggcagataatttattgtcttccagggcagtctagtcccattgcaggacagcccaaagttacaaagttacacaagttatgaagttcttctttataaggagatgaaatatttctctcaacaaatttctcctacttgttctagaatacagaatggcaaatatattcaataatggaaataaaatggggcctacaaaaaatccaaatcaatagtcctcaacttgtgggataagagagatggtaagagtaatagaatcaccagtaaatagctattaaaaagaaaagtccaattcccttctgtcaagatattctgatacattaagtgtgtatacgcatggaagacagaggtgtaaggactgtataattagattttttaaaagttctcccaggtgattctgatataccacctcccccatctccaacacatacacacacacaacaacaacaacaacaacaacaacaatacacacatgacaacacacagatacatactaggattttggttaattttcatgtgtttgaatagacagtctttcccgaagataaatgtactgaggtgaaagtctaaaaaagaatgacctgaacatgtgtgggttagcgtaggaagtttaatagaaagcttcacacattagaggcaagaaataatgacttaaacttctacttgagaaatagagaaaaggctaaaaattaaaataagaaaatcaagtataggggatattctggccttccatccaaaatccattcctccctttggtaataacactgatttccctcggagaacagttctttttctaacctagtggtgtaaagtcttggtacgactgtcaatcaaggatcctggtcctcccctaggtctagcctgggcatatcccttacttactagtgccacctacagccctgaatcactctttgttctgtcgaatcttagccttctttcattctgatttatgtgcattaccttatgtcttccataaagtctttatttctttttaagtaagccaaatttattttcctttgcatacaaccagagaaccacgattcttagtaagtactgagccagaaacttataccctaagaatgtactaatctcagatggatactttcaacaaagttgaaagctggtaatgtataaccataattatttctgtgaaaggcaacttctcattaaatgcctgcctctgggtttagtcagcctgcatgtcctagtgttaggaacaaatgtaaggaaggagacagtcatatcagttcctgcacatacagataagtgtcttcctttgacgatctaattcttcaatgtctattagaacatgttacatatcaggtacaagagaacatctaattcttgaagaaaataatttatcatttttgagtttatctttcagcaagctgctcattctgtttgaaaaccacccctcacatactctttgaaaatcatacctatacttcaaggcctggatcaaatattgtctcttccacaaactcttttcagatgcccaggatccatatctttatcttcccacactctcgcattatagcgaattctccttctctctaaactcatttatgtatctatcagatggtgagctgcttgagggtaaagacgatgatatattcttttaaaaatattttcccatcaagttaaataccccgaaaatagcatttcatctatgtaaataaataaaaataataatttatctctatctggaactgaatcattgttaatataaattattgtctattgtgtctgaaattaacacatttggtgaattctattttttaaagtcctgtgtacaacttaatttgttcgttggaagctgtgtcctttcttccactccttcctaataaaaatgatcctaattctgtaccgtatgaatataaaggtaagaattattgctttaggttatggggggaaacacctgagaaaagaaagtccttaggttattaaacttaactgccccgagtggatttcagtctgactgtgtatattcattggaaacatcaagattagacaaatctgtagcaaagatacaaataaacagagaaaaactttgaatatgggtgtggaaataatctagctgaaatgtgttatttatttttaacttgtattggcaaaggagacttgggcttctttctgaatttagaaataaatggcagttcataaaagcttgtgaagaagcatgaagaaggaaaaatggtgtctatgccccttggacacagtagtaagtagcaaaactacaaagtcactagccaaatcactgatagatggaacactagaagttcttcaggttggtaggagatagcaagagttgaatcagatactttgagtttgagttgccactgagatacataagaagacataaactacatatagttagatgtgtagttaagagggggtctacagtagagatattaattaagaagttactagtttattgatggtaattagatatgattatgtgaggagaaaaagttcttggaggtatataagatattaatatttattaggcagaaacatgaggttactccttcaatgagacttagaaaaagtggccagagataagaaaggttgcccacaatactgtgatgtcatggagaccaggagaagaaaaggtttcaagaggatgatatcatatatcaactgctgagaggtcaagtaagttatccctgaaaatatccagttcagccacagagacaaccatgctaatcattcctagagtgttcaagtcaaatgatgatggttaaactagtctgacatgaacagaggactgtgtatgaggtaaagtaaccccatgagtcttatgactcaaggcagagagctacaggtcgcctggataatactcactctctcattctcccatctatccattttaaaacattttacctctcagtaatatctcaaatcatgtattaggttggtgcaaaagtgattgtggtttttgcaatggcagaaactgcaattacttttgcaccaacctatatttttgctgtcctctaccctagttaagattttgatcagttttatttattttattcttgtttccagttttagcttttgttgtcagcaaatgttctttctctacaatatgttcacattgcagccaacaaattttttcagatgcaaatttggttcccccatcatcacctttccatccccacatcatacccccatccctactacgtcttgcagtctggcctgagagtcatcatgtgtagttcttgttctctctttgcttcagctatatcaatgtacttttatgtatcaatgcttgcttctgccagaaaacatctgtacatactgttctctgttggctggaatgctctcttcctcccttttcacagccaccttcacaccacttatacttgcttaactgctatccatcagatctctgctcaaaagtaattccttggaaagtttttcaccaacactgtcctccacctccacacagaatacctgaaacttctgcccacctaagtcagatttttccttcagagcatgattctcagtttataattatatgttcactgggaagattatttgattagcatacatttccccagatttataaaagcagggaccacccctgtatttgctcatcattcagcctacagtgccagtacctgacacacagtagacagtctataaatagttctttggggagtgaatgaatgcatgaatgcctgaatcagtatgcttgagaatgtatcatcttcttgatgaacatgagatgacaaatagaagaaaaatgggttttaagggaggagtcagcagcagaaattcaggacaagaaataaagaggaatgaaatttttcctttgaaattcattttcaatattctacaaaggcttagacaactggactttcaagaaaagtacttgtttttcttctagtctggccatcatccttaacaaggcttggggggcagcttctttcaagttttaccttcacttaagatatcaaatatggaactactgaataggtcccaatttagcttttaatttatttatttttaatcaagtaaagtaactcttaaagggcccaagctggatgccaaatgttggcaagtgtggcagatggaaagaggcacagtaacttccatagacaaatccaagagcttcattgtctatttcagaatgtaatatatgctctgcttctgataattgcagaaagagctctgatctccccatgttggcaccgaatgacctctggctaacaagtcagcccttctctttctcctagtgaagcagcgctgctctgcttcccttggtagtaataagaaatgattatgaattatgggttctgtagaatatttaactaatataactgtgctgtaaaagcacatagcaaattgcagggaaacaatttcatcaactaacaaatattgattatgcacctattatgtgggctgggaactgtcagggaaatgatagaagtcaaaatcaatgaaagtgaatcccaacaagcacaatctatttaaagggacacgtgaaaggatcaaaaactaaaactctgtctccaaatactacaagaagatagaggtaggtgaacttcatagagatgactgtagtaagagtgttacatggagacaaattattacttaggaaattcatattctcttgaactttgcatctcaagctgcttcccaaattttatgaatcctcaatcacacaatccggtctctgatattagttttgctttacctctctgtctttggtcatccatctataagatgaggaacagattgacttcatttctagacctctttccatttcaataattttgttttactgcttatgtaactgataacaaaattagacagaaattagacaaaggagaagagctatcaggcaacgttcctattaatttaaacatgaatttgtagatgaaatattagccaatttaattcaactgtgtaataaaaaataataataaagcaagacaatgttgtttattcccagaatgaacaaatgactcatgactgagagatctaatactgaaattcctttttgaactggatatcaatagatttttaaaaagcattgatgacaggtttatgcctattctgattaaagcaaagcaaaactacactaaaaaacaaactcaaaaccttagcaatctatgaataggaagaataattcttaatctcaaacaaaatccagaaatttccagcaagtgtcatgctcaaaattcaagattaagataagcattcccactataagtgaggttaatcaatattttactcaaggttctagtaaatctaaatgaataaaaaaaagcaatagatgcaaatattgttaacaaataactatatttattcccaggtctcaaaattgtctacctagggaaaacaagattatctgaaaactgttattactattgagtattcggtaacacttcttcatgcagaatgaatgtgagatgaataatatatttttctatatattttaaaagttttcatgacaaaatttgttattatagcaactaaatattataaatttcatagcagtatatatctattgaaataagcacaattatagatatgtgtgcatatctatagatgtattaaattttacttaatgatataaaaagagaatggaatgaatagtgagaaatatcagattcctggatggaaaaactcagtattgcaaaatataatgttatctctcataaaatttgtctattaaatttatagagctatactgaacttaggtaaattttaatgtgcatctggaagaatatatgaaaggctggcaaataagttttataaaaatggggaatgggctgggtacggtggctcacgtctgtaatcccggcactttgggaggctgaggtgggtgaatctcctgaggtcaagagtttgagaccagcctggccaacacggtgcaaccccatctctactaaaaaatacaaaaattagccgggcttggtggcgcatgcctgtaatcccagctacttgggaggccgaggcaggagaatcgcttgaacctgggaggcagaggttgaagtgagccgagatcacttcattgcattccagcctgggtgacaagaatgaaactccatctcaaaaaaaaaaaaaaaaaaaaagaatgaagaaaagtattatgtgccagtaattaaaaacacaaaaatttagtgtttttcagggtaatggtaaaaaatattggtgatggcccaatttcctgctctctactttcaggagaaaagtgcaattatgtaaaaaggctagaatatattactacataaaaaattttaaatgtcaaaatattgaaaataaagttaaaatacaaaagataggcaaaactttgtttttatatttgataataaaaattattatccacaggtataaatagctcctaagtatcaataaggaaaaaaggccattaaaaatggacaaaatatttaaatagagactttacatatgaaatatgactaataaatacatgaaaagattctcagtctagctcttactaagcaggatattcaactaagcaagaaaatcacggtttttgctcatcagatcagaaatatgtaaaaagtttttgatattatccaatactgctgagaatatggggatacaactggaaggtaaatggccaacttttcagagagcaatttagtttcacctacgaaaatttaaaatgttcagaactgtagcaattcaatttaatggaatctgtcattcagaaatacttgcatatgtgaacagactcacagccacgtgaaaactttatttgtaaaagcgaaaatgaatctaaatatttaacagtggagaataaattatgtaatattatgattctgtaaaaaaaataaaatgttatgctgctgtaaaatatctcaagtatataattttaagtgagatactgcagaatggaaaacatgattctatttaaaattatttacttacatgaccaggtgcagtggctcacgcctgtaatcccagcactttgggaggccaaggcgggcagatcacgaggtcaggagatcaagaccatcctggctaacatggtgaaaccccgtctctactaaaaatacaaaaaattagccgggtgtggtggcgggcacttgtagtcccagctacttgggaggctaaggcaggagaatggcgtgaacccagaaggcagagcttgcagtgagccgagatcctgccactgcactccagcctgggcaacagagcaagactccatctcaaaaaaaaaaattatttacttaaaattatgtataaatgcaaagtataatgtccacagtgataattcctactgttaatttgagttatatatgggagagaaggtaggattactattgctatgaagagaagtatccccttttgactatgtttctatatcgactgaagtttttccaagtatatttttcactatattaacagtgaaattagttttctaatttacaaaaaaacgcgattgatgaaatagtcctatatgtattggtgtatatggaacacaccaatgacaagtaaaacagcatgtgtaataatctcatttatgaaagatggtaaggttttgtgtatgcatatggaaatgtgatatccaaaatgatcctccccaaaatggcaattgtgatgatctctgaggagtgaaaatcaaggtaatttcaactttccttttctatattcttaataatttataatttggcttattataataaaaatgaatcattttgaagagaataaaacctatctatacctgtatgtgaatttttaataccaatcaagaaaattgtattaatcatgacacttattgcgaagcctgaagatacagaaccatttataaataaggtttccagaaaatacacatatataatgattacatagaaaaaaatgctgctaagcagaaaatagttttcatggtctcatatgctgttatatttaaaatgatgattcacaaaaatgattgagaattcacagtagggaaacaaggcactggttttaccttgtcttaatgtcaaataatggcacaaaaacaagtcaattaaagcttcttatcaatgacaaaatcataccagccaatattgatcttaataatgaatttaaattcaacatgtttggaaaggtactctgtgcatggtgtgtgtgtgtgtgtgtgtgtgtgtgtgtgtgtgtctgcagcagatataaggtaatgattcttatgattgaataattataacatggtcctacatttcttcctttttcctatcttactcacacctccaattctattcaaatttgtgtctgaaattcttgtccctctcaaataagtcattaaagatgaaaatattcatttgtctaagtggacatatgtcaacattgttctgaaaaagaggtatcagtatgctgcgtcagaatgtgccatcacaaaagaagcaattgagatgaaaacacacatacacacaaactcaaacatatttggctgttacagtattattgcttccaataaattatgagaaatatatgttacatagctcaaattgaagtctgcaatgtagactgctctaagagtcccattttgccaaatatatttcccttttagtttggaacaatatataactgtaaatggacacacacacctcatattgctgtgtgatgtaaattataatggtaaaaccagctagatagtttattcaaggtccctctctaaattaagctattattcacctcagaatcaccactcaaaggataaaagtatgtgtcacctgcctagtaaatttaatataataaacagtaccaaataaaatatattgaagtaccaaagagatgaaacaaatctaaactataaattaaagacaggattaagtgttgtttcctaaactagtgttattctttgttgtcactgaggtcaagaataaatatgaagcatgcaggtctaataagtgtttattaataggatcattgtggaaagggtagatgtcaaaacaatgctataattagctttcattatcattgaaattgctgtcaaatttcaaagcaattttatgaccagtgacctgatttctcacatggcagaaagagaagggattttcttaaagagagatacaatatattaaagccaatataaagttttcagtgagtctatttctgaatcaacatgttttgtacatattgcactgttcaaatgctatcatgggaacagaaggtgttgcataggacaaagttaattgaattgcaattgtgtaaacttcctggatgtggatgagaccatcaatatcacctgattccctaactaatcacgaaatacacacccagattcattccttactttcacaaaagaacgggtctcttagtagaatgacagtaggcaatcaatcatctggcaacttctatcttcgaagacatcataacaataatctgtgaaactatttttttcctgtaggcatctatttattatgactttgaaggaaataggcaaagaagctttgaaatttaccataattataatcccagagaaagccccttgtctctgagtataaattgccgataatgagtgaaacaaattggaagaacactgtgtgtgtgtgtgtgtgtgtgtgtgtgtgtgtgtgtgtgtgtgtggagtggaagagaggcaagcacatttgtgtatgtatatatgaagtccgagcaaaatttacaaatatgtgcatgtactattattaaatactatgatttcatatcccctcattcttgggtccctgaatctcaggagggctccttgaatgtgttctgcatttaattatatgataaaaatgaagtatagctaattatgtaatatagaattaaaagaaaataaaatatttaggccctttaacgttagcaggggcataagctattacaggtttaatcttaactacccctgtacctctacagcacactgaaatactggacacatactgtgagtagtggccattactagaggataggataagacacttgcagtgtaatcttagtaatttttttaaatatatattatttatggttcctagtagttctagaagggaggagggaggagtaagaagggatcttgtatactaaccttccataattagagcaaaccaacatatgaattctatttgcacaaggttaaattgtgaaatccttgaagacagaaaccatcttactcctctttttggttctaagatattgcaagcagtgggttcttaaagcttctgttgaatacatttaacccaacattgcaaataaaatatttttcacgttgtcttctctatacttatttatgattgatctctttacagaggcctaaagacaacaacaaaatccacaaatatttattatctatcaggcatgttccaggcactgaaagaaaaagaagagaagatggggaaaaagtagttgccatgcttcaataaatgagagatttagatgtaaatacacaaaacatttagagctattaataatgaaaacatttaaatgacagtgtatactatgctaaacgagtaaaacactaaatgctgatgggcttcataataaggagataacgcagtgaagctttaaaaaatgttagctggatagttttaaaaagtcttaaagaaagacaatttctatatatcaattgaattgtttaataaaactctaaaaataagactgtcatataaaaatgtgttgatagaaaacatagaagttttaatattaataaatcccagtaacagaagatttttggataaatcagaaatgtttcgtttaaatacaaattctctttaagaaatagtgaatggtctaatgaaaactgttattgcaaatactgaaagttacattgcatgttattttatttctatccttattacaatacttcctatgtatttagttgttttcaattcttatgtcaagtaacatgaaacttaaatcaaaattcaagaaagcaatgctgcattcaaggtagctccatgcacatcagccacatggcactacatggttgcaccagccaggcctggattctcaccagcattgctcaaaggctctgagtctgagtcacaggagttggagggcatttgccatcaactagtccagtttttgaccctgtttcagaaggctggcttgcttgcactgcacctggagcctttcaaaccgttgtcaggctcagcctctgaagaaagaaatcccacagcattctggctttgctcagtgtatgccgttttgttccagaagtcaggagacaggttgcttccttccccagctcttgagggcagaggctgagctttctcacctatgagatggtaaccttaatgagcacctcccccttgggacacagagtacaaagcgtcctggatgctcagtagccagaaacagagaatgccaataaaagcccagttcatttttcatcacagaagttagagtcctaccctcaccttcagcctctgactactatggatccctcctgcccctggctgccagtctttggaaagcacacccacaccttgttggttaattaacactaatgggcagctgccatccctgcataaaaccacaaccatggctggattacttgagggctgattatgctgtttgtccaggcacaatgtttctcttccctaacagcctaccctttggaccctgatggctcattatcaccttccaccactggaagaacaagacaagactgtcagctgcgtcacttctcacatttccaagaaaaagcttaaatctaagcaatgccattctaggcgttctctgcaagggtttttagcttagcaaaatccctcttgcaatctttgttcatgattttgtctcaaattctgaattatcttattaagaactggaaactgttcctgcaagtgacttgtttttaaatttgcttttcagacatctctaagggttgctggcaactcaagtgcaattcgtgatttcctctttcccagcacattctatttagcctattaatttcaaatgaatgtattttccctgcatcctctagaagcggactttaattgaatataatatcctcccgccgccgcccacccctccgccgccccaactctagaagtggacttctgggcgggggcaggcaattatattcaattgatattaataggcttaatctattcacttgaaattaataggctaaaatctgttgctctttcttttcccataaatagactaatgccagtccctgctgtcttcctccattcatcttccacatcctcttttttcaaggcccacaccatcatcttcccttctctgaaactgaattcagtctctacataatcaatgtactgctgtgatcacagctggtactttctggtatctccaggaatcacagttgacctacctttgttgatttctgggctctgaactatcattcttttctcttttctcccccgcccattcgttattcttgtcacatagtttctttcccttcccactagttatcccatcttgtagaatacaaaatccctcatacttttcctctcattctgcctttttcacatcactgtctctgtggtaaataaaacataacaaacaatatgttttttttaatctttgcactttaaacatatatttatgtgcagagaaataaaaatatatttctctgttggtgaataattcatttcctgttgctttggaaatagagtctgtgagccaggggctagttttatatctacgtttagtaaattgaatagaatattttgctataatgcagtaagtgtacctgaaatcactgttttgggagccacaaattcatgagggaaaagcctcaaaggctatggtacattagttgaaccatagaaaaagaaatcaattataattgcttctccagttaaatattatgagttacagtgagtatttaagatagttttgaaaaaaacattttattatttcaagatctgcatcctagttacagtggccatttttattagtgggtccaataaagtattcgtatttatccttgctctgttagcaggtgctgatgaagtagaggttgcgctatgaatataggaagcagtatgatttgaaaaaaggagaaatggcagtataggtattggaatccagacagaatgaactttatttactgttatcttatattttactcatcttccatgaagatgactaacccaaagggattcatatttgtggtcccctcaaatatgtccagttagtggaaacacatcacatattttagagtatgactcaataatataactttaaatccttctaactctccactctttcatattctccagtaaaaagataaaacttgaagtatttatttagaagtcactatgcaacactgtgctttgggagttcataactaccttaaaaagacataatctgtaacaagaatcattctaatactgtgtgtccttttatgtttaaataagtatgcatgtaaagctaaaataacatgaataaatttaccaagtcaaagattttacttcatatatgtcacttttaattcattactgtagtcattttaaatccctaggtaagtttaaaaaaaagacttgtttctcttctacaattatactacggatgaactgtgcacctctctctctctctctgtctgtatagctacatacatgcagatatattttactttaagtgttcagaaatcttattatttcaaaaggaatatgtgcttaattaaaagttttggaaaacactgttaaatacaaaagagtaaatacacaaaatacacattttcagtgtggcagataaactcacccaatgcctactctcaactcctctttcctgtgtcttttctcccctctattgcatatcacagagctctggccatatctcctcttcatattggatacatccatctttcagctgctggggataactgctattgaccactcatggcatagtcgttcactaggaactgtcctaggttgtaggaaactaccttccccaaggcaatgtctcttcccaggggaagctcacaattaatgatggagtgagttgggattacaaaggcataggtcccttgcctctacatgtgacaattctgaaaggtcacctgagctccagagtccctaagagttcaggtaaggtttcagttgcaaccacattcattgtaagtcagctgctgcttctacccaattctacctttctcccttcattacaggcttatctctgaagattactccccagtaaatcttcaggatagaactatccgtatcaaagtatacttacggggagccaacttaagaaaatcataatacccagcaaacagaatactcattttttcggtctcctttattgctaggctgaaccatgtgccaatgagattaggcacagttccccagggaagaatttttccccccaccattagtagtcaagattcactagaatatattcctttgactttttcccctttgttctcctcccaactgggatgcagacaaaataccaagagggcagacataatcttaaaactataaagataaaagcgaacaaacataccaagcatccaaaagatccttggaaacatcattgagcaaatgaacgcatgctagcaatcaccaacccctcaactttttgacatgggagaaaaaaacaaaaatcatttttaaattgattgttatttgcagccaaatgcaatcccaagtgatacaattaaggaaccactctatctagaagtatatgtatatatgtagtagagtgttgtttataacagcaaaaaaatgaaactgtcatataagtgttaagttatggcctatccttaggaaggaaaattatagtcattgcaataattcctttgaaaaatgaagttgttgagaaatgctttttatgccatattaaatttaaagatataaattccaacacacatagatataactacatatagccaatgaagccaccaatcttgtgacacttctttgtagaaaaagaaatttccatgttgtagcatattgcattttctaaaaatggccagactaatattatgtctcaacccacataatctccctaaaatgggtctacactctttccattgaatctgggtaagggcttgtgactgctcctaacccacagaaactataagagataataaatgattgttgtcttaagtcaccacattttgggatgatttattatgcaccattagatgacaggaacagctgtgtgttatctttgttatttgatcttttgaaatatagtttaacttggaaactgaagacaagtttattcctttatttaaaacatatttaatatgtgcttactgctctttttcattgtgataaaaaactttcattgagagagaaacatctcttaatattagtttgtcaggtgttagaatccaggacccctgccctggaattgttcatgagtccaagcagttgtaactgcatctagcaaataatggtctgctttgctgtctccttgttaaaagtacttcaaaatgtatgcaaaatatgtcttatagccagcaggcttctcattccttgctagggactctgtaaatgaaaaacaaaacaaaaaacccaaagctacagcagaacacatttgaaattatgaatacaaccataaaaatggcaattctaaggtaaggtttgagaatacagaacttatctgagcctgttgccttcttctgtgcaaaagaaccattatagataaacaggcagcagatagtcacaattcaatgccatgatatgtggataaaacgaaacaaaggtcgagaaattagcttacttccagatgttctttgggtcaggctcatctatccctaacttctcatatgaaagttaaactgccacagcctgaaataatagataattgaaattctcattttcttcagaaaattctgcaattaaaatgttgatatttctttaaaatacacacacacacacacacacacaaacacacacacacacacacacacacacaaaacctgatatcaaatcttacattccctccacccagaaaacatgactaggtcatttaaacagtacttgaatatattcacagaaaatcagcaggtcaggtagaaaattactcaccctacacaccagttgtgtgagtgttgcagagtatgaaccgctgccaagatatctgtcattggcatatctccacttttcaatttgatacaatgtgtttaacctatcactgttattcagtgtactataactgctatacaagcacctgtgtgtttaccagagctttactattcccttggctagaaatatttccaaacaaggtactaaatataaatgcccgccattttcaaaaatatatatatataataaacattctccaaatattttaaaagcctacagttaccaataagcttttgtgtacataaattagagaataaggggcaaagaaaactttattagcataccattaagtacttaatttattatttttgcagtgacatccttgcaggatttcttctttaacatgaaaaagtcaacatcttaactgttgaaggctctgctttagaatcctaggggcatttccagacaagttctagcgattattgtgaaagtacctgtttctagaccaactctttaagcagaccactaaaaagaccttttcaaatcttccatgtaaaggaaagccttgaaagggagagagctagatagatacatagatacacatatatagatagatgatggagatagatacagagaggtcagatgataacaaagatcagattataacaaacttaaatgtaggtgctccagctagctaacagagaataacaaatcatcacacagtttagtgacttaaaacaattatcacataatttacaatctaaacttgtaaatcttgtcaacagcaatcaggagtccacattatcctttaaaccaaattttatttccaagtagaaaatattttcttatttaattgtatactgatctgaattcaatgtatcttgtacatgaaaatagcaacttggctctgctgggtaactgaagaccatgtttgtgactggaagcatgttattaatctacttaaaatcttcattccttaataaaatctactccctgtcaacatttattttagaaactgaaatctttgtgagcatagctatattggcatcataagctctaaatggaagactacttaagggcatcttcttatttctagtagagttaatatcattactaaccccaactattctgatgaaataggtatctagcataaacatcaatcatcttcttttataactcattgataattccccatggtcccttgctctatttttcatctgttgtaacacataaaggggttcaacaactactttattctaagctttctctgctgcaaaccgaaggttactaattcacttcattaacaattacaagtatttgtatctgtcctcacaaattcaaaattgaccattttataaaagacatatcccttctcttcattctacctttgttaggtatatttttctatttccaaatatttattttatttccaaatcatgattcattcaaataagttttacacaaagaagaaagtacaagatgtgtaacagctctagtagagaacatttcagctgtgccacaaaaagaaaacagcaatataatggtgtgctgacaaaataggccaggcatggaggctcatgcctataatcccagcactttcagagaccaagacaggcagatcacttgagcctgggagttcgagaccagcctgggcaatatgacaagcccccgtctctgcaaaaaatacaaaaattagccaggcatggtggcacatgcctgtagtcctagctacttggcggggttaaggtgggaggattggttgagcttgggaggttgaggcttcagtaagccatgatcatgctactgcacactagcctgagtgacggaataagagacttggtctctctgtctgtctgtctgtctgtctgtctgtctgtctctctctctctctatatatatatatatataaaataatactttacatatattatatatattttacatatagtatattttacatgtgtattttatattttacatatatatattttgagaccaagtctcttacttgatccaaacccccagatcccccccaaatatgtatatatatatatatgtttatatatatatatacacacatacacaatatattagacactatgtaaatgtctgaaataaattttagttgggttctttattgagataattacaaattcacatgcagttgtaagaaataatatagagacatcccttgcaaactttatccccgtcttacaaaatgttaccacatcatccccctgtggtaacattttgtaagactatattttcagggtcttgacactgatataactcactgatcttatttttctccagttttacttgtattaatttttcttagtgtggtatgggtgggtgtgcaataagtctatacaattttgtcacctgtgtaggttcatggattcaccaccgcagtcaagatgttgaacagttcccacaccacaagagtattcatgttgcctttttataactatatccatctccctccttcaaaatcccacatcctcctgctagctcagtgcccccacacaaccactaactattccccatttctaaattttattatttcaaaatgttttataagtggaattatatagtatgtaatcttttgggatttttttcataacataattcttggagatttattcaacctaaggtgtttatcaacagtttattcctttttattgctgagtagtattccatggtatatatgtacaatacaaatatgttctcccattctttagcttgtaattttattctcacatggttttcacaaagttagcattttacattttgatgaagtctaattcatcaattttttaaattcacacttcatgattgtggtatcaaggactctgcctagccctagatcccgaatattttttcctattttgttctaaacattttgtatttatattataattttttaatattttacctttgtctctgatccattttgagtttatttttgtgtacagtgtgagacttcgttcggaactcattttgctgcctataggtgtcaaattgctccaacaccatttgtggaaaatgctgtctttcttctattaaattggttttgcatctttgtcaaaaatgtgttgaatatacagatttttgtgtggggatatttatgggtcccctattccagggctccccaacccctgggccacagacaactaccagtctgtggcctatcagcaaccaagccacacagcaggattggtgagtgaactttactgcctgatctttgccttctgtcagatcagcggtggcattagattctcatacgagctccaaccctattgtgaacagcacatgcaagaaatctaggttgcacgtcctttatgagaatctaatgcctgatgatctgaggtggcacagtttcatcttgaaaacacccctgcctccactcactatccgtggaaaaattgtcttccatgaaactggtccctggtcccaaaaaggttggggatcgctgccctattctgttccattgatctatgtgtctatgctctggcaatgtcacaccactttgattattgcagctatagtgtaaaacttaatatcaggtagagtacttttccccactttatttacctctttttattatttaactatttttgctattcattgtaaatttagaccacatgcatttatatttccaaaaacttgccaggattttgaagaaattgcatataaatccttttgggaactataatgaaattaaagaaagaaacagaaatgttctaggataacagagcaaaggcagataaagttctggcattggaggaagactaataaactaatacaatatgaaaaaaattgatgtgaaaaaatagaatatccacttgaaccatacatgcggacgtgtggataggcatcagcattccagcacaacggatgggacagaaacaaaaaatgagattatagcacaaagagttaactttaactatgtagtcatcacagaatgttatgggagcaaaacaataactcagtcacagcaatagaagtgtcaattttattataatagtgctgaccttttttggggcaagtggaaggggtagggagtagaagactgtcaataaagacatgtctgtatggaaatacagacatcttttgttggtaatctgctaaaaccacatacttttaaaggtgaaagagagatgaaaatacattatgttattaaggtatactctaaattgccaggcaagattgagaaaagtgatgaggcttccctgatagagactccacaattagaaccaaagcagtacagagcagcaacctgagcttccatcattcactcactgggattcccatcaacatacagcatccttggcaagtcttgttcagatggaaaagcagtcacaagaggagtgctcttctaatcctgtgctaaccaatctaaaagcatttgtgactgaagtagtggaaactctgaacaaaattaccttgtaaattttagtttatagtagcccagatatgtggccatgctagattccaaaaacttcagagaaaaatgggtataattaatgacctcttattctgacactttgagagggtttgaaggctatcaataataattctgtgatctcaagcaaaaaagaaaaaaaaaaagaaaaagaatgcggctgcacctcagactccatgagaagcttatatgtaaatggacaaaattcagaagaaataagtgcctcgcacaggccttaacacacaagttgtgctcaatcatgtttggtaaaagaatgaatggacattgtaaaaccaaaaattaacatctaaagggttcatacactacaagccaggagagtcaaagtatatatcatctgttcatctaatcattccatcattaatttattatgagcttcttgctttcagggtcccatagtccagagtgaaaaagtgatatgcaaaccaaaaaatcaaaatacaggaaagtaactatgactaggtaattgtttaaaatactttgggaacaggcaggctggagttattaattaactatatttggggaaaagaagactacaaaagtcttcacaatgtagttaacatttaagtaattttgaagaatagcagagatagagagttataaaaattactcttttttttttttttcttgagacagagtcttgctctgtcgcctaggctggagtgcagtggtgtgaccttggctcactgcaagctccgcctcctgggttcaggccattctcctgcctcagcctcccgagtagctgggactacaggcacctgccaccacgcccagctaaattttttttttttttgtatttttagtagagagggcatttcaccttgttagccaggatggtctcgatcttctgacctcgtgatccacccgccttggtctccccaagtactgggattacaggcgtgagccaccgtgcccagccaaaaagaactctttatatatgtttttgaaaagaagaagaaaagagaagcatatgctatcaaaaaagaaattcagtgctggaatgataatgagctcagagcaaaagtaaagagataaactgcctatagattgtttggagagcttaagttgaaccctccctagccattcccaaagatgcaagccccctataaaaatttggagcacctaacactacaaagtttgaaagaatattatctttgatatgattcctccctgtctgttaacttccatgtttccatcccattggccctgcttttatgtatcctccattggcctaacagctctcaaccagaggttttaaaccctgacagctcattagcatcaccagaagaacttttacaaaagccttccacttgtgtcccttccccagggattctgattccactggtttggggtaagggaccctgtgttgcccacagcggctgatgcccatcaaaagggcattaggaaaatcactctgcgggaaatcactctggcccgccatggtgaatgagtgtttttaagaggattaaacaaacatcaaaaagaaaaaaattaatgtcatggagttccataccatcttaagacttaatgattcatatgccattacacagaaggaatttgcccaagatagctatgaattgtagccatgatctctaaaaaagagtcgaatatgcgaatcctacctaaagaccggggacaagtgatccttaattcatacaaacagtaatggggagacactaaaatgttttctgaagaacattgacaaattaagatttgcacattataagaaatattctagctacatacaagaaaaaatgattgtaaaaaaatcaaagatgattcccagacttttgtttgggaaaccagatgaacataaatacaattcatcgagaggtaatggagaaaaaagtacaggcgtggcagcggaattagatgaggacagaagttctcctttagatatgctgatttttgggtatatatattacatagtggtttatacacaggttggaaattcaggagaaaaatcattacagatgggagatgtgtatttgagatccatctgcatatagctgggttgttaaggcaaagaaatagataagcttgttctgggagggtgtgtagaattctctttaggagaagaatacctagggcagaatttaaaggaacgctaacataggcagtagaaaaacacccacaaagtagattcataggaaatggccagagaggtagaaggaaaatcaggagagtgtggcataataggtgccagaagaaaagagtgtttaaaggaggaatgattgaacaatacttgcaaacattgcaatgatttcagtggagaatgcgactgaagtttgattagagtgaattaaggagtagatgggaggtaaaataaaaagtagaaataagaattagaaaaggtttataaagatggtggaagagaactttccagtgcttatccccacagagaaacattaatttgaacaaatatccatgcacaaacaaaagttcacaagagctaaagaaaccatgtgagagattacagaagctgagtggagcacagaaataagaaagacacactgataaaggtaagaaggacagttttaaatcacctgtgaagccgcttcacaaactgtatacagcacggacacagacagcagcaatacccaacccttacgggaaggaaagtgagcaccaaacttactgtggaacccaacactgggcctgctccagcaaaacccaacttcacgcaggcacctatggccccagactccaggctgatacctgcagactaagcttccaggcccacctggattctaggatagctcccacagccctgggatccatgcctgctcaatagactcaatctctgggcctgccccactgccaggctgaccccagcagccctaggctcgggaacagccccagtatcaggcaagccctaccagccctggcccttggtcagaaccagacatcacagatgtaggcataagcctgacccaggaccaggcctgacacaggccagcaccttgggacccagcctccaggttaagccccacagactcgggcttcaggcttaccccaggtttcagacaagccggaagctaaaacatcccatgcagtcccaggcctcaggccccaacaccagattagcactcctggtctcaatagcaggggactcaaatatcccactttcagcaatgaaaaaattatccagaaaaaatatcaataagtaaacatcagattaaaactacactttagaccaaatagacccaacagacatatacagaacattcccattaagcagcagcagaatatacttttttctcaaacacacacagaacattcttcagggtagatcatatgttaggtcattcacaagagcttaagaacccatgtgggagattacagaacccgggtgtagcacagaaatattggcaaaacaagtcttaacaaatttgaaaagatgtaatcatattaagtattttttctgatcataatggtaagaaattagaaatcagttaactggaaaaatttcaaaaacttcacaaatatatgaaacttaaacaatatgctctttaacaaccaacgaatcaaagaagaaagtaaaagagaaattaaaaactattttgagataagtgaaaagagagacacaaaacagcaaaactcatgatgtgtccggaattggtgggttcttggtctcgctgacttcaagaatgaagccgcggaccctcacgatgaatgttacagtttttaaagatggtgtgtccggagttcattccttcagatgttcagatgtgtccagagtttattccttctggtgggttcgtggtctcgctggcttcaggaatgaagctgcagaccttcctggtgagtgtcacagctcttaaaggcggcgcatctggagttgttccttcctcccgtccagagttgttcatccctcctggtgggtttgtggtctcgctggcttcaggagtgaagctgcagaccttcacagtgagtgttacagctcataaaggcggtgcagacccaaagcagacccaaagcttccacaaagaacaaggcttccacagcctggaaggaaaccccaacacgttgccaccgctggctcgggcagcctccttttattcccttatctgaccccacccacatcctgttgattggcccattttacagagagctgattggtctgttttcacagggtgctgattggtgcatttacaatcctttagctagacacaaaagttctggaagtccccactagattagctagacacagagcactgattggtacatttacaaaccgtgagctagacaaagagtgctgatcagtgtgtttacaatcctttagctagacacagagtgctgattggtgcatttaaaatcctctagctagacataaaagttctccaagtccccaccagattagctagatatggagtgctgattggtgcatccacaaaccctgagctagaagcagagtgctgattgggtgcatatacaatcctccagctagacaaaaaagttctccaagtccccacctgactcaggagcccagctggcttcctctagtggatcacgtgcaggatccctgggctgagctgcctgccagtcccacaccaagtgccgcactcctcagcccttggggggtcaatgggactgggcgccgcagagaagggggcagcgcccatcggggaggctcgggccttgcgtggggaggggggttggggggcagtgctcctgcatggcaggctaagggtcccaagccctgccctgctgggagacggctgaggccctgagagaattccagcgcagtgcccgccggccggcactgctgggggacccagcgcaccctctgcacctgctggcccgggtgctaagcccctcactgctcggggcctgctgtgctggcctgcggctccgagtgcggggccagccaagcccacgcccacccagaacccgcattggccggttcccacccgcgcctctccctctacacctccccacaaggaaagggagccggctcctgcctcggccagcccagagaggggctcccacagtgcaacggctaaaaggctcctcaaatggtggccagagtagatgccaaggccaaggaggcaccgagagcgagcaagggctgctagcacgttgtcacctctcaatgagatgcagcaaaagcagttctaagatagaagtttatagcaatagacacccataataaaaaggaagatcccaaataaacaaatgttacacctcaaggaactaaaaaaaaaaaaaaaaaaaaaactaagcccaaagttagcagaagaaaggaaataataaaaatcagagcagaaataaatgaaatagtgactgagaaaatgatagaaaaaaaatcaacaaaagtggctttttggaagttaatcaaaatggacaaatctttaagtagactaataaaaaagagaaagactcaaataacattatgaatgaaggaggggacattacaactgataccacagtaatgcaaaagagtataagacactattatgaataattatatttcaataattgaataacctagaagaaatgggtaaatttctagagatatcacccacccagattgaatcaaaagaaagagaaaatccaaacaaactcataatgagtaagaagattaaatcagtaataaaaagtctccaatcaaagaaaacccaggaccagatggcttcactgcttaattttatcaaacatttaaagaagaattaattccaatccttctcaaactcttctgaaaaacattgaagaagaaatacttccaaactaatttcatgaggttagcattaccaccataccaaatccataaaaggacactacaaaaaaataaaattacatgccaatattcctggtgaacatagatacaaatatcctcaacaaaatactagcaaaccaaattcatcagtatatttaaaggaacatttatcatgatcaagtaggatttattccagagatgcaggtatggttgaatataagctaatctagaaatgtgatacaccacattaacagaataaaggacagaaaaatatgatcatgtccatggatgaaaaaagcatttaacaaaattcaatatccttttgcaataaaaattatcaaaaaattagatatacaaggaacataccttaacacagtaaattccatatatgacaaatccatggctaatatcatactggatgcctctaagattaggaataagacaaggattcccgttcttttcggttctgtctaactaaagtgctgtaagtcccagccagagcaattaggcaaaagaaaaataaatggcatccagattggaaaagaggaagtcaaattgcccctctttgcagatcacatgatcttataaatagaaaaaattagtgacctcactaaactactcttaaaactgatacattcagaaagttgcaggatacaacatcaacatacaaaaatcagtagtatttctacagactaacaacaaactctccaaaaaagaaatcaagaaaactatcccatttataatagctacaaaagcaataaaatacgcagaaataaatttaaacgaggtaaaagacctgtggattgaaaactctgatacattgataaaagaaattgaagaagacacaagtagagttatcccatgttcaatgattaaaagagtttatattgtttaaaatgtctgtattattccaagcaatctacatattcaatgtaatctgtattaaaatgccaatgtcacttttcatagcaatagaaaaaaaatcctaaaattcatatgcaagcacaaaagatgctgaatagccaaagcaatcttgagccaaaataacacaatcagaggtatcacattctccaatttcaaaatatactacaaagctatagtaatcaaaacagtgtggtactggcataaaaacgtacacaaagaccaatggaatggaatagacagtccaaaaatgaacccatgtatatatgatcaactaatctctgatgagggtgccaagaatagaaaatgtggaaaagataagtctcttcaataaattttgttggggaaaatggatatctacatgcagaagatgaaattagacccttttcacacaccatatgtaaaaatcaactcaaaatggattaaagatgtaaatcaagcaatacctgaaactgtaaaactgctagaagaaaacatagaggaaaatctccatgacataagtctgggcaatgattttttggatatgatctcaaaagaaaaggcaacaaaagtgaaaatagacaaatgggattacattatgctaaaaagtttcttcacagccaaggaaataattaacagagtgaagagacaacctatggaatggaagaaaatattgtaaaccatatatctgataaggagttaataccaaaaatgtatgtgaaactcctcaatagaaaaaaacccaaataacccaattaaaaaaataggcaaaatatctgaataaacatttctccaaagaagtcatgcacactggccaacatgtatatgaaaaactgttcaacttcactaaccattaaggaaatgtaaattaaaactgcaatgagctatatcaccttatacctgttacaatggctattatcaaaaggaccaaagataagtattggagaggatgtggaggaaagggaactcttgtacactcctggtgggaatggaaattagtacagccatatggaaaataatatagaggtttttcagaaaattttgaaaataccactacaatatgatcttgtaatctcacttctggatatatgtccaaatggtatgaaattagtatgtcaaagagattgcctgcattcccatgttcctcacagcattattcacaatagccaaaatatggaatcaaactaaatgtttgtcaacatatgaatggctaaagaaaatatggcatatacacacaataaaataccatttggtcttaaataagaaggaaatcctgtcatttgagatgacatggatccacctgagggacattagtaagtgaaataagacaggctttaccacatgatctaacttacatgtgaaatctaaaaaggttgaaatcatagaagcaaagagtggaacagtggttaacatgggctgtgggatggggtggagttggggaaataatggtcaaaggatacaacattgcagctggataagatgaacatgttcaagagatctattgtacaacccggtgagtggagttaatagaactgtattcctgaaaattgcttagaaagtattttgtgttcttaccacaaaaaaatgttaactatgtgaagtaatgcatgttaattatctggattcagcctttccacaatgtatacatattttaaaacatcatgtggtacatgataaataaacacaattttatttgtcatttaaaaaattacttaaggtttagaaagtagaaattagaatagttacctctttaaagatatttgcacaattaaaaagatttttcatgtttcttttttgaaaagtaacatatatacaatctagtactaaaccttaacagatagttattattttaagacgacagaaatgtgaacattttacttctgatgaagagaatctataagagagaaagatggtgatgctaaacaaatgagaaattataattattaaaatacaacaaggtatctgggatagaagcaagacaggtggaaagattcactcatgctttgccctgccaggagggaatattccagtataatgggcagaaaggaagaaaacatggaatgaatgcagtatgattaaaagtctggtgataggataaggatgcatctctagtctagtggcttcaattttctcagcaaagtaggaggacaattctgatagtaaggaaggaatggcaggattttaggtttgagagggtgaagcgggtgaaagcactgcagagacactgagggagataactaggaattacagaagaattgccaaagagcattgaagtctcaaaactcatcttaagttggataagtacacaattttaggagcagtgataggtaaatggcagaaagtatatacaagtattaagtaacttcaggctcaattccatccaccgaaatgttgggacttacagaaaagcagattcaatatggaagacgtggctcatatctgtcataggaataacagaagaagtagtagtaaacgtttattgagtacttactgaatcttctgtttaaatgttttacataaattttagtacacggccagtaaatagtgttattattttcagtgttctaatgagaaaaccacagcacaaagaagttgagtaattttcccaaggtcaaccagctacaaagtgcagagttttaaacagtgaatccaatgcatgtccagagaaaagtgagcaggacagcaaaggatctctgcaatataaggaagaattagataattgaggatattttgcctaaataagacaggcagcagcaaataacgattgcttcaatacttaagtagttgctatatggaaaaggaattagagttttacattatgtttcttcagggagcaaaactaaaactaatatgcagaagctgcaatgaagtagatttcatctggaaagaatgatttttgtagccatgagaaatacaggtgaagtagaaggagcagcttcagaaagtgaagttccagtgaccaaggagtttgagcccagaaagggatgttaggaaggactttatacataggtgagagaggacttgctagtttatgtaaagttcaacacccattctaacactgaaagtctgcctctagtgtgcattttattaaccccaataaacatttacttttttattttctccccagagtaagcatgttggcagatacatgaagcacttggatccatgtcatgacaatatttggatataacagataagacataatgctttgccaggactgctagacctgggctttcaattgcttccagggctataataaattcagatgttgggggaagagagaggaaaggagagagtgctttttgttgttgttttttgtttttgtttttgttttttgcaatgtagccccttcccaagagtaagaaaaaatattcttctgacaattgtaaagctgtttcctgccaaaattgtcattgttaaaacttttaaaagataatccatatgtccccacacttcatactcttgcactttcatgcaaagagctcaaataagaaaatttgaagtttttctctgagtagaggtcagtgtttctgatgcagtgccagttttaatgagaagattttattttctctctctcttaagagaatggcacgaggaagctacatgttaagaagttaagatggtctctacttggacctgatgctaaaagaaggttcatgccatattttatttgacattgtaatcttgatttggctgcccaatttattgaaaagattaatattctctacaggttttagatagcaaattttaagttttgatcctgacttgccttagagagcctttctttataaagcagctctcgttctttaatcttatagcaaccttactgtgttcttgctcctgttcttcaatgtggtattgtttgtttacctgtttgtgtagaatgttaggatgccacagttaaaaacaacacacatcccaattcattatgatccataggcatcacatgctgccactaatatgtacggtaaagcttacaccatccaatctgaagcaaatgacaaattcctgactctttatttcaggcacttctctccttgatttgtcttcttcaacagctgtcatctttgcaatttctcccaaatcagaccctatattactgagcaatgtacttgcacactttcatctttgtaaactactgcatgtctgctgctttataatttttattttattaattgagaatagatttccacccatttttcaataacatgcagcaatcttagtcactaaatattgtttaaaataaattctgcaattttcttacctgaaaatcagatagttttactttttgcttcaaattattacaaagctaccgtatgggaaggcagtcgtgcaattaaaccctggttattaagaattttgagagggaaatcgaacatggaaatatcacagctgaaatatttacacttaagtccttgtactttttttgctgattgttggaagcaaacccaatcagcaattttggcagtgagtagctatagtgtaaaacaaagatggagatgtggatacttatcatggagatgtgtgtccctttcaatttggtctgtctgatgaacagggagagaaacattgctactttattgttttggttgttattgttttcacaactttcacctaactctagtactctagtaacttgtctgggagacctgggcttgagtctgatttccatcacttgtcaatgactagaaaattctctctctctctttctctctctctctctctccccctccctctctctctctgcattcatttcttcatttgaaaatgaagagctagattggatactctctaaaatcctttccagctctaaaatcttgtttttatgagacactatttctggaatgagcaattaagaaataaataaataaaaatttaagtgatgtgataatcaagattatgtaactaaaaagatatgagagaataaattaccttttaaaattcctgaacaactcagtgggggaattattctgcctcagtgaaaatataagagaggaggtcaatgttctgtgttatcacataattttgacaaagccaatgagtgaggctaccgttaagtgccagcattggagagtttgcatgcaaacacaaaagaagtaaaaagcggaaaaaagaagaggtgtgacaaatggaaggtagcctgatcatctgcctgcagcctggccttctctctcttttctaaaatattttttggagacagggtctcactctgttgcccaggttggagtgcagtggcctgatctcagttgactgcaacctgtgcctcacgggttcaagcgatcctcacacctcagccacctgagtagctgggactacaggcacccacgaccacacctggctaagttttgtaattttagtagagacagggttttgtcatgttgaccaggctggtctcaaactcctcaagggatccccccgcttcagcttcccaaaatgttgggattacaggtgtgagccaccatacccagcagtttttttcttctcagtcatattcattcatttattcactcattcaacatgtattcactgaatgaatatttattaaatgcttatgatatacctgaaactcttctaagaactgggactatatcattgaacaagaaaattttccataccttatgaactttacgttttagttagggagacaaaaaataattaagaaaacacacacacacacacacacacacacacacacacacatacgtgtagttcaatttaacttcagatatacaatgctcaaataaaaaatgaagcactataataagatagaaactgactaggtatttagatggagagagaaggtctctctgaggaggtaactttgagtagagacctgtataagtgaggaagagaaccatacaaagatttttagaaggagctaaagttttatttagaaggagctcagttttgtaactgagatctttgcttctattatattttctaacaggttgttgtgagaaaagacttagaaagacctattgtgtacttacaaggaatatttaaatgccgaaagtggagctgctatggtctgaatgcttgtttttttacaaatattcatatgtttaaatcctaacctccaaggtgatggtattaggagatgggacctttgggaggtggatggttaatgagagcagagccctcatgaatgggattagtggctttaagaaagaggtcccaagggagcatgtttatctcttctgccatgtgaggacacagttagaaagtattatctatgaaccagaaagtgggccctcaccagacatcaaatctgcccgagctttgatcttagacttcccaacctccagaactgtaagaaataaacttccgctgtttataagctacccactttatggtattgttttatagcagcccaaatagactaagaccctaggagatttaatgaaaataaagtacttctaggatctaggagtcaaaatatcattatgacaatattgacaatattcctgggttttttttctttttcatagtgacagggtctcactaagttgctcaggatggtctcaaactcctggtcttaaaagatccttctgccttagtctcccaaattgccggtattacaagcatgagccactgtgcccagcctattcctcattctaagagagaatagggaattaacctatgcacatgggttccaagatcttacctgcccatttgctcatacaactggtgactgctcattgactaaaagaatggagaaaggggctttgctctatttctacttgtgtacctcaagatgccagtgtggttcttctgtgagatcactaaaatattagttgatagtcttttaactcactggtttttgatccatgaggcagataagatagcctaatttgtgatatgcctccaacctcttaacttgtgataactctaaggttaggtgggacatccatatttctttagggacaaccttcatactgctgtagttcttagagttgtgctagagagacaaagttatgggattgagccttgcaaaaatcagtgaccaacttgtcatctcataaatatgtggttggttacaaaaggtccctgataagaaagtatgaatgcatacaaaatttatcataaattccttcaacatagaaggtatgctttttgcccaggaattttaacttgttatttcttctccctagaatgatttctcctcagctgataatatgtatcacttctttaattcttttcaggtttttgctcaaactcagagaagtcttccttcacttccctatttaaaattgatctctactctcattatcccatatccccatttcctgctttattttctctccaaagcacttatcaccatctaatatatttattccttatttattgacttttgcctattgaaatgtgagctccatgggatcagggatttctgtatcttttattcaatattttcccaaggcctatggcaactaatattggttaagtgaattaatgagttcttagtgtgtttttgttagagtttggtatattaagtgctcagtacagtgcctcgtacatagtaaatactgaataaattatagctataattattattcataaaccaactgaaatatatattttttgatactaaacaattagatcagtcatgttagaccattcatatcactattttcattctgccaattttagaatctaatattatattagtccattttcatactgctgataaaaacatgtctgagactgggaagaaaaagaagtttaattggatttatagttccacatggctgggaggcctcagaatcatggcgggaggcaaaaggcacttcttaaatggtggtggcaagagacaaacccctgataaacccatcggttcttgtgagactgattcgctatcacgagaatagcatgggaaagaccgccccctatgattcaaatccctcccacaacacgtggggattctgggagatacaattcaagctgagattttggtgaggacacagccaacccatatcaaatgtcattttctttttaaacctcttaaaacatttatattagttaaaaataatttcataaggcagaagaagtaagtcttgaggtataaagcattgatctctactctcatatcccctcttggtctccagggttttaagtgcaccaaaacaaaacaaaacaaaaacaaaataaaaaaccaacaactatgtacaatgtacaccttggccactattgctggaaggctaacttttattagcctgaaggttgttgatgcaggctttatcaccgaagagattaatgtaaaattgctgagagtctgccaacagggtaaatgttcccagagagatggcaaaagcagcaaggtaagagatttaagtgcctcaacatttcttattaatttttagtgaaaatgttaaacagtcgaatcaacgtatggtggaattacaattcagctcacagttagtttgtaaaaatttcatgcagcttcaaaaagtctggttcaaaaactggtgcactgctcaccatccatacacattataaaattaaaaagttctggatgccgcaagtgacctctacatttgcagttgttaaatccaagaactttagaaactagaaaacatatgcttaaaaacgaattgttgtttatctaaaattcaaatctaacagagtcttctctattttatctggcaagtctaattcatggggaaaatacattctactaaaattctgctgctaaattaacttttcttaaaacaatggagacattggtatccttaacaacattaatcaattaattaagacatacattcttgcaatgacaaaacatatacaatttgcttactggtctctctgaattcataatcactaactttaagagggcgtttagcatacacctgcaatcctactacattttgctggaacttccctactgtcctagatgaccatctcctaacttttcttcacctcttaaatatgcaacaaccctaccattttcttttgtttttgcaggtacactttcttcccctttcattaacaaatagaagcaactggaagagctcttctacttactttctcaacatctattcactctctcagtctatgcccatggccttccttcctctgtcctttctgtctcagtcctaaggccaatccttcctcttaagcaccagatcccatctccttttgcctcttaggggtatttctactacaattgttgtctgcttccctccttcaagatcctcaactttatcttctctaatagattatttccatcagcattcaatcatgtagcaatattttcatctgagagagagagagagaaggaggggaggagggaaaaaacagggaaaggaaaggaaggagaaaaatgcctcctttggtctcatatctaccttcaagtataatttcatttatttgtttcctccttcacataaatcctgcttaaaatgtttacctacttactactttcaattcattctatggtctttcctcccttgaacccactccagtcaagattttgacccttcttcactgaaattgcttctgtctaatttaccactgacctccaggagctgaatccaatggcacattcttcgtcctcaccttaattgctgtatgagtttcctagagctattataataaagtaccagtcttatcttactataatctattctctacacaacagccagaatgatctgttaaaaggtcagatcatgttacttctccatctaaaacctctaatgattcccccttttttcagaataattaacaatgtccttacaatggcctaaaagctggcccctccccagtcatgaccatcaactcccaaaccaatgcaccgttccccttatgtccctttcacatacctcagaatttactcttcccactctttgggaccatcgtcctccaaatttgtccaggatattttcatgactttctcacttagtttcttacttctatgcaaaaatgtccacttaaaaaggtttttgccttttacaaaaaaaaaaaaaaaaatcctcaccagtaacccaattatgcctttcccactttgcttttcacctaggcttaagaccacctgacacattacaaatgaataaaagcaattattttgtatctctccagtttgctgcctttctctcccactctactggaaactaacttctaagaagactgagatttttatctcttgttttctattgctagtgttgaaagaatcactgaatcaatcagaacataactctaaaaagttaatcagagttcagttctgtacaccaagttaaagtcttgtaaccagtgaatacctagagcaaaattaagaaaagattgtcctttagaatgcagaaacttctgcatacttataaaatcttataaaattgttacactgtgaattaaacatagttttctcctttttaaattagcattagtctccaaagaattttttctagttggacaaagactgctattacttatattttctctcctttgtcaccttaaagagtaaaattttttgccagttattcttttgtttcccttaatataagattagaacctctgtagccatttcaacatacaaattcagcctatatctctcctgccaaatgtcttctgtactaattttatattttatattaattttttatcatatacaaaaggttaatcttttatacaaaagattaatctttattctgtgtcctgctgaatacttatcagaagtttaatctcccccagacacttttatataaatatttatagggttgacattgaataataaaatgaaagctcctgatactcttgccctgtcacatctcaaatagtttttttaaaaagtgtcaatcagatttatagcactaactaagtcacataattgagcacagcttgaagaccctaaatttaccaaccataaaaggaataattttaggaaacgtttggagctctgtatgtaagttactggcagagaccttcatgaatattggtcccatctccatgcagagaagagaagatcttggcctctgatctagttgtggggttggatgaagctagcctagtagttgtgagccttgtcaggccctttgggaaatgacagatacaggctcattatctttggtgccatgactacgacaagcctgaaatctagaaacatgactattaactgactggaatcatctaggtatgttccgtctctcctactcttcctggtagggagcagaacatagcattcagcccagaagctgatgttgctaggaagaaaaatcccatgggaaaaaaatctctctcactgatatttctcactgggaaatgctcattgaaataatgcctttcaggatcctttgataatattattcaattttgtccttacgacaatattataaagctttgctcatccaccctggctgaatatgagtcagctgaaaaaattaaaaaaaaaaaaaaaaaaaaacagagatccagaccttcctacaaactggataggacccagacatctctgttttgtaaagactctcccagtgatttaatacaaatacacagagcggataaaaaattatgtaaaaaagattggctgggccaatgtagttactctgtataacaagtaagaaaacaggtcagacaggttaagtgacttacccaaggtcacactgccaacacaaggtcttctcttgccatcatatcatggtgccctctcccagcttccccaatttctactatttcatataaattttctgccttttcagttaatgaagcttacttcagctcatttcagctcagaggagaaaaacatgaacaaaattggactaaaatgggtgtaagaattggttcatggaggataaaaagcattggatttctgccagacccttcaggatgtgaatcagtcaaagaaatcaagtcaacacataataataacaacaaaagcaacaactcttttggtattttacatagtaaagccctttgcatgctgtaatttcaataatgattcctgcaaatgcaaaagtcacacaattttatctctgtctttgtattcttttttatttcagacattctttgtataggcttagatttaaacaacataaatatctgagaatctttacccaatcatgagtctgaaaaagtcaattgatggattcttataaacattgtctaacttccccgacccatctgtttcaatgccagcataggccagtaaggccacatttgtccattgaggatttaaaggcctgatgttctaaaagtctgaaagatcctcagctgtggagagatgacagtgtcagaaattcctgactagcaatacttttatatgatcataacttctttttaatcataaaacacctcttttgttttataaattttttcccttcacctttctaaactattctcagagattacactttccaaaaaatgatatttttgtcacatattacaactcaagggccaaaacagctggtttatgacttataagtactttgtgaattgcttgagctggtggggaaggttagacaataggaacgaagttttcctactataaatcattgagtcacagaatcttagctttctagaactagaaaagataaacacaatctaatataagtccaacacattgcaggcgagaaaacaggcccctggatgttggtaaccagttggggccaaacagggaattctggacagagcagacagtagaagccaagttcgtttgccttgactcccatgtattttcctaagccagactgtctactttggagtatgagatcctctgagcacatctaactctgtcttctccttcaagattcaattcatttgctgcctggtattacggaatttcaggaatgaaagagatgctaaaatcatcctgtccattcagggtttgacttttttctaccatggtccccaccacagggtcaagtactttagtaacaaaactcctaatgaagcagcctgttccatctttggatactttggattaaataacttataatatttagctaaaatgttttcctaaagcaactgttaaaaaattgatcacttttgtcatataagagtctcttatatacttgaacataggtataataaggacaccttttttgcattttccccagaataaccattgcttgcctttaaaatttcttcatgttgtgccatcctaattgctctcctttatatgccattaggttttgaaatatgtcttaaaatgtggtattcagaattaaacacattattgtaaggactgctaagaacagaatttttctttcttctttctagaatattctctattaaataaagcccataaatgctcaacaggagtgatatcacccccaagaggctgaaaactggttcttggggaaaaaaaacttacttttttaatgtataaagcacatataatgtacataaagtacattaacagatatgttatgtacttaaatatctgtggtattcaaatttcattggggaagtgatcagaaaaaaacatttttagggactccttaaagggataatagttttttttaaaaaaaggctgtgaaacagtgatatagcctaagatcacactagcacattagctattttatcagagaatcatactattaacccctattgagtttatagtcaagcacaatccttaaaactatctatctaacctacttgtacaactgttgaaaggtattttcactaccgcgaggtttccagtgtgtttggttggttagatgattggtttgtttttgaagagtagtaattttttttttgcctaattttgttactataagagcacaaagttaaatttatttctgataaaattgcccttgttaggttttatctattcccgcctgtccagatattttggaatgtaatacattcattattttctgaagctctgattatttgcaaattttatctcctatcatcttgattgctcatgccagtaatttgcagaaacaacgttaagagaacagagctgagaatattgtcccgcacacaacttttccattttgtgttaaagtatcagcagtatgttttgactaacatttcttcatcgaggtattaatgttactaactgtacatttccttacataaaatccatagttttctatttttttttatttgtacactctgagaaagaatgtcaagtgtctcacagaaatccagattgcctggctctagtatactttctaacagcctagtaagccaagtgaataaagaagcaagatttagtcttttgtttttctttaataattctgtgctggctcactctcattacttcttcaatttatctatacttaagaggttctttttagtagtctgtacagacatctcttcccagcacagcttaaatattctattgactgcatttctccctataacagtatttgtcagttacatctagttggctcttgctctgtttgttttcatgggcatatgccttaacttttcaaaaaagattataaactcccagggttgaagcatatactcttatagtgcccacagctgcccattaaagtatcacagaagatgataaaaataaattgtttgatttactaataacaaactactcactatcaaatcagattgatgaaaggatcatgaatcattcactcacaccctagcccaggtttacagattgttttaaatgcttgcttctaataagggtgtattaaaagagttaaatgctttcttctaataagggtatattaaaagagtttctttccaacactcaatttactaatttatcactaagaaatagcgtttttgctaagtaataaggaaattaagaactgatgatggaaaaggaaactatataggggaatataatgggaaacataaaagggaaatatgtctgcaaaaagtaggattacaaggtcatgtttctttagaatgaggagcctgtttccattttcacaaattaaaatcatttgaaagcacatatacttatcaggatgggttcctaaaacttttttctcaactctcatatgtgtgtgtgtgtgtgtgtgtgtgtgtgtgtgtgtgatacacatccacatatatacatacatacacatatatattcaaagatatataatcttatatataaaatatattggccgggtgcggtggttcatgtctataatcccagcactttgggaggccgaggtgggcggatcacttgaggccagaagtttgagaccagcctggccaacatggcaaaacccgtctctactaataacacaaaaattaaccgggtgtggtggtgcacgtctgtaatcccagctatttgggaggctgaggcatgagaatcacttaaacctgggcggtggaggttgcagtgagctgagatggcaccactgcactccagcctgggcgacagagtcagaccctgtctcaaaaataaataaataataaaatatctcacatatatattctatatatatatatctcattgtgcaaagttcccaaattagacattttgactacattaaaaacacaatgactacttggataaaaactggattaccaaattatctaaatgagccatttgtgtgctatttgatggtggtatatttttatatcttggatattatccatatactgaatatatatgttccaatattctaaatctctaatataattcaattacttgaaataacatattaaataatctgagagagggcggagaacgaattaagcctcaattatttttacaatatgctgtatgcttggtgttaacacaggtgttcattcattattctcaaggcctttttgtatagctaaaatatttcatattataataagttgtgtgtcatagcagatcatgttaaaagaaatctaaagttgcccgagcgtggtggctcacgtttgtaatcccagaactttgggaggccgaggctgatggatcacttgaggtcaggagttcgagaccatcctggccaacatggtgaaaccccatctctactaaaaatacaaaattagccaggcatggtggcatgtgcctgtagtcccagctactctggaggctgaggcacgagaatcacttgaaccgggaggcagaggttgcagtgagccgagatcacaccactgtactccagcctgggtgacagagcgagacttttgtcaaaaaaaaagaaaaaaagaaaaagaaatctaaagttaaaaaataatctaaagtttccattttgccattcaactgccatgtttacccacagctcctcttttctggtagctgttttcagttaaggaaagggaacactgggtggaggatgggacaggaacactcctttcacagagggctctgcatatagcagtccccttgagcatgaattttccaagctttgataaaatctattgaggaggtaaagagaggattcatctttaaaatattgtcaatgtatagttaattaaatagagtttattctgctgcaatcttacagccctgagaggtacagaatgctgaggttcataaatgctgtcagcaacacagtgaggcagtgagggtgaggagaggaaggggggataaaaacaattgcatgaaaaatagaataaattttgagatgtcttctaaatcaaagctcatccaatatggagaattgaaaaaaaattaaacaaggaacatttgagattcatggtatagaaatctccctttccctaaacattctttaaggtcttctttcaattatttctgacagttatggcaacatattatgagagtaatatgtccactatgggggggatacgcattagttcactattgttgccataacaaattaccacaaacccaacagcctaccacaacataaatgtatttgttctcagttctataggtcagaaatctggctgggttcagctgattcctggggtctaaaaggtccaaatcaagttgctggccagcctgggctcttatttgaaggtctgagcaaagaaagtacttccacgccaaggtcagtggctgaattcaattccatgctaccatagaactgacatctcaatttccttggggctcttctccagggatggttcttaacttccagagatcaatcactttccttggctcagcgtccccttcctccatcttaaaggcagcaacaataggctgtgtccttctcacattttaaatccttctaacctccccttctacctcttctcttctaggctcccctcaccgactgatttttctgttctccgattctgcccttaaagggttcatgtgattacattgatctcacctggataatctaggctaatctcctttttctttaaacgtcaatgattagtaatattagtttcatattcaaaattccttcaaaacattacctaggttagcatttgattataaccaggaatgggaatcttgcagagacatctgaattctgtctaccacagggtgtgcccaccagattcaaacagacctgccaaccagaaattggcagtttgatttatatttctcagtctatgaaacataacatttctctaaatgaagcattcttaaatagtatttgattactcaagtggataacttcatggctaatgataaagcttttctattagaagtttccattaagaatgcttttgtttgagttgttttgtgttttaaaacaggacttggatttcttgggagaagctgtttaaacaaaggagagaggatattatttgattacaattagagatgtctttttgtaggaagcaattatcagtataaattaagaaccaaactgcaaattcaattattcctaagtatttactagagaaacattagtttaactgtaattcttctggaaattaaccccataaaatatgttataagagcattaattgcatttttatagttaaaatatgacgcaataacaatattacaaaagctatttgatccatattaattttgtacaattgctgaaaaccatctattgaaatcatttttttaatatttgaattggagtgcattaggttactcctttgaagatttatgcattacccaagaaagagaaaaccaatttttaaaaataccaattaaatgaagatactcagttaaattaaaaaataattctaatgctccaaattcttgctgtgaatttgcttattgtggaatcagaacatatttgaaagaatgaaaatggccgattttaaagtacttttgaattttctgttacttttcttgttaaaccctaaatagttataataattgtaatgaaaatgtttttagttactgacctccacatgagtggcaacatgagtttcacacagttacatatattcagctgataaaccaggtagtaaaaggaaatgattaagatcacaggactctgaagtcagactacctagatttcagtcccatttgtcactttatctgaatggcttgaggcaaattattcagcctctctatgcctcagcttccttctgtaaaacggggataagagtagtacacattactcccagggttgctgtgaggataaaataggataatacatacaagtaaatacatgtaaagtcatgtaaatgtttcatagttggtatggactaaataaatgctggttattattcttgaagtgatgtccaatgttaggccctagactgacaaactgagacctcaactcttcaaacctgtcagcattaggatatagaggcaaacagccttggcctcagtagaactgacctgtagtcaagtcagctgatcaacagagagaatggaggaaggggctgaagagtccctacagaactccagcaattagctctgtactcctactggctagctatgttttcaccgctacaaagatgctatcgatatatccctcatcctggccattcaccttggtcattcattttttatcaaaaaaaaaatagtgagtacctaacaaagttataggctctgtgtgaagaagatataaagagctgaattttaaaattataagattttctgctcttacggagttcacagtcttgcaaacaaacactagcaaccccaagccatccttccttttgactcactgatttaaattgaacaagaaagccactttcctattgaaagtaataaaaattagggaaaaaagatgaaaatggtatcatgagatgtcgaagttgaggtgctatcaatgctttgggggttatgtatcaaaatttccttaagacttttttacgacattgtcactcacagttttattaaaacagacactcaaaggaaagctatggaaaaataacacagtgtctctggttcctacaaggtatttggttatggtgggagaggagacgtaaattacctctttacttccacatacccacagagaccctccatcacatctgcttttctccacccacccgagcaacacccactatcttaataccaagtgctgtataatcaactgagttaaactattttcaatttaagctcaagaaagtttagaagagctccttaaggagtagcagtttagatccaaaaagctcttaagattgatcagccttctttcatgcagtctatattctgagggtctcagaattttaggcttagaagaaaattttaatatataataaaattattttattcttctaaatatttgaataattttctcaaagccatatggatgttagttgcaaatccagatctgggccttaaattccatttctatttcaacttctttccacatcagcatgtattataattgaatataatgggcatttactactgccaaggatagattctaaagtactgattcaatctattgctaatgaggcattaaatgtccacagctgataacaaatagcatgaaaaatatttgaaaacagaatttatcaccatttagcaccactttagtcagattgcataccacctttgtttatgtattccatcatgcttatctctttgttaaagatttttgttcgttaaatcaccatatagacatattacatacattaatgaaattataaacttgactttgaagttgatgtagctaaaaaatattgggaaaagagtaaaagattcattaagtgttgctaaattgtaagtggttctatgttatgtttccaaacaaaagaaatcgtctacattacaacattgtaaaagtaatgaccacaaataaaataacactttaatacaccaggcttgctccaatactgaaatttttcttttagtttaagatacaaaactcctagacacttgtttattaagaatatctttactggtggaaaatgatatatttaagcttccaatttatgaataattaaattcctatgattagatataccaaatacagccacatcgtcaaaggatatactacataatcttaaaggcaatgaagattagatatgggccttattatattcatcatttcaaagaaacatcaaaagacatctgaataaaataaacaggagtttttatttttatttttatttttgcttgtatcaagaactttctgagcacactgtctggcaaatttagagtgtcagattagaagttcaatggcaatttgattcttgtctttgtaaacatttttacattctaccaggaagtgtataggtttttctttttattattgaaatttagaaatctcacaataatatctagatgtgagccttctttcattatcactatactaactcagcacttgttaattttttttttggtctgaagcctcaagtctttagctcaagagagtatcttctcctgtgactattgtttctcctcaatcaattccatctattcttataagatttatgtattgggtgttagtgccaagattctctaatatttgctgagattttctaacttcttcttttaaaatctgacatatgggataactccttgggtttgcttctgatttttattgatagctgttgtgctcttttcttgtcctagtaagggtttttatttgcttttgggtttttttgttgttgttcttttattatttcttcaaaacaatggtcatcttcttttcagtttctaagtccttggtattcagtgtatagtgtaattaaggttatgggcactgaatgtaggtctttctagagccttgggttagcactttcctagctattttaccttgggcaaggtatattaactatgcctcagttttctcaccacatagagataatgtgcaataatcttcagtaatattaccctattgctcctttgcatagcagtgtgtttgctcttttacagagtgaagaaaaaaaaaacctcccaaatatcaatgaggacatcaattagaattctaaatcattatcttttgtctacctgtaatatctatatttcatttgttctaattcccagctttatccctattctctccaatgatgggtaatactttattatctgttcatatgtatgcgttcagcgttagattgcccatcctagtggttgatacgggctccctctgcttaggccacctttgatgtcatgaaattgctgtgttcagggcataaagaggaacagaaaggttgatttattcccaggtgcatatgctggaaatgaacctgatacatctgtttcaaagagaaaaagcaaagttaaagtgggtaggaaaagctccaactgcatttagaatgccgatgacaccaagtggaagaagcaccagggcaaatatttcagctatcttctctctgcagagctctaataaatcctagagggcctcttgtgtgattctctctgacattcccactctttcaaatgggggttaaacaacgctacagcttcccaagcataagattcccacagttttctgctggaaagactgtctacttgcctctcagggcttccttacctggtttatattgagcaaaacaaaagccattgtcagctccttgattaaacccgatccatctgctgctgcttttttttttctttttaaataaattactgaaagagtatgcttgcttgatgttacccttcctattttctagtattactacatacctttttgctcattttgtgcttctttagtcattttcatggggttaagatatgaagggaagaaaaaaaatgagttggtttaacttcccatcctaaagctggaaattatattttggatcttgaaaataaccaaaatattcattatttttatggcagttgagttagtcgaggaacagattctatgtaatgtcatgttaagttgcttatttagctaaaatgatgcaaagtaaatagctgtcaacatgattaaaattacttgcaatctgaatttaattaaattgagaactatgttattttcctactttctccaacctctggccacttaattagtaagatttacttttagttcatctcaaaatttctgtgcttatggtcaagagtggttatgtgaacaactcaaaagagacatccagcctgaatcatttttattggcacagataccattatgtgactgtttgggttactatttgccttcttaattatattatcttcagcctaatacatgaaaataagatttcaatccctgtggctatgacagaatatttgggagatactatctggagaaagcaaaggctatgccacccagaaatttgaatctggaaacacagaagttgcaacctgactatataaaatcaaaaggaccaaagagaggtgcaaggtctcagagctattgtttacataaaaccagtcatgtctaaatcattggaagaaagcttttgtacaacggaggatttattttctgttaacataaataatgggaatttctacatgttagagttaaaacctttaaaacacacacacacacacacacaactgcaatttatcttattccttccaggttgtgaaatggactgggggaaaaagaaaacggtgacagagaaagaggttagactggcttgttctgtgtaggcaggctgtcaaaatggctgctgggataggaaaaggtattcaactttatgcagtgaaggaagctgtacagactcctcctgagcgtctgtgaggtcaaatgctatgcaccccaatctacttcctgaaattaatagccaggtgttatgctagttactgtaccttaatcattaattatgactgtggcagcaagagagaaaaaaattctaggatacatgagctagagtgataaagggaaagcatcaatcacgcatgacaggaaagccaaaggtaccctctctctgcctgggatactttcatttgtgactgcagattttctcctacatcagacttcaaacttcagagaaaccatttctcatagcctgcctctctctctttctccctctcacaaccagctatggtcctaggactcaggaggatgaaaacaaaataaaacacatttgttagtaatgccatattttccatgtactaccaccaggatctatttgaaattaaaggtaatttatacaaataaaatattcagtcaagagatgatttattcaaaaaagcaagctacagcaagaatggagtttagagtcaatagttaataaacattctggcagcacaggctggcccacatgccttcatttttctacaatgtcataaatgtgttgcatgtcatcttaaacaagtgggcagagcaggtgaatctccctcaaagtctcatggcacagtctagtatgttacaaatcttgataagcagaaacccaagccacattctggtggtactgagtggtcagaaatggggtatttggaagtaggaagaaatacattaatttagttgaatggaaggaaactaagttgggttctactttactatggtattgtggatagattacttgacttctctagcattggtttcctgtttgtaaatgactggtttgagccagatcaggaacccttattctggggtgacataggagcttcagaggatctggcaggaaactcaaattataggagaaattgttcagcatattatttaagtgttactaaaaaaacatacacactaaaggagtgcttctctaactatctgtagtgaagaattagcactttgtaatttccaatctgctatgaaccacctccttttaaaaatcatacaaaaatgaaataaaaaataattttatacaaaatagaagcccactttttttttaatcagactcaatagatataaaaatactccttcaagttgctataaagatgatatggtatggctgtgttcccacccaaatctcatcttgaattgtagcacccataattcccacatgtcatgggaaggacccaatgggaggtaattgaatcatgtgggcggagctttcccatgctgttttcatgatagtgaataagtctcatgagatttgatggttttataaaggggagttcccctacacaagctctcttacctgctgccatgtaagatgtgcttttgcttctcatttcccttctgccatgattataagcctccccagccatgtggaacctctttcctttataaggtccattaaacttctttcctttataaattacccggtctctggtatgtctttattagcagtgtgagaatagactaatacaaaagattttaaaatcttcctatcaacttgggtcattgtaatggactgaccagaactggaccataggtcaaactttgagtaacaactattctaaggttccttccagctataatcttaaaactttctatgtaaaaaacagatatccctatgtccattctgcctcaactcctcctgccaaaaccatacaatctcacttgccattgcattcagcactataaacggaactcaatctaaaggtccatcttccttgaaatgcaatgaaagattgtaaataataatgacaatgacaacaaaatatgctttcccttgtcactggtgattatttatgttccctgaacaacaaggataaaaatgagggaaagcctgtaggactacttaccactagaacctaggccatctgctccctgacctagtagttccctcatctatgcttttgtgctctcataattatcctgactcagaaagcctttactagcctttcccctattccctacctgcagtcttttcaagatccttactgcatttattgggtactcaaagcttatctattaagcacttacaaatagaagaggataaaattataattatttggtccctgtcacatacacacacacatgcacacatgcatacacatatatacatatatggcccctgcccttaagttgtctagagcaattcaatgtttataagtatgttatatgaagaatcacaacagggaatgcagaaggggcaatgacaaaagtcaaagttagacaggaagggtcacataagacttcttagaagaacacttttggggctatttcttgagtcatgactatctggtgatctggctgtaatattaaagaggcttagtcagctcactgaactattacttgcagttcttcccttcctttattgctacatatttggtctagaagtacattctttccaaagagtcgactcctctttcatcaagagtgttctaattaactaaggggggaaaaacatgtgtatgagagtgtgtgtgtgtgtgcacgcaagtgtgtcagttttatgtgtttggtgggagaaaggcaaagaatctgggagagcagcgcatgtaaagtaatgtttaaaggctggagaaggagggaccaccaggtcatgaagcttcttgtatatttccctaaggattctggattcatcctgagcacactggtgactcattaaaaggttttaagtaagggtgtaatatggtcaatgttttgtttttaaaagatcactctagcagcatgatgtaggatatctaggtggtgagcagggtggatctggtagtgccaaggtgttcatctaataattcaaatgagaaatcatgaaatcctagactaagtcagtagcagacaggaatgcgaagccatttcaatctgagacagatttgaagcacaccaagaaggcagaattactggctatgaatcatggacaaatgaatgaatgaatgatgaatgattttgaggatactagcttcagcaattgggagattggtgatttcattccctgaaagagaaaaacactcgtgtaaatacaagatgagagtgtaacaaacaagaattcagatttaaataagttaaattcaaggtgtctgcagaatgtttatatggagaagtctgttgggaggtagaaacaggagtctgtagttagaagttgggtctggactagagaaaataagttgatcaacagtaactgaaggcttgagatgggtgtgattacttcagcatgccttgcctgaggaacttcattccactccaatagatttgattttaccccagaagtattcttcatttttatcacctgtatgttttccttaataggcattgtataaaaatatactcttttttactaaataaaaacataagtgggaaaaataagctaaagggccaatgaggtacagcaatgaagataaagttggactgtgacttacacacaacatgcaaactacttgataccatttactgatctctggatcacactctgacactacactttcaagcaacaatgcaaagggtgacgaaatcgcaagttacatatttaatactcatacaataaaagtaaaccaatttctccaaaacagaattatttatgttactgtgagctgagaaaaatttctcctgaaggtcctcataagaagagcattcaccatattaatggtgagcagtatcttttttttgacacggattctctgtcaccaggctggagtgcagtagcttgatctcggctcactgcaacctccacctcccgggttcaagcgattgtcctgccttagcctagcctcctgagtagctgggactacaagcacatgccaccatgcccgactaatgtttttttttgtttgttttttgtttttttgtttgtttgtttgttttactagagatggggtttcactgtgttagccaggatggtctcaatctcctgacctcgtgatcctcctgcctcagcctcccaaggtgctgggattacagacatcagccaccacacctggccagtgagccttattcttaatcacatccccatagtgaataaaaaataatacttacacaattattatatccatcaatgtaaggtgatagtataataacaaagaagagtagaggaaaggcaattcaaaggaagaagaatggcaaaattctgtcatttatgtggacagcccatgtggattggtatgtatgaatgaacagcaacatttccttcaggtattcatctataatacttgggatatgggatgtattttatctcccaaactagactggtatgtccacatctgcctttccactatttaatgtccacaactttcttcaagatgcattcatttgttccttcaatagtcaataattttctgaactaaagtcatgaaggactgagtcttaaaggatacttaggaatgattcagacaagatgggagacagggtaggaatagaaacacttccaaacagatggatacgtagcatgaacaaagctaccaaggtaagaatgagcttggtatgcaaagaaatataagcaatttagcatggcaacaatgataataataaggcagagagaatgatgagagaggaagctaaaaaggtagacaggagagcattgaaggaattttttcttatctctactcttggcaaatacaactcttggggactgagatcatatgtagccttaaatgttgcataagctgtgtatatggcacagaggtgatctccagtgtctacataaactttgtggaatttcactgatgaaacagtttgtgccatggctggagaaaagcatttggatgcatatttattgactgatgtatcggatgtgatgtgatgtttgaaatatgtcataagagtgctttctagaagaattacccatttgttcattatgtaagagagaaattgtttctggtcctctagaataggactttggggagtgactgcatattaccctgactcattctgccatcaatgtgctggagtcaccattcaacaactgcttcaactcacttggtcctaagtttggcagctcaaaattccaacaacctcacagaatatacctggggatccaaactggaaacagctcattagattcaaaataggagggtatattttagaaaataaaatctagcatacctttactggctcttaaaaaatcagattggaataggtggtctgaaaatgaatttatccagcaaaccatattaaaaaacaaaacaaaacaatatcggagtcctggcctaaataaagtggttggttactacctccctcttcaatcaccttaggctcttgtagcaaaaggacttttaccatattagctgctacaagatttaataaggatatgatgtactatatccttcattttgctaggcaacgcaacattctaaataagattgaatgtttgtcaatatttggaagaggaacctcaggggtttctttaaaaatttcctcttttcctattcctctaagactgattttaacctaaaactgattttttcttttcatgtatacaagatacctttttgggggtttgtgtttatttcccctgaagaaggctttacagagcttggattttaatggaaatttattgctggatgtttgatagccaaaaggattgtgttttgatcacagtcaaaatggcaattttctccacagtagcatagcagcatactagtacaaggccactgcagctagaaacctgtgggcgtgtcaggtcctttgtagtgagtgtcagtagcacctgcaagagcccaatccctaactgtgctggaaggaggtttgatcctattaagtttcaaataatatgtcagcttttcagctttgatacaaattcctccagaattatctattttcccacttgtgatataagacttcgtgaaatgtgtaaaatctaagagggtctgcctcattttctgtgttgggagagctttggaatgacctcggactctgtcaagactagtatttcttgagctttccccaaaccaattaatcttttcatctgggggttatacaatgcacaataataagaattaaaggtaaaaattaaaagaaaataaagaaatcttgttgtataagaattaatgcaacacaaacatagaggccatctcctcaaaactgacctggatggctacagattaaaatatggatggaaggaccactgagaaaaaagacagacatagagagcaagaattaatctaatactacatgtttggtacacaaacaacaaatcaaattgagcaaattattttctcaggagattctctcaatcactgtattttattatctgtgaattccagtaaaatcctcattttctaggtggaggctttcttttttttttttatttctgttttctttcttttttctttttcaggttttattttagattcagggggtacatgtacaggtttgttatatgggtatatttcatggtgaagccctttcaataacaaaaggaagaggtaaataattatacaaacaaaacaaagaaaagcaacattaaagaatacatttaaatgtgagtcaaaagacctaaattgagggccaacaagcatttgctctgtcacttcacttttctgtgcctcagttttcttttctggaaaatggaggtcatgaaaatactcatacctgccctcctcatttcacaggttgtggagcaaatgcaatgagtgtggctcaatcattgccagatcttaacgttgtacataaatgttagtgactgaggacaattatttaacccctatgagctttcatatatccacccgtcaaataaagcttggatactggcctgcctatccccaaaatgatcttataaaaatcaagtaaggtgataccagtgtgtgctttgaagtagtaggtgctatcaagtattagactgtcaaatatattcaaacaactgtgtgtgggaaaagattgtggtggactagaaatagccaaactttagaagtattctatagtctttgggaataaagctgggatgtatgaaaaaccttcttatgatattaaaatgttcacctttgaggaagaaagtagactagcagaaagtttcactatcaaaattctagaacattaactactgatactattacaagttgttaggaaacagtaaattaaactttgtaatgctctcccaaaggaagtagaaatacaccatcattacttatagtttaaattggactgggaacagtgggccagcatgtattatggagaagcaatgcttcagtagtagcaaagtgaaccaaatgacactgcagatcttatccatatttaatgtttgacaggcaaaaatacttacattaatgcagtaatgtgctatgcaagtcatcaacatgggaatgctcaaagctttaatactgtttaataagcatcacactatgagagcatattttccctttcaagtacgactcattcaagtttgagggaactgctaaattgtcacacttggcaaaatcttgaatgacagccaatctaaacaaaagcaatcattttgtattttgggctggtttgaagaaagatgggaagtgtgaggtaggcagggggatgtaggataccccaaaaggccacaataatcagacaaaacccccagcaaaattgcaaaggtaggatagacaagaaaaggcatcaatgctttgcgattgaacctacacaatgacctgatgtatacaaaaaagatgggattttggtcaatggtaaagtttatttcaggggctggaggtgtgagacatggctcctaaaagtaggtgtgtcaatgactaattatctaatttacaataagttgacctctctgtaattctgtcccactttttcaatttctaaaccagcagttctcagttggggaggggaaggaggataaattttgtcagggatattggggttatctggcttgtcaccacaggggaagtgtggtgctactggcatctagaaagtggagtccaaggatactgctacatatcctataatgcacagggtagccctccacaatagagaattatctagctgagattcaataataccaagcttgagaatacacgtgctaaactaaaatcatctgagaagtatattatggggtaaaatgggacctaatcattcttagcataaaagcaattttctaaaaatcagtattttattaatattactgttattgcttaagcttcttttctactgagtttccttttaattataaagcacttggcagaaaaataagattcatttctataataggcttagtgctttctttttcagcagtctttttcttcaattaattaacatttaactgctttcttataatgaaggccaaaaaaacaagctgtctccttaaacttctcaggagaagtgataaaactctgtgagtatattaaatttttctgataaagtatttgtaggacatagatttaggaggtctttctctcttaggaatgttacttataaacatttcttggaagtccaagataaaattaaaaacacgtgcatgattctagaggctacatatgctattgatgctgaaaatagaatgttggcaccggagaagtccttactatatatgtggatgaagatgaactcctatttattagtaattatgtaggaataaacgtgatgattctaaaaaaattatcttattgtctttgttggcatttattttaaaaataagtgaaaaaaaactataaccaatatgcaattcatagatcttctatcatggctaatagttcaaattttgcaagctattggtttgaattattgcatttgctacatataaaaatggaaggtttctaaaagaaaatgaataatagaaaatattcagatgaaaaccaaagcaagctataaggcattcttagaagaactatatatatatacacgtatatatatatatacacatatatatatacgtgtatatatatatacgtatatatatgtgtatatatatacgtatatatgtgtgtatatatacgtatatatgtgtgtatatatacgtatatataagtatatatatgtgtgtatatatatgtgtgtgtgtatgtgtgtatatatatatatatatatatatatatttttttttttttttttttttttttttttttttttttttgagatggagtctcgctctttcgcccaggctggagtgcagtggcgctatctcggttcactgtaagctccacctcccgggttctcgccattctcctgcctcagcctcccaagtagctgggactacaggcacccgccaccacgcccggctaactttttgtatttttagtagagacagggtttcaccatgttagccaggatggtctcgatctcctgacctcgtgatccgcccacctcggcctcccaaagtgctgggattacaggcatgagacaccgcaccaggccaagaaccatattttttttaaaaagtttgccactgtaaacaagatatttaaaatgaccatgaacaatttttatgtatctgtaggcttctctctttaccagaattaaagtgtggggtcctggaagaagcagagggctagaagccacgacacttaggtttgtctcctcatcttggcactttctgagatgttaaattattcaacttcactgattcttcattttcttgataataaatagaggggattagatatagagatgcacaaaatccctcccaactctaaattttcatagttttataagactttgagtttaaaatcatttgatctacttatataacactcataatttttgtatctttatttccatatgcacagtttatgttatgacaagaaccaactcaaactagcttacgccaatacaggaattgattggcttgtcttccacacaaattcagtcagcatgcggatcctgctccagggactcaaatggcatcctcagtatttgttttttctatatatctcagctctgcctcatgctatgtttatttaattcttgaggtatatgtagtaattccctattgctccaagaatactcttcagcagcctgggcaacatggcgaaaccccatctctacaaaaaatatgaaaactagctgagcataatgacacacctgtcagcccagctccttgggaggctgaggtaggaggatcaattgagtcttgcaggttgaggctgcagtgagctgtgattgcactactgcacctctgcctgggtgacagagtgagaccctgtctcaaaaaatatatattttttcccattttcaaatttcagcaataaataaataagaagctgtttttcttttcttctctctactgtcctagcaaaagtctgcttctttctagtttgctttgatcaggctataggcctctctttgaaccagtgattgcagacatagaaataggatacacagatttaagtggcatgaatgacatgtcttctcctgggaccagagatgaggtaaatggaaagaatgttcttgaagcaacaggaaaatacaataaatattttgagtattaaaccaatatagtaaaaagcagagctgagagagagaaaccaaataaggacaataccatttgaatccctgaaaaaatacctgtatgaagactgaaatttcatgaagaacaaaccaataaatctctgtgatttgctttagtttgagttgttgttgttttttgtttttttgtcacaacataattagtaccaactgaattaaagataattttttaaattacagagtattatatcctatattaaaatcaataaaaaattttaagctcaaagaacttgatgatatctttgatacaaatgacatactttatacttaataggttcccaataaatatgtattgtttggtacaatgtaatgaatatagaattaaaagaaatatgtatgtaccaaatgagtatgtaccaactaagaagaagggaaaaagggtacattcatttcctatctatataataatatggcaaaaagaatggaaaaatatatacataaatgatgcaagaaggaggcaaaaaaggtgataaatttcaaagtggaaacactcaagatatatatgttgtccttcaccaagaaaattacaaaagaccttgatattgaaggcttcttctttgtcttcttgatgcctcccatttcttctcagcgaatttcattggtacatacccatcctaatatgataagagcattttaagaaatacctgtaaataatattttcccctattctgttagaatataagctccataactttagaaatctttgttttgtttactaatatataccttatactactaagtaaatccctagaataaataaacaagacatagtaaaataattgtaggatgaattacaaacaggtgataaaatgaagaagcctgaggagagggccaagcaggatatgaactgttctgaattctttcttctacctttttttctcaccttaaaaactctggtccttatcacctgtattgattcatatatatatatatatatacacacacacacacatacacacacacacacacataccacttaagtcagatttcaggattcagaacatatggaagatggtgattatcttctagactctatattctaatgaaagataatattttcttttgggaggcatttcatatattccataatttattgaggaaaaaaatgatattgaggtcaattatactatagagtttgtaggataacttacttaattgtgttgaagattttagatttgctgagcttggaagaagaaaggaagagagattgtgtcaaacaccaaatgagaagctgttttgagggtaaaagatcctagaaataaaaaatatatggtagaattaaagtaaaaatatataaaatctaaaagaagattcctacccttgcattttgacttcttccctggtagacaaggctagaaggaaacaggatttacatggcaggagagtataaaagatgactcaagtatttccgtgaagaaaataaaaagatcatgtccactgtgtcataaaatcacatcacccttctgatcaaaagcaatcaagaacttcccttaggttttagaataaaatccaaatgtttcccctgcctatgtcctttattattacccatttgccctcatgattttctagtcacaccagccttcttgcagacctcaaagtcgccatgcttgttttcatcccaccggatttttgcatgggttgttcctctttcctggaatgttctgccaccctcagcccccaacattcccgtaactagtccttctcctcagttaggtcaaagaacgaatgatgtcacttcctcagagtgacatcttctctgacactatctacagtagccaattcaccagttactttctatcagctagactgctttattttcttcacctcagcagaagattttttgttcatttattgtttgactttactaactttattttctaaaattaaagccccataagagcagagaccggccgggcgcggtggctcacgcctgtaatcccagcactttgggaggttgaggcaggtggatcacgaggtcaggagatcgagaccatcctggctaacgtggtgaaacccgtctctactaaaaaatacaaaaaaaaattagccgggcgtggtggcgggcgcctgtaatcccagctactgaggaggctgaggcaggagaatggcgtgaacctgggaggtggagcttgcagtgagccaagattgccccagcctgggccacagagcaagactccatctcaaaaaaaaaaaaaaaaagagcagggaccaaatgcctattttaatacccccaaatacctagaagaatacttgacatacagcagtgaatcaattattattgaaatctcctgtgtgtgtatgtgtgcacgtgtgtgtatccatgaatcaatgaatcaatgaatcaatgaatccattaatcatccaaaattaggagaacttggggcaagcctgagacacttagggcagagggggaatgaaggttagagctgcttctgaaataggcagagtaagcagtggtataaaaattttttttgaaacatactgaattgaagcagaactgagtatcaagactttcaacaaatggcctaggtccttttaatgagtttgttggcctggacagttgtcccataaagctctctccaaaattaggtaatcaaagaaaactattaattcctgagaaattgccttgtattgcctttatttcaaatattttaccatgtcataatcatatttatgcaaatgtggcttaaacaaacttttggaacaatcccaattatttgttaagagtcacttgctattaacatgaacaaaagaaaatttaaagaggtgatattaattatatcatattaaaatattatggtcagttttctagtagcccaagagtccttggagacatttaaatagacaattttgatatctcaaagctctttgacatattaataatattgaatgttgcctcactccttaatgaggagtccaataatcttctaaatcataaataacaagtggattcaataaaataacaagacagtaactgctgatattgaaaagtaatgagaagaccaataaaggagaatgcagtaagactacaagggagagagggggaaaatgagaagaaaataactcagtgcagctgggatttcacagtattcctaatacttgtgatctagtcccacaaacaagatagaaaagacacagagaaggcaaaatgctacagatctgctttctccacacttgttttaatattttgggaaatttctgaaaatagaacaaagaggatagcaatgaaactgcagagaacaaaaggacaaagctgatgagtattaggcccagagaaatttggaaaagggaaattagacacaggagtcttaaagcttaataaagtatccctcaaaaataaagaataagaggtgtgtaactgggagtatgcatgtatatgtgtgtatttgggtatatgttgaatgaaggttcatcaatggtggctctagaaatagatcatgggaaggacttgggtgcagactgaattctaatataattttatttacagatacttaaatttgaattttacattatttttatatgtcacgtcttttaatttttttctttttttattattattatactttaagttttagggtaaatgtgcacaatatgcaggttagttacatatgtatacatgtgccatgctggtgtgctgcacccattaactcgtcatttagcattaggtatatctcctaatgctatccctcccccgtccccccaccccacaacagtccccagagtgtgatgttccccttcctgtgtccacgtgttctcatcgttcaattcccacctatgagtgagaatatgcggtgtttggttttttgttcttgcgatagtttactgagaatgattcccaatttcatccatgtccctacaaaggacatgaactcatcattttttatggctgcatagtattccatggtgtatatgtgccacattttcttaatccagtctatcgttgttggacatttgggttggttccaagtctttgctattgtgagtagtgccgcaataaacatacatgtgcatgtgtctttatagcagcatgatttatagtcctttgggtatgtacccagtaatgggatggctgggtcaaatggtatttctagttccagatccctgaggaattgccacactgacttccacaatggttgaactagtttgcagtcccaccaacagcgtaaaagtgttcctatttctccacatcctctccagccaagatggccgaataggaacagctccggtctacagctcccagagtgatcgatgcagaagacgggtgatttctgcatttccatctgaggtaccaggttcatctcactagggagtgccagacagtggacgcaggacagtgggtgcagtgcaccgtgcatgagctgaagcagggcaaggcattgcctcactcaggaagcgcaaggggtcagggagttccctttcctagtcaaagaaaggggtgacagacggcacctggaaaatcgggtcactcccaccctaatactgcgcttttctgatgggcttaaaaaacggcgcaccaggagattatatcccacacatggcttgcagggtcctacgcccatggagtctcactcattgctggcacagcagactgagatcaaactgcgaggcagcagcgaggctgggggaggggcacccaccattgcccaggcttgcttaggtaaacaaagcatccgggaagctcgaactaggtggagcccaccacagctcaaggaggcctgcctgcctctgtaggctccacctctgggggcagggcacagacaaacaaagagacagcagtaacctctgcagacttaaatgtccctctctgacagctctgaagagagcagtggttatcccagcacgcagctggagatctgagaatgggcagactgcctcctcaagtgggtccctgacccctgacccctgagaagcctaagagggaggcatcccccagtagaggcagactgacacctcacacggctgggtactcctctgagacaaaacttccagaggaacgatcagacagcagcattcgcggttcacaaaaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcgccatcatcaaagaccaaaagtagataaaaccacaaagacagggaaaaataaaaggaagaaaaactggaaactctaaaaagcagagcgcctctcctcctccaaaggaatgcagttcctcaccagcaatggaacaaagctggacagagaatgactttgacgagttgagagaagaaggcttcagatgatcaaactactccgagctacaggaggaaattcaaaccaaaggcaaagaagttgaaaactttgaaaaaaatttagatgaatgtataaccacaagaaccaataaagagaagtgcttaaaggagctgatggagctgaaagccaaggcttgagaactacgtgaagaatgcagaagcctcagagccgatgtgatcaactggaagaaagggtatcagcaatggaagatgaaatgaatgaaatgaagcaagaagggaagtttagagaaaaaagaacaaaaagaaacgaacaaagcctccaagaaatatgggactatgtgaaaagaccaaatctacatctgattggtgtacctgaaagtgacggggagaatggaaccaagttggaaaacactctgcaggatattatccagaagaacttccccaatctagcaaggcaggccaacattcagattcaggaaatacagaggacaccacaaagacactcctcgagaagagcaactccaagacacataattgtcagattcaccaaagttgaaatgaaggaaaaaatgttaagggcagccagagagaaaggtcgggttacccacaaagagaagaccatcagactaacagcagatctcttggcagaaactctacaagccagaagagagtgggggccaatattcaacattcttaaagaaaaggattttcaacccagaatttcatatccagccaaactaagcttcataagtgaaggagaaataaaatactttacagacaagcaaatgctgagagattttgtcaccaccaggcctgccctaaaagagctcctgaaggaagcactaaacgtggaaagcaacaaccggtaccagccactgcaaaagcatgccaaattttaaacaccatcgaggctaggaagaaactgcatcaactaacgagcaaaataaccagctaacatcacaatgataggatcaaattcacacataacactattaactttaaatgtaaatggactagatgctccaattaaaagacacagactggcaaactggataaagtcaagacccatcaatgtgctgtattcaggaaacccatctcacacgcagagacacacataggctcaaaataaaaggatggaggaagatctatcaagcaaatggaaaacaaaaaaaggcaggggttgcaatcctagtctctgataaaacagacttgaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaacgagacttagactcccacacaataataatgagagactttaacaccccactgtcaacattagacagatcaacgagacagaaagttaacaaggatacccaggaattgaactcagttctgcaccaagcggacctaatagacatctacagaactcttcaccccaaatcaacagaatatacattcttttcagcaccacaccacacctattccaaaattgaccacatagttggaagtaaagctttcctcagcaaatataaaagaacataaattataacaaactgtctctcagaccacagtgcaatcaaactagaactcaggattaagaaactcactcaaaaccactcaactacatggaaactgaacaacctgctcctgaatgactactgggtacataacaaaatgaagacagaaataaagatgttctttgaaaccaacgagaacaaagacacaacataccagaatctctgggacacattcaaagcagtgtgtagagggaaatttatagcactaaatgcccacaagagaaagcaggaaacatccaaaattgacaccctaacaccacaattaaaagaactaggaaagcaagagcaaacacattcaaaagctagcagaaggcaagaaataactaaaatcagagcagaactgaaggaaatagagacacaaagtacccttcaaaaaattaatgaatccaggagctggttttttgagaggatcaacaaaattgatagaccgctagcaagactaataaagaagaaaagagagaagaatcaaatagacacaataaaaaatgataaaggggatatcaccaccaatcccacagaaatacaaactaccatcagagaatactacaaacacctctatgcaaataaactagaaaatctagaagaaatggataaattcctcgacacatacaccctcccaagacgaaaccaagaagaagttgaatctctgaatacaccaataacaggctctgaaattgtggcaataatcaataacttaccaaccaaaaagagtccaggaccagacggattcacagccgaattctaccagaggtacaaggaggaactggtatcattccttctgaaactattccaatcaatagaaaaagagggaatcctccctaactcattttaatttttttctaacttttaaaaatatgtaaaaataattcatagattgcaggatatacgaaaacaggtagattaggtgctcgcaggccataatttgcctctgccatcaaacaatagcataccataatctacatctgtgaattccaagggatcacaaacagaaaagcacaatggcagctgagaacaatagtggaagaatacatttttattactgttattacttattccacttatacaaatggaaaatgccatttttaaatttggtatttcctcttgtgcctcctcagaaattatactaaatttctttcagaattcatttattattaatgtgcccagattgtttcagtataagatttcttcattaaggtgatttcattttgaacagaggcaaagaaatacatttggctatttactaactataaaatatacaactgctgaaagctcgatggcacctaaaggaattgaccactttgttatcccaaaatgttctgacacttcaatgtcattgaaataatgccagagatatttcaagggatttcttttccttttcaaagatgcacattaaatagattgctatgtaaagctgatacatcatttagtcctccccaaaagggaaatgcaggtacaggcatgtttgcctcctgactcccagacaccatggctgggaaataaaacaagcaaggctgggaatctttggagtcaggcaaatctgggctctgctcaataggaagtatttgtttctttgggcaacatggagccttagttttctctccactgaaacttggaccttagctccctcacttctaaaatggaaatagaaatttctacttcccagggaaaatgagaggtttaaacttaaatgaaatgagaaagtatatgtaatattcacattgctagcacaatgtgtagaatctattattatcctcgaataccctctgtgatacacatagaaatagacacagcttctcccagcagcctagtagttggttgaaaattgttctatattcacaataaaagtcattcccagaagttgttgcaaggaaagaagtgatcctgttacaggtttgttgagacaggaagatacaagaagacaaaaataaaaatatttctttaatattgttattgggccatctgaccttagaagctagattcctgcttaaaaattcatgactaatttttagcatgaaacagcagaagtttccaattctcaagagacccactgcattgaaaatcctggggtctttttgtatggtccaaaactaatggagacaacttagcccatctaaaaattgggtgaaagagacgtaaggggggggggcaataaaaatgtatttttctaactagttttcaggtatccatattccaaaatagaacagcatctttgccagaagttcaagtcattaaggagttggtatggcattctcacttacataaagtatgggcacctctgaacaatgacctgaggattactaacaggtatgcaacatatttgaaatgtcaggtacagcaaagcaaatgactttatcaaaatataaatcacacttttagcagaaaaaccaatagttatatgaatttaacttcatctttaagtgcaaagagtaatattttgtgaattttctaaccgttttttagatgtcatcagtgtttcagaaactggtttctttcattttaaaataaagagatgctatttacttcatcattttccagccttcctgataggcgtatactcacatgaggagatacaaaactgaaaacattatctcattatagactatccacgatttaaaccttcaagctggcaatatgtatttaaataatatgtcataaacacctcttggtacataataatgtagtaaatatgagaatgcctttaaagtgaactaacttattctcccaactgttagattattccctgctatgatcccatcaccaagtgaaattttaggcatattcctctaggcaaagtaaatagttatgaggaaaaaaatattgctaattccagttgaaataagaaagcctcttaatcatctaaaatatttctggggcagatgcagtggctcatgcctgtaatcccaacactttgggaggcccaggcaggaggatcatttgaggtcaggagttcaagatcagcctgggcaataaagtgaaactctgtctctattaaaaaaaaaaattaaagaattatccaagcatggtggtgtgcgcctgtagtcccagctactcaggaggctgaggcaagaggatcacatgatcccaggaggttgaggcggcagtgagctctaatcatgccacagagtgagatactgtctctgaagaaagaaagaaatacataaataaaataaaataaaatgttctctatgggccagatttctctctgcttaggtcaattaaactacaaatttctcagtaatttttgaacgctctatctcccaagatgcctaggtggaattgttaggaagcaactgcccatccacaaaatatacctggagaatctcagatttcattcactgcttttaaaaaaggaaacaagaaaatcttcctcttagaagaaatttaatcttttaccacttttattacttttattatagaaatatatatgtatatatacatatgtgtatttatgtgtgtatatatatcagatatatctatatatatatagatatatagatatctatcagaaagcaaaacttaccttccttagacaaatggagatttggggaaattgtattggagtctagaagaataaatcctaggaaaagcaaacacacggtatacacacgcacacatacaaacctccaataaactttgggaaaaaaatttatatacacaaacactgatacacaaaatatatggattatatatgtatgtatatgtgtgtatatatattaaaatataggtttattcaccaatcactgaaaaactacatcataaactacaccaaaggagtagttttaggacaaatggcaaaaaatagtaccttacagagttgacagtttggaattgcaatacttcagatgatcacaagctttaaaaatgctcaatgtgctcgtctatgaatttcaaaatgggtataaattaaaacttattacactttttttaagttgcattcccagtacatgaaaaaacattgtcctaagactacctctttgaagcaattttcaaggattcgtgaatgagtatcgtgagcaataaactaaagctgcataagagagatatagtgtataaactgtgctagcatattatctttggttccaatcgcctcataagcattgctacactgactcaggccaatggtggtctcaaaacaatgttttcatctccctgaaccatttattcttttagaacataactcattgttgggtttcaggtgactattctgactgccattccaaggaaacaggccttctgaacaagaaaaaaatctgaaaacggaatatttcctttcagagatgtatggaaacaagctctgcctttttacccatgccataatgggtcttgctgagagtttgcttcaagaaccagaactcagtaaatgtaaacattcccttaaacagatgcacatatgttcttaatataaaatcttccagatgtaagtttcatgcaagaaagcaaagtgacctagcaagaattgagctttccatatctggtgaagcatttttcttagtgtgtgccacaagcagttattctgagaaatcatgcatctgctcctcttcacatggacattccacttctgatgagactacattcttggaaaatgtaggcaggagctgaattcaatcttacaatgtgtgtgcgcttattccttccatctatcacttacccaaaatacctgcaggtggtatcagaaatgagctttaaagggcctgtggcactgattacaaaaaaatgttaagtggtatttcatatggttgtggagtgggcagactcctgcttaagattcataatcctcatcagtaacacaagtgtatcacactcacaagataatattgaagtaatagaagaaatcgtccagaaatgcaaaaaatagttcacgtaagatgcaaaatcttatgacaaaatgaaatcctgaactaataaatagctctgtactgatatcaggccctaaagcctatattactgagagataaaacgtgggggacagcaacttagagatagggctattacattaaatctatgattacattagctaaaaagaaaaagcacaagagatgaaacaaaacatccaagaaactcatcaagatttatgcttcaagcaatgtcctaatatctgagaatatcaagatatgaggacactaacaaaagtattattattctaccggatcatttaaaaaattccttttgttctgaaatcaaataaaaagtaacaagactggcctgagtagcagaatatacatttcatactttatatttgtgtatgtctatatatatgtacctttacacatacacacagatacacataaacaatcacatctgtatttcatatctgtatttcaaccttctccattcactggaacagacatttaggttgattccatatcttgtatattgtggctaaggttgcaatgaatgtaggagtgcagatatattttcaaggtgctgatttcatttcctctggatatatacccagaaaagggattgttggatcatatggtagttctatttttaattttttgaggaagctccatacattttttcataactgtaccaatttccattatcagcaacattgtaccagggttcccttttcttcacactctcgccaacacttgttatctcttggtgtttttctttttttctttttttttaaataacagccatcttaataggtgtgaggtgatatctcattttggtttgatttgcatttctctcattagtgacattgagcaccttttcatatacccgttggctatttttatgtcttgtttagaaaaatgtctattcaagtactttggtcattttttttataaatacatacacatatgcacatgtgcacatatacatgggtatgcacatacatatgcatattttaataactatgagtactcaatgatatttaccttttttttttttgagatggagttttgctcttgttgcccaggctggagtgcaaagtcatgatctcagctcacaacctttgcctcctaggttcaagcgattctcctgcctcagccccccgagtagctgggattacaggcttgtgccaccaccctggctaattttgtatttttagtagagatggggtttctccatgttggtcaggctggtctcgaactcccgacctcaggtgatctgcctgccttggcctcccaaagtgctgggattacaggtgtgagccaccacagctggcccactttggtcattttttttaaatcaagttacttggtttttttttgttttgttttttgctattgtgtgagtttcttatttattttagagattattaactccttgtcagatagtttgcaaacattttttccaacctatagtttgtctttttattctgatgattgttttgttatacaaaagctttttatagtcccacttgtttaattttgctttcagtgcctgtgcttttggtgtgatgttcaaaatatcattatgaaggacaatatcaagaagtttttcccttgttttcttccagtagttttagagtttcaactcttatggttaggtatttaattcattttgacttaatttttatatatggtgtagataagggtccagtttcactctttgcctgtggatatccagttttcgcaacaccagttattgaagatactaccctctctccatcgtgtcttcttggtagccttgctgaaaattggttgactttataaacttgggtttatttctgggctttttattctgttccattggtccatgcatctgtttttatgccagtaacatagtgtttggttactattactttgtagtataacttgacattagggaatgtcatacctccaactttatttttctttctcaagattgttttggctattcatggtctttgtaattccacattaattttagaatttttccatttttgtgaaaaatgctatttaagtatgtccatcattctaaattaattataagagtgaagttatgccctaaattgttcattttgtaagatgtgccttgcagttttgcaccttgcaaaatgagcattaaaaattaggaacagtattttgctaatttgttcctgtgatctagaatacataattttattctatagcaggagctgtatattctcacatcggaagaaagtaatataatctgcttatatagcacatggtgtagccaataaatagcattttacatttcgtcccttttttcctttctctctcatactttcctactatttttaacagctttattgagttaaaattgacataaaataaacatcccacatttcaagtgagtgtacaatttgataaatttttggtaggaggttattgattgaattttttatattaataaccagttgttccagcaccatttgttgaaatgattatcctttgcccactgaattgcctttgaactttggttgagtatcagttgtctacatccatgtagatctttatggactctagtcatttctattgatctatttttctgagtttcctttaacactacactatcttgataaccatagttttataatgagttttgaaatcaggcagtcttagtccccaaattttgccttttatcaaagttgttttgactattctaggtcctttgcatataagtttcagaaacagtttttcaattactagccaaatgaatgttgggattttgatctggactccattaaatctacagatcaattgaggagaagagaagaccactttaacactgttacagtttcaacactgtacagtttaacatcataatctgcatttatttaggtcttccttaatttctcttggcactgttttatacattttgtgtacaagtcttgttaattttttatagacatatttcatattattgatattattgtaaaaggttttactatttcaactaatttcaattactcttaatgatacatgtaaatactactgatgtttgtatacggatcttatatcctgaaaccttgcaaagctaagttttgagttctagtaagtagtagaggttgaataaccctatccaatacacttggaatcagaagtgtttctgattttgttttttaattttggaatgtttgcatatacataatgagatatcttggagatgggacccacgtctaaatacaaaattcatttatgttttatatgcaccttatacccatagactgaaggcaacattatataatattttaataattttgttaatgaaaaaattgtatattttaaatcatcagaaggcaagtgtcaacatctcggccacccatatgagccatctgtggttgtttggcatcacaatcattcttgattttgaacttataagctactgataagcaacaattttcttaacttatttacccataagtacttatctgtaaaaaatatggcatgccatttacacagtaaaaaaaaaacaaatgtgtccagggtaactaagcagcacagcagcatcaccagaattcccgtaacagctgttgaacatcagcaacaaccaacaatggcaggctttcagtctccacctatgatgctgtgttttgattaataggttactgtgtgctgatttttttttaggtgagagaaaaaaaaaatcaaaacagttgaaggaccaggaagtgagtcctctagggatgaagaggcattttgtggatggcttttaaaaatgtttccttcagagtcatcttgcctcattaacaatggtttttgtcttagaagtctccctttgggattacaggcatgagcatgggtggatcacctgaggtcaggagttcgagactagcctgaccaacatggtgaaaccccatctctactaaaaatacaaaaaattagccgggcatggtggtgggtgcctgtaatcccagctactcaggaggctgaggcaggagaatcacttgaacttggaaggtggtggttgcagtgagccgagatcatgccaccggcactctagcctgggcaacaagagtgaaactccacctcaaaaaaaaaaaaaaaaaaaagaataagtagtagtagtagtagtagtagtagtagtagccatcgtcgtcgtcgttgtcgtcgtctctctttggctttataaactgacatgatttcttgtgctgttataaatgtacagtgctgtagtccttcaataagcccgtcacacatttttaccttatccataggaactttttcttcagtgttaacaatgtcattttaatcatcactattatcacaatcaacttgattcaaaaccatctggactatttccccattggtcaatgaagaattggaatctcattattgatgttaaaaataatcaagttctttgatatttacttctgctagcctagggaaagactctgaaattatattttttgtgtatgtaaggaggtcagacaccatctttttttctcagttggcccacagaattcttcaaagtcactaccttgttcatcaagatcacttaatatagtcacaggcaagaggttgtgccaggagtgtactactgtgtctttagtcactgcgttccaagtgttagcaatggcataaacagcacccttcatgctaaactccttctagaaaccttccacacccacacctctcttcactggtgctggcatgatgttcaagaaagtgtttttatatttactcttcatcaatctaaggataccttggtcacatgactgaattaatgaagtcacatttggggaaaagtatatggcataagcattatttttgatgaaaatttcagctgaaggatgagcagaaatgttgtcaaggaataacaaaaatctaacagttgtcatccaatccagcttccttgcagtaaccttgagcctctggtataaatgtttgtgaaaccaatcagaaaatatgtccgtggtgatccatacctttttgttaacataatagtggactgctgagaaattcactccttgaaaacagtgaggatgcaagcttttgcttttcagaacaagtttatacttttgtatgcctgctgcattagcacatgccagcacagttattgtccttggaatccttaatttttgtaggggctacctcattagcttttgtcagtgtctttctggggcaacagtaccaaaacagtgatgtttcattagcattatagactagttctggcatcagattttcatcagcaatgactctggcaaatttgtcaatgaatttttccactactacatgaccagaagatgctttatcactacaaatctttaaaaatgtaatatcatagtttttcttaattttctgcagccagcctgttgagtactcatggttcccttcaatattcatttcctcattatagatctttgcttgtctcccgattcgtattccattaagtgacaagtgttcactgcaatggtaatggatccactatttaaatacacaatcaatatttttattgttagctgtatacggtgtttttctatttttcattgacttctattcatcactttcagtataaaacttcaacagtttatccttctgtttcttcaggtcatatatggtagtcaacactatactcttccatagaacatttcaacttccgccactgtccagtttcttcttcttcaacagtttgactttctgtgctgtagagaaacataaatgcttctttttcttatcactgttacccaatactgatatcacagagggaactgcaggagtttttaatatttttaataatctttacaccatagagcagataataagaaaataaaaacacagtaatgcatgtaggtcttggccccatgtgacacattattggaaacctgccattggtgtgtttggcctgcatacatgccattttattaccctttatgagtgtgcctgcatagtgggggtggaggaatctgggtacttaagaaagatatatttcatagctgaaggggtctgggagggtcttcttccccttagggatgctgaataaactgtgtgctcagagcctgttttttgactacaccagtcacatgaagtcatgtatagaattttccacttgtggtattatgtaggtgttccaaaaagcatcttggattttcacattagcaatgctcaacctgtactagtagattccatcatattttctacataaatgatctcatgtcatctgtaaagctttacttcttcctttccaatctggatgtcatttgttcattcattcattcattcatttattgctttccttagtgcactggctatagcatctggtataatgctgaacagaagtggtaagagtgaatatccttgtcttattcttgatcttaaagtatccagtctttctgctctaatgatgtttgcattttatagacccctcttatcaagttgaagaagtttctttccattcccagtttttactttagttgaatttggtcatatttttgtctgttgggataatcatatggttttcttttttaatttgttactatggtaaccttacattgatttgttttaatgttaactaacctagtattcttaggataaatcgtatttcattaggatatgttaagcttttagatacattgaattagatttgcccacatcttaaaaataaatttttgtatctatattcatatcgatccatatatttactaattttttataatgtctttggttttagcatcaggatagtgttagcctcagagaacgagttgggaagtagtttctctgctcaattttttgaaaaataattgtatatacttggtaataggtactatttcttacttaaatgtttggtagaattcatcagtgaagccatctgggcttcaaattttctttgtgggaagatataaatgttagctggattaaattgataatgatgccgtttaagtcatctacatccttaactaatattttggtttgaatgttctatcaattattgagattgaggtgttgacatctctaaatataattgtgtgtttgtttaatactccatctttttttggaagcataatatcccttccttaacaaattatcttcttttattctatttgcacttttactttttattatgttcttttttgatccttttaagaatactggttgtactaaatgctacccatggttacactgatttttgtcttaggctttattcatttctagcccaactatatcttcctacctcttgtttgaaacagaaatattcatttttctccataaagcaggcatcccttctaatcctaagcaacacaattctcctagacacaagtattttcaagccagtcatctttgacatcactttatagaaaatacatcttctcagttaaatctttactcaagtagtgtattatcctccctctgctatcagtccctgactgtacttcatgttatgacattttaaattattgtggtaaacctcttcagcctctagaacagtatttcatacatcatcagtgtgcagtagaaacaagaacatccccaggtttactactgcctacaaaaaacaatggaaattcttcagtctatccaaataaaccagttgtcctcccttggcatcactctgtctccttccatccttcatccattcattcttccttttcttctttccttccattcaacaaatatttatactcgctcttaaatgcagctttcattcaattaatctactcattgttgtcaaaagatagcttatctttttttttttttaattggaccatatggccccactactcttcctatgcaagtcttgcaaggcccacttttagcccatcttctgaatgaacattttctgtctccaaagacagcaatttctctcatttctgagcatattattgactgtgtacataaacacaccaaacagcagtggattaaaaaaacacacagaagccattactgcctcaatcagttaaataagaatggttaaaaataatctgttgtttaaactgatggaaacaggaaggagaatgtcagcttgctttttaggctattgtcttcctgataacactggtagaaagataatcctttaccctaaaaattaatactgaattatgaggaataaatgcatacatagttcttcctgccatgcagtccatatgaaaagggggagggggtcacaacagcttaaataaaagagaagtttcagtttgtctgtaaatgtctacaccataaggaaaaaaatatttgaagccacagtaatgagagagtgtttcggtagaataaagtgtgaaatttgtaggaaggagaaccaagactgaaaatacaaaaacattattaggaaagagacattgcaaaacactataatgtgtacagttaacagaattagcagagaatataagagacacacaagaagattatgaaagatatcaatactagaaagacagaagagaatgtttaaaatagtaagaatactaatgtgtccaatttaagcatttaatgatgtttaaataaaaaataagccaccctttaaaaattccttctttattttagagttccaagataaaaatattgggaaggtatttttcaatcagtaaaacaaacttcagttagaaaaatttactattagataatcttattaatatctataaaagctgcattcatattgatttagcctacacccactttgtgcacaatgtatagagaaagaacagcttataaaattaatatctaggcaacgatggccacagtgcattttaggtatggccacttttacagtcttttgtaataattacattttaattttttttttgtcttagcaactggatcgtaaaatctttgagggcagggctccctcttacactctgtgtatcatatatagtatctagcaaggtagaaattaaataagatttcctgaattattccctggctgctcatcttaattgtaggaatccataaatgtctttcctattgattctaacatgttgggagtgccaagtatccttaagattacatccttggactagagatttaatagaaacacttcatttaatattaatagaaaagaaactaactcagagtaccaatttcttgggtggaaatacatggataataagtgacaaggtggtagaaaagcaagctacctatttcaaaaccatatttcatgtgtcagctggtgttaactaaccaggcaactactatggatgtaaacaataactacagacaacactttccaagtcttcatatcgtatctccttagaaaaaagctattatcaagcagttttgaaatccacttaaaccttttcaaaatgtattatagatttacttaggacaaagtgttctggtgcattcagtcataattggtaggaaatatcaatcaattgtttcatttgtcataatgttaaagtcactcaatctagggtcttagctgatttctcttttctgaagaactataaaacgtacaaataaactttatagaaatgggaaaatcccaagcatgtattaaaaataattcttgccactaactataaaacacatcaactctggcaagagcctttcctggggagcatagtgtacaaggtctagatgtgactatcatacagagcttttttggcttgccaatgctgccaaaaaaaaaaaaacaccactgactggatgtagcttaaacaacataaatttattttctcctagttctagcggctaaaagtccaaaatcaaggtgttggcaggtctagtttcttctgagacctcttgtctttgcttgcgggtggcggccttcttgctctgtcttcgcatggcctttcctctgaactaacacacattcctggaatttctgtgtgcccaaatattctcttcttacaaggacactagtcatgttaggtaaagtcccatcctagaagtctcattttgtctcaattaccccttgtaggaccctatctccaaatgcactctcattccaaggaaggtgctaggagttagggcttcaacatatgaatgaggaggaggaaggaagagatacaattcagcccataacaagaggccagagagctgtcatgaaatttcaggaaagatatagctctctcaaataatatttttactgagtatcactgaatttagagccaaaagagacctcaaagttgatcatgtctcaccacctaggcaatgctgaaatccctcgtaaggttgtaaggtttcactgactagtctcagcctctgcttccttatccagggaattcaccactaccatggaaatagatgccatttatagagagttaatcattgtgtggtgggataataattttgaaatatcaaccgttttttcttttccatttttctatcttgtattttctcttttcatcaactccagtgagcttttattctatacttatcacctcaccaagtgatatacactagaagcttttagtgtgaaaacgtctaggccccgtaaagaccaggaaggatctggcatttgcactctccaaggcctgaattcctctagaccaaattcataaacacagcagcagaaccttatacacaaccttatataaacttgagaaaacctaaaatatagggaaataagatttcagggtagaatggcttgctctgtgtctgtttcagggctctgtgtctccttagatggacctaaaacagtccacggaatttcctgtgcttggatgtggcacaggaaaatgaatcccatcttccaaaaggggccttgacatagctgagataggacttgtagataggaacaagtattgattcagtagcaacttgcatgggtgaatgactagaaaggataatgagtctcagcaaatgtcagatgaaatggaagcataaaggtcgtcatcccttggcaatatggaaagccccataaattagagagctgccaaatggctaaggtttagtttttgccattctgtctcaaaacagaaattatttcgagaaaaaacctctattttttgaatacttgggtttatgactaccattaaacaaaaatatttattccttattacttcttcactcacttatattgattacaaaagtatgaattatattaaaagttggtgttgtttattacaaacaagaattgaaatgagatcaactagtatatttgttcttatacgtaggtgacacacggtcatttcaatgcccactctttaagaccccttgggcttgtaaaacatgaagtacatattaagaggtgtgaatatgtacaataccaacaaacatggctgattatgagcctcccaaacattctttaaccaaatcagaaccctaatgtgtaaatttcgctgttgtagtaagaaatatacaattatgatatttgaaatgctattagaaattaagaaagaaactaataacactatacgttgcttttgaccctaataaaatactcataaaaataaattggatgtgtcaatgtgtccatcctttgagatcaaggccaattgtagcgacatagaatgttgaaactgaaagggttcttagaagccatctggcaaacactctcataaacagatgtgagaattgagatccagaaacatgaaaagatgtgtttagggcaacagcagtcactggcaaatccagtgtggaagatggtgtcttcacacattccacttctttttctgcaggcatctcaaggtcacagcagaatcatttcttcaaggtttccttactcttctataagggcaatcacatggttgatgcttatttaaaatatttaaaactatttataatcatgaatgaaatttaaaagagtcaagacactagctaacccaaaagttgggcttttcccttttgagaaaatatttttctaactgatagaacatttggtttctcaacttttatctatcattaatgatatgctccactgctagaatgatggaatggcctagattgtttagagtacacgaaattatctttaatgaagataatttcattatctttgtgataatgaagaattagcctatctttgtgataatgaagaaataaagatttcttcacaatgataagcttagttgaatttagaaaaattaatatgtggctcctaaagcattcataattatatataaatctctttaataatttttttcctaaagttatctctgtgataatatatattctagacatatattcaaatatatttaagatatattaaaagtagtaattttaaatacagtttgaggaaagaattaaactctgagatatttataattcaacattgaaacaaatcttaaaactttgtcatgcgcttgttacaattacagttttgtaattctgtttgcatcaggtatgttgcaaataataccacctctttattcatttagcactttctatctataaaacatcttttaaatatactactaatttcatccatgccttgctgtagaatctttaaaaatgtgttagcagtttatgcagttttttcttctagttatagatcaaaagattcagagttagccacctgaggtaggcagtgtggaaacctactctcaaatacatttttggtgagtgaacataatcctattttctaccaattgacacaaatctcaaactgatttgttagaacatgtattctgcaatagtcaagcaatacaggacctggaatacacaattagtctcttcaagaaactttttcagcctttcaccgtgaacaagaaacaaaaaaaaaaaaaaaaaagtaagaaacttcagcaagataaagaacataaactcatcatgacctttagcttcagaaatttcagaaattttaattgaaacattaaaaaacagctatatatcatgaaatatatgaatttaagtacttgaactctctaataatgtatcttcctaggtgtccctcattcatatgtcccattattcagtctgcttttgtcttccttgtgcttctctgtgttgcttctttacccattcaacaacataagttaggataacttggtgggcttttcttttttctttttttgttttcttgagacagagtctcactctgtcatccaggctggagtgcaatggcgtgatcttggctcactgcaaacttcacctcccgggttcaagtgattctcctgtctcagcctcctgagtagctgggattataggcgtgtgccaccacacttggctaattttttgtaaattttagtagagacagggtttcaccatgtctggtctcgaaatcctggtctcaccaggatggtctcgaactcctgaccttggtgatctgctcgtctcggcctctcaaagtgctgggattacagaagtgagccactatacccaaaccttactttcaaaagttcttacctttcttgtgtttttactatttagaatatttggctgaagtttttactctttctttttgccttccccaagcctaggccccagccatcttttctgactgctcccatttttgctaggcaaaacctagcaagaacctcctttacaccaaaaacaaattttcctaatgctctcttgtcaaggtccaacagtggtagagctgaaacagagccaatggagttgtttatatcatccagcttcgtatttattagccacatatgtgctgcaaatcttagaaagggaaggatggtgctaagttctctgcagatgctcaaatgctaaataataaacatgtgatacaagctgagattcacaataaagacagggaatatccaaaaatatgtacttcaaaattatatcagttatttcccctaggcagtttagaatacaggattttaaaattcttgatgagtaaagagggaggaattaaatgataggcaaacatgtagcctgcatattgagtaagaatttattgtcccaaagagctgttatcccaaatcagctggttctgatatttcgatattattcaagaaggtagttagtcaccattttaggaatggtttaactttagctgaaactgattagcagttttttctgaatataaaatatggagaagttattaataaatgtcaaatcagtctctctcttaatcgctctcactctctctccctctctctctctctctcacacacacagcaagagacatttgaatataccatcaactttcattggcttactaacgctatggcacagcagagtgtgtttctttcctttggagctctatagtagcataagaaaaccttgctgaaaattgagcaacactttttcatgctgaatgattttgttttacatttcctctgatacaaatagaaaagacgtctcacattcagctacctatgctagactacaccacaaataagctcatacctttataatgtgtctacatgacagtaacaactgtggtgagcatagaattattcatatgcctatacttatttcctatgtctttacttaacatctgggaaccactctcaaggtagtgtctctggtagttctgggaaagctgggtgcttctgtgttactagtatactaagaccttaagtaaggggtcctcttatgctctagggacttctctaacctctctctgaaaccctcaaggtaacagagctttagttccacacaggaggctcgagaaccacaaagctagcaggctgctatgatctgggtctctctaatgcctgtgcccgcccatatcttattctccttctcaacagacagaaatgagttccaaaatcttttcaaatcatttcttcctctggcaatattcaatagcagggccctcaccttggttcctgcaattgcctcacttcccatctctcctaatcactgtggcttcattccttttcagttttggttcccaaagtaactctaaccagggatctcttttatatgacagtatttagcagattggtattttaaatgttttagagtgtggttcctggcaggcctttttttgttgtttggtttttgtccacagtgtgagcaataaagatcttaattaaagaaattaatgaaaatgtcacctagagttggaagctcaattcacagtgttgggttgctggttccctactaatagattatatcctggcaacactgtcacagtacagcaataaaaactgttctggcatcttccaggtccaccacagagtctcattcttgctgttatgtctggactgaactcagagtaacccagaatcttcctcatacaagccttgtccacctatattctattctcgaatcatatctgaatcagcatttaaaactcaagtcactcctcccaataaaaccctccagtaatatcccatttaatttttggcttggcttataactttcatatatttacatatttcaacatatggaaggagacaccttcatttatactcttgccctggttcattcaaacattaagggtgaacatgcatcctgctgcctgttaaagagagtaatattaattttactaagcctaaaataatattttaaagtataaggacatactacagagaaaatcacatgatagaatataatgaagtaaaaatacccattctgaacagatctaccttgtaagagagtaattaagttaaaggcttgaggcactctccaaagaggagaccacacccaaaatgatcgaatcgtgatggtgtattgactgttattgataaataacattagcatattaactatatttacctcaaacttttcctaatggagctagtatattctgtaagtaaataactttccctcttctttggttcagcacacccaaagttcagtaatccagttgttgcatgatattcaattaaattgcacctttacgccaatgactacaattaaaatggaaatccattctctttctctctttctctagattacagacttgggctctttcatacattcaaaaacaagcaagccagatacacagttatcctcaacacttgtgtcttccttatccagaccttgcaaattcagttaggtactgtttctcaaaactcttatttagacccttcatcactgcttccataaaactccctttatttttccctgctttgttgcagtaatcccctatcttgtctactttctgtagattcatctttctaaaccattcaccatccacctctgcttttttgagcagtgcttcttaaagtatggttcccgtatcagcagcatcacatcactcaggagttgttagaaatgcaaactcttgggttccaccccagaactactgagtcagaagctctggaggtggggcccagccatctgtgtttcaacaagccctccaagtgattatcatgcattttaaaatttgaaaaccaaggttctaaagtcatatttttaaaaggcaaaaccaatcatgtcatttgcttgcttaaaacttctttaatgagtctcttctgaaggataaaagccaagttcttgggaagacgtgtaataccctttctgttctcatatttcagcccttctctttccacttcctccttcccacccagtgttttagtcatataaatgttttgaaatattgtgaagcaacctgctttttctgcctttttgccttttcctagtgcacctcttcccacacacaattcatccacctggaggggttccattcatctttccagatcaagctcaaatgtcccctttttcagaatgatttctgagggctaatttcaataacttacttacagcctattccacttcttccaggtccacctacataattttcccaaattaaatttttatacctccagctctttaaaaggaaagaaagtctgtttactgggcaaggaggcataggaaaaaatataaagggcactgcttatcccacctcacatcctcccacccctagttcacaagttaaagattgtcatccatctcttggaatagttatggctccttaaggatgttaatgccccctcctagatgttgtctcaattgtttattggtaagcccactcctagatatgcaggacccaaagcaatagtagaaagggaggcctacataccacatttaaatatttaaaagttatttaaaaactaagaaactttaataaaatatgttctatcattgtgctgccttaaatatataatttttaatgacaaatgaaaagtattatgtaaggcaatagtttttagataactaaaagctggcaaaatatcaaagatattcagtgcaatatttgatagcatacctgggcattctcttgatgagatagcaatgtttaggtaagtaataaaatgaaaccagcttaattcataaacacacatgtgttccataaaatttatatttctcctctttatttcatcaaaattatattgctatggtcaagatttttaatttcttgacagggatgagccaaaggatttaaaataaaatgaaattgtattgaagttagaaaattcaaatatatttcattaaaaattaaatataaaaacaaaaataaaattatttttttcataattcttaaatattcaaattatctattaagtcaaaaactgaaatgcatataaggaatatcacattttaatttcagaatatttcattaaagctgacattttctcatttaattttgtctcatttaacattgagcatccactatccatttgcttgccaatatgaagaattggtagcacacttcatacttattttctctaaccctacatatagacaaatgtaggagtactatgatttatttaataatccaaaatatacttatcgtgtacaaatgttatgctaatttgtctggactttcaaatctaccaatgaaacatgaacagatacaagaaaatggatgttcagctctacccaggaaaacaatcctcgattctgcaatgatttggtgcgttcattccacaaggaagaatttgaaaataatttatgtatattttctctatagtgctcaaatcctagcccaccccacccacctgctgcaaaataagatgttcatctctcatattgacagcagttcaaactgcaaatgttcatggcatttgagctttgttatctttttgctactaggatgtaagaaaaattgtggagaagaattttccggtagcccgagtaatattaaccacgagagtgaatgtttagagttacagattgcactgagccagtgctgtaggccagaattgaggcaacagaggcatttatgtttgtgtttttgtcatatgtggggccctctaatgcatggggcccaggacaaagacctttctttcctggatctaagcatggcactacctaggtgtttgatggctttaccctaggagtaaggttgagttttaaggtgctatcctagggaataatttcaatatatcttggagttggaacttctatacatttgcagtgcgtcacccgactttggtctatcaaagcaaaaaaacttggtcaggctttggtgcctagctatctggtcaaatatttatctaaatgtttctgtgaaggtattttacagacgtggtgagcatttcttaatcaactgactttaattaaagagtttacccttgataatgtaggtgggcttcacccagtaagttggaagccataaaagcaaaagataaaaacagaaaaaaaaaaaaacagaaaactgaggtatcccccataagaagggattctgccttaagactaacatagaaatcctgcctgagtttccagcctgccaacctgccctacaaatttcagatctaatattgcaacatcaactcttgcctgagtttatataaaacctacgcgatagatttcagacctgccagcccccgccatgtaagccaattccttttggaggaccccgactgacacaggtaaataattccatcttcttttatcccagtccccaaaggcagataaagaaaatgtaaacatatatatgtactatataccttatctttataccttctgatagcacgttggacaaaccacggtttctagaatttatggcatagtattataatcataggtttcaaagtctgtctcctattctagactggaagttccttgtgtgcagaggctgtgttatcacagcgctttttgaggctggaaataaacgttcaatacatgtctgtcaaaggttagagaatcaaaattaacacattacctggataagctggcatgtggtggggacaggagtaggggatggtggaagagcaaggagaaagaatcaaacaatgtggacgtaggaagcagtctccctgaagctaagacaccccatgagatggtactcatccagctttgccaagctcccagcacagtcttaatcacctctctcacagcgactttgatagctctggctaaggaacttgatacctgcaagcaattaactttaataagccagcaggtgatttccttgagaatgctgacgattcaatttgctgacagcagctctagattctctggctactcagccatggcttctacctctgcccttatgaacccagtgtgtggttgtgagtaataaatgaaaaggtagccaaagtgtgaatccttttaacagtgaaaattgtaatcagctttaaggcatgattatatattacagacagaaccaaaaggtcttttaaagttatgaagaaaaacaaaagccaacaagttgtacagctacattggcaccaaacttttatagtttctgtgaatgtgaaatgaagggatataaaagtactttcacctgtattaaccttttttttttctgttactcatcatagcattatctaacgcagaatcctaggaatgattctaaactctttctctctgtctcaataatcctaaatgttgcaattgccttattgtcctattttactgcattattttttacacaatggcagcctaatgagttcccccggcatcagtctcaggcatcacctatcaaacaactccactgcttgcgtcctcttcccaaaatgcaaatattatttcatctgcatgtaatttcttaatagttctccattgttaattgactacagtggagtcaaatcttagaattaaattttaaggaaaaagaggcaaaagagctattttactcaaaattaacactgaatatttcttaaattgtccaaaaaatacagtatgctccccattatatatgaaactgtgcagcaatacatgtttgtatatgtagtaatttatggtaaataaatttataataaaactgtaatattataattaaatataataatataatgtaaatatcattaataatataataaaataaacttataataaagagaatgtaagctttgtgaggacagtgattttcattcattttgttcaccgatgtaccccaaaggccaaaaactgtgcttgtcatagcaggtgatcaatgaatacttgttaaatgaaaatcacataacaattgattaacaccattttaacaattgatttgacaattgttatgtcactgacaattgtttgttaaaatcatttcaaataactttattttccctttttgtgcaacacatttaccactaaagtaacatagaaagtctgtgtgtggtggaaagtcattaatttacattgctttctaggtactaccgtcttccatgatctgcgctatccgttctgcacttatactttgacttcagtgtatcaaatcactcaatgttctccaaatatgctgtgcaaagatctttgcactttgattcctcaagccaatttaagtgtcctgtgatcttacgaactttgtttttcctctattttcaatgtttatttcattgcatttttatcgttttcttgtgggtctgccttcttgatcagattctaagactcttgattataaaatctatgtcttaatagtgtttttaatagtgtctctagtacaatgtcggtgtatcaatagacacatacagagtatctgatttatattaagtgtttatttgtctgtctgtgccattatgaccacatatgttacacttgaactttctgaccctaagttaacatctgataacatgtgttctacattttaggagcaaaagatatacttaattatttcaacaaactaatgagcaaacaattttagtatcagcctgcagtaaatactctttgatccagtatccagaatccagtacacagtatccactgtgtagcagcttctgcacatggggcatcaagggtaccaccccagaaaaactgctatgaccagaagtattgcagagaccagggtaaccagaagcacgatcatctcagaatatacctgcagcagcatgcctacagtggccttatatggtttgtgggcaagagaccattgtgaggaagtcagagaaacatatttgagtcactttgttcctatgcaaatatatgcctcccagagatcttcttgagttggcagagagggactttgctgtgggagaggggagatatgttttttggcctcaatggtagcagctaggcaccagtataatttgatattaatctagatgcctgcatttcaactcacctctcaggcgggaatatggactcaggcttttagaaagctttttcacaatgggggacaaagtagcaagtgaaagaaaagggtaaagtggaaggaaaaccttttcctgatggttaagcagttcctaacttacatgtatgaatgcatacatacaaatataaatactagcttaaagaagaataccctatcccatgcactccaggtaattaaatgtttatttcactctgatttgagatgtctcacgatgctaaggaaaatattggaaagaccttctctctcgttatctcaccttcagttaaaaaaaaatgaaagagagaagaagagagaaaagagataaatagaagggctatttgaaggtaagaaggtgaaggcagtcaccttttatgccttcctcccttcctcctgccaatcatccactctatttggttgactcccaagcttgctttataaacagctggagagcaaagcaaaacttcaactttagaaagataaggtcaactcatcctttcatttgcaacaagttgatagggccattgccgtgcaggtttggctggtcctggacaaaaccgccttctccagaatgggatttagaggaagacccttctctctctaatgtgactgaggaaaacagaaggaaggtaggcaaaggagatctgctctaggccaggcacagtggctcacgcctataattcaagcactttgggagactcaggcgggtggatcacctgaggtcaggagttcgagatctgcctggccaacatggtgaacccccatctctactaaaaatacaaaaaaatagctgggcgtgatggtgggcacctgtaatctgagctacttgggaggctgaggcaggagaattgcttgaactcggaggcagaggttgcagtgagccgagatcgcgccactgcactccagcctgggtgacagagagagaccctgtctcaaaaaaagaaaagaaaagaaaagaaaacaaaaagacctgctctccagtagcctctgaggccccaacttcccagaatgggagtgttgatcaggacctatggtaaatgtttcctactccagtccaacagctcactgggctaaacaaaagaggcccttcacagcctcggggcagacccacaaatatttttatttaattggtttgagatggggccacagactttttggactggtccccaggtgaatcacacgtacagacaaaattcagaagcactgggttagagggccagcatgagggctagagtgagagttcagatactgcagggagaggctatgggatttcctcacggaaagagacccaagggtgtggaaggcattttctggaagatgactgaggtacttggttatgggcaagacagtctaatttacaaaaacatgataaacctctcgagcaaagcttttcaagctgtgcaccccagaaggtgtgcaagatgagccatgacaacatataagaaaacaactgaatgtaacatttccattctaatttttataaaatttctttgttttacttattagtatagtagtgcatatgtattatttataaataaagaaacatttattaggagtatagcctcaacatcattttactaatgggcataaataattctaaaatttggaaactagtgttctaaagaaggaccatgattcctcactgaaggctcagctgagaaagctgtgataaccaggcaaaccagagaggaacttcatccagttgcctggtaagaatgatgaatattctgggttgctaagaaaatacatcagccagaagggagcaagagaggctgccctgctggggaatgtttgggagaccataaaaacagaaggtgggagcaacgagagggctcttcatcgctactgttaataacaaaacaatagcaacaaatgtaatacctgctcttacttactgaattcccagtaaggtcaagcactgtgataggcactttttgggcatcactgttaatcctcatgctgtcatacccattttacagattaggaggaaaaaaacctttaaaaaccataagtggtgcaacacagatattctactccaaactcaatgttcctgacattatgtcatgcagtttcaagagcatggatcatgagtgacattaggaaactgagagaagaagcatattatagcacttagagggtattatagtataaccaggttgtatttatcagctgtcttttctttcaattaaaatgctaaaggccgggtgcggtggctcatgcctgtaatcccagcactttgggaggctgaggcgggtggatcacgaggtcaggagatcaagaccatcatggctaacatggtgaaaccccgtctctactaaaaatacaaaaaattagccgggcgtggtggcaggtgcctgtagtcccagctactgaggaggctgaggcaggagaaggatgtgaacctgggaggcggagcttgcagtgagcctagattgcgacactgcactccagactggacgacagagcgagaccctgtctcaaaaaaaaaaaaaaatgctaaactgtggttgatgttttcataaacagagaattggtgctagcttcccaggcaatttgagagaatagattttcctgagtgtaagtaaacctacaagttaaaagaagtgacatccactgggagactcaggccaaatgtgatttcttccatacaaagtcaggtttatcaactccctccccccaccccaccacacacagaaacacacttttaatacttgcttttacactctgcatctgtgttcactttttccattgaccctccaaccaaatttgtggttctaaagctctgacatcaacagtgcattcctgagggtacttctctaggactgtcttcattttaagtctttgctcataggcacaactgtaaacttataagaagtttcaagcaactgtagagtaataagaatcagatctgtcctggggttgtggcgggggtgggcgggggaagtgtggctcttgagtagacagagacttggcatgacagtccttgtttaggattgggactcaagagattccaggaaagtcagtgtcccttccgtccaatcacagtgtgaggcccggtgattctggccttttctgctctatcattcagaaatgaagtcttttctgctctatcattcaggaaagaagtcttttctgctctatcattctagcttcttagccaccttgttggtttttatggattttctttttaccctgctcctgcctagcaagaaagaataaagaaaagggagaggaggggagagaaaggagctgactctgcagaccacaactttataattatttgaatataaaattagctggtaatgtctctctctttatgcaggctatgagatacatgatagttgtttctagtaacatatgttttctcatttttatcttttgaaatgttgttgaagtattcctaacttttatggctattaatggaggatgctgctaccatcctacccaagggcccatttttctaaatcctacaatcctctacgaatggaagcaatagcactacagttaacactctaaattgtacccttgtgcacacatacaggcctaaatcacttggccttatagccacaaaacacaattaggaaggactaaggtcatcaaaaaaaatcctaaatgccagttcactgcacagcacattctatagtcatcttacttacttgttcttgataaaaatgaatcccagcagggactagaatggtgaccctgattgtgaataatggcacacatgcagtgtccctcaatggctaccagaaaacaacagcatcagttaatagcctgtgttgtctcttaactgcccattgccagcaataggttttgctctatatagtctggattcccagtttcaagggtcttcactcctaccaggcaaaagtgctgtaatgagaacaagccaagaaaggaatgaggcaggcaacaagccaaaatccaggcagtgttagaacagccttgtcagggaagcagagaaacaaataattgaaattagaaaaaactagattttcagaggagtctcataaatcagacttgaaaatttaatttgagagcttttctctttctttcatcatattttttcccctcctggagctgtgctacaggcctgaacagaggaagtggaatgtaattaatcgatgtaaatctgcttcattaatggattgctactccctgtgtttcctctagtcaagaatgtttctgaaagtgctctctgacaacaatgctattcacagtctggataatggtaccaagcaggagaagaaacgatgaagtacttgcatgaagggagcccatgtttgctattgactggtagagaaatttagttagctcattaaatgttctgcttacaaaccctattcatgctttttaatcaattgatacttgtcctcctttctcacattgattaaataccaggaagtcctcacaagatagtgagatgtgaagttcccattgcagttaacaaatggtcctaagacccttagaaaacacatggttgtgcatctttatgcccacagggaatacgccattaatctgaactaataaagaggaacagcaggctaatcatagctcatttatatttggccctggaatgtgttatgtggtttttggcagaagatttaccttactaattatgtcttacttaaattaataatacagttaatttgcattcccttagcacacaccaattgacagtgagaagaaatgtgctaagtgataaggggatatcatctcgaaatttaaaagcttcattgaataatttgtgtatatatgtatgtgttgacactatatacatttaggacaaaaactctcaacatactttggaaagagaagttaaaattatgtgtgaaaatcgctatcaccttttggctaatttgcatcatcattgtttcaatattttatctcactacttctgagaccaataaattagaaagttaaacctgtaatcaacaaatatgtgtatatgtaacctaccatatcctgagcactgttctcagtattgtaaagggatttgaagaaatatacagtcattactctgtttcaaagtggggactggttccaggacccccatggacaccaaaattcatggatgctgaagtctctgatataaaatgatgtagtatatgcacaaaacctatgcacatcctcctatttactttaaatcatacctagattacttataatttataactcaatgtatgtgttatgcaaaatagttgttattgtactctgcattgtatagggaataatgacaagaaaggaaaagtttgtacatgttcagtacacacacaactactatagacctaaccacatttttcatctgtagttggttaaatacatggatatggaacccatagatactaagggccaactgtaggctattttctatcttaagatctaaaaatctggagaaagaaatattaagagatctagcactaatatgctttaggtgatctttgccttgtttgtagagactacaactcatttacaaaccatctcctatagacctggattgctgatgtggggaagaaaaaattaaggggtttacctttaagcagagtcaaggaggttaagaccaggtatctgattttccagtaaatgaagttgatgaacacaataaacccatgtatcattgctaaagtgctgtaaagtagagctttaatgccctctgtcaacttagaatcaagagtaaatatccactagcaattctacactggtataacaacattgcccagttactccacctttgaaatcttcccagacggacagttgttcaccatggcagatatgaagattcaaatatgtttgagctatacgaagtacatgataatgtaatgttgatctatctggttttggatgcatgaagcaatggtccaaacttggatatggaaaggaaacctcacttgtttcacaaatcacaggcatatttgtttcagatattgtaacacaatgattttcacccctctcacttttagcacaagtgttgcataagacccttggaagttggcctaatactagagatatcactaagtcttttttataatctatttctgattaattagtcctttaggataacatatacttatcaatatcattatgacattgcaggaaaaacaaaagcggtatgggtggattcatctcctctaaacttctttctttatggtcttgaacaaattactaaattgtaatgagtaaaatatgtatgttaatacccacattataatgtagttataagagctcgacataatgtatgttgagtgcttttgcaaagtgctttatattttagaaatactctccttttagtgcagccatactttgattctttttcattgcaatgacatggaaatttcaggacacaaaaatcagagtggccaaagaatttcatgggttcctttcaaaggataaaacaggaaattagaaagaataagtatgatataattcaaaatgtaaagccaatatctcgccaacttattaatacataaaattatatgccaatcttaacagaaatgaatgctacaacgtggtttgctaagctaattcaataggactacattaataaagttcctataacaattgagatggtaatctcatgttacagttggctagtctggccaatccaacaatactacattctattttgaacatcacttggagtggtattaccaaaaaataaactggaaagcatttagacaagaatggctcagacaaggtaagagctaaaagtaaccatttgaagggactataaaattcacctcagagaagagggagcatatggaatacatgagggctgacttcaaatatttcaagagttgttgccaggaagaactttaaacatagagtaactgatgtttaactcatgccgtgaactcatccactgtatgtttgaaaaccagtagcccagtagcctgttgggaagacagatttgtttcatatgtaagtaaagacaattcttcttattgaaaaaagcatggacataagatctgataaatccagcagaaaatttcaccttcaatcaagtagcaatgtgaccctaaatataaaacctctttgagcttatttttccaaactataaatcatgtcaacaataaggctgatacaaggattacctaagagaacatgtttaaaagcaccagcataatgctttaaatttcatagatgtgtaacaagaactaattctaacagtcatatgtcaaagatgttcaaagatggaattgagtgttatgggagacaataattttcctatgctagaaattgtttaggcaaaggctaaataaccacttggaagaatacaaaagaggaaagtcaagcttcagaattaaaattagattactttcaggattcctttcaactctaaatctgaagatcttgtgatacaaacattaaaaaaaagtttgcctaggaaaaaatatcaagaatagcaacagttatatctacaagagtaggtaaaaattgactaatatttgaaaaattagtctagctccctattaaagtatatagtttattactcttttaaactagtcaaggggaaaaaataaataatattggtaaaactcaatgcagatcatatttcattaaacaagaacatctttctttgccagatgtataggttagttatacactttcagaggatactatgataatgatcatatacaataacccagttgtcccattctttgatattaataattaaagcaatatttcttttggagaagttattcctttaaaaattcaactggtaggataaatctaatagagaagtagcacacagctaaaaacagaagttttagtaaattaatgagtggaatgttgaattcagcagtagctttaactaatgttgtgaactcatccactgtatatcagaaaaatttacagtacgttagaaaataatttgtgaaaccaatagcccagttgtctaggaacaaatgcacatcaagtaatagggaatatttttaataaaatttagtagattatggtgtaaggttttatacacaaatgtaaaggttttaattcaaatgtgataaaggagatgtttgtggatttatttagggtataaaaagccacatttttaatataaaactttattaatgtgacgaaattttggaattaaaagtagtaggacgcttacatcatatccctcactaaatgaagggcgtattgtttatgaaataatgttacatgagaaagaagacaatattgcacatacatattaacaaagtccttagctatccataaaatctagtttttccttcattactagtaacagatgtgtagcttttgcaagtggctaccagaaacactacatttcccagtctagcttgtagttggaaggaatcatgtggctaatttcaggagaaggtaagcagaaataatgtgtgacactgatacctgtaagaccagccctgtatttttcttgtacatttaagttccctgtacactctggatattagacctttgtcagatggatagattgtaaaaactttctcccattctataggttatctgtttactctgatgatagtttattttgctgtgtagaagctcttcggtttacttagatctcatttgtcaatttttgcttttaatgcaattgctttgggtgttttcatcatgaaatctttgccccatgcctatgtcctgaatggtattgcctaattttcttctagcgtttttatattacagttttgggtttttcatttaagtccttttttatttttatttttatttttggcagagtctcactccgtcacccaggctggagtgcagtggtgcaacctctgtcattgcaacttctgtttcccgcgttaagtgattcttgtgcctctggctctcgaatagctggaattataggtgtgtgcaaccatgcccagctaatttttgtatttttagtagagacagggtttcaccatgtttgccaggctgatctcgaactcctgacctcaagtgatctgcccacctgggcctcccaaaatgctaagattacaggcatgagccatggcatccagccttatttaagtttttaatagatcttgagttaatttttgtatatggtataaggaaggtgtccagcttcaattttctgcatatgactagccagcactctcagcatgatttattaaataaggagtcctttccccattacttgtttttgtcaagtttgtctaagattagatggttgtaagtgtgtggtcttatttctgagttatctattctgttccattggtttacatgtctgttcttgtaccagtgctataaaaagtggacatgaacagacatttgtcaaaagaagacatacatggagccaacaaacatatgaaaaacagctcaacatcactgatcattagagaaatgcaaatcaaaaccacaaagaaataccatctcatgccagtcagaatagctattaaaaagtcaaaaaacaacagatgctggcgaggttacggagaaaaaggaatatttttacactgcaggtgagagtgcaaattagttcaacaattgcggaagacagtgtggcaattcctcaaagatctagaggcagaaatgccatttgacccagcaatcccattactgggtatatacccaaagaaatataaattattctattatgttcacagcaatgtggatggaattggagatcattattctaagtgaagtaactcaggaatggaaaaccaaacattgtatgttctcacttataagtgggagctaagctatgaggatgcaaaggcataagaattatacagtgaactttggggactcaggggaaagggtggaagggggcgagggataaaagactacaaattggatacagtgtatattgcttgggtgatgagtgcaccaacatctcacaaaaacaccacaaaagaacttactcatgtaaccaaacaccatgtgttcccccaaaacctaaggaaatttaaaaaattttaaaatcattctattataggccaggcgtggtggctcatgcctgtaatcccagcactttgggaggctgaggcgggcggatcacgaggtcaggagatcgagaccatcctggctaatgcggtgaaaccctgtctctactaaaaatacaaaaaaaattagccaggcgtggtggcaggtgcctgtagtcccagctactggggaggctgaggcaggtgaatggcgtgaacccaggaggcagagcttgcagtaagccgagattgtgccactgcactccagcctgggtgacagagcgatactctgtctgaaaaaaaaaaaaaaagatcattctattataaagatacatgtattcatatattcattgcagcatgagtcacaataacaaagacatggaatcaacctaaatgcctgttaatgatagactggataaagaaaatgtgatacacatacaccatggaatactatgcagccataaaaaggaatgagatcatgtcatttgcagggacatggatggagttgaaagccattatgctcagcaaactaacgaaggaatagaaaactaaacactgcatgttctcacttataagtgggagctgaatgatgagaacacatggacacattgttggagggaacaacacacactggagcctgtcggcatggggtggggacagggagtgcatcaagaagaacagttaatggattctgggcttactacctagatgatgagatgatctgtgcagcaaactaccatgacacatgtttatctatgtaacaaacctatacattttgcacatgtacccctgaacttaaaatttaaaaaaagaccagtcctgtcttttcacattcccctgatctcttcctatgagctggaataataaaaaccagagtgatcttttatatcacatggtgaataaggcagaggcactaccagaataagaccttgagtgactatgtggaaggaaggcactgctaacccagaatactcatttgcaattgttatgtgagaaaaatacacttctatcttgtctgagctattgaatcttactttatttgtttcagtagtttagcatttgaccctaaaaactactctgactaaaactatgcaaaaatgcatgtttatctaatcatagagataacaagaagccctaggaaagtacaaagtgattgttttaaggtaatattttataaaatttaagtattttccaattatgtgacaacatttcttttggataattattatggatcagtcaagggccaaatacacaataaattgttcaatagattcagtcttcctctgaaatccaaggaaggccatatataaaaacaggagcaaattgctaggggaattcatatttgattcctaattgtacatttaccagaagaaaatttggcatttgaattgagcatttaaattcactactattcaacagcaatctgaatccccaagttcaattaaaaaggtcattaccctctagaactggaggtgctcttttaattacaatattgctaatgaattgggagacaagacattttggcttagttcaattagcacatttaagtcaaagcaaacttcagccaatatgggtgactttcccagtggcatgctttttctttattccctccttccctccctcccttccttctttttgtgtcttccctacttccttctttcctcggaaatttaagcataactctggcacgtaagtctctcatttccattttatctgtaaactgctgcaaagctgttaatagctaaggacctacaaccacatttttgttttgcaaaactcttcaaatttatatgaatattgagaaaacattttgatgagaaatttttaacatagctttctgaagcagagtaaaacataaatttcactttccctagctaaaacaataattatccaatcactttatcatggtgtattgcacatgcttttgctatgggaaagggggaaaagtgaacatatttaacactttgctaccaacaatggtttattgaggttaatttatattaggaaagtggagtttccggatgacattccaaactaaagaatactaatgaatagctcctgagctctgagctttcctgcctggctagaattcacaggacatgaccttaaatgtaacagtttttggtaaaaaagagaaaatcttcccttcaaagtgatttgaaaagttcagaaaattagctcttatgctcaaactaatagtaacaaaaacactgctaccagattaaatttaaataaagttcataacagctgtttgtaacatctagatttaactttaggggaaataattgactcaatttgcccaggttattctcttcctttgctatgccagtaaagggcttggagaggttgcccatgcaacatatcctacagatttgagtcagctagactaggtgtttattcatttattcaggaaatacactgagcagcctactgtgagcttggaggtgggcaaacaaaacagagaaaaatctagacctctctctctctgtaaattgacataaagatagttttagccaaggaggaacaatttccttctaatttagcactacagagtgttctccttggaaaagccatccacttggctttgtaccctgattagtctgttctcacactggtaataacgacattctcgagactggttcatttataaagaaaagaggtttaatcgactcacagttcagcatggctgaggaggcctagaaaacttacaatgatggtggaaggagaagcaaacaggtccttcttcacgtggtggcaggaaggagaagtaccaagcaaagagggaaaagctctttataaaaccatcagatctcgtgagaattcagtcactattacgagaacaggagcatgggggtaactgcccccaagattcaattaactcccactgggtccctcccatgacccatggggattatggaaaatacaattcaagatgggatttgggtggggacacagccaaacattatcccctaaacaaagtcataccttttcttttttttttaaagaaacagattctcattctgttacccaggctggagtgcagcgacatgatctcagctcactgcaacctccacctcccaggttcaagtgattctcatgcctcagcctcctgagtagctgggattacaggcaccagccaccgcgcccagctgatttttggatttttagtagagacgaggtttcaccatgttgaactggctggtcttgaattcctgatctcaagtgaccctcctgcctcagcctcccaaagtgctaggattacaagtgtcagccaccacacctggtcaagtcatacctttttaaaatatattctcctttattatattcaagtaagatatgttctttaaagaaaatttagaaaaaaaagaagaaaaaacaaatatcttctttctttgccaaagcaaaaactgctaacatttttaaaattttctttcgaatttcatctctttaactctcttgtgtgtagtagaaaaaaaagttgtaattatattgttttttaaatttgtgctaagttttaatgcaaacttttcataaaacatttagtggaagcatattccttaatttataacatattatgatttttcttattgttttcttcattgcagattataattaagatgatcaacttttcagataacactttcctaggagaagtgttgagtcaaagaataaatatgtatgtttttattttaaagtatatatgtatacacgaacacacacaaatatatatgtatatattttttatttgtttaatttgtattgttaaagggcttttccaaaagattgaaacaaattatactccatctaaaaaaaatgcttacttaacctcactcaggtatatacataatccacagcttactcagatgtatatataattttctaatgagttaggaaaatgattacatgcctaagattttctctgtatttgtaactaaagtatggtgatttgtgaaaagcttctttacatctattttctattaagatgttgttaaatttttttgcctatctttgaggtttcttttcaatggcttattgtgtgtaaaataaaccatgataaaactattaggtaatctttaaaaaacaatttctaagagtgctgtacatattaaaaatatgaactttatattggccacatttattgcaaatattttcccagatataattagttttaattttatttatgacatgttttaccaaaaagtacaagttttatataactaattgtgatgtatttcttatatcaagatgttaaccaatattttttattcaattcttatttttcacttctgataaatttccatggtatttgtctcaaagctccacataattctcatcattccttaaaaaaaaatattgactttttaaagaaacttcttttacttattgaattttattactcattccaaaaatggttaattttcttctctctcttttcttctctctctctaaacatataatctaaacaacaccttttaagttgtttttcttctccagtaattatcttccttatttccactcttatcacagaagccaaacttccagaactatataaaataataataataatgggaatctgaactattagttgttaatataatattgatatttttcagcatgttaagaaaatacctttttatttctaaatttctcaaaagtattttgttggtggtgctggtggagaactatttttacatttaaagccagaaatgattagttatataaaactctgactttaaatgtaaaaaagtgcattacattatgaattttattacagccaggcatggtggctcacacctgtaatcccagtgctctgggaggccaaggcgggtggatcacaaggtcaggagttcgagaccagcctggccaacatggtgaaactctgtctctactaaaaatacaaaaaattagccgggcgtggtggcaggcgcctgtaattccagctactcaggaggctgaggcaggagaatctcttgaactcgagaggtggaggttgcagtgagctgagactgtgccactgcactccagcctgggcaacactgtctcaaaaaaaggaagactgtttcaaaaaaaaaaaaaaaagaaattttattacattacggaatcttttttaaggcatttgcaatatattcagtggctagctttgcaaaaagttcttatgaatttgttttatagataagatgttcaatattgtcagcattttttgattaaatatcttttttatcttttattgataaaacaatattttttattatatattattaaagtaagttattctgtataacagactaggcaacagtgaaagttttctaaatgctttcttgattcaccttaatattgaattttgctatctataataaaaaattctataattattacctttttgttatctttgtcaggctttttataaggtaataattatagaatttttggggaaaataaatcaattggtagctttccatacttttgcatgtcttacaacaaattctatagcataggaataattcttttaaaaaccctaaatactttgggaccaaattcttatttagaggtaactaacattttgatactactcatgactaatggtacattaagaatgtttttattttctggctcaatttaggtagtgtatattttctcagaaaaatggcttctgagaccttcaaacatactaagatttaattttacataatatttccttattttaaaaagttattcttaatatatttccattttaatttataacatttataactttatatatatttactcttactatttgattcactatgggtcagtcttgttttgtttgaaataaccagagttgattaagttatcaactcttctgatacctttcttctaataaataaattcttgcttttatctccatcattgtctttcctccattttcttctacttttttaattgaagaggatattatagaagaaattgttatttcttcacaattcttccttagctctcactcttgccatggttcactgtgggcagagtaaattccttggctccactgacctaggcctgaccatgagagttgctttaataacatttaggtagaaaagaagttgtgtcacatccaaataggggctttatggagcattccatgtgtccctctccacgtgtcttgtgttcttacccttgccttgggaacatgcttcccatttggcggctgatccttcagtcagcatcccagaaatagaaaaatgcataaagcagacatcagtccaacctgcagagtgcagttgagccacagcgcccaacaacgacccagcctctcttattcaacgtgctgggaaacaaacatttattacagccattgagattctgtactgtcatggaggaagacctagtgaaaagtgacgaatactttttttttttttagactgagtctcgccctgtcgcccaggctggagtgcagtggtgccatcttgactcactgcaacttccgcctcccgggttcaagcaattctcctgcctcagcctcccgagtagctgggactacaggcgcacgccgccacacccggctaattttttttttttttaattttagtggagactgggtttcaccatgttgcccaggctggtctcgaactcctgagctgaggcaatctgcctgcctcggcctcccaatgtgctgagattacaggagtgatctgccgcacccaggcaactaatacaattttacattattctttctatcattataaattgaaccccttctttatgctccatcttacctgtttattaataataaggctaaaattatgccactgtgtacagctttgtaaatgggccaaaaatttaataattttatgttaaaacattctaaaagtatgaaattatagttattatttcctatttgacctaatatatatttacaatatatattttaaaatttctatctgtgtgcttttatcatttaatccgtattattcgtttacagcattcttgcagtgttttcagagagatgtggtcttacaatttttgagttttcaaatagatttaggttgcttatatggcttacaatgtgatattttaaaatcacattactgttttggtaaatagttgaaaaacatttgatttttaataacactttaaatgttttaaacttaatctgaatatttgaatttaatttgggatataaatctatgtgccttgattatgatgactggtaagattcactttatctctgcactgtgtgctttaattttcttcagtgatacaaaaccaaaacattcatatcctcctaaatttttaagcgcattcttaaaccatttcctctgattaacaaatttatgaaaaatacaaaaacattggcctgtgcatgtttcatcccccaacacacactagtgtaaaataattttttatttctagttcacttaaattttcagtatttgacaagatattttgaggatacagttgttgattatgactgtttaatggccaaacttttcatatatttattctctgggaatttttttaacatttgcaaaatattccgtggccagtgttgcaaaagtttttaaaaatctttatgttgaactggaatcatgcccacaccactgtatatatgttatttaattctctagttcttagttgccgcattctcatttttcattttattggagcatattttcaagtaggattattcaaaaatgattcatcaatgatatatgttttgaatcctttacaatttcaagaatgtcttcacatagaaatgacaacatggctacatttataaatattgaaatgcaatttttttccctgtgagactccatataagtgacttcttctagcatttattatggtgcaaactttgaatctaacttaaaagttgtacttttttttttttttgagatggagtctcgctctgtcaccaggctcgagtgcactggtgtgatcatggctcaccgcaacctctgactgcctggttcaagtgattctcctgcctcaactcctgagtagctgggattacaggcatgtgccaccacacctagctaatttttgtatttttagtagacatggggtttcaccatgttggccaggatagtctcgatctcgtgaccttgtgatctgcccgccttggcctcccaaagtgctgggattacaggcatgagccatcgcgcccggccaaaatttgtgcttttaagtaacatccttctcttccctgcactgaaggatatgactttgttattgacattttaaaaatctaacagtatattctaggcataggtctttttcaccagctttccatgaaacatagtgatccttttaaacttacaaagccaaaatcttattagttctataatagctgttttattatgactttgattattctttttggtcagtttgttttggcttaattcccaaggattgtcagctatctacaaattgcatctttgttttctttccttgatatctattatgtttttgattgatctgcattcttaatgtacttttcaaagttgttctttaagtcactgactgcatttcatagttagctgattctgtttttaccacctccaatgaatacttttatcagtttgatgtattctttctaattttccttctcatcccatattttttatgctcacaagctgcatctctgcaaatgacaactttgtatcatctttaatctcttctgtagtgaatttgtcttttctggttctttattgaaaaagcaaatatacattctagaaaaaatatgtttctaaaataattacttctgtttgcaatgttaggacatcaaatttttcttatgttagctctttctgtagaaagagtttggtcttcatcgatttgaacaaggggatctttacccatatacacgtttcatgtaaataagtgtatgtattcattttaatctccatcactatttccctgtgtacatccagatattccttttctgatcttgtcaatgaaacccagattaagtgagattgtatcatctcctgtttccctaatccttgcagtaaagtaggtgtatttatttctggataattttaagcagcctgaaattattttcttctatttcccgcactactggtattttacagttctacttataatttgctttataaatgtgttgtgtggttttcccaacccttttcacctctaaacatgctgtatggaagttgcaatctccagaatagaggaagaaagatagtgatgtgtgagggggatgtggaggaggatacaaaataaatttcagtcatctcagtcacccatagacctgggattatcactaaattctctagatatatacagagattataaatctctgaacaaaagatccagagtggggatgaatgaaagacatctcccacccattctaatcacttctggatccattccatctctactgtatttagagcaatggttctcaaactttagtgtccatcagaatcacctggaggacttgtaaaaacaaaacaaaacagattgctgtcacactcccagaccgtctaatttaataggactgtggtggatcctgataatttgcatttccaacaagtcccaggtgatgctgatgctgctgctctgggcaccaaatttcagaatccctaacttacagcaattcttccaagggagctcaatcacagattgaaatattttttaactttatatcagtgtgtattttcacagctatcccacgagcatgtaaggaaaggtgaattaagcatccacagctagtgatttagttaaaatatgttatgtttatatatatttatttacattatttatgcattttactattagatttctttttaagattatcttatatatagatagctatttaaaagctagttggaaatgaaatgtgtttcattgtctaatagaaccattaaaggtacattgttaagactaatttgtaacgtactggccattatatctggaataaacttgtttttagtgggggattaaataaaaatttcctaatacaaaaattgagctaagtctgattggggaaagtacagttgtgtgtttgtgtgtgtgtgtgtagacacaaacatatacataaaatatatacatatgtgtatacatatatatctgagagacttgctaaagtttatacaaagaaaaattctaatttctggctgtgtgtattaaaacatgaagaacaaagccctcctgagacaacattaagcacgtgcaagataacgtgggaatggagtaggaaaggtgtttgttcctggctggccagattcagatcatttggggaatcatgtcttgagtgcagaattgtgggtcactgtgtttctctttctctttgttgctttgagttattaaacaagagcgggggactttattaaaaagaaaatggtattaatgttttagtcctgttaatatcttgaaagttgtttccctaagagtgaccagacatggtgagactttactcaatcagcaagaataccaccatgtactttaataatgaaagaaattaggctggggctattgtaagaacagtttctgaatgacgatgcaaaatataataaacacagaagtcccacactggcacagcatctgtgaggctctggggtttatgctccctaggtttagaagattttatgtttcaactccacagacagacattttcagactacctttatgtgattacactgtaatattcaattttgtcaaattatttttctttcatgcattgaattagtccctttttcctaattctctttggaattaacaaatttagattttccagcacatggcagttccatttaagtggaataaaataagctctgttcatttctcttttgctttctacagtttgcttttctctgtgtgaaaatgctgtttctttttcaaatgtattattattctcacagacacaaacagaagctccttttgcaattgacttgcctctctttctgccattacaaaattatcactatggtagtttcatgagttagaagataagtatgattaaattccacttgaccttgtttaacccttcattcatagaacacttcctagagcaagggattttgaagctgaaatatctctttgaagctgatacataatatggagaggaaaagcaatcttgccttgaactttgaaaagcttacaatctagactgtgccactgttctaaaagcgtggtccatgaacatcataggtatcacttgtggatttgttggaaatgcagattcatggaatcacctagtgaaacagaatttttgtttaaacaaccattccaaatacactattttataaaatcctttaggtgattcttatgcatattaggtttggaggctactgctataatcaaagataaattatgattagattttttaaatgatatcttagtagatttcagaagtgaaagcaatgccttctggtgcagataaaggaagtcttctggcacttgaactgaaagtaaagaaggctttttctgggttatgatagtggatcaatggctaggtggaagggaagagatgatacaagcaaattcccaaggccaggaaaacacagatgtatcattgcatagggggcaggtaagtcaaaatacaaagtctaaagacattaccaaagtactttgtgagtaccatggaagaaaacgtctgataccagcaagagtgaggggaggcctcacagagcaatttatataaggctgggccgagatgggtaatttcaatttacaagtcatctaaactgacggctgggaaaacacaaattcagattttcagagcggaagagaccttcaggataaactaatacaattcactacacaatgcatggattcctcctctacaacaggttggatgagtgtttggcctttgctgggttctactgcacattcactagcattgcgggaagtcagggaccccgaatggagggactggctgaagccatggcagaagaacataaattgtgaagatttcatggacatttattagttccccaaattaacacttttataatttcttacacctgtccttactgcaatctctgaacataaattgtgaagatttcatgggcacttatcacttccccaatcaatacccttgtgatttcctatgcctgtctttactttagtctcttaatcccgtcatcttcataagctgaggaggatgtatgtcgcctcaggaccctgtgatgattgtgttaactgcacaaattgtttgtagagcatgtgtgtttgaacaatatgaaatctgggcaccttgaaaaaagaacaggataacagcaatgttcagggaacaagagagagaacctcaaactctgactgccggtgagccaggcggaacagaggcatatttctcctctttcaaaagcaaatgggagaaatatcgctgaattctttttctcagcaaggaacgtccctgagaaagacaatgtgtccctgaggggaagcctctgaaatggccgctttggggatggctgtcttttatggtcgtagctgtgggatgaaataagccctggtctcccatagcgctcccaggcttattaggatcaggaaattcccgcctaataaattttggtcagaccagttgtctgctctcaaaccctgtctcctgataagatgttatcaatgacaatgcatgcccgaaacttcattatcaattttaatttcgcccaggtcctgtggtcctgtgatcttgccctgcctccatttgccttgtgatatcttattaccttgtgaagcatgtgatctctgtgacccataccctattcatacactccctccccttttgaaaatcactaataaaaacttgctggttttacggctcagggggcatcacagaacctgccgacaggatgtctcccccggacacccagctttaaaatttatctcttttgtactctgtccctttatttctcagaccggctgacacttagggaatacagaaaagaacttatgtgaaatatcgggggtgaatttcacccaatacaccaggattctctcatacattaggaagatatctaattatcaagacaaagcgtcctcttctggtgttctcaatttctgtttatttgtttgacatttttacctgctcatgagtcagtatctctggtgatggaatattttaatatgtaaacatcttaccttttaactatactgctcagatagtaggtttatattttacatcatttcctctgcccctggttttctaccgtttatacatgattttttttgaataacaacctgaaagaccaaagctctaacttattttcattgatatggagtaaagtggtatacatttaaattatgtattggacataagatccaagattttccaacacacaaaccgagaatgcatttaccttcttggtatgatcacaggagcaccaacatgactggctgaccccaaacacctccccactggctgattataatagacatgtaagatacatgtattttacagggataaacttgtaatattctttcagacatctaaaaggtgaacaggcatcattgtatccatgtagatacagaatagtacctaatctctaaagaggaaaaacccttagaattagaggaaaagatcgtacaaatttaccctctgcaaataaaattaataaagtcatcagcatatgactttttacctagatatagacatttacttatatgtaaattaacccttaatatgagatattgcaaatattttctgaaaatatgagactttatctgggtttatctgagatactctaaacccattttggggagatactagagtatattcttgaacagacctgacttgcctatttctgctttaaggaaaactataatccacctaattggattgtaacatgtctggtgtgaggtacttctagttattcataaaggggaaaactgtataggaagaatgcattcagaaagagtagaaatgagatccatagaaagaaggaggaggaggtcgggtgtggtggctcatgactgtaatcccagcactttggaaggccaaggcgggtggatcactaggtcaagagatggagaccatcctggtcaacatggtgaaatcccgtctctgccaaaaatacaaaaattagctgggcacagtggcgtgtgcctgtggtcccagctacttgggaggctgaggcaggagaatcacttgaaccagggaatcagaggttgcagtgagctgagatagtgccactgcactccagcctggtgacacagtgagattccatctcaaaaaaaaaaaaaaaaaaaaaaaaaggaaagaaggaggaagaggaggaaaagcagaaagagggaagaatgaatgtaaactgcaggtggcagggctttagtctgcaagaaactgactactatgacagagcaaatgcacgctctcagacctatgagcttctaaaatgatccgaatccatgctgaaaaaggaaactttggatcactttttaggttttacaaataatcttcatgcaccaagaactgatatgatcaatttgttaaggtttgcttgtctatttagctcttcttagtatagtttttattcctttgaattggccaaaaatactgtttcttcaaataattaaggactctatgtcttttgcacatgacattctaatttggatcaaagaattaagttttgtttttgttttagtgttagaagcaccttatagatcatcaacttccatatttttaatgaaaaggttaacattttgtcaagatcactcaactagttaatgagagcattggggttaggacattggggttgtcctgtcttgtgattcaggacaactctatttccagtgctccatatcacctatttctagacagtatctaatgatcactggcttcttagaggttagtagagaaaagttgtttgccttgcatttatattttaaatatttgactttatttcaggataatgttattatataattggctaatttgcttagtttaaaatctcaaatactgttttataaggattattgtctaatccatacccctaaaataaaatgcttaccaaatggcatagagaaaaataatcagtgtaattaagcctcttttgtgtatgaataaatgaaactcctgaatctgaggtataatcactatatctttaggagttctagggtttttatgttgaggaataaattgtaataaaatatttcagaagtcagcacccaaaaatgattgtttaatgacctttgaaatatcttacttgatttcaaggtgctaaattgttttaactacactaacacaaaagctctttaaaagctaagagtcacaattcaagaccgtgggttcattattttatatggattggcacaaactcagtcacctgttcacagccagctccacccccagcgcttctcagctctcatccaccatgctgtcatcacattcttagttttcagtcaaacaaggtctggagctctctttacactgcatcatgttaacatcttatttgttagcttcaagtgtaatgcctgttcaagtttggcatatgcagaagtaaccacataggttctaaatattttaaaacttgatgtaaaaagtccagattacctcatatttagttattctgtgattggccaaggtcaaacagtaaacttggtaaaaatcacaccaaagaacaagcttatctgctggtattaactctaccatttaaaaatacattgtcaaggtgtgcagaatatctaaaggactaaagtttctgctcaccatcccttaaaagccaggcctgctgacaaaggatgtgctccataagtgtctgcatttattaaatcatttaattaattgtagaatggctactatatgtcccatacatggaggatctaatggtatataatgcagacagccttttttttttttttttttttgagacagagtctcactgtgtcgcccaggctggagtgcagtggtgtgatctcggctcactgcaagctccacctcctgggtttacaccattctcctgcctcagcctcctgagtagctgggactacaggcgcacatcaccacacctcgctatttttttttttttttttgtatttttagtagagatggagtttcactgtgttagccaggatggtctcgatctcctgacctcgtgatccgcctgccttggcctcccaaagtgctgggattacaggcgtgagccacagcgcccggcccacagacagccattattttaagtgctgataacatagctgggaagaaaagacacacaatattatccatgataaggcattagataataagtcatattaatggtatttacaattgagatatctggtagtcagttaaccttccaccaactaactatatgccatcggcatgttccttaattttcttgtttgccaaatgaaaaagaaatgcaaactagaaggtctgttaagcttttccatctctctggctgtcttcggtccaatcagacgtaacaaagttggttttgccattgggagcaaatgctaacaaataatactagataatattaggaaaacaaatttcaaggtaaaaattattagtgaagacaaagacaaatattttatgaaaggtataatagaaaacaaaagattatggactttgaatccatttagacctagtttagacctaggtacaaattctagctctactatcttctaacagtgtgatgtcaaaaagctgattcaccattcttaacattctataaaatttggcaaataatatctaactgagataaagcctgtaacatagtctggcatgcaaaagcatttacacaggatagctattaatattactacaagtattatttgcatagcattttttttccttttctaagtcctcacacattagctatgtcattttatcttcacaactactctgtaaagtggtattgtccccattctgcatttgaggaaatggaatcacaaagaggttcactcactacaataggtaactataagtggataccttctatgtctctctacacaaaaattgtggtagagagagagagagatgaaggtgagagtcccttgactccccataagtatcaaattttgcacaactatttttctcccaataagagtcaatcctaaaatgtctgcactcacaactttaaaaatattccttttctatgttgccaaaaatggatgcagtgtgtgtgtgtgtgtgtgtgtgtgcgtgcacacacatgtgcacaaaggaatgcagtgtcatggaactgcgattagtaattagtagggattattcatggcatactttatagatttttagtcagtaatgtcaagatgttttccaagagaaaaaaaaaagtcttttcatcaatataatggagattaaaagcataacagaaataaaatgctggtgaaatgtattttatacaaaggcataatagccaaagtcaagtgacagagccaggaatagaacctaattcaaatgttttgactttatttcacttaaatgttgcttacaagcttagaaagtatatattgtctcgggccttaatgctttttaattttttactgtgtgttcatatcttggatagaaaaggcactcagtctgttaacaaggtcaaaataactccttcctactcttaggaaaataataaataaatttgaaattcttcaagactaaatggttaatagcagccacacttgtgagtaggaagtctgcctttaaataatgatcacaaccatggaaatcttgagacctgtctagctccggtaaaactgcctgcaggtcacactctcactgcatcactacaatcctgttttaatgcagcaggtagctttatagctgtgaattttctgaacataaattgaattatggaaaactgacctatgcacgtcacttagctaccttccagtcataactcagatctaatctttcttagctccccgcagaaaatgtctaagactgaccacaaattccagaaattacatgtgggttggtcatgggaatgtggttttcatatactgggggatttagaaaacaggactccaaaagcagagtcacctgggcctgtgatgaataactactctggtgtgggctgttctgctccagttcttaggaaggaaggtatcctagaaacaagcaaagaaatagataaatcctgggtgatccctatgcttttcctcatttatcttcctcttgctttctaaaaaaggtttataacaatcataaaaataatacaattacgtccacagtgaggggatttttttctccactggcaccaactcataggtcaaatgggagattcatactgacaagagtccagacttctctacacagcagaattgacagtgacagtccatttcttaaagaaagctggtgtctgtgcttcctgctgtcagtccttaccacagagctcatcgactctggcatcaaaggtatcagcaccatctcatgccaaacctatacgagggaatctaactgcaaaggggctttggaaattgaaaaagtttgattacaaaaaacgttcgaatctggagattaataaccttcaaagttctgaaaacaaaaatgtgagatccatttgtgtgtctctgtgttgaaaaagcaattccgcagacattttcactgacttcaaggttaccttttttaaaaattatactactgctttcatgtttctgttctgctccttgccaatgtagttaaaaattgttccatttttgaaatcagataaatctgctaatttgagtgtgactgtcctcttgtggctgctttcctaggtatattttatagctgacagatgtactgcagctcctatataattaatatcctggagtttctatgtttaaacaaaaatgcttaaatcatattatttaactgttgatcagagataaattaaaattttcatgaataaaagacatttttaaatgggacattgtctcagcatttcttttatcccaccagatgttcattttacctgagatttgttaaatgaataaaccaattaacaattaataaaataattaattaattcagtttatttttagagcaattttaggtgctcaaaaattaagcagaaagtacagagagttcccatacacccctgtcctcacacacagacaatatacccctctgtctatatcctgcaccacagcggtgcatttgttacaatcgatgaacactgacacttcattatcacccaaagtccatagtttacataaagattttctcctaggttgggcacggtggctcacacctgtaatcccagcactttgggaggccaaggcgggcggatcacctgagatcaggagttcaagactacctggccaacatagtgaaaccccatctcttccaaaaaaaaaaaaatacaaaattagccagccatgttggcaggtagtcaccatgtagtcccagctgtcacctgtagtcccagctacttgggaggctgagacaggagaatcacttgaacccgggaggcagaggttgcagtgagccaagattgtgccgctgcactccagcctgggcaacacagggaaactccaactcaaaaaaaaaaaaaaaaaaaaaaaaaagaaaaggaaagaaagaaagaaagatattctcctggtgttgtacattgcatgcggattgacaataataacatgtatccaccgttgcagtatcctacaaaacagtttcactgccctaaaaatcttctgtgctctacctcctcacctctccctcttcactatcccctggcaaccactaatcttttactgtccacatagctttgtcttttccaaatgtcatattgtggaatcagataggatgtatcctttcagattggcttttttcacttagtaactatgcatttcagtttcttccatgtcttttcatggcttggtagctcatttttttgtgttgagtaatattcccattgtctggatataccccggtttatttattcattcacctactgaaggacatcttgattgctttcatgttttggcaattatgaataaagcttctatgaacatccatgtggaggttctagtgtggacataagttttcaaatcccttgggtaaatatcaaggagtgtgattgctgggtcttatggtaacagtatgtttagttttgtaagaaactgccaaactgtcttccaaagtggctgtaccaccagcaattgcattcccaccagcaatgaatgacaatgcttcttgctcggcatcctcaccaacacttggtattgccagtatcttggattttggccattttattagatgtgtaatagtatcttgttgttttagttggcaattccccaatgatatatgatgttgaacatcttttcatatgcttattggacatacgtatatcttctttggttagagatttgtttaggccttcagttcatttttcagtttggttgttttcttattgttgagttttaagagtactttgtacattttggatgataatagtcttttatggaatctatgtatttcaaatatattattcatgtgtgtggctttgttttcttattctcttcatattatcttttgcagaacagattgtttttattttaatgaaatccagcatatcaattgtttccttcattgatcatgactttgatgttgtatctaaaaagttgttgccattctcaaaatcatctagattttctcctatgttatcttctaaaagtgttatggttttgcagtttacatttaagtctatgacccattttgagttaatttttgagcagggtgctggggatgtgtaaagattcatttttccacatttggatgtccagttgtttcagcatcatttctgaaaaactatcttttctccattgtaatgcttttgctcctttgtcaaatgttggttgactgtctttatgtgggtctatttctatgctctctattctatactatttatctatttaccttttttgttcaaataccatactggttcaatcattacagctttacaataaggcctgaaggcaggtaatgtcagtcctccaatgttgtacttctctttcaatattgagttggctattctgtgtcttttacctgtttatataaactttagaagtaatttgtcaatgtccacaaaataacttgctaggatttgtattgagattgcattgaatctataaagttgtgaagaagtgacatgtttgacaatactgagttttcctgtccacaaatatggagtatctccatttatttagacttttaaaatatctttcatcagaggtttgtagttttcctcaatttaaatttatacctaagtatttcatttttgagggtgttaaggtgtaaatgataatatgtttttaatttaaaattccaggctgggcgtggtggctcatgtctataatcccagcactttgggaggccaaggcgggcggatcacaaggtcaggagttcaagaccagcctggccaatatggtgaaaccccgtctctgctaaaaatacaaaaattagccaggcatggtggtgcatgcctgtaatcccacctactcagaaggctgaggcagaagaatcgcttgaacccgggaggcagaggttgcagtgagcctagattgtgccactgcactgcaacctgggtgacagagtgagactatcttgaaaaaaaaaatttccacttgtccacttgtttgttgctagtatataggaaagcaattgacttttgtatattaatcatatattctgcaacctttctacaatcatttattagttccagaaagagttttttagtcaatgctttggatttttgacatagacaatcatgtcatctacaaacgaagacagttttatttctttttcccaacctaggactttttaggtttatatttattgtaatattatttgtactacctcattggattgtcccaataaatgaataggtgtgctgtccatagacattgtcttcatcttcctaatgagagaatgatgggctaagttgctcagattcacatggtattgaaatcagtatttgtttcactctatgctctttcctactacattagactatactgccttccaaggttctaacaagttttgattttaaaagcagcatcacatttcttacttaaattagtttatacatcaaatcagttaatttaatgggcaactttcctaaaatttcttttaagtgtactacacacaaaaaagaaaaacccataaactaacaaaataagttaaaaagcttacaatggatttatgtagtataaaaataggtggcaaattttttggcaattaaaaatgtttgaatgctaaaaactgcaaaacattgatttaaaaaatcaaaggaggcctgaataattggagagatataccatgtttgtggattggagaactcaatactgttaagatctcaatcctttttaaactaatataacgattcaatatgatttctatcttaatcttaacaatagttgtgtaggtactgataggcttatactaaaatttacatggaaaagctaaagaaatagagtagccaaaccaattttcttaaagaaaaagaaagaggactgacaacacctgatttcataacttactataaagttacagttttaaagacaatcttgaataaatggtagacacatagatcaatgaaacagaacacagagaccagagacatacccacacatataggccaatagatatttcacaaaggtacaaacatgatttaatagacaaatgataatcttttcagcaaataacgctgaaacaattagacatccatatgtaataaataagtaaactttgaccctttatttcacaccactaattaactaatatacaataattaatgcaaaccctaaaattatcagacttccagagaaacatagaagaaagtcttcataattctggattaggcaaaagtttcttatctaagtcataaaagcataatccatatatagtaaatttaataagtttgatttcattgaaattaaatgttctgccatggacaagatactctgaagagattagaaaaacaagccatagaaatagagaacatatttataaatcccataaataataaaaaacttgcattctaaatacataaacaacttttaaacaatacaaaataagaaaatagggcttgaaaataaaataaaagatatccacttcagaaaggaagaagtatagctatattctcagatgacatgatcttgtatatagaaaatcctaaggaagacacacacacacacgcacacacacacacactgtatgaacaagagtgactctatttaaatgctaatctgccatgtgactcctgactaaccctaagtctaggaatgcctccaagatgtctagctgatgtattactttttatatagaaatacctgttcactgtaagttttccctttcctccaaaacaacccttgatggtgttgcatacatcataggctatgaggcccatagctacctactcattccttctggagcacatatactttttccccaattcaagcctggactaagggggttgtggtgcagagatctacctatcttgcagctgtgtaagacatgcttccatttgtaagttctcccaataaatcactattttcctataatctagatttgtctgcctcactctttgctttcttcactgttagcctttggaggatgctttgtatatacagccctttcatggaacacacattcacacagcaacaattagagctaaaaagttcagcaaggttgcaagattcaaaattaatatacaaataacaggccaggcacggtgactcatacctgtaatcccagcactttgggaggctgaagtgggcaggtcacctgaggtcaggagttcaaaaccagtctggccaacatggtgaaaccctgtctctacgaaaaacacaaaattagccaggcgtggtggtgggcacccgtaatcccagctactcgggaggctgaggcaggagaatcgcttgaacctgggaggcagaagtttcagtgagccgagattgcaccattgcactctagcctcggcaaaaagaatgaaactccatctcaaaaaaaaaagaaaatatatatatatatacacacacacacaaataacaaattatatttcaatacactgcaataaaaaaatctgaaaatgaaattaagaaataattccatttacaatagcatcaaatagaataaaatttattgataataaaatttactgaataaatttaatgaaataagtgcagactgaaaactacaaaacattgttgaaaaaaattaaaggagatctaaataagtagaaagacaactcgtgttcatggatcagaagacataatattgttaagatggaaatactcccaaactgatctacagattcaatgcaatccctatcaagatttcagattgtcattgaataaattacaagtttatcctaagattcatatagaaatacaagggacctataaaagccaaacaaccttaatggaaagaagaacgatactggaggattcatactttctggttttaaatcttactacaaagataaagtaatcaagatagagtggtactggcataaaggttgacatatagatcagtggaatagaattgaatcttgaaataaaccctcacatttatagttgatttatttatagcaatgtaattgaaaaataattgtcttttcaagaaatgagctggaataaatgggaatctacatgcaaaagaatgaaattggactcttacctaacaccatgtacaaaaaataactgaaaatagatcaaacacctaagtgtgagagctaaaagtataaaactcatggaagaaaatataaaaataaatctttatgaacttggattaggcaatgacttcttataaatgaaaccaaatgcacaaatgacaaaagaaaaaaatagataagctgcatttaatcaaaatgtaaaaccttcatgcttcagagaataccatcaaaaaagggaaaagagaacccacagcatggaagaaaaattttgcgaatcatatatctgataagggggttacatcaagaattcataaaaatgggcaaaggatccaaatagatatttctattaaaaaggtatacagatgaacaataagcacatgacaagctattcaacatcattagccaacaggaaaatatagagaaaagccacttcacccccacgatgatggctataatcaaaggcaaatagtaacaactgttggcatgtagagaattgaagccttcatacactgcagatgagaatgtaaaatggtagagcctggcaccactgaaaaacagcttaatggtttctctaactgttaaacatagagttatcatatgaccgaaacccagaaatgccactcctacatatatacccaagagaaatgaaacagtatatctacacacaaacttgcatatacatgttcatcagaattattcataacacccaaaaaagcagaaatgacccagatgttcaccaacatatgaacagagaatgaaatgcagtacacaacagtatacatcagaactgggcataagccggaatgaagtactgatgcatgctacacataggtgaaccttgaaaacattatgccaagtgaaaaacaagtcataaagaccacatattgtatggttcctttatatttaatgtccagaataagaaaatgtgtagagatagaaagtagggcttgaaagtagattaatagtttgatagattaatagtagattaatagttacctagtttcagggagatagaaaaaatgttttaaaattgattgtagtgatagttgcacaactctgtggaatattggaaacaatcgaaatgagtgaattgtataaaacatgacttatatctcgataatagatatctcaaaaaagatcattgatatcatttgtaattagggaaatgcaagttgaagcattatgagataatattacatacatattaaaaatggaaaacagaacacacacaaaaattatcaatacgaaatattggcaagggtgtggagcaactggaattcttatacattgttagtgggaatgcatgtgccatatgactcagtaaatccgcttctgggtgtctacaagagaaacaaatatttatttacagatagaaatctatactcattcctcagtctaaacgttgccagtccttctgtctctaaactttccctctattctcatctccttttcctaattcaacttttaacccccaaattctctttagttcatagtttagaagcccacttctcaaaattggaatgtttaatcctaaactaattcaatctgcatataagttcccataagacccagtaattacaaccatacacaattgccatttacttttatttagctcctcctaaatgctaggattcaaagaggtagagtatatttcttctgattgtgattgaatctctagcaccagcagtgcttctgttttatttttaaatttatttgaagaacatttgcccttttgcaagcataatgcaaactttaaacatcatattgctagctaagaaaaatttaaagcaacatagataattctcctttgacacaatgatctgactagaccaatagctggaataaaataatgagaggaagacattagagtgaaaaaagaggaggacaggaagagagatcatttgcagtacacagtcactaggctgattcaaagcaccaaagtgaaactctctaaggatgtttcacttttatattggaacgccatatataatttcataaaaatgtcaaagtgattttgaaaactcaaatctcttcaagttgcttatacttaagacaaagcgatcaacgcaattcagagtaaatttgactttgttttttagtgatgggagcatttcttaaaaagcatcaaatctaacatttctatcttgcagaaatcaccaagcctagttaattttctcatgaaagggactttctgggtatacacagctacagatttaactaggtctaacatacacatgaataatcctttgcaaggtcccccttcctctctcctgacccctaccctaacattgcttgcaagcagcagaggagataaggggaaacagctgatctcctctgtgtttctctaatccacttcaattcacctcctaattcaagataaatcactacaggaaagaaagctgggaggaacccacttccctaaatcaagttcccttcctgtattttactagatagttgcaatacctgattctcaccaaaataacgtcctctagatcttatagacatctttaacaaaaatccaccttgttgagccttgtcttttcaaaacttgaccctagagcagaaattgcaaaactagtgattcttggcattatgtattgtcataagtgatgggattgtgtttttgctttaattttgctttaaattgattcagctctctacatttcaaaacaaacaggcttttacattgaaatccatatttcttagttcttttgagaaatgtgaatgtctgtcaacactaggcctgcattcatgcacagcaataattgactggggacgagtagaggccaacccctttagactgagtgtatactcattatttcagcacagcctcatgctcctgagccctttctttcactcattacttcttggtaacctactgtaagcatttgaattttctgtctccaccttagggctgagagggggctgagtgatagggagtggcaactctaaatgcattttagattaggaagaatattcataacaaaatgcccttcgagtctatacttctattaggaactcaatagcctattgaggattaagtaaggaagctaactagtatacatagcactggttaaaagacaaaatggttccaatcaacttacaaatggactacttgtactttctcattagaagaagatgactgattttcttaggtcttgtgtcctgggctaatcgctaagcaatagctaagcagttacttaagagttagaaagaatgactgcatgcagattttacaggcagaagtgtgggcttcccagctctctgcttctctaattaaggaaggtggaataagaagaaatctaatcaactcagaatttttgcagcctgatgtactcaatagcaggtctcttgtccaaaagcgttcagaaaggtttctcctctcttcatttaaataattaaacatataaaacttgggctcactttctacttttaaatttattatgctacctttatccctttaatctctggcattgatagaactgagctgatatctacttttccatatattagctgtgtgatcttaagtgagttgcttaatttctctcagctagggtttccttatcagcaaaatggtaataatagtatttatctccatcattgtgagcattgatataatgaggtaatgagtgtaaagtattttgcatgattttggcacagattactaaatattttattttcctttattttcttcccttttcttttctttttattatttttaaagttattttcatcctataaaagccataaaataaccactcctgcagtatgtctggttaactagcctcttccattcaccatcaaattacctacatgtatgaaacaaataaaagaactctcccctttggtttttagaactttcaatgccaggaatggagaaaattattttaatctcacatcttccatttatagataatgaaactgaattccaaaatttagtgatttgttaaaagcacttcagcatgggagtagaactcattcattttaaaacacaaaagacaaaaatggaatgaggctttaaccagcagggttcagtatatataagccctaaagagcacgtcgtagggactcattatgcttgtgtttaattgagtggaatagtgaattgattaaaaagaacagatcatccccaaagtgcatgatcaggctgatgattaaaacaaagtttggtttcaagactgggattattcttcagctagttgtcagttagcatgtttgcttgttacctcttgaccaaataccatgttggaggtcaatctggggaagttttcaagttcagagaagtttcacccaccaattaattgtatatcaaaactttgggccgggcatggtggctcacgcctgtaatctcagcactttgggaagttgaggcaggcagatcacctgaagtcaggagtttgagaccagcctggccaacatagtgaaacctcatctctactaaaaatacaaaaattagccatgcgtggtggcaggcacctgtaatcccagctacttgggagactgaggcaggagaatctcttgaatccaggaggcagaggttgccgtgagcctagatcacgtcactgcactccagcctgggtgacagagggtgagacttgtctcaaacaaacaaacaaacaaacgacaacaaaagaactttgggtacataattttagcagagaattttgcacatgacaacttttgacctgttaatgttgctgaaaaacaattctatctgaaattgaaagttggatacaagggtccaacaacatatacatttgaaaattaccttatgaagtgaaattttcaaaaggaaaatgtcaccgcttgtcagagctatctgaagattcaggtgatctcttttcaggcaagatttttgaaaaaaacatttagagaagaaagggaagacaaatgtttcctgaacgatgatgtccacactgtgtggcatttggtactttaatgtgttcgtattcattggatcctacttgcttcaggttgcagtggaacacttcttttacaaggcagatataagagatatcaagtgtttttcctaagaacacctagccaggattcaaacccaagtctgtctccatatttcatactttactcaataaatcacgttgttgtccacatttcaagattttctatggggttaatagatgttcgtttattcaataattcattcaacatttattgaacactgcacttactaaatgtcagactaagaaacaaaaacaaaggttctagacagtatgtccagggtccagcacagtatatggtcacaataggctttaaagacatatgtattaaattaatgaataaagacacttctgctctcaacttgctcattatctacctagaactgcactgtctgatatctggccaccagccatgtggctattgagcacttaaaatgtggccagggtagattaagatgggcttcaaatataaaatacatcccaaattttaagtcttagcataaaaagaaatataaaatatctcattaatggcttttatattgattatattgaaattatagtgtttggggtatattgaattaaatgaaacatattaaaaccagtttacctgtttagttttttactctttttagtgtggatcctagaaaatttaaaactatacatgtaatttctttcaattcctattggccagccttaacctagtgctgttaagtcctggggcacttgcttttctgtttcaagttcattattaaaactagttctattctctctcttttatgtatgataataagttaggtttaaatgcagtttattttaaatgcaatctatgtttgtgagattagaatcaattgttaaaggttagaaatttttgtattcagatgcaaaatagtccacacgcaggctctactgaaatatgacttccctttagtccctttcctggtgagaagctaccacagttctccagatatgttactgccagctatacaagaggaagtctaacccgtgcagcctgataatcaaatatttaaggctgttcaactgcctctatcccatctcatgctcctgccaacttacctatctagatttcctttctacagtattcctggaacacaggaatgagcactgtacctttattcatgctgttatctctacttggagttttttgtttgtttgtttgtttttcaattccaatgcctgcctagttttcaaggttcagcttattgtttacttcttgccaaattcccaaactactataatcccatataattttctcttttctccgaattctaagacactaacattccatttgaaaatatctatacttgattgtgggaaggctcttacttttctataaatgaatcattacccttttcttatattccaaagaccgtaagtagaaaatttataaagaaatcactacaacatggaaaggaactcaccgtgcatttggttaggcttttaaaggtcatgttcagccacatctttttaacagtaaaaggactaagatgctgagcagtttataaccaagggagtgggcagtcacaccggtgtgctctgttctacataagtaaagcattcccgcctatagcatcccttccctaccaaaacaggagagctgccaagatgctcacttagaacagttgttggtttgtgtacaagtgttaagtatgggtttgttctttttcttttatatttttttgagggaaagaagaaggaagaatggaaggggactggaaaagctgtatttatttataatcaaacatatccttatttgataacagatgaccaattaaagcaatgtgtgaaacttgaacagcattctgtcaaaaagcaaagaaattagcagagctcatagcaatcagcacttcttgcaaactgcaagagtcccctctaaagccttctgtcttggcactggggctttgctaaatagggctcaccattttgcgagtgggaacaatcagctttgtaggtggtagggaagtattataattaaatgtccacccactttttcctttctgatgaaaggctcccatgaaacttactaaaataaggtacataaagatagatgaatttttgatgagtaagtcaaagcaccgacaaacctggctttccacatagagaaaattctttaatttatagaaaaatttcggcctagatcattaatactgtcatatttaataactaatacgataaaatccatagggtaactggagatttcactgttttcgttggtagtgattgtagtgctcagcatgaattgacttgcagaaaacaaatataattcaaaaaaagagtgaaatttttcaaaattgattttagagaaatattaagtgatagccatttaatcataatagcctttttaataataaataatgcatttattgaatgtaatggcattcttccgaataatagttatagtaccactttaaggttagaaactatatctctgatatagcaaagggcttgaaagatgttattgaattgtcagaaactttttatgagggagctctggaacagagtctatagagtctgcttttgataattaatggtaatggcatttactaaaatcactgtgaataattaattttaagtacttatatgcagtagagtagggagcttctctgctttataactgagctcagacatatatttcaagtccagttactagcattcacaaagtcaatattttagaaagaaaaagaaattaaaattaattggtactatgaatgttttccttcattcaatgtggatttattgggcatgagctgtatagactttgctatcagaggagcctcaaagcaataatcctctctagaactaatgaatatttttatttttaagctaaatttcatatttttatcttcctgttcaatagattttattggcagaagccagtagagataacggtgccctaaatcaccaacaaggtgagatcaaagtactggggaggatatgaacacatttgtcattaattgaacacatttgtcattcattgctaatcactatgtgaagatgacttttaaaatactcctgacgacttcttatccttccccactgtggttctgtggatccaagaacacagagtaactggatgctcaaagtaggaaaagtttgcataataggtactcagctcagcataactaagataaaattagccacaaagatctagattctccagttactggcactatccagggttttataaccatcattacccatgatcattttatagtaaactacaataatagatgtggtgacacatctgaggtctcctcctgtattattagtatagcgggacacctcagatgtgtcaccaccaaggaacaggcatgttcagaccaaattcttcggccactgtcctcctcattcccgtttgtttttttgaattccccagaacttcttgtttttcaaattattacccacatacttttttaatatttcattttctgctttgtgtttagtcctactttttactatctttttgtaaaagttacacgttaaccattatttaaagagttcctttaacagtgtggaggttttcttcaaagacttgatagaaatctttaaatatgggcttttttctcatttaagtcttacttcaacatgttcactgattttagatttctctgacaaacatggttgaggtatcaaaacaaagacatgttgataatagctttttctcaaagtcatttagaatgtaagactttctgccgtgctatgtcaaattgcccaacttgggaataagatgagtgtatgtgcatgtctgtggggtggggtggtagggagcaaggaagtaggggattggtaaatagtctatacaaggagaactcatattgtcctctaaaactgatatatttaggctctcctattttccacgagtctatcatagacacttgtgtctcaatgtttgtagtaaattactgatgattttctctgttgctttggttaggaagatcctttcaaaaacagatttttctgggagataaatgcagtactttttcttcttcatgagataaacacacacacacacacacacacacacacacacacagagagagagagggagagagagagaaagagagaaagagagagagagaaacaacctagtgtgcaagcagtatgcctaaaaatcatttttattttctcctgttataggaatctataagtctgtaagtctctcagttgaaaaaaaaattgttacatcatagaatttaagaaacttggaatgaccttagatattatcctgtctaactttcactttatagataaagcaaatgaaaccctgagaagagtagtgaccacaaatactttgctattccttctattgagaaatgtagtctcactgctcccttttcctgtgtctgggcagtctctgtaattggtttgaccaatagaatacaaatgacaactgcagcttcctaattcttgcttgcatttgggacttctcatctcagaacccaaccaccatgctgtgaaaagctgaagctacatgaagaagccatgtattgatgcaccagtcgacaaccacagctaagcccccaactgacagttaacgcacttccagtcatgtgaatatgccatttagcatgtccggactaggccaacctttggcaggctccattccctgccagtatgtgacagcaatcacacgagaaaccttaagcaaaaattgcccagctcttcccagtcaacccatagattagtgagagataacaaatagttgctttaaatttcaggatggtttgttatatactaaaagctcatcagaaatgaaagtgacttagaccaaaacttctaagcattaccagagtgaaaaccagaactcaaatatcaccccaaacctcgtataatctcattataatgtgttaaggaaacatgtcgagttaaatgagatccagtttcagtctcccaatagttcataattccaaaagattttattctttcaaaattcacatggaatgcagaatttccaaaattcttgaactttaaaacaaattcttagagctgtgtctacataacagtaaaccatcatttggtataaggtagcattcccaagtgttcctcgaaggtagtgtcttagtaatgtgccatgaaagaaagagagataagctgatttaatttgtttaaactaaattaaagaggtctctttgcttcaggatttttcaagaatgtaaattttccaagaggagctatagatagtacttattttctgagaattgttcgaccaaggcacccttcttcatcaaaaaactaaactgagaaataggaagaggaattcaattttgtcagcataaaccaagttttgctttcagaggatttcataaaaagaagttgttttcataatttggtgtgtcttcagcttagagaacacatttttagataacacttttatgactgtcagggactgtgcttagttatgtcttttacaacctgttcccatttcttcccgccttacttttaacattctttggtgtctacagttaataaatctttctggaatgtgtagacgaaggaataaataaaagcagataaataataaataattcaattaattaaaaattatcctgaaatgtttcattaacaatgtcaatgactatgaagaggcccaaaggtttttgagtcaacctctcatttagtttaataacctggaaattagctccaactctaattagcttggtttgggttttatatctttatttacatctaaggccaattgaaattgtaacacttgccatatctaacagagttcttgggaaattcaaagaagatttcaaagttggaggtggaacggctttgggctacaaaaattgtagcaatcatgtattcatccactcctttcatcttctagttctggagattgagatccagaaagagagtttatagcgcaaatgctagctgcattggaaacctcctccccgtggatccacgttaaagatgttaggaaagttctctttttcagtagatgttatattgaatggtgtgattctaattcacgtgctgattattagacagactatttacaagcatttgggccgtaaaaacatatttgaccacagaattcatgactggtataggaaggtgtggcagtcaaaacatttaataacccatatggcatggccactgacaaccagagtagacaccagccatgaacaactggtgcagccatgctgatgagtatgagccatactgaatatcatctgagatctatggatctagtagataacatttcccacttcttgccactggtttgtggccttgtgaatactttcatcttatttgtattagacattcctccattcaggctgtctcttaaatatacttgtgttattgacatccataatacagtaagttctattatctctctcctgggaagctatcagcacttcacagctccttcagcaatatgctatcctgttccaaaaatcatggtgcattcccatgtctctagtttccaagcagagggaataatagttttatggtcttcttttgcccctgtggggacatgagccagttcactacccctacttacttattcctggatatctctaccctgtatattcctatattcttgttctgtagtcatgctacatagttaaatatgacttgaaaggctgacagagtaatgcagctacaaaaagatggcagagaaataataaaataatatgtgatagagtatttgatacttttaagtcagaatgggaagaaaatatttgtaaggataaatcaaagtattctgcatttagccagttcctttgtgaagctctaataaaatatgtgtttaaaaaataagacaagccaatgtggagtgatctatacaatcggacatatacaccttcatattactttggccagactctgctgtatttgtaacacggtgtcaaaagtttttatttaggtacaattcaaccataaatggagaatgggagcctcattctcctggactttagtgagttacagttctagcatgcttacctctacaagcctgctggtgtgttcatgaaatatcgcagcatattcttttatttccttttcccggccattcttagcagcttcaatgagaaccaaaagagggactgtcgtatccaggaaagagtctgacacatgatctataatagccttgcggagctgagaagaaatgaaaaattcaggttttttttttccaggaaatagttcactgtgtttccttttcttacaatctcagtagttacacaactcatttttcatttttgcacaattcctaaaatcacaatacttaaagatatacaagaatgtcccttaagaaactaaaaaacaaaatatccaggcaaaaagaaaaaatcatctagcaatatttcctttcctctcaaaagtaatttttcttaagttgtatttaacctggaagtcagattaaaaatggtaatactttcttttttgctcaaagaaattgtgttattagaatatttatgagtgtgtacacataatattgtacatcttgtatttttataattacaaattatagaatgttttctaccttgttggaggaactgatgataaattttgattagctaaattgtagacttcatagtaattaagccaagttagatcaccgattatgccagttgataacagattaatagagcaagaagaataataaatgagtttgatgtccaattttccccatttgcattcattgttcttgccctcacactttaaattattaaacaactataacattctgctacaattagttcttttcaattagattacatgtaagcttattaatgacaattaggcaattactctagtcagcagatattttctgagatttaaaactgcactgaaaaattaattcattgtgtttatataatatcgagtctttaaagatcataatatcgggccaggcacagtggctcatgcctgtaatcccagcactttgggaggccaaggcaggcgaatcacgaggtcaggagttcgagaacagcctggccaacatggtaaaaccccgtctctactaaaaataaaaaaattagttgggcatagtggcaggcacctgtactcccagctacttgggtggctgaggcaggaaaatcacttgaacccaggaggaggaggttgcagtgagctgagatcgcaccactgcattctagcccaggcaacagagtgagactccatccactccccccgacaaaaaaaaaaaaatcataatatcctgaaatgtttcattaacaatgtcaatgactataaatgggcccaaaggtttttgagtcaagaccttcatatagttcaataacctctgtacaataaaacagataaatagctgtcagacagaaaaatgtaatttttctgtcaaagttacattttagagtatttttttaaaagaatagacacttagtttagttttagattacttgggaatgaatagtaatacattttgggagagctgaatgatagagctaaatagaaagtactgtcttctataatgatcatagaataataaatccataataattacaggtttctggaagaaaaatatctctgcccaaaatagtgagcttgctcagaagcattgtgaaattttctgactatcaacaatttaagaaaggcttcaggaagatccccaaggaaggattctgcttagtatgcagaaaggcaaattactagtggcaactaatatttactgagcacttattaggacaaagtatagagtgccaaggggttacaaggcaaaggggagaccttaactgaatgaataatgtgtttgctgtctataggaagtacaccagggaagtcaggcgtaaggtcacgaatttatttgagctgggaactacaggttgtgtaagtttcagatactgaagagaaaagtagagattccttctaatttctcagagtgggggcattttttaatgattatcctcccctttattcttttcttctttcattcataattaggacatgtagattattcttttcttctttcattctaattgagacatgtagaaggaaagctcagatgaaatctacactagagatatgccatgaagggccagcatatgggaactaactcaagcggagagtgtggatgagaccatatagagtgaggagacccacagaggacctcttaggaaacactatcatttacaggagtcatgattaaagagtagggcctaaaaagagactgagataatagccaagaaacaaagagacaaattacccacaactaaaagacaaactttcaaatatatctctgtgttaatgctcttcaaatgtagttatcctaccaaacataactataatattcccatcatggacttgttaaatcttctctgctgtgtaaatgatttcattcaattcagtaaatatttctggaaaccatttcctcacctttctaccaagagaaaggtattgaaggaaatgttaagatggaaattcatgatcccttataatctagtagaagagtgaatattacaataatacattaaacattacaataaagaaaaacttagagactgacagcaaaaaaaaaaattagagtcaaattttaaagataaattaaattaaaaaaaaggaatgagacttgtcccttgggcttgaatactaagaggttattgataaacttggtaagagcagtttcagtggaaaagtgggctgaagagtcctattgctatggtttgaagagtgaatgagagataaggcagtaaagacagtgagtataaacttctgtttttaataatttgattgtgacatgaagaagcaagacttggtatttactactctgagatatatgtttaaagagtgactgtttttcatataaagacttcactataatttcccatctgcaactatagccaaaaagtcttattactcccctttgctttgctggaaatacatattgatttattgccaaagcaagaataacaggtgaaaaagaactattgtctcacattgtgccaacttttgtcatcttttcgtcccatgacagaaggaaatgcccagaaatcagtgacttgagctggatgtgaatgaaacctttaggagctagcacatggtcagaggcagggatgtatctctcccactgaaatcatcttaacccatgcaaaaaacaaagtgtaactaattcaaccaacccacaatattctcaccagtctaaccattctccctgtctaacttgctggttcctgatcctttaccttcactattatgaactacattatagacttttggtgccttatatctcatcctctggatctatctctgatttcagcttttgctggggggaacagttccatgtcctctgaagacattccatgcttcttgtgtgccttccttgtgtctctttgttattctatctcagggcctgttccaagtctctgtgaaattctcaacccagcataaacactgcctggaagttcttcagcgtccacaccactgggggaaaccctcaacctatgcggatagaaactactgcataaaattcctaccctccatccattagtcagacaattctgggaaacattctgttattctcagagatcctcaagctctcattgcctacagcagcaatctcaatagcatatcatttcctctttccctgcctcgcttttcatgttctataacacttgcttccaggaatcacctcctaaataaatgacctgcactaaggtcctagttttagtcactgctttcaggaaaacccatctaaacaggtacctttgtctggtattaatgttgtttgatcatgcaccaagtaagagactccaatgtcttatgtaaactactcattgctaattatactctactaccttggctctgtacatcactgggttttgttctgccatgccctgaattatactcactgtaaaagaggaattattatgagacaggactagaaatgtaggtagggacaagatgtgaaaggactagaatgttatgctaagcaattttcattatatgttctgacatattcatatggaattgttttcattaaattgtatagtcatatatacctacatataacagcaaagtagcctctatcttatttatttccgcattattttcctgcccagtggcacaatgcattcctttcagttgggtgatatacaaaaagtttaaagaagaatgcaatatgccaatatagaaatggaagccaaagcactaaaatctgaagttagtgggaggccaataggaattacagatacatactttcaataaatacctgtttgtggccaggcatgaaagatgttagaacaaaaccaaactgaggtgcttttcatcttttctcactacagtttaataaaaggctttgagacatcaatttttctatttcctactgatgtaagtggtttgggatctcaaaataatatatatcactacaattgaagcccaaagtgaaagccctatgtgaaaagtctaaaaaagccccaccattcccaccaaataaaggaacagaaagaatgaaattgtgatgggaaggggaatggaaaggggagaaagtgtttcagaaaggaatcatcttcagggaaacagaaaaatacatttagactaaaatattttatgttaaaatattgtattaaattttaataaattaacagtatttaaattttaataaatattttaaattaaaagccattttaatttaaatcaaatagcaaaatgtgatttttaaagcttggaattaaatgtactaataattatttcactgtgtatgtactatgtaagtttagtgaaacttgtctcttgtggatacataatgttatttgatgatgaggatgatgaccaggaggtataaaagcctacatatttttttctgagtggtgaactggtactatgcaacatggaagagagatggacctaacaattcagaaactcagcaactaaagaattaatcaagtttttgttttgtctgtttttaccaaaatcccatttgacatacttcatctttactttgatatttatgaaataaaagacatttttcttaatatacacaaatacaaattttagcctgcctttagtgaaatcaaatatattttagtatgtatagtaaaatagaaataagatatatttgttgcttaaatttttttataaagtaaagaatgtttaaaaagtcttcctccttttactgagagagttgcaataggtatacagttttcaaatgaatgatggaaaaagaggctaaagaaagaagaaaatttaactttaaaaaggcatttaaaacaaataataaagaaaataatacatgatggtaaaatcagtgtattaggcactgggaggttctgaaagtgaataggccataatccctagcccctggtgtggtgattacacatatgggctggggttggatggacctgggctagaactgtgtctctatcacgtagctgggtgatgtttgctatgttaactcattttgggggacaaagataacaataccatggcattatttattgttttaggaataaaaattaataatgtaatgaatatgcttggtagagagctttgcaaagcatttagtaaatgagagatgttgtcatagctatcattataaggacttaaaatgcagtgggaagaaaactcattacaaaagaaaaaaatagaagaatataatcattgctgtaatatgcacatgctgtaagtgttccaggaagaaaaaggtccattccagctggtgaaaacagcaaaggtttcatggaagcaatagcatttacactactctggaatttagttgcttatgagttggggttgtgtgtaaggagagtgagtggggaaggcatcaagctgtacaagtcatatgtacaaagatgcaagtgtatttgagcgggaggtgatgcaaattctggtaaataacaagtagattctttcatcagaaaacaggttaatgtgggccaggcctggtggctcacacctgtaatcccagcactttgggaggccgaggtgggcagatcacaaggtcaggagttcgagaccagcctggccaacatggtgaaaccctgtctctactaaaaatacaaaaaagtagcagggtgtggtggcatgcatctgtaatcccagctacttaggaggctgaggcaggagaattgcctgaacctgggaggcggaggttgcaacgagccgagatcacaccactgcactccagcctgggcggtacagtgagactctgtctcaaacaaaaaaaaaaaaaagagagagagagaaaagaaaacaggttaatgtgttggtgtgatgaggaggacacaacactgcgaaggagagctgaaggaaaaggaacattaagaataatggggattaagtcagggccaaatcacagagaacctagaacaccatgccaagaacatttgtctttgttctctagtaaaacaggcaagaaagtcacagaggaagaagattgaaacaaataaatactctcgcctcctagaacattccatcttgatgtcctcaaatctataatttgcttctccttagatatttctaagcaatctctgtcattcctcttggaagaaatccaatcaccctctgaactgaagctgaaatgtttctgcattactgatagaaaggccatggttaagaaaggggataaggatgaatgggcaggaagatgggctctgcttattttttactaaaaaaagttttaaaagataaaaccagttctaaagcaaacgatgaacattaaatactccaaagaaaaacattttaagggcagtgctttctctttcctgtgagaagaactatatgtgagatgcttacaacaactgttggataaacttcttaagaacaagaagtagagataacttatattgctgttttaattaactgtgacttctaccaaaaatgtaaacatcaggatgaaaaataaagtactagggggagggtaagtgaggataatgagaaagaatcatagcaactaacttcatcaaaacggaagatcatggaggtgttcaaagacagcttctaacaattccatccattcctgtacacacataccacttctcctacaacagacagaacttctgcctactcctattgaactgggacagggtttttgactgttttttacttacagattatagaggaaatagcattctctgactttggagctaaggcactaagaatgcttgtcagcttccgtctcccttttcttggcaacttgaaacagcatgaaagagatctaggctaccctgctagagattgaagccacatggagaggccctaaaacattaggcaccgtatcgagagagggaacaggaagaagcactgaggttccaaacatcaagtcccaaatctagccacagatgccatttgactgccactatgtggaaaaccacaagtgaaaacggtacagaaaatggccccgctgacgcccagccaacccaagacatcgtgagatgcaaatatcgttgctactgtttgtggtggtttgttaaacactgatagaaaattgaaacaatggagatgttaacctgtgaaaccatacagaatgttaataccttcagagcacagcagttttctacaagatgggagtatcttcttactatgaagaatagtattagtaatccccaatgctatttctatatctcactgatggtagtgaggtggaaatacaagtaggattgcaatataaaatacaagatgctcggttacatttgaatttcagatgaacaactttttaaatataagtatgtaccatacaatatttgggacataattatactaaaccatgtttgttgttaatctgaaattcaaatttaactgggtgccttgtgcttttatttgctaaatctggtaattccacacacaagtaattgcattttcttgactttatttagaaaaataataattctaaaacctttagaagtataaatgtagattagctctttatgcataatgttgttgaaggcaatatagagggaaaagacacgaacgagagacacaatcattgagagctcatagagacaacttttctgagtcctaggtgaagcagatggggtagaaatcctgaagacgatggagaatagggatcattccacgaaaggggaggatcgctctgaggatataaatttctgagtcctggtacaggttctgactcggtgccccatcctcttaggcaggtcacctcaccacactgacctgctttctcatttgcatcgtaagacaggttgtgctaagttccttctgactcttacattccatgattacaagtgtaaatggtagaaacagaattcacattaagggcataaagttgagaaactgagattttcacagacttcaacattatgtttttatgcagctattattaactggctggagatctctattccatttccaaatctacgtccaaattaaaagattgcttagccattttactaaatcttgccattaaactacgataatacattgcattaaaagttcatagttgaaaagctttttctcccttttgatgagttaatgatgaccaagtgaaagttctgcatgagaaagaactctggttattgaacagaggaaaggaatgaagagcaaatgtctttgaaaatagctaagtcttcctatttctggaaaaatgtttaacttgtggcatcatactagacttataaattgtttaatgaaattctttctaatcccatgttcctgatgacttaaggttaaaaagaaggcttaacttttacaaaaactaatttttgaagtatcatgaaaaaaaatggaaggaggaatgggtagggtctctgaattacttactagttaatcatttggatttaagcatttggatgatgaactctgatgtaatacaatcaattgatcaacattccctaaaaacttgctatgggtcaggcacttacatgcattttattgattcctcacagccctattgcatattattaatttcattgtataggttcaaagcagctcagagagctgaaatatgtgccgaagatctcacaactgatgagaacagaaccagaatttgaatgtaattctgtctgataaggcacacattctttctctgctttgtatttgccacaaaaaacatttgaggtatgaatatataaatgtggaaagtatatatttactctttttttcctgttctaaattaatttgaaaggaacaaaacaagaaacaaatatgcctgcaatgaataacagtttcatttagcccctatgtttctgactccatatctctctcttccctcacctgtctgcgaaggtctcttgtcttcttacacatgttgtctaaagcaatattcagggtattactcctttctttttttccagcctgcaaagaagaaaaaacgacataagcaatggtatcaattaatctttatcacttagcaatttgctttctaaatttcctgaaaataacagcttgaaattcaagaataggtttcaaaactgctatattatatatgattcatgagcatttcacttaagactaagtagaatggtgattaaagctcacattattttcatctttatgcttctgtaatatttccgatacggagttaggttgtattcagtgtgacaataggcagagcattatcttcatgaaactctgatcttcatttttaacaagtcaaatcttaaatcactaagcaggcaattagcttaaaagcattagatgcccaatttgtcaacttctgtgggagtttctaaagtcatttccatggtgtattgtgtaagttatgcagagccatattggaattttgctaaacactaaataaagtatgcagtgcaaattcatacaatttgcaaaagttgaccacaattttagctgacaatattccaagaacaaattgttttaagtaagaactggacgctgtttttggctctttaagataatttgtgcaacacctttttattctttgagcagaacagctctctgttatatccttaacctaaatctttaggctattaagcacatagagagtcaccttggttggtattttctacatattatttttgtgcaagacaactggattaaatctaatcatactttttgcagtgatatctcacataaaagagattggaaaaatcattatgtgattcacctctaggaaaattgctgctgtttaaattaataaactgaaaagggatcttgagagaagaccttgaaaatcaggaaggcaagtttaagcagctgataactgaagggggttacagcacgaactcaatgaaaaaggacactgaggccaagtataaaccacgaggaagcatgtctgacactttccccaatgactaaactcatgcataaacccataccctgcagtggactccctaacaagaaatttaaaaactctctatactctgtcctaacctacttttttactcttatgtactgctatatactctcctttacagtagcaatattcctataattttctgtctcttctccccagttcttacatgtaatgtacctttgatttcagagatcatcttctaaaacacctactgaagtcctatctactcctcactggtttctacagggagttcttccaacaaccctgctcaaaagtaaagtctcacttttcctttttccaacagcattttgagtgtttttcaatataatcattttatttatgtgcatcccccttatgatactgttagaatcctgatattggcaaatatatctcaattttttttctattcctgatagtaacttacataggacttatcaaatagagttgactagactataaatgagcaatttaattcaaaacacaacatagtttgattagaggcctactgttttccaggaaggtgtcattctagagactctggaggagattttagcatttagctctcaaggcacagctaaagttctctatgagctgaggttgctggtatctacctcaaactcaggtcaacctatattttcccaacagcagtgttactgatatttaaagtgtgaaaaatggccatcattggagatcattcgatacactgcaagatatctggcattcgtggacccaggtctgctaaattcaataccaaatctggcgcactgtgacagccaaaaattggcaccacatatgttcagctgcctcctataggaagacacagtagaaggccagtaagtctttaccatgttttagtttcttataaagagattgtggaatgtgtacaccatggaaactgtgtctagggaagagagaagtaagaaaagggaaataggagagatttggttaggttatttctatgagcactaataacattctggatatcagagcaatggcagcaattacacagatgaaagttgtggctaccttcacagctcctactcagcattctctatgctagcagtggggaattatgaagagctaactcatgactatacaggacaatggcataaacagatacacaatgagctctcagacagtttataattttacctaaagaacccagcccttattctctagcttcatgcagtgtttgctcttggttgtatcgctttccacttcatgaaagcagagataataaaaaagaggcagaagtgggacagacaaagagacctcctacacacacacacacacacacacacacacacacacatgcacacacacacacacacacacagtatcaggaataatatgggagactcctgttgtgttggctgtaaaaacccgctagcttctgtggtgtgattcatcagaacaactaaaaaatgtcagctttctcagagctagcagcagaagcataccaaactttaaataaaggatgacaggaggtgacagcacaaagagattcaataggaactataaaaattattccctaatttctacccagagcttaaccctagtttaaaatgtttcactgggtcaaagacatttcattgtctaggcaataataaacagtccctatcatgacaggaagtttaaaggtctcccttcttgcttttttctcccttgatcccctatccccaaccacaatcacctttctactttttcacctccggctttttattggatccttgctctatttatctagatttatttggcttcagtcaagccattttatgcctctttattccttttgcatagcataaaaataaataaggcaaggagaaatagccccgtcctgcttaaaggccctcattccttcttttttcaaagccttaacaaatcatcaatgagctcggactaaaggtgaattctgtgttctgagacaagagatggaaatggcaggatattaaaacacaactgcagataacagtcagaacctgcctatatcccgagtgctcagaaaagagactgctccttaaagaaatccttgacagaagccattattaagtcagcaaatccctgctaatggaaaagggaccacttacagtggagtgtcaggcagatagacactcacatggcacaggtcagcactgtatagggaaagcagtcacattcttcatctgtaaacaaactgccaagaaagactttattaaaaaaaaaaattctgggccgagtgcggtggctcagcctgtaatcccagcattttgtgaggccaaggcaggtggatcacctgaggtcaggagttcaagaccagcctggccaacatggtgaaacaccatctttactaaacatacaagaattagctgggcatggtggcgcatatctgtaatcccaactacttgcgaggctaaggcaggagaattgcttgaacccaggaggcggaagttgcagtgagccgagatcgcgccactgcactccagcctggcaacagagcaagactccatatcaaaaaacatttaaataaaaataaataaaataaaatagtaaataagaaatagacaaccaaaaaatcccaaccctcaaagtgcttactccctagtggagaaacataaggtctaattatgtccctcctttgctctaaaacccttcactgtatccctactgatgaaattaagaacaaagtcttgatcattgtgttcaaagcctcatataatctacttctgtatttactaaaccactaataagacaccttaatgggtcttttctattctctgcaatatgattacaactcaagaactctgctagtataaatacctctcttttcatttcttgtctcttacttttcttgttatggactccttccttccttccttctttcttttctttcttttctttctctttctttctttccaaatgttttgttctgttgcccaggctagagtgcagtagtgccatctcggctcactgcaacctatgcctcctgggttcaagtgattctcctgccttagcctcctgagtagctgggattacaggtgcctaccaccatgcctggcttatttttttttttgtacttttagtagaggtgggttttcaccatgtcagccaggctggtcttgaactcctgacctcaggtgatcctcctgccttggcctcccagtgctgggattacaggcataagccactgcacctggcctggttatggacctctttcaaggtataactcagttactaaattttacatagagcctttgttgatcttctcatttgcaattaattactctcttccatgatactttcttatagttcttatacttcttttataacacttggtttaataaataggtcaacatagtcaacaaatctttatcatctactatatgcgggacaccatgctaagaactagtcgctgcctttcaggtgcacaaatctagtgatagacataaacacagtagtttatagaggtacctaggataacacatggattgatgagagcagcactctcaataatgatgaaggaagcattcttgagtaggtaacaattgagtattacaggatatataaaagtcagccaggtgaagagaagagaaaaagcttatcagggacaggtatagcctgagcaaaggtaaaggtccttaaagattatttggttattagtaaaagtgttaggagaggcctgatcctggaggtctttgctatgccaagaaatgagcttaaccctatagacaactgggagtcatagaagttaagaaaatgaatgatacaatcagtccattatatcaaaccggctgtggagtctgcacaatggatttgaggagatgacaagcagaaatagaagcattaaatggtcacagtaatagtccacagagagatgaacagtgttgaaactaatgcaatggcagtcaggataaagaaaaaccacagacttaaggactctataatagagtaacctgggtaggaggatgactggcagatgctggcaggtgaaggaaagagaacaatctaggctgatgtcctggtttccagcagtgacagctggctagatgatggagttgtgaactgaaattgtcatttcaaggagaaagccaggtcaacacaaggatgatgatttcagcctgggaactgctgaagggctcataaagagctcatttcattagtatttgtcctatgcttaattacttacctgaatgtgtctttctcactagatggtatgatccttgaaatataaaaatatcttacatatattttgtccctcaaaggatctagcacagtgctttgcacatagtaggggctcaacagttatttgttaaataaatagagaaatagaagactggataaggttttggcagatcccattacgtttctgggccttaatttccaaacccataaaatgaatatttgtcctaaattgtttctatattcctttctaactttaaaattctatgaaagggccatgttctctaaaaggaagaattgtagaataatatgttacttttattgcacaatttcttgcataaacagccattgaaaatatgtcaaaacatgtgtgtgtaatacgaagctgaaaataaaaggagacgtttgaaataggaaggccatgatgctcaccctataaattatgaagcctcaaacactaagagatgaggtttaaagcaaataaaaatttatctaattcatagtcaaatgaaaatcagtgcagaggagccctgtgtggaattcaaacagcaggaaaatgttttttgttgttgtttttgttgttgttattgttatgttttatttttgttttgtaagtgtgtgccattttattcaaccttttaaaatgatgcattttccttttaatggtaaaagatgaaatatgatacccttaaacttagttcttctctaaagaaattgcttgaaaaatagtttatgcttagcacatagcacaggcacagattctagtctacatttttcaggcatgaaagacacacaaacagacaagtataagaaagaaaaatgaaatctctccttctagaataccactgtactgaatggcgtatcaggaagacacctgatggggcatgctaaatgatctgtcagaaataaggtctataatgtgaaaatacaactaaaacaagccaaaaattaactctgagttttgaaatgaggtttttaaaaattaaccatataagaatagaatgatttagctaacagaggaagtaggatgaagactacaaatgtcttgaacttttgtattgtttgggaaagtaagatgccatccccatgtagatgcctgctggggtatgtctggaagtcagtgagagggaaacaacattgtgtcaaatgtctaccacatataataagtactttacacgtactgtctcaactgctgttcacaataactctacacacatttgtatgtgaagacactgaggttcagtaaatttaaatgtcctgcctctggaggacacacagtaaattgtgtgtcaggtagaactgtgtcccatctcagacttaagccaccataccatgacaacttgaagccactgtaacttaaactcaatatatctgttatgtaagctttataaaagtatttataaaatataatgagcagaatataagtttgtggagccagttgaaattgtattctaatcagctccatcacctgacagctttatgtctttgaacaagtgacttaatcctcaaagtcttagtttctttgcccataaagtggagataatataaaatctatattacaaagttgttataaggaataaaaggataaagggtatacaaagctggcaaataggaagggttcaagaaatgttagcagttattattagacatatcattggtgttaccaatgtcacacttgggtttcttgaactaaaccaactggctgatttccctgtgctttttcaaacaccagccttgtcctggaatgcccccatctcttcttgttcaacaggaaaattcttaattcataatctgagactcagctcaattgtctcattctctgtatcaccttttctgaccctcctcaattttgctataaaaatttaaagttacaaatcatctcatttgttctttcattaatctcttcatatatttccactatatctgtgagacttttgttatcttttatttatactctgcctcatcttctacactgacacttcttaaatctgtcatttgtatctactataacacctgaaactcaattaatggatgtgggtaaaatgaataaatgaagaattgttaaccatacttctaataagtaatattcaagctatattattaatacattgagtgtttgtatttttaacaaaaataatatctatcctattagttattaaatattttattaaatcagtgtttttattcaaagactgctgttattattacctataagtagtacaatataaacttggtatgaggataaaaatctaacctgtgaatcagaaaatggggtttctaaaataagctctctggttgaccttaactaggatgaatcacctctcttgtcctgtctcaaatgtccttagcatgcataaaaggaggccattacactaaatgatctttagggttcctctgaactctaacagtgtgtggcattagagttctctgttggtatctagtctagtaaataactaattaagtactgagaacactacactccagcttgttgcctgtgttctcagaccagagatactcacgccagaatacagaattttaaccgatattcaccaaacatgaaataaacattcatgggtttgcactacaaaaagaaaatcaaatcatttttctgaagatgttactcacaggtatcaatataaactatgactttgtcttttaaaggtgtttccatgaagagtcaatcatatatctgaaatatagatatctaggccaaagttcataaatccttcaatatcaattaatgattaaattgcacattatgtctttactgatattttaattccaaaacttttttactgagtcaccatcagaggatctggagtaagatctgactcattctagaaatccttttggttttgtgatgcctgacccagcagccagctttagaaaagtgcctacccctgaagaaagcagctgtgatgctaatataaaagcgtctgtacgaacgtggagaaatgcaatattttatgctgtcgattacactgtgagctcctgtgagctcatatggcaacgactttgtctacaatattcagaaccactaccagagtctaataagcaatgacatagcattacacacatagaccaaataaattattttcccgcttttaaatagaatcaccattttctggcaatttttctgtctccaccatgtttttggagatagagaatcagaaaaccactgatcttgtaaaaattttattgtctgccattcctccagtttcttaagtctaattcctactctgtttcccaagccaggttttcatagtttaataatactcagtatgtcaaacttcagccaacagtgggttttatggcgtttgaataatagactgtcaaagtatttccatagcctttacatatggctatggaaagtctatgaaacttagaacagatagacttccacgattctggttattgttttcactttcacagtgaactgtaatctgtgtcttgcagacatgtttatttttaacaccataaaataagaatacaatggatgtattctttgctgattaacataaatattttctatcatttctttcctaaattagcactttcaaggttcataacgtgaagagtttcatattctaaagcatgtgagaaagttaaattaaagcctccactttaaagaaacttggcatataaaaatttttccttcaagataaattagtaggtaataattttctttacaataggatgcataaatatattcttttatagcagtcctcttagcctattgaaaatattatttgttatgaaacttgatttgtgcagacatcttaaatttttaaaaatctcataaacaggatctaacttatatactgtcagaagaaatacagatctatatggcattacttgagaggtaccagtggcttctactcaaagatagtctctcccttttttcttccattgccagattctaatatttgaaaatctccatctaatatttgaaaatttccattcttctttatttcattaaaaaactttagctttaactaaatacatatagggcattcctcatttctgtgccagaccaagataatgattttcaaaagaaataatcaaaaaccactacttggctctgaataaaacctcacatccataataaaggtataaaggtcaaaacatgtggagattagggaaggtttattggagaggatttatataaagaatctggaattcccattctcctccctactttctcactccatagtctagaaagagacacttcaatggaacatttaaaagcaaagtccctggcagctgagattcagtggacacttgtgaactctctcccaagaaatctaactagtgaaaggaggtcggctacttgctgatgaataagcagaaaaagatgtgaatgaattccaacatttgagcatttttcatggtccagatatgggccttatgctaaagacagctggtctggggtcaccttgtttttttgtttgtttgttttgtccaaggctattgcctagatcagtaaaatagagaaaagctacaaggagttatagaaacatctggatttcataaataagcagtcagctgcagaagaagatatcactcacattaagtgaactgcaggtcagatgcagacctccaaggaaccctcaaaatcacctgtgacatcaacttgattgggttaaaagatacctaggtaactggtaaaacattatttctgggtatttctgaagctgttttcagaataaaattcgcatctggataagtagacccagtaaagaacaaaatgcctccaccaaggtgaacaggcatcatctaatctgttgaggggctgggtagaacaaaaagacagaggaaggacaattttgctctctcttctccagctgtgacatgcatcttctcctgccctcagagctctcctggttcgcaggctttcagacatcaggacttatgccagcaccctccctcaccccttaaccttgtactaagcctttggccttggactgggagttacaccattggctcccctggttctctggccctcagatggggactgaattataccattggcttcccaagttctccagcttgcacacagcagatcatgatacttcctcacctttataatcacataagccaattcccataataaatctcctcttatatatgtatcctattcgttctgtttatctgtagaatcctggctaatattttatctgtgccagattttttccatttgcccctttggatccactcatcaccttttttcaccacactctcttcccccaacccccagatatcacaaaaattgttccatgttttcaggtgagcttgtgcaaagcaagggataggcagggaggaggagagtagggttgaaagatttattttcttgttgccattccaggtagttgctgtaagttggttgtgtctgtctactgaagaccacaactcctggcagaagtcttcttcctacagccaccctgtcttgttctatgacccactccctccccttgatcctacaggcctgggagtgggcagagctccctgtagttgcaggcctagggtcttgctctatcccttattgagtccctcaagccttgttcatagctatataaataggccctttaatatactctcctcaaattaccagcttggggcactgtttttttttctcttgctgggaccctaactgatacagcaagtttatgggaaaagtcagccttcagaaacctgagagctagaaataacttttatgttcccttcagctctccttcctcctcttgcttctaccccagaaaaggggagaacaataataaaaagcaattaagttctctttcaactgctggtttcctacctacaataggtctaagctgtggaaaatcagcccaattgaaatcaaggtataagttttgacagttatattctagttattgattagaagagagggactggcacaaaagactgaaggtaactagaaaagtttggccattgattgacttttcagccagggtgaagggaataatttacccaactgtataaaatcaatgagacaagaaacaaaaatataataacttcattttacctgttttttaaacatcttagttattttagttttaaattccaaaagctaccttggaaacatcccacatatgaaatatgcattattgggggaaaatacagtagaaagaagagagtttgttaagaaatatgtagaatattgaccattcttagagggcaggcctgacagtggtgttcaagtcagttaagtggaaagaagggcatgaaaaggaggacaacctaagggcaaagtccaactctacagcgctgtctcagacttactcagagccctgatcacaggatgatgcaaatttaaaattcacaatgcaacttcaaagaaaatccttctctattcaaagtgatattcctaagactaattccaagtacatctttctaagttccttttttcctgcaaaatactgatgtggagaaaaaattaaaacctctacttagtgagtcagaggagaggcgattcctactcctaacttttccacttcctagatgtgtgaacttaagcaaatcacacagtttctgtgggtctcagtttcctcttctgtaagatggcgtgtagaaacagatgtgttgatgtctcgatcagatctgatcactatgtactaaatgttactattggtggtgttcattgcctctcggtggtatttccctacaggaaagagcatttttattttactctataagagaaaatattattagagtaataccccctggttcgctggtctgtctgggtagcacaacttacttagggggtgaggttggacagaagttggagacgacttattcacagctttatctctattgggcttttctctttctccttctgcctctgtctctccttcctctccgggaagtgctaaataagttgtctttaatgtagggaggaaggagtagcaagcccctttatgaccaagacctatccccttgtctagttttgttagttctagttcctgtagttcgaaggggaggaggggcaagtgacaagccacaactaacgcacagaagtcggtagaaattggtagcaaaagatattcttgttttcatttcaaccagcaagatttaaaatgaagtatcattctggttacaggacttataatagatacatgtttcaccacatccttgcaaaaatgcagatttagtgagtgattcttctacaatcaatgtgcagagatttctaaagtaattcagtaaactgtaattaatgttattgaacagagcctggagaacacccatgtatctgagagacagaactaaatactgtctatgcaaaaagaatctataaaataaccatttgaaacacacttatgtatccaaagctgttactaccactattttaccatgttttcaataaatatatatgctattcttcatcttaggtttacaagtcaaactaggaaacatctatgtttcattattaattagcactgaacaaaactcagtaaatttcacttaatcaatgatatcatctagtttgattcagaggggttcagaatcttaagtgttagacttttatttctttaatgaccaccaccctccttcccaagggtcaacgttccccctcactgagtgggtgcaaactgacatacccatcagaaaagatgggcatttggagagccataaactaagcctctctgagcagggtgatttggacagggtgctatatatcagttccaggcgccagggaggactgatacagcagcacaaagctcccgatgaagcacagcccagttgcaggagattgctgtgatgataatcgccagaacaaaccataaattctggactcagaattaggaatggcctgtaaacatcaaataatgggtgtctaaattgaaaatgaaactatttgttgcctgtaatatttcttgcagtgtggctcagagagccagtaacattcgagacaagcgtgatctttttcaatgtctgttgttagaaagctgaggatattaactcctccttccatcaaccccagggaaacagagctaaatgaactagctagaaatcatgggacataaaatatagatttaacattatgcagcaagaacattacaggttaaaaaaaaaagaacagagaaatacaagtactgcattgaagaaccatactggcgagcactgaaggaacaggctcaaatagtttactcagggccctttcacactcactcatatacattataaaatgaaacttgactttcttgcatctggtttaagggggtgccagtcaacctggtgagaatctagattatacaaccacagacatgacatttggggatccataataattgcagattgggagataggtacttgatggattttttaaggcactttattaaataggaagaatcgtgtctaataagcacagttttaatttagtaagatcttttgttataataacaagtgcattgttacaagtgttacaagtacatgaacaaatatttttctcctgccattttataaataaaacatatttttgctctatttatctgcttactaaaccttttttttgtttatttgtttgttttgttgttgttttttaagtctcactcttctcgctgaggctggagtgcagtggtgcgatctcggctcactgcaacctctgcctcctgggttcaagtgcttctcctgacagcctcccgagtagctgggattacaggcatgcatcaccacgcccggctaatttttgtatttttgttagagacagggtttcaccatgttggccaggctggtcttgaactcctgaccacagataatccacccgcctcagcctcccaaagtgctgggattacaggtgtgagccactgtgcgcggccacctttgttcttatcaaaagaaatgaaagccaagatgcatagattaatgacatctaaattcacgaaaatttaccaaattcatgaaattactgttactcctgctaaatcaatgtacacatatactccatttgaccaagatctttttttatatataataacttgtggaagaacagaagatattgattcttgtgggttctaggtactgtaattaatagaatattttccatgtgagtataggcggatattgtgtatgaagtagttaaatagtaatgtgacgtggggatagtgatattcaaaatgtttaacaaacagaagtgcagaagtgcctgagcaccagcactcccctgcatggacaaggggcatttgggagctaagggcagcaagataggatctatttgagtatcatccatagaaaagtatgtatttaagaaatcagtgttcaggtagggcaggatactgaatgttagctcagcagtactctcgctgagcaattgctgatggaggagtgaagggaaaatatattaaaaatgacacagaggacatgcaaggcataacggggtgctctttataaacattgtgcctcaattaagaggtgtctcaatgaaaagaaaattccctatctccaggactatgactctatagactaaaaatactcaagttaaagaaagctaacagataaaaatattatttctggctgggtgtggtggctcatgattgtaatgccagcactttggggtgcccaggcgggtggatcgcctgaggtcaggagttcaagaccagcctggtcaacatggtgaaaccctgtctctactaaaaaatacaaaaattaccaggcgtggtggtgcacatctgtaatcccagctactcgggagactgaggaaggagaatcgcttgaggcagaggttgcagtgagccgagataacagtgagccgagattgcaccactgcactccagtctgggcgacagaacaagactctgtctcaaaaaaaccgtttctcaattaacaagtaaaggtgtagccaatatgttgcagagaatatgagagacaaaggctaaagagtatcaataatataaacaacaataatatcaaatgttaatggtttacttataatgtgccaaggcctggactaagtagtctataaacatcattttactgaatgctttcaatggccccattaattactggtaattatatttttgtggtatgccataactaatcttattatatgagtatattattctcatcttaggatacagtattggtcattccaaccacatattttaatcgtcttaacagaatttggaccaaagaatatcttcatgtccaaaccaaactcatgaccttcccaccaaaacgtggatcccctcactgtcagccgtgaagtgccataagcccaaaatctagaagttgcccagactcctgcttatccctccaattgtacatcaaaacctcttatttacttctagaatccattcacttttacctttaccatcgccattacctcaattctttattgcttaaattaatctcattattccctaattggcctacctgttactttttaccctcccagtgttcaagttaatgtcctagcccccactctacagccagtgtgatcttaaaataaacaaataaacaattagaatttctctttgtgtgatacccatttgtttaaaatccctctgtttacaatatgctcctctgtttaaaactccatttaaaaccccttaacgggttccctttgaaggattttaaacagggagtcaaatccttaacacatcctaaagctcctgtatgatctggcctctgcctaaccatctctccagctccatctcaagccacctcttctctttactctttgtgttccaaccattatggctttccagatagttaaacatgtcattcccttcttctccacagggctctggtcatactgatccctcaatttggaattattttcccattctttacctcctatattcttatcctggttatttcctactcattcttccaatctcaattccaatgccacttctgccagaaagccttcccaaactcagcacttacaaatgcttaacacagcttgtaatgataaactcattttttgtaattaattgattaatgcatctctcccccaatagatatgaaaatactagcagggaagaggaataaatctgcttttattcactgctctcctcacccccagcatgtggcatatgccagacactcagaagccttcataattaagtactgaatcagttagtgaattaattacttgtttttataagaatactgaggatttttagataggcctccttacaatcaaggttttctcatcagagttagcagtagtttgtgaaagatactgtcttatcaaagctcatttctatatcgttgggttatatactatacttatgcactataatccgtatacatataacttgtacaactgcaaagtgtataatatttcactgaaaagatataacatcatatgaggaaaaacaccacttctatagaactattttgtaaaataatttttaaagactcataaattataagtcatgatgacacatttacctacagaaaatatttcatcatttgcatgaatagctttaatatgccacatgctgatttaaaatatcttactctctaaaaaaatataacctcctttaacatttaccttgtaaaagaatcattttttttctgaaaatgggtaatctacatttggtcctgtcttgaggttagaaaagacatttgaagttaacaattatttgtaagaacaactatcgtcatgatgtctactaatattcctcgtatttcattattttccatttgtgattcagcatcaataattcagataaagcatattttttaagtgtcctagagtattatttctcaaatcttaatttgcataagaatctcctagaagagcttgttaaaatgtagattctaattatttatgtctaggtggggcctaaaattctctatcacccacaagctcccaggtggtactcacacagcaggtacacagaccacagtttgagtagcaaggatgtagagtaagtggaatactccaatctaaatccaacactgttcagatacccagcattttctgttcttttgcttttggctttgagttctggcacacaactctatacaatccacttaatgttgtgaatgccaagaatcaaaagtcaattaccacttggcaacatgtacaaactttctgtttttaaaatatcaaaatctatgctggagtagtagctgtaatattaggcaaaatcagagatgatattatcaggagtaattatagtattctaaaacaaacttctaaagattgcctcatcacctaggtctggacagaagtttgattaaaagccactctatttaggtaatcatcttctctagaagtttacagagatgttgaagtgttttcaattatggctttttattggccagtaaagtatgggagacaaaaaaatcttaataaatatgtacagaaatcactttgttttataaatgttgaaactaagtcagaaacttaccaaaattaaatagctaggtaatgatagggctatgagaattaggtttgtaatctatttgtgttggatgtccaatggtaatccacaggtgtaatgaggttttggggggagtaggtttttgtttcattttcttgtttgttgttttaagacagagtcttcactctgtcacccagactggagtgcaatgatcacagctcactgcagcctcgaccttcccaggtgcaggtgatcctcccaccttagcctcctgagtagctgggactacaggtgcacatcaccacacccagaaaatttttttctattttttatagagatgggcttgtgctatgttgccaggctgatgctgaacttctgggctcaagtgatctgcccacctcggcctcccaaactgttaggattacaggcatgagccactgcaactttatatcctgaaattcctaccatgaaactggcttccaatattttttttttgcttaaagtaaacttgtctaaataatatttacctacttgtccagtatctattatacaccaggaactatgctattcctctgtataggtattttatctagtttagtagccactctgaaattgattattattatttacctttatagtcagataaattacaatgttttcataagtggtggagttcacattcattacactttactatacactatgtatttgaaatgtttataagtatttttaaacattttattgtaacttttttttaacttgagctgttattgagatgtctcttaaatagacttatgatatctgctgcattgttgtgtcagtacagtcataattctgcaactacataaagaacaattctatttattccttgtactgggatcacacccttggcctttctccatactggaattatatcagcttggttttctcattagctattagtcacaaatatagcaatacacaagcaaatttggaattttgagtcactgaattcaaactttccccctcaccttctgctgaggcttccacttaattacagactagtacgttttaatactaagcatttaagattaaattacctggccagaaatagatcctgaaaaggctggttaaagcagaactagggcatggtttagacagacacagaggcaacatgaaaagaaaattcaaaatgtaaataagccccacaaaactcgagtaagatgcttcaaatgtggggccttaaacaaccaccatcctttacataacaagttgggaaaatgtcatagataaaaatcaagtacaggaatacctcaaagatattcgggttcagttccataccaacacagtaaaagaaatactgcaataaagcaagtcacatgggttttttggtttctcaatgcatataaaagttaagtttacacaatactttagcctcttaagtatgcaacagcactctaccacactatagtctcttaagtgtgcaacagcattatatctaaaaaatgtacataccttaatttaaacatatttattgctaaaaaatgctaacagccatatgagccttcagcaagtcaaaaccttttttgctgatggagggtcttgcctcaatgttgatggctgctgactgatcagggtggtggttgctgaaggttgggtggccatagcagcttctgaatataagataactaggaagtctcctgcatcaattgactcttcctttcaagaaagagttccctgtagatatttgagagttttttactagcggtagaacatctttcagaactggagtcaatcctctcaaaccatgtgtctgctttaccaatcagtgttgtaagacattctaaatccttttttgtcatttccacagtgttcaaagcatctccaccaggactcgattgcatctcacaaaacaattcctttgttcattcatgagaagcaactcctcatctgtcaaagttttatcctaagattgttataattcagtcacatcttcaggctctacttctaattctagttttcttgctatttccaccacatcctcagttactttcaccattgaagtcttgaagcccttgaactcatccatgaggtttggaatcaacttcttccaaatgcctaatataatgttgatattttgacctcctctcatgaatcatgaatgttcttaatggcatctaaaatagtgaatccattccagaaagttttcaattaactttgcccagatgaccagagttattatccatggtagttatagccttatgaaatatatttattaaatagtaagacttgaaattcaaaattactccttgatccatgggttacagaatggatgttgtgttaccaggcatgaaaacaacattcatcaccttgtaaatctctaacagagttcttgggtgactagatgctttgttaacagtaataatttgaaaaggaatccttttctgagcttcaggtgtcaatagtgagcttaaaatgttcagtaaacggcaacataaacacatttgctgtcatctaggctttgttgttccatttacagaatacaggcagagtaggcttagcataattcttcagggccctaggatttttggaatggtaaacgagcactggtttcaacttaaagtcaccagctgctctagccaccaacaacagagtgagcttgtcctttgaagatttgaagccaggcattgactactcctctttagctatgaaagtcctagaaggcgtcttcttccatgagactattttgtctacattgaaaatatgttgttaagtgtaactacttcatcaacgatcttagctattatcttctggataacttgctgcaccttctacattagcacttgctgcttcacctggcattttcatgttatgaagctggcttctttccttagacctcatgaaccaacttttgctaccttccaacttttcttccgcagcatcctcacatttctcagctttcataaaatcagacagttagggccttgcagtagattaggctttagcttatgggaatgttgtggctggtttgatcttttagccagacctctaaaactgtcctcatatcagcaataaggttgttttgctttctcatcattcatgtgttcactggagcagaactggaagagttcctacaagaacatttcctttgcatgcacaacttggctaactggtgaaaaaggcctagcgtttggcctgtcttggcttttgatatgttatccccactaagcttcatcatttctagcttttgatttaaagaaacagatgttttactcctcctttcacttgaacacttaaaggccactgcatggttattaattgacctaatttcagtatttctgtgtctcagggaacagcaagcctccaggagaaggacagagattggggaacaccagttggaagagcagtcagaatacacacccttatcaattaatttacccatcttatatgggtgcagtttgtggccccctaagacaataacaatagtaaaataaaagatcgctgatcacagaccactgtaacagatataaaaataatttaaaaatttaaaatattaaaagaattaccaaaatatgaaacagaggcatgaaacgagtttatgctgttggaaaaaatagtacttgcctgaagcaggatttccacaaaccttcgatttgtaaaaaccaccatatctccaaagtgcaataaagtgaaactcaatataagctcaaaataaattatgcctgtatgaatgcaaatctaaaagagagcagtcagaaagaccaagtaggtattaacaaataatgaataaatcaataagtgaatatatgaaataaacctcagctgtgtccaaaagcacaaaagcttctgaaattataagccatgtaacaaactaaaactgatctcagcaagatgatctagtgatcactccagcggaatatcaatgctttagcctagtacacacatgttctgagctgtgaaggtttttcatgattattatttttatccttcgtaattatctttcagtttatatttctagccttgaaacacataagttattctttgcatttagagcctattaacacaatttcaagaagaaaactacaataagcagggcttgtaaatttgttttttttttcctactgaaaagcaaagagaagtcgatttgttgacaacaaaagtgcctcaagtgattatgttttctttatttattctcagtgtttattcccaattcctcagtcccaactaaaggtctactacagagagtacatatttcttaaatctggaaaataatttaaatacatcaactaacacttgcatggtgcaaaataccttcagctagttgatgccaatgtggtacttaaactatggttcccaggatggcaatcctacatttccaccacactagcagccccacaagatagagttcactgcctcaatgagttcaaaagtaagaaaaaaaaaaaaaaaacccacatttaaatactaacactattgtgcatgaataaatggcaaaacaaaggaaactaagtgctttccaatggtttaaccaagaaccattcaatgtccctttttctgttcctccttaataactttttccctaggtgaaggttgaaaagaacagtgccattatgacttcgaatttggtgcaaagccagtaacacatattgatactgtcagtagctgtgcacgtgattttgctgtttttaaaggagagctacattttaaaaaccgaggttggagcttgctctctctaaagtgtctgtgattgtccttgccctagacctcaggttacttatttcatctctatttgaagagacagaggcagggttgttcctcagtcaatttttttttcagtctacaaatcaagttaagctcaaaattaacataacaattatttgggcatgtaaaatatgatgaattcctatttcctatctcatttaacattccttccaatttcataatgtcaataaaccagggactaaagcccttgtaaattattataaatttctccatatatgcatccagattggcctttgacaatatcttaccacaaggagactattttcattatacactctatctactttcttcatgatatgtcttacaattagctcagcagagctatccacttacaggttggaactttaaaaaattgctcaagtctccatgaattaaatgaagatttagatgaaattcaatgaagatcaaaagcttagaagtgccaaatctcatttagctaacacatattattcagtctcctctaagtgtttactaaaatacccatggaaacatattttaagttgaaaattgataacaatattattactaatatttataacaatatcttgcagttaatatatttagaactattaacctgtttagatttattaactattaataggataaggatagcttaaaaaaagttaattgatttaaagtttctgtaaagaaagatactaggcaaattatagcacaggtggtgtttaaaggtggaaaaaaattgtgaaaatggtgtaaaagtgatggaagtttgggaaactctggagtttattgccaatgccactattttagttaggtaaatggctgtataactcaattcagatcaatcttagttctttcgacatctaattggaaactccaaatcccagaaaaaaaaaatgggtagaaaagagaagaacttggaaatagtgcattgaattctaggagttgaggtgcatacaggtaaactttgattagtgaagtgatgaaaaaatgattctagtatcagtatatagtgagtattggagtcttttcaccatgtacgttacctgttcaagtctccaaggtagaggtaaaaagtaacatttcagtcctattgagatatatgagataaaagacatatgagataaaaacctgctagacaactacaatttttctataaaccttatgcatcaatctgtcatcatctatagaactgaagggtgattcggccagcatacaagtaaagagagtataattcaaagtaatatatatgtactgtttcttggtaaacaccaaactatgagagagctttctttgcatgtagagtaaaaaggaaaagaaaaaaccacatggcttaaaaattacaaatgggacctaacccaagctttgacagaatcaaaatgatctgccagtgacttaattcactgtcagaacaaacctcaacactcctgaaatgaaattaaaacaatcaagagcttctacaatatatgatccactgtgaatagcttacaataaaaaataaatagtcatgtaaaggagtataaaagtgtgactaataaaaactaaaatagacaatacatataggcccagacattttctaaataatgaagttaacggacaaggacttcaaaagagctgtaattaatatttcaataaaaatgagtaatagagagacaaaatgtatgaaaacatacagtatttccacagaaaattagaattaatcatttatgagatagatattttaaaactgaaaaatagaatatctgaagttaagaacttattattggacagaactaacagtactggacatagaagaatacaaaattagtaaatctgaagaaaagtcaatgaaaaatatttaaactgaagcattgtggtgaggagagggaagaaggtagagacaagcattagagaaatgtgggacacggtcaaaacatttaacacaagtttaataagaatcccaaaaggagagtgtagagaaaatgaaactgaaagcaatatttgaagaaataatggctgataattttccacacccgaagaaaggaaaaagcacacagattcaaaaatctcagtgagccccaactaggataaattcaaaggaaacagaactaagaacattctagtgcaattattctaaagcagtgataaagataaaatcttaaaagcagccagagaaaaagacaattacctttatggaaataataacataaatgttgaacacctttaaagtacttaaagaaaaaaaaaatcctgccaaccaagaattcaatggccagagaaaatacctttcaaaaataagagaaaaagtcattctaagataaaagttcagagaattagttctagatatcacacattatagaaaatactaaagaaaggtctttaagtaaggttgaatcatcagtgtttttgatggtatacagcacaatttggatacaaaaacacatgtacaaatcaaaaagacatttagaagaattagattgaatataaatcattctagtaataatttaacccatgtactctgcttatattttcctctttgttatatatactacactaataaatgataacacaatatgttcaattactcaaaagaactcttttgataaattaatatcaaaagcctaagtgattagaagatgcttatttggcagtgttttattttctttcttagtggtatttcagttaatgatctagtttatccatggaattataggttttataaaatacagcaatactttaaaaatcaaggcagcagaattgaaaaattcaataacacttctttagataaaaaacaatgaaacaggcaaatatttgagacacttatctatgaaaaaaatacataaacaaaataaggcaaaagaaactgatgagataaataaaatatagaaattttcaaatattcctaataaatttgaaggtattgaaatttaaaaatgtctacaagaatataacacaattttctcattaaaaagtagataacaatcaggaaactacaactatataggaactatataaagacatgaataaagagattttgaagttacccccattaagtccttcataactttaatcctacgtagatttatacattgtcttacaagtatttttatttgctgaaacaaataaaaatggaaaagcttccccattcatcctacttgctagcataagcctattcaagaaaacttgacaaaaatggcaccaacacaacaacaaaagatatcgtaagtcttatttatgaaaacagatgaaaaacattcctaaacaaaatataatttttcacatacaaaaaaaaattccagacttaactggctccactagttaattctatccaaaatttaaagaagtcatactaatcttatgcaaaatctctgaaaaaatatagaaaggagcactaagttgttctccacacctctattcaataataagctggaggtcttagtcaatccaatgaggcaaggcaaaaatattagggggaaataaatataaagtacaaagaaaaaatgtctcacacatcgtgatttacagacaacaaaataaaatcacgtgaaattaatcatcaaagtattataactagtaagttagccagatcacaggctacaagttcaacaataaattatatttttatataataaaaataagcaaacggataatggaatttacagacaacaaagtaaaatcatgtgaaattaatcttcaaaatattataactagtaagtttagccagatcataggctgcaaggtcaacattaaattatatttttatacaacaccaataagcaaatggataattgaatttaaacataatgctatttgaaacagcatcaaaagttataaaatacacaaaggtaaatgtaataaaaagtttaaaactttactctgaaaactatgaaatatttttgagacaaagtaaagcagtcaaataaatagatccctatgccctatgcatgtattgaaaatgtaaatattgttacgttttccaatctgccaagattactcaatggattcattacaatcacaattaaaatccagcaggcttttatttcagaaattgacaagccaattctaattttatgtggaaatgcaaagaatctaggatggacaaaagaatctcaaaagagaataaagtgaaagaataatagaacctgatttcaagacttcctataaaactacagtaattaagaaaatttcctattagcaaaagtataaataagtacatcaatgaaagagaagataatccagaaagagattcatatttacatggttaataaatatttacaaagccttcagagaaattaataggaaaaaataagtcttcaatatgtggtgctagaaaaactagataaccatattttttaaatgaacctcagtccctttttaataccacaaacaaaaattagtttaaaactgtccataactgtaacacctaggagcaaagagcttcttgaagaaaacataacatgtttacagtattggagagggcaaagattttttggatatgataaagaactacttaaaaatgacaaattaaattacttatagaaagataagaatatgaataagcatgacacaaattgagaaatattattcacaatgcatatatctaacaatggacttgtaagcagaatatataacttactctttcaacacattaataggacaaataaaaaccataaaaagaagatatgcaaatgaccaataaacacatgaaaaattactcaacatcaaatatcattacagaactgaataccatctcaacacccactagaatggctaaaattaaaaagactgaccgtaccaaatgttggcaaggatgtggaacaatttggaactctcttacattgctggtgggagtgttagatggtaccacgtctttgaaaaaagatttgtcaattcttacaggaataaatacatgtgtatagccagataattctacccagcatgtgtccaagaatattaaaatatatatcaaaaagaattgtacaaaaatattcatagccatctgaatcataatagccccaaaccgaaaaaaaaaaaccctcaaatgcccttcagcatgagaatggatacatttgctgtatattcattcaaaacaatactagccaattattaaaatgttccaacgattgatatagccacgaatgtggaggaatttaaaatctttttctcaatgagagaagacttacacatctagataaatctctaaatgggtaaaactgatttatgttcaaagaaatctgaaccttgatcatctgaggggttgtggtgtataagatttgactgtaagggggccccagtgaacttaatggtatatcggaaatattcatttttttttagaaatatgagttacacccatgtacatatttttcaaaacacatcaaactgtaacatttaagatctctgcatttaatttaaacatatttcaatttcaaaaatgcaaaggtgttgcatcgtttttatcttcttacaatagataatttactttttattttcaggcagggcaattattaatccatttggtttggttctggatttgtgtctcttttcctacctctaactctcatattttacaatccgccgtcatcaactacttacaattccccaaacttacattagcacatgaattctgtttgcttggaatgtccttttcctctttctccacctacacaactctcacttcgaatttctgagactctgcagagacctcacttcctttccaaagtccttccttctctcaggcaaagttaatacctcccacctctgttcaattctgcactgcataccagcatttatcactacacattgtatattttgagagtttatttgcatgtctctcaccatatatagtccttaagggtacagaccatagctacagatcctataaagcaacaataacaacatgaaccatttattgaatagacacttattgcaggcagagacaagcaccttgcataaatatctcatttaattttcaccataatccccattttacagatgagcaactgaagcatagagaagtttattgcccatcaataatcacaaagctagtgtactgaataaagttaattttaagcttttaattttcagctctttctgattccaaaatccattctcttaatcactaagtaggattaactacctcttaaatcttccatttaaaaacaaaataggcatgaataatgattgcatttaacttgccaacaattttttgccttcattatgacactgatatacaaactaaagcagttacaattaaaagatgccagttgttttttttttttttaatttaagcagtggtgtgcatgtattgtttttggttttcatctgttgccactgacatttgtgaatatgatcagacaaaagtgtattttttttacctctactaggtgtctagtttattgtttttccccagaatactgcctactataattggctctgtgtatgacacctatctgtctgtggttcaccccctgaaaaagaaataatatatttcaagctcttaaactggtttccagaatactgaaacttgaccaacccaaaacttgctggttttatgtttcaagcagttagtctaggttttatatattgttttattttgtttattaaatcgtttggctttgtgacattggccctggtctctccagctgccccagtgcctcattagtgaactccagcatcatccctacatccgcgcatctgtatccttgctcagtgtcacttctggaaaaactctctgttctgctttcctaatgataagaacgatacctcaaaccctctctcctgcaccccacatgtcccttatttgccttttatgtctacaatatacactttattttgccttttttctttgaacaatctctgagaagactagtgaaaagatgatccttcctttcctaaaatactagttggagaatataatggcactattttttctaaaggggtactgactagatgaacgtttattaaacacctgtaacataaaatctatattgctctccctagttattttcagacctaatcccgttgcattgtagttgtcattaaagctcaatttttagagattttatggagttagaaattggctctatttagctcctgtttagaaaagagttaacatagcaggagtgaggctccttttcttataaaggcatgtttgcaaggctggcccttgactggaacttgggagcttgaagagtaaacagtttctatattgatacaaaattttccccaattgataagagtagttcacagtgcctaaatgtttgtgcaaataatatgctttatgttgaatacctattttcctacctgacttatgtatgtgctcagcagagggtgattacatgattagctcccaatagaaactttggacttctgtgctcagccaagattccctggtgataacatttcacacgtgtcgtcacaatttgttgctggaggaattaaacatgtcctgtatgactccactgggagatgacctctggaagcttgagactggattcttctaatctttgtcactttcatcttttccctttgctgagtttgctttgtgtctctttgctataataaatcatagccgtgtgtacaactatatgctgagtcctgtgagtcctccttgcaaatcatcaaacctaggagcagtcttagggactcctgacacagctaatgttcagttttattctttaaaaaaaaaagaaaaagaatattcagttaaaaatctcatttgtttgaagactgaattaattatgtgttcatgattttttcactttctgtctctagattccatatatatacacatatatatacatatatatttatacatatatatatatattatccttcaattgtattcttgattatacaagtaaataataatggtaatttatgggggggagaaaaacataaggaaggattttctgagatgtctatttttctcagaaaattcaagctatctcttttatagattcatctgtaagctcaaattttaagaggaatcattagatccagataacagtcagaaagtacaagctgaggttctaaagagttggttcctttaaatagtcatcatcctcagcaggagataatgttttgaaagagttataatatttatttttccaggaaaagaaatgcacatctgtgtttttgtaccaggaggctgagagaatgaaatgtaacagggacagtgtgagcagctagaaaagtatttatcgatcaagttcctgtgatacaaaatgccaaggaagttttttcagctttcacatttacatttcattttctaatttgaatggattagatgatactcctctcatactattcataagggtaatttgaactatttcaaagcaataaaatggaaaattagttgggaaaaaggtcattctaatatagtaacgtaaaatgctcaatgatgaactatcaaataaatagctatttgattataagagtgctttagggaaataaagaagcaaaagagagaagggaaatttaaaaagcattaaatactgaagttagagcatgatataaataataatgtctaagcacatagtatttactgtgtgccagatattggtgtttgtgtgtgtgtgtgtgtgtgtgtgtgtgtgtatatatactcatttaataatggcaaaaatcctaagaggtagttgatatttctatcagtgccatataacaatgaggaaattgaggtttagagagataaataagagtctttaaagatcacacattgagtggcagaaccaaatccaagctttaatcactgtactatgttgtacacttaaagacgaggcatattgtagaaagatttctcaaaattgtgctaaaaattgttttggcttacttaccaaagttttattttataaggaacgaaagtgggtgaagggacccaaattgactattgtaacttttctcacaggaccaaacactgtgccaggattccatacgcagatatactcaatggaaggctaagactttcctgagaccacattctctataaatatagatggaaatatattcatcaatatagagggaaatatatccatctatatttatagagaatgtggcatatatgtgtgtgtgtgtgtgtgtgtgtgtgtgtgtgtgtgtgtgtatacatatatacacaatgtggtatgtgtatataaacatacatatatatattcggcaagtattttgtacaatcatagcttcttcgagtttatagataaacatttcaggaaattgagagagacatctatgttgatagaaaccaaaccagtaaaacacaggtaaatggatgagaggtgactgcaaaacacagagaataggatgaaagctaatcaaaatgacaaacgctaatcaatgtaggcagaaagggcaaaaagataattctcatgaatacttacaaagtatattctgaccttggaagtcttaggttggtgtttatcaatgatgaggccaaaagtttgtacctgtgtaacccagtttctctgagttttgggtgcgcactgtgaaaaattacctacttgttaactgttgtacctggagctcctgcttcaaaaaaagttcagcctcagaaataccaaaactgcttggatccagagatacctgagatgatgaattttggtgaactcccctcactactgtactaaaatctctgcacagggaggaccttattctccattttctacataagtgacgtatgttgaagcatgattggtgactgtgccagcacggcctttactccaacctcagctaaccaacccagtaaaagccctgtttccaccattgttcaaggagggactactttgggaactatccctggtgtcctcttcgtttgttgcaagtaataaaatatccttgttaaatcctccttgattgtggtcattggactgttacctgacaagcaactgaacccacccgttgtgtgggtaacacctgtacttggaaaactaatgtctaactaaattgagtaattagaccagtgtctattagctcaaaactattttccctcactatgagtgagatctctgggtctattttccaaaataaaaatttttaaaatacaaaattcagagttaaaaagttatcttccccaggcctgtttcttcctcagaaagttgaattagaaaaaaagcttgagtttttatatcatctgataagctttctcgcattttttaataagagctatataacttctttaatccactttgactcgggctatcaataaactcattttcaggagtttcccttagtctaggttttctattagtgtgatctcaccactcttgcttgcttggttctagcctcagtatgcttaatttagttattttattgtatttggagttctcatgataagccactgcaacttctcttttgaagtatattaaatataatatgtttatgaaatgaagcgcttaaactgaggataaaaaaggcaggtctcatcggcaaaaatgtaagagaatagacctagagattttattggacagtaagttcaatgtggttaagcagtgtgctgtgactgctaagaagtcaactccattttactcaagctgcatccaaagatgtatattacctacaataaagaaggatatgtccctggcaaagtagttagaccagagcataccatttagcaagtatgtcttgtaaatttaattggacaattttgtttagaccacacatggaatattgtgttcagtgagcaaaagcacactgctaaaaagatatatctgaccatactcagtgttggcaagtaggtaaagcacctgagactctgatacactgctggtgtagatacaaaatggtacatctgtaccttcgggagtggtttggcagttactcaaaaagttaaacatacagtagttccccttatctgaggttttactttccaaagattcagttactcaaggtcaacagtattctgaaaatctcaagtgaaaaatgaacaattcataagttttaaattgtgtgatgatatctcgtgccattctggtctgtcccactcaggacatgagtcattcctttgcccagcatttccacactgtatatgctaccaatccaatagttacttagcagccattttgattatcagatccattatcacagtgtctcagtgcttgtgttccaataatccttattttacttaatggccatcaaaatttggaatgacttattcgcttactggtcatttaaaattatgaaaaaatccaatgataaatataatcaaaactttaaaatgaatcttcaagtgtatatttaaattagtagaagatgttgctttattgaaaccaaattatttcttgcagcatgaatgttataccttgggctgttacagcagatggttgtcagcattggttacctccacgactatgtattatatgaagactctcagtgtcgttatcattttcttgttggaacttgcataacccttctttcttaaagcttgctgacatcatttggaaattctcaaacacttgttctctatatgaactttaaaattgttgtattatgtggtatgtgtgattgtgtttaaacaaaagcaggcaatttgactggaattattaaatacatacatctatctggcaagaaatgacatcattatgatattaagtcttcttatctaggaacatagcatttatttccagttacttaatttttattttatctattaaataatttttaaaatatcggtttacatcatttttactaaaagtattcctaggtattctatatttttattgctaatatgaacggattttttccattactaactttttactttaacgtatttttcttggatctgggatcctcacaaaatattcatttttgttcttttaacagatttgaattgtttagatttaccattgaatcacctttaagtaatggtgattaattcctttttccaatatttgcacagcttattccatttacttaagtgattcactagaaatgctgaatgatatagaatagtcacgctgatagaaagcatccttgatttgtgtcttatattaaaggatcaatcttcagtatttcttaatattatatgatggttttgattagttagacggtctttggcacatttaggaaaatgttttctattcccatttaatttatgtttttacctagaattgctgatttctttttttttttttttgagacaaagtctcgcccttgtcctccaggctggagtacaatggcatgatctcagctcactgcaacctccgcctcctgggttcaagagattctcctgactcagcctcatgagtagctgggattacaggcaactgctaccatgcccggctaatttttgtatttttagtagagacggggtttcaccatgttggccaggctggtctcaaacccctgaccccaggtgatccacctgcctcggcctctcaaagtgctgggattgaattgcagatttttagcaaatgtttttcatgtctctgtttctacaattataggattttgctctaaaattctcttttagtataatgaataatattgatacattattaattgtgaattacctatccatagaatatagcctattttaagcagaggagtgaaagttatagttccaacatctaaatataccaatatagtatgaagatgttctggcttagcagtagttctggcaagcacattagttcccccacatccctaaagccacttctttcccacattccctagctttctggaagatagcaccctccagccagctggaacactgaagtcatcttagatcactctttttctgtgaaccccacatccaatctgtccccacattctgctgattccacttcagaaacatctctcaatttcagatctcccatccattgacttattttaggttctcaatatctctatctctttgcccacagatttcttattgggtttgtggtttcccatgttgctcccacatcccctaaaataactccaacacttcagctagaaactgagtaaaatattttgttacttaaaatcttcaatgttttctcataagtaagatctgtgtaaccaatgaatgctgtagtaacagcaagtatgttagcatgccctccacattcatggtggtcttcaatgcccctctgtcattgcccatgacctccatcccatagctaatcagcctcctgcctatgtgtttctccccacaagcctcttcactagaacttgtgtccttctttccaagaaatctctcttgattcccactctcatagaatgagttactcttagactgttatattagtcatcttcctccctgtcttcatttcatctctacatcctaggtattaagcagagtatattgtaccatgtggagactcagttgggtttcagtgtatatagtggaactttagataaacgcaaattgaaattatcaatgtaggtgctgatttgcaagttaaaaactaaaggtcaaagtcaacagtaagttcacagtatactgtgcaagcactagtccatgtagtatacttgcactaaaatcaggatgtgcattttaaaagaaacagtgaaaaattagaatgattctagataaggcaaccagtgtggtgagggctctgacaacaagggcacataagattttcaagatgttccagatcctgggaggactagcaacacagctgcaggaacttagatgtttaggttagagaagagaaacaaaagagaacaattgtcttcaacacttagaggccagtggaagagaggaaaagaaatagaatcacagatcatggaatgaagagccaattctgaatctacgcaagaggaatttaaggaattttaatccatatggcagaatgcatagtaataaaatcactataattctttagcttcccctagtgggtttcgaaatggagtaaaggtagtttgaacggaagagttcttagctgtatagaattagtctggacatagcagaacatttagcgtctctggctcccactcacaaaaatccaatactagtcctaggtcattggaataaccaaaaaagccctcactcatttacaaacgctctcagttgagaaccactgaaatttataccatgtgctaggaattgtgcatgatcgctttaatacattttttaattctctcaataaccaagcaagatagaaactgtcattcccatgttaagatgaggaaattgaaactctgctactagcagacagaccttctgaatcagattgcctgtttatatctctgatagcagagcactttaagatttatcttagattaagataaccaagactctgtattaagtttctgagatactatcggtttcattcatgagtatgttcagtggccatactattcacatttgagctcctgcttcctgagatgaatttacctcttgtagcagctttactttattgagatgatctagttttatgtcccaggtgctcctggttttctttatctcactgtagtcagccttaccatgtaccaacatgggaaaattctctccttactaaaataaaacaagtagtttaagtggagaaatgaagtaacttgccaaggataataaggcaaatgaaaccggagtaaaatccatgccagtactaaattcaataatacattgaggataaagggagtcagattgtagttctgtgaaaggaaaatatctataaattatatataaacatatcttagaaagatgtcttacttttgattgctaaatagtgctcatagaaatctggtattttgttgacacaaatacaattacatggtattctgctatgacaataatgctaaatcctaattcattaagcaagagagagtgaaaggcaacataatacaatggttaaatatttatgaactggcttaggctgtataagtttgaattccagcttgacaatttattaatttcacgactttcggtatgttattcaaccttacatacctcagtttcctccttgtaaaatagagtaattgtagtatctacttcataaggtgagaattaaatacgttagtacataaaaagtgcttagaatatttttgggaacagtaaaaatattaagtattattattattaaggagcttatatttccaacttgctatctcaggaaagtccttttatttctctggcttgctttcttcatcactaacaatggtttgcatgaaaagccagtccagaaattctagatgtataactgcaaatttatcacaatttttttatctccacaatttttcactggatacatctcactgatgtaacaaaataaggatatcaatcatcagttgtacatatcctcttgaatattacataacttttgttttctctcactattttgttgaaacccaagcagcagttatttttgtctgttccttgaattagtaggttctgttaacaccttataattgttcatagttcagttttgtagctgctcacccaaagaacataaagtgcagactggctattacaaattttgtttgcttaatgagaaggggaaaggataaaatgtttgcaggtacatcatgttcagagttttggaatattcaatttgcttatcttctgagagacttgctcatgtaatatctatgttttatgtcttaatctaagacagccttctctgcaaaatccacactcaaattgctgcattttatcctgtcagctgcgtctttgggatcttgtctaataaaacatacaagtgtctttttctcctcctattcattatcactaaaagcatttcagtgtctcatttggtgaaaacaggcgtctactcaatttgtgaaatgatagggtatctatgttttaagtcatgcttgtcagccacctgattttccactagagttaggaaagtttaactcacaatgctgctttaataaatcagctcaatgaattattccattcagcataaaataatagctttgctgtaaagaagaaattcatatgtaattatttaataaattcaataaaatttttctggaaattactggtcattcgttaattaaaagttaattatgtttctattgtattccaaatactgtactgggaatgaatttttctagaaaattaataaaacatggctcctgcccttgaagggatcatagtctgatgagagagagtaaaagaattctaaaataaaaatcacctttttaaagattctaagtataaagtcggaaggggcagaatcagatttgccttagagaaagactatttgggggaagggcgtgtgtgtgtgtgagtgtgtgtgtgtgtgtgtgtgtgtgtttgaaaggagacagagacagagaaatgtgaaatgtagaggcaaaaaactcacacaagaagctctcatgtgaaatgaaggaagcctaaattacggcagtgacattggagacaaagatgtgtagtatagattgtagagctgctagaaaatatattcaataagactgaagacaaattagatggggaaaattctcaaggatgacttataaggttgctaaaccaagagactgagtggatgatggtgccattgaggcaactggatatatggggcaaaagctcaggaaaggtattggggcccggtatagaaacgtcagaggcagtaataatttagggaaagtgaaagcctctggggtgggtgacattattcccagaagaatgtttaaagtaaaggaggaaagaaaaaaaaaaaaaaaagaaacatcaatttttgagaaatttgcaagacagaggaaactagagactgagaatgaaagaatgaaaagttaataagaaccagaaatttcctttagcatttcatttaggggtcaagcctatgatgaagaatttatataaatatcattcatttaacaatattttaaaatgcaaaaagacgggctgggtgcagtggctcagctgggtgcagtggatcacacctgtaatcccagcactttgtgaggccaaggcaagcagatcacttgaggtcaaggagtttgagactagcctggccaatatggcaaaaccttgtctctactaaaaatacaaaaattagccaggcgtgctagcacgtgcacccgtactcccagttatttgaggggctgaggtgggagtattgcttgagcctgggaggcagaggttgcagtgagctgagatcgcaccactgtactccagcctagctgacagagagactctatctcaaattaaataaataaataaataaagcttaaagacaaatgaaaatctgaagcaaatatttgaacttttgtaacatataaaagttagcattcttttttttttttttttttgagatggagtctcgctctgtcacccaggctggagtgcagtggcacaatcttggctcactgcaacctccacctcctgggttcaagcgattctcttgcctcagcctcccgaggagttgggactacaggcgcctgccaccacgcctggctaatttttgtatttttagtagagacggggtttcaccgtattcgccaacattttttaaactttcacccaaattaatattttatatacaaaaatgaaatgatgaaaatctttaaaatggtagaataagaacctccaagaatcttctcataaaacacagcaaaatcgtcataattaactttttcaaaactctagaaattaatcaaagacttgcatcaaaatctggggagtgtgtgttctagaaaaacggttgaatttcagtaagaacagcaaattttatggtatatgaacttttcctattcccatcccctcccttcatccccagttctgtggcggccttgaaaacaaacaattcacttcgctggtgagaatcagtagcctggcagccaccaaaggggaaggatggggctaaagttccctcaaagccccattcctcaagaactattattgtttgacttgtctggtggttcttgggaagacttatctttcatattctctttatttgacacgatttgaaatattcgaatctttcatattcaaatattctccttatttgacatgatttgaaatgtcagcccacgtgaacagtgtcttcccctaggtataccatctttgttgattgaggtggtaaataagttagggcaaaaaaaaggcaatccaaaaagcttgtaaataaaagtttggaaataatatatttaaactgctaaaattaatttaaaaactgccacataatcgaaacgtggcaaaactatccttcaaaaaatgaagcagaaatgacattctcaggaaaagaaaaagtgagacaattggttgctagccctacagcaaataccaaggggcaatttccaggctgaaataaaaggacataagacagtaacttgaattcagatgaagaaataaagagcaccagtaaaagttaactacataagtaaatataatacacagtatagctatatttttgtttgtaactaattttctttgtgttttaaaacaagtacataaagtgataactaccaattcgtgttgacgggcatgcacaaaggactgggggaaaatgaatctatagaggagcaaagttttgtgctctactataattaagttgctattaatttgaattaaatttccataatttaatgtgttaattgtaatttccaaggcaaccactataaacataactctgaaaatatagtaaaagaaaattataacagtacactagaaaatacatatttaatacaaaaaagcaaagtaaaatggaggaatggaggagcacaaaatatgtaagacatagaaaacaaatatcaaattggtagacgtatattctgccttatcagtattcacatgaaatgtaaatgggttaaacactccaattaaaaggcaaaaatcgactaatggatttttaaaaataatacaacatgctgtttataaaagagacatatacattcaaagataccaatagaatgaaagtaaaaggatagaaaaagaaataccatgcaaacagagccccagaacacatgaggaaaaactgacagtattgaaagaacaaatagaaatttcaacaataccagttggaggctttaatacctcatgtctaataaataatagaacaactaaacagaagagaaacaaggaaatagaagacttgaacaacactataagccaactacacctaatagatatttatagaacactccatctaaaaattgcagattgtacattcttcccaaattcacatgaaacattctccagaataaaccatatgttaggcagtgaaaaagcctcaattaacttaaaaggatttaaataatataaagtacgtcctccatctatgatggaattaaattagaaatcaataacagaagaaacattgggaaattcacaaatatgtggaaatttaaaacaatcgtaaattgccagttggacaagaataaatatcaagagacattagaaaatattttgagatatattaaagcaaaaatacaacataccagaatttatgggatgcacctaaagcagttcttaaagggacagccataactgtaaatgcttatgttagaaaacaaatgagatctcatatcaataacagaagattttatcttagggtacagtgtatactgctcaggtgatggatgtaccaaaatctcagaaatcaccacgaaagaacttattcatgtaaccaaacaccacctgtttcccaaaaatctactgaaataaaataaaacaaaaaacacatccaaattttttaaaaaacaagttagcaaaagaagagcaaactaaacccaaatcaagaaaataataataattaaactagaaataaatgataaaagaggataaaaaacctacagataaaagtcaacaaaaccaaaaattagtcctttgaaaagataacaaaattgacaaatttctagttagactggccaacaacaaaaaagagagaattctcaaattaccaaaatcaggaatgaaagcatggacattactattgacttaacagaaaatgtttaaatattataaggaatagtatgaacaactacatgccaacaaattaggtaacctatacgaaacagacaattcctagaaactagctacactcagggagcaacaggcaaatgaataaagctataacaagtgaagagactgaattaataaataattactgacaaagaaaatctcaggatcagataaatttactgctcaattctgccaaatattcaaaaaattaatactaattcttcacaaaagaattccaaaaaagaaaagaggacaaaaaacttccaacttatttcttgaggtcagcattacattgacactaaaactaaagacaccatgaaaaaagaaaactacagataaacatcctttaaaatataagtacaaaaaccatcaacaaaatattagcaaactgtttccagaaacacacaaaaagcttatactatgaccaagtgggatttcattccaggaaggcaagaccgtttcaacatatgaaactcaatcgatcccataaactatatgaatagaataatgaaccaaaaccacatgatcatcataataggcacagaaaataatccaacgctcttttattattaaccaaaaaaaaaaaaagcagtctaggaatagaagactactttctcaatctgataaatggtatctacaaaaacctcacaactgagaacatacttaatggtgaacactgaaagtctttccctaagatcaggaacctgacaagaatgtctactctcatcactttgacttaacattgtgctggaattctaactggggtaattagacaagaaaaataaataaaagtagtctttggaaaataactgaagttatctttactttaaaatgaaataattttgcatataggaaatcctaaggaatacagacaaactatttatgataataaattctgcaaggttgcaggatgtaagatcaatatgtgaaaatcatctctatatctatacacttgaacagtctgaatatgaaattaaaattccacgtacaatggcataaaaagtaaaatagaaacaaatttaacaaaggaagttcaagacttgcatactgcctacaaaacatcactgaaataacctgaagaagttttaaataaatggaaagacattctggggaatggattggaagaattaatattctcatgatgtcaacaatatccaaattggtcacaaatttaatgcagtccctttcaaaattccagctgtgttttgtgggtttttttcagaaattggcaagttgatcataatattcatatggaaaagcaagggactcggaatactcaagacaatcatagaaaaaagttaggctcaccatcgtaatcccagcactttgggaggccaaggtaggcggatcacttgaggccaggagtttgagaccagcctggccaacatggcgaaaccccatctctactaaaaacacaaaaattagcagggcatggtagtgcgtgcctgtaatcccagctactcaggaggctgaggcatgagactctcttgagccacggaggcagaggttgcaatgagctgagatcgcaccatcgcactccagagcctgggcaacagagggaaactcttgtcttaaaaaaaaaaaaaaaaaaaaaaaggttggagtagtattggcataatggatcaaatagatcaatagaatagactggagagtccaaaaataaacccatacatctttggtcaattgatatttagaagagtaccaagataattcaaatgtgaaaaatattattttcaacaaatgggtctgggacaactggatatccacatgcaaaagaatgatgttggatctctatcttaccccatatacaaaatctaacttaaaacgaatcaaagatctaaaggtaactagtgaaattataaaatatttataagaaaacattaagtataaatttcttggctttggattagtcaatagtttcttaggtatgacatcaaaagtacgagcagcgaaaaataaataggtatactggacttcatcaaaatgaagcacttttcaaaatgtgcttcaaagaacccaatcaagaaattgaaaaaaacacacaaaatggaagaaaaaatatttgcatgtcatatatctgataagggtctagtatacaaaatatataaagcaatattacaactcaactatttaaaagaataacccaattaaaatacaggcaaaggatttgactaaacatttttctagacatacaaatggtcaatacaaacagatactcagtatcaattgtcattagagaaacacaaatgaaaaccacaatgacatatcatttcacaaccactaatatgactataatttaaaacacagaaataaaaagggttggccaggatgtggaaaatgggaaaccttgcacatcactgatgggaatgtaaaattgtgcagccactggggaaaacagtctggcaattcctcaaaatgttattcatatagttaccagctcatccagcaattctattcctaggtatgtaccaaagagaactgaaaatgagttcacacaaaaacttgtacataaatgttcagagcagcattagtgataatagcaaaaaaaaaaaaaagtggaaacaacccaaatgtctttaattgatgagtgaattaaaaattacagcatattcatacaatataatattattccatcataaaaatggaatgaaataatgatttctgctacacatcatggataaactttgaaaacattacgctaaatgaaagaagctggtcacaaaagctatgttttctatttacagaaatgcccagaataggcaaacctataaagtacagaaagtggattagtggctgctgggggtgagggtaagaaattgaagtgactggtaacgattaaagggtttttttttgaggtgacgaaaatatactagtattagataatgatcatagctgcacaattttgtgaatatattaaaaactactgaattatacaatttaatgtgatgaattttatggtatatgaattacagctcaagtaaaaataaatgacaagcatgtacacatacacagatatatacatatgtcatggacattatgaggtgcttaataaatatttgctgaatggctgaaaagactgagagaaaagtatatggtaacatactccaaaaaggaagtgaaagtaaaaaaaaaaaaaaaaaattgtccatgttagttgtatattggtgacgggatcatgagtggtttctactttctatggtatggtttcctatttcaaattttttaattacttctacaatcagaaaaaatcataatctgtggttaaaatttataaaactagtttataacttctgattatgaccaaaataaggttaatttatatacaaaaagtcttctagaaataataagtcttaaaaataaaaatgcaaatattggacaaaagctccctctggtatatacaaaagtgttagtcttccttacaaaacacccctttatattttgcctcagttccatcatcattaacttattagtcagtctccatccactacaacatgttttaaaatattatcagcatacgtgatttcttagagagatttaattatggatatacctgaagcaaatttaaacctgtgtacatatgtgtactcatatccatagacaacaatacacaaacatctaagtctattcatgcacatagtttccttgtaaattttgtgattatgacgtatttgaaaaaaattgtaattagatatgcttgacattttaaagcaaagaaagatatagatttgacagtttaaccaatttgaaaacccagaagcccatacaaggtatggtatgtcaaattatttccaaatgtataatgctttgccagcaggtcccttgtctttatgggcatattctggctataaatatctcagtgagtataacagtttggacaacggagatcaatataaaacaagcagtggaatttaataggagttgatgtgaaaaaagtggtaggaaagatataaactgaggaatccaggtattcaagaattcaccacagctgaaaattcacaggggaatcaatttgcaataatagaaaaccagcagcaacctaacccactgatctttattacatacaaaagagcactatccattttcaacagggttgttttgagtcataagagcaaatgattcctaaatgtttagcattatttctagagacaggaatgacaccatgttgtcacctctttgaagattcctcatgaacttatacagggttaattgcttcttcttttctgtgaacactcagtctgctagtatgcgcttttatcatcgtatttattaagtctttgcaacggtttccacaccatttgctctagtcaaccaaagcaccttcaagacagacacaagaatttatttagctctagatccacagcactggagcacacagaagttgctaaacaagttgtggctgaacaaataaatgagcagagtatttgtttctgtaatttaaattttgtcctgaatattttttgaagcacactgtttaaattttccatactatgtaattaacaacatcattattaatatattattgtttacattatataaagtatataattatgttatataaaattacatatattatatgtaaaatttatgcataaatattacgtttatatttatgtcaatatataatatataaagtatgtaatatgtttatattatatattttagcaatataaataattatagcatcatgctttggcctagcataaatggtgattctacggatgacaaatatttaatatataagatgtcatttccttgttccatgaccacggcaagcattgttaatcgatcatggcattcttaactggagttagaacgggccttcagaatcctcatcacagtgtcccagggagccgctactgatcaatcaggattggcacaagagttgtgactaaccactattcctgattttctggatactttcagaggaatattttctttggaaacccattaattttcaatatttacaagtacaattaatgaagcacacccattctcctatacatattatcagctttctaaaactctgttataccacttatgtgtcctagaattctgcaatgccatgtgaaataaagttctggcgacacttccagtaacctgtaattaaacactttcaatagtagactattatcagtcttcactatttttaacgaaagggcacagatcctattaaagaaagttactgcttttacttcttatggagagaaagggaaagagaacaaacaaatacttgtggataaggattcttgaactatccctctgctagtaagacctgccaggaatgaaactgctactttggctgggcagagcaggtgctgctgattgattcagtaagtaaggaacctttacatttttttaggtgtaagattatcttcttcctgctgctctgaaacatctgatccacaggccagcacaaagaaagctatgttttttaattgaggaagtaacagacagaacaagaaaggctctatggtacggcatactgagaagacaactacaattaccaccctgcaaagctgggatttgtgagtcctggcagggggcctgcaacaattctggtagtagcacagtcccagaccagtctctcagagcctccaactaatgcagaactgtgtttaggagtctggaaaatccatatattaacagcttgtccacattcctagctggtggtgagaactgagcagtgactctgagagaatgccaatggtagacattaactcaagctggtttctttagaaagtaaaacaaaacctgaaattctttaaaattttatttgttcataaattccatgtcatcaccaagacaaaattctgaatgcaaaatccttttgttattaatttcctaactcaaacagatgttttatgtgaattaaaaaaaaatttcttaaacaattatttcctatttactaactgtggaagcagccattcttcttctacaaggaggatgaatgtagagttgtgatgggctagtggtcaggcagctggaggctggagcagggagacactgagcataggaatgtctgagcaggatgcaaggcagtgaggagagtcggaaacatcagctgctgttattagaatcatggccaatgcatccagttttttcttaattagtttatcatactaagtattaaaaataacaataataacaatagttaatgtttattgagtgagttttgtgctagacactgcgctggacactttatatgctttatcccaattgattctcaaattgaatttaggaagtagatattattacctaaatttatggatcaaaatagcaaggcttaggacaggctaactgacagactcaatgacacactgctaataaccagaggggccagaatcaaacctaagcatacaccatccacgggtaaaatattggagagttaccatattccctccaagggtcttaaagctcagattgaattcaaatttatgtaacagatagaaagggaaaagaaaggaaaaaatgtgaatgttctttcatttgtctcaaagaaagaagaaccctataaatatgccatactcttttttttttttcctagagagtgggccagagtccatttcttaatggttaagaaatgtcatgttaaagaaactatgtatggggttctattcagcatgtctttgctcaactttaggtgtttcaattcatgagagggtttgagagtatataagaaaatggcacagtggcctgtgtcggctaagactgtactttgtcattccagtgcactaatctgtgatatagcagctagaaacttataaaacattcaagcaaagccatgtgctgattcaagtcacggactaggatacagctaagcattttagcctctgttattgaagcaataagtacacaggtgactgaatgatggctatctcagaaggatttcctggaattggtcattcaaatctctactcatttaaaagaaagcacttctttacaggaaaccctggtaggctgaaatggttaagtatgatacccaaaatgaataggtaaggaaataggtaccttgaacatgatttgaggggaatatgaggcttactgttcagaaaagattaaagatctatataatccaagcataaaattaataaaatgaccttttcttttaaattgtggatggaacttccatttgtttcttcaaaagcagacagtatgtgggaaacatcagacaaacccaaattgaaagacgttctataaaatacctaaccagtactcttcaaaaccatcaaggtcatcaaaaacaaggacagcctgagaagtcatcgccgtctaaagaacctaaggagacgtggtgactaaatcccataacgggatcctgggacagaaaaggggcattaggtaaagactaagaaaatccaaatgaagtgtggagtttggttaacattaatgtgctaatgccagtttcttaattttgacaaatttaccatagttatatcagatgttaacaataggggaaactgggtgaaatgtatacaagaactctttgtaagattcctgcaacttttctgtaaatctaaattttcaaaaaaaaaaaattatttagaaaaacaaattacacacacactcacacacaggccagagtgtgcccttacaaatggccacatattaaaagcacattcataagcacttagaacaatgcttgacatatagtgtaaaatagcatatattttttaaaaatacatatatattttaagatatatatatttatataaatgacaatatatattatataaataaaaatgtatatatacatatatatatatattttttttttgagatggagtcgtgctctgtcgcccaggctggagtgtggtggtgcaatctcagctcactgcaacctcctccttccgggttcaagcaattctcctgcctcagcctcccaagtagctgggattatagctgtgcgccaccacacccggctaattttggtatttttagtagagatggagttttgctttatgttggccaggctggtctcgaactcctgacctcaagtgatctacccgcctcagcctcccaaagtgctgagactataggcatgaaccaccgcacctagccttttgaatgaatgaataaatgaatgaattaaatcactttccgtagttaaaaacaaaagtcttcaattgttcctttttatcttaaacctacactcagcctcatttaagatcttccacaagctagccaaacttttttttctacaggtcatcagaacactgcctctgttcgggtcaaagaagtcatctcactgtcccaggattgtggagccctcatttctggcttcgctttgtcatcccttaccccaaagccaaaatgctctcccaaatcattctgcctgttccagattgaattcaagctccccaggccctaagaattgtttcaaaacactcctgtattctcctgaaatcttccttctctgaattcctactgtctacttttttagttcaacatgtatatataaaattgcttatagtggtcaacctaattccttcttatccaagtgtcatttagaatggatttttaggggaggagtgaaaggaactttcatttgctccttcaaaaggaaggggttacaaaagggcactaggaaaatttaggggtgttcagtatgtttcttgatggtgttgtcagttctttttgatagacatatgtcaatcttacgaaaattgtacccatttagtatgtgcaatttaccctgtgtcaatggtagagcaataaacctgctaaacatgtctatgtaattgaatgtttggtttgtttgtgtttttttatttgtttacgacatggtcttgccctgtcgcccaggctagagtgcagtggtaggatcacagttcactgcagcctcaacctcccaagctcaagtgatcctttcacttcagcctcctgagtagctgggactacaggctcacaccatcacgtctggctaatttgtgtattttaatagggatgggggtttgccatgttgcccagcctagaatgtttgttttctaatttattatttatttacacatttatttattataattactgtaagataatagagatttgtgttattttctgaggtttaagccaaaagtaagctccaaacaaatttaatgtttgaactattacatgagtacttgagaaatagtatgagtattctctgattttaagtagtttgagatatatattttagctcattaatctactaaaaactgaaaaactgtctctcactgtgattgtatcctggtaacttcaaagtgattgcagttttagaaaatgaacacattagatcactgcttacggtataatgccaattatatgtcatggagtagtcattttatctggcttttcacagaaacctaaataaacttaacctaaacccttcaaccactttccaattactgtcccactcccagcctccagcctggctctttcatctggagacagtgacatgacttgtgtggctgtactgtaccaagttacttatgattttccaaaaattgactatatctttactgaacatttctccttgaccagcacctgcagcatcaaccttggctatggagaactggtgcataagagaccacaacctcagaatgaaggtggcacaggctccagctgcaggctatctactagtctcagtctccttggccagctttctatccacgtccatcccgcattcagaagccccctttcttttcctccactgctgacttgtgttcttttgcaatttttactccttttgttttaacttgtcctgctggctatgatgctgcttcatcaaacaccaaatcagctccaccttcttgccctcctttaccatacttacctcccatattagacatgtttattaatttgcttgctttctctcatgccctgcacaatctcttccactcaaatcattaacaatgatactttcaatttctgattttgccttaccaaacactctacttcttcatattcagcttccctttatacccagcacatagtaatattgtcctgctatgcaatatagtggaaaaagtctcgtaattggaaaccagagtctgtttgagtcatggttctgtcactgactcaaccatgactagttatattatctggaataactcactaaacctcactaagatccagtttcctcatatttcaaatggcattgtgagagttacataaaaatgatgcaggtaaaatacaaactacaaaatgctacatggatgcaagatattgcaaacaggcaatgtgtatttattcccaatacaggtgtatgtctttgagctctttgaaaaattaagtaaagtattccatttctgaaagtaaaagctataaaacctttctaaaagtctcacagtaacttggtagacataaaagtggagaaagaaattgcctttctgaatactagagctttgtaagagatgaaaccgagatgatataaaacacaggctgacttcaaaatggagaagtgggtaaaattgaggtactaatcaaaatgtttgaagcctgtcatccttataagaataatgccatgcttaagagccatgtgttcaacatctgcaaagcaaaagcaaatgaaaaattctattagcttgtaccagaaatgtgaacactcagctgaaactaacactattgtgaggggtataattcaaaggaatatcaagatggaaatgatgagtgaggagaaaaggtaaaaattattacataaacacaatttattttggaaaagcacgtgagcatatgcaaggcagcaaaatctagactatctcctggtaactgaatagcagactcagcatagggtttcagaagaaaaatcagaagccagactaaaccaaactagttttttctgtgaaatctttcctaattcccctaggccaacttaagtactttattctttatgctccaattgccccttgcacttacctccatggtaactattaccacaatgtattataaccatctgtgtacgtggcaatttcccttaaactgttctacttgaaaagcagaaaccattcttttttcctttgcttccccagtgcccagtatgttgcttgccacgtggttattaagaaattgttggtaaatgatgaaggaaccacattttggccaatggtatatctaatgatgaatatcagcttcttctgaggacagcaaataaagatacacttattttaaaacgcttaagtgttagtgtattgcttatggaaacagcttcatcattttattaaaacccaactattttttactgcactattccagacaaattattagggacctaccacttggagagtcatagtctgcccaagataattcacaagattgatttctgattctagtgaaaccagagttacagggtcagcccccatacaggtcagacagagcagccacagagggcttgccagattgcatactatgactgcacagctgtatggaggtgccattcacgtagagtaaatgtgaagaggcatgtaatgcaatacacacaacccacatgacagccaggtagcttgttgacaaaataaacctgcctattttgcatccaaagtatttatctgtgttccctcagtaattccacaaaggtgtgtctttgcttaaacaataaaggaaggatatccttgggccactccatgtcaatagctagaaaaaatgtctctggtacaacaccttgtaaactccctttatggaaagcaagttctaagggctgttaatagatactccagtaaaagtggttcagggccaaatgagtcagaggaacacaggaataaagtttaactctttctttcatgtaggatatcttagaatttgtaatatgcgaatacattaatctataaaagacattataggctgggtgcggtggctcatacctgtaatgccagcactttgggaggctgaggtgggcagatcactttaggtcaggagtgagaccagcctgaccaacatggcaaaaccccatctctctttactaaaagtacaaaaattagccggccatggtggcacacacctgtaatcccagctactgtggaggctgaggcacaagaattgcttaaacccgggaggcagaggttgcagggagccaaggtcacaccactgcacttcagcctgggtgatggagtgagactctgtctcaaaaaaaaaaaagacattatattatacagtgtttctcaaatatattttacctctaaacactttttcaattaacattttggaaaaaaaaaaaaaaggactagtgcaatttcatgaaccacactttgggaaacactgccttagactacagcacccattcctattagccttacaccaccacctactgatcagaaactatgaggataggccagggaggtgtatttttaacaagctccccaggggatttgttgttgttgttgttgttgttgttgttgagacggagtctagctctgtcccccaggctggagtgcagtggtgcgatctcggctccctgcaagctccgcctcccgggttcacgccattctcctgcctcagcctccagagtagctgggaccacaggcgccctcccacaggggatttttatgtgaccaaatgggcactactagtggacccaagtttggaaaccactctatgtgttaacctcatgtctcaccactaaagatttccattctcaaaggttaagtttctctggcttatatttcacagacctcaaaatctctcatgtctataagcaggtatgcaagatagaaaaacagcctgatttctaataccagattaatacttttgtagtttctgatttacgatactgttagcaaagcttctcacttgttgaatctagaatttaaatatgtgtaccaataaggattaaaacagtattaagatatttaaaatgcaaacaaatacctgaaggtttttctttcctagagttttcttacaggagcactcatagaatcttagaagattagaattgaaagaagtaccgacagaggttaagttatttacctgtagtcccagagctcattactagcaaaactggggtttaaattcagagctcccactctgcttctactcgtgctccttcttcagcataaaccaatgcagcatggagaattctattctaaacacctcaacccctcacaactactaatttctctttttttttttgtttttcctttttgagacggagtctagctctgttgcccaggctggagtgcagtggtgcgatctcggctcaccgcaagctccgcctcctgggttcccgccattctcctgcctcagcctcccgagtagctgggactacaggcgcccgccatcacgcccggctaattttttgtatttttagtagagacagggtttcaccgtgttagccaggatggtctctatctcctgacctcgtgatccgcctgcctcggcctcccaaagtgctgggattacaggcgtgagccaccgcgcctggcctactaatttcttctttaagcaacctttatgtcctcaaaaagtcataaaaaagggaaaaaaaagaatttttgttttatatgtttttaaatgacagctttaaagacagttacctgaaaatgaaacaaagaatgattccaaagctttactcccatgaaatagcctcttcaatactcccctgatccaatgcatcaccatcatcctctttcacctggactactacaataatcaatcttatgtccttccaaataagtctctaatctgcaggaaaaacaatggtctttttaaaatgaaaacctgatcatgttattttatttctttaaactccccagtgattctctgatgctctttggatccataagcagtaaggcctttgtaagcttgtgatccttcaatcccatttctggcccatcttcccttgtgtgccaggcttcactcgttctgacttttcaaatttcttaattgtgctatgctttttcccatctcaagactttaccatacgcttgctctctgtctagaacatttcctatgcccaatccaagctttcactccactaacttttaatccacccttacctctcaggtttgaaatcttttctgggatgctttctctggctttcattactgagctgtctctctaccagttggcacttcaattgtttactggtttgattcctctcctagactataagcaccatgaaagcagcggatattttactagacagtaaatcctcagcctacctagcacacagtagcaattcaataaagagttgtgcagagaagaaacaaaaaaaaggggaaggagcatgagatgcaggaaagcagaggagagaggaaagggaaagagggaagaagggagagaagcatgaaaacaatccactatttttccagcacaatgtctttaatatgatgaattctcttttatctgatatcttcagggatgagatattctgattaattcattcaatttaagacatagttcaagctttcaaaaactaatgaggataaggcaagcagattaaagaagacaaggaattcaattgtatggaatatagagcaaatcctttatcaacaaatagcataaggaaaggaatgaatttggtcaggtgctctgaaacactgaacaaaatacctacgtacacagccactcatcctgaaaaacccagcacattctaacacccagaagcactgcaaaccactaagtaattcactgctcaattaaagttcatatcaaagacataatatttctataagttgggaagaaactacactcattttggcagaaaaaatgactctatagttttgatgataaattgttattcttacaaagagaggtctgagaccctgtatatatctataagcagtagacagggccttaatttttgaaagtctcatgtagatatctaagatcacgcactgtaaaagcacacacagctcaatttatctgtcttagaaggaaagtgagccagatggaccctgctgggatttgtacctgaaagttacgggaaaatttgaagttccggaaaaagttcttaaggcacaccagttaagaaaaataagttgaaaaatatattgtttttgaggaggccatttactaagccaacaaaattaaattaatgccacaatcactgagaaaataaaaagatatacacgttataattttagttctcaattattctcctgtaatcagtttgtcttcctactagttgtggatatatcaattttcaaaaaaaaaaaaggaagaagaaaaggtttttttatgacccaactcaaagtcacagattcttctagctagtagcaatccagaaataactcagcctaaacttctcattttaaaggtcagaaaaactgaagctaagagacattaaatgaccctagcaaggtgacaccgtgagacattggcagagtgaggaccagagctctaatcccctaactcagtagctagatttctgagcactagatcactggaggaagcagccatatttttctattcagaaattttttttcttcaaagcaaatgcatcacattctatttgagcttgtagacacctaaaaaccccagatggtctcatatcaacttcctccaaggcagttcacccccttcctgaatttgtgcgatagattatttttactctaaaagaagaattttatttatatccatgttatattttatcttggtgctttcagatcattgtttctgccttttaagatcaaattgaattttggatctgccattcatgttgctaggtagtcctctgaggtctgaatcattgaagaatctaaagagcatgacttgtgtgtcttcattcaggtcacagtgaggacactgaatagggagagcagagctgctgctagccagtctgccaggaggcttaatgcatgaatcaagacctacttcattgactgttcagtaggcattgaatccacctaaagattttttcatccaatccacatttttctatcttgtttatatctctataataagcataattgcactgactacgtgcaaatccttatagaataagcatttaaaaacaaaatattacatttctaggaggttttttagttgacaaagtattttatgcacattatttcatctgaaactcagagaaagtaaacaagtcagggtttattatttctgttttgtagattaggaaactaagtttcagagaagttcattgacttactcaccatcaacaagctaatacgtattgaagtagtgtgttcctagacacttgctccaacacttttatgttatttcatctggatagtgtaggtagctgtcaaatacatgactgagatgagtttcagtactgtactacaaaatctcaagtgaactacatatccaattttctgaacaccaagagagcccaacagggagagaaaggctcctcttccatgtgttttctcaagatggactaataggatttcacgaatcctgtttcaagtattgtaaacacacacacacaccagcttgctatttttctattttgaatacctaagaagcttttacccatcccgccctttgtcccagtaagtaggcctttactgtcaagaaaaagagcctagttgtcttgccaaaatgttattgggaaggtaccttatcaaagaccaacaatagggtgtattgttcccatgttctttcaatgacacactcagctccttggtatgtctccctggttcctagatagagaatgccaatacaggttttaagggctgcagccaatcccccacttttcctgccttctacagttgagctaatagccagcttttgtacctattatgtgtactcacatacaattgtcaggttagctattaagtagataatcagatgctgttttgagtgttggctttcacagatctataaaagacaccctgctacacacatacatgtgcaagatattacgtcctaagggtccactgtgtatcctgactgtgctgagtattacaaggggcattaacaataacacttcacagttacacaggattttagaattgacaaaatactttcatagatatcattgtgatcctcacaatagttatatgaaataaacagtacagatgccatcatttccattttatagatgagaaaagtgagatacagcaaattcagtgacctacccaaggttacacaactattgagtcactgagtggtcttaatctaaaatctctgcaatccaatttagcggagaacacaagttatttgaagatatgactttaagaaatgaaacagtcaacagcatgaaccactcatattcaaatgctgcattctaagcgttcatgaaaaaagttgtagatttcccgattgagctcaacaaggcatgcaaggcctgctagagctctcgtgaaaatcttttaaatcttttcaccctagaccacagttcaaaccactaaacactttaaactgtgcttttcatgcactagaaagagctcttattctgttgtggagagtacaataagacaaagatgcaactcaggtgcattaagttatcctattcaaagaaaataagtaaattctattcaaagaaaaggggaaacaccctgttcaacctggtgaattatctgatggcagttaaaggtatgaatcataaggccatagacactgcagtgaggaagcatctgagtttcatctgacacaatagcaaagtactaagcctgtaaaaacttagtaagacaaggaagacaaatgacaaagtgcagtatgactctgaataatttcttgacagtaaatggagggctcagcagtttcctgcacattaaaaatcatgccctatatgatgtgacctgtaccctccttaaagaaaaattacagtcaagataaatgtaataagagagaacaaaaagctgagaagctgaattcacaccaaagcagataattcaaaagatgttctagagcaatgtcttcaagggtggcgcctggaccagcagcatgatcatcacctgggaacttgtttagaaatgcaaattctcaggccccagtcagacccaaggaatgggaaactttaggcctggggcccagcaatcaatagtttagcaaaccctctaggggattctgactcttaggccagctaaaaatatagtagtcctgttatcatatttactgatatcacttgccctttggcagtgccttcagatgaagaaagttaatactggatgatgaatggtgtgtttccatctgctatgaaccctggaagtgatacttttgacacacccccaccaccacccactgtgggtgctataattagcaatctgtggaggaagtatctctgaaagcttaataagtacaatgggacaggtatgaggtaattaatcattcaattatggtcatgatacagttaattaaacatagtttctcctccctcaatcacctagctctttcttagagcagtgattatcatattttagcatacatcaaattcacctaggagggagggcttgttaaaggggaatcctgagacccaccccaagagggtgatttagtaggctagcgggtggggccagataatttgcatttctaacaagctcctaggtgatgctgatactgctgatctaaggaccacattttgacaacacctgtactagagaaaaaaaaaacaattaaattaattttttaggtactggaccactggtgtgctggtgaatgtttaataactggctttccaggaagaaaacaaaaagtagtcaatgatttgtagcatttgccaattctgtagcaaatatttcaaccatgatctatattaagctacaacatgatgtcactgagctgagagttaggtagaggtgtacacagtccatgtttgctagccagctccagtgcagctctgtagccactccacatttctctggacttgatacgtgcaaaacctgcagcatcacactgtttaaattccacagtcccctgaaagtaggaatttgctgagtcaaacagatgccccatcttaattctgcttccttgtttggtgagtcactgactctttagcaggagagtcatgtgaagatccatttctcacaataaaactcatagtaaatttccccaaatggagctccattatcctgagtatccaacactcagaacttgatttgggaatggtttcggcagcagactgtccactagaaaacgggataccataaaagtaaatggcaaaatataaaagctgtattaccaggcgagtcctgcagtggggctcctaaagtaaaatataagtgattccatctgaggaagagttcagatatcaaatgtgacaaacccactatgtggcatgtagcgaataacccagttcctttttaaatatggaatgcatgctcttagagtgaaacactcagaaattttaaataagttccaataagaaaagatgaaaggaaaaaaacagattcctctttcctttccatttgaacctctactaaactattctgcataaaattctatgtattctgtaaaaacttctgtgttgcctcggtgaaatcatgacatcttccttacccccacgtatcatttttttaatgcaattaatgctgccacaactggccaatcatccagtcttgtcagaaattctggtcagaatccttactcatacactggataactagcctttgaataatcaaaaggtgactgtaaaagtgaaatctgcttcaggtcttacttgctttgtgaaggtaaaaaaattcctgatcaatgtgcagagaaaaaaaaagtggatcagcaaaacagttgcctttaagacattctcttgccttaaatttacttatcaagagagtctccttaccttgaatcccagccagtattattatcgaataagcaacatcagaaagtttcaccactacgaacaacagaataaccatcacaagccttttggcaaaagataatgtgacactccatttgaacaacaattttctctacatactaattaaagtagttactgttgacccacattttcatctggtactaggggacaaagataacatgtccatgtatcgtttaccagcaccagatttcccaagctttcagccagccctttcaccaacttgccatcaccaagcagtgaccccttcctgaagagcttaacctacagagagttcacttggagtcattcagcacagctccgtaattccacacttgagaagtctctcttgttgttggaccacagccagaacaaaattaaagcatttcctattcaattttggcaactgcaaggacccactcacttaaagcttgataacagtgagttgattcaattgccattcaagaagaagcagttttgcaaaatgggtttcctgtcagcagcccacattaagcttccatttgttctgcctctctctttctctccttttccaaagatttaggaaaaggtatgtcccaagaacttagcttttttggtggtcccactgaggacatatagtaaccgaattccaagatatatattattatatgccatgtacataccattgcacagtcatcaaggactataaatatccctaattctctgccgccacttgtccatgtctctgtctacagattcttccatattcatagctttcaaacccacctgagttcctcctttctctcatttcaaaccccagtgacggtacaggtctaaatctgaagagtcttcattattcgtcttctccctcattcactgcatcacctagggcaataaggcatttttcaaaagaaactatcaagcaaataaggcctgagtggtttgtttatgattctaggataaaactcaaaagttgcagtcttttgtgatgcatgatttaatagaataggaagcaggccaagaaccacagactagggagagggagtgagaccattaatcaattacagaggagcactcacaacagtggatatcatagaaagccatgttttccacagttcagaacacactgaggtaatgttagatgattcatgtataaacaattttgcttcagtaattatgtgtttagaacctacaacaataataaatgttatctattattagtactactgttacattattttgtcttctagaagctaattctttaagaaaactattagtgctttgatgataaataggttttaatgtacttgacaattctgaaagataaatagtggatgcctgaagagctatgttggggaagatggtgaagccacgtctaaattcagcaaataaataaataaataaaatgccttcatcagttagagataactatcataggcttggacagcatatgtataatacatttgcccacctgcccccaggactagcctttacggttctctaggagaggaaatgtgctgagctgctgtgttttacactgctgtattatcaattcctggtgcatagaacctacttaatacatttttgttacattgaatgcattgatgtagaagcactaagacttcgctgaataaacactgagcaaaatgcaagtctgtattctggaaccagcaggaaaaagtaactaatctattacctcagactaatcactgaactatttcaggctggtgcttataagaagttggacaggatgatctctaagtccttgggtagccccaaagcctatcactatttcattctcccttctgtttctctttggcgaagacttttgtaccctatgttatcgatgtatgccaatacattcatacttataaaaaaaaaaacagaatcaagagtaagttctgaaagaacagagaagtttgatatttaaaatagttgaaagttgtgaaagtatcaaatagaatggtctgtgataatgccaaagggccacagaaggttttaaatgagtggctgaaccttggtttgctttttagagctgagcctttcaaatctgattctctttattctgtgacatttgtcagtgaccactgctgattacctacttgatgatgtttgagctatgggtttatactggtgattggaaaggagagaaggggtagctgtcagaaatgtgaccaaagaaagatcataacctagaaaatgaaaaacaggatggcaaaaattctagttcttagctgacatatgacatgaatatgagtaccttacagagaaggcataaaagtatacagaattactaaccatgcaacctagtgaaatacaatccaataaatctcttatcaaagcaaaaagacacaaaaacttcataataataaaaatttttatctgttctatctagtctggaatccaaaatagtacttaatgtccccagaaaattatacatagacaactcttccatgatattcacacagcaaaaagtgtgaaatgtgaaagcacttaggatgaatattcagatgtcaatctcctaatatcctcaaacatctcagaaaagaacattcggaaaaacacaaactggaaaatcaaaataaagagacatatggacagaaaaagagaacaaattataacaggcagatataatccacatataaataaacacaagatcatgtttttctgtcttaataatttatacactttactccttagtgaaatccaggacttttgatgatatcagctctaaccaggaatctacactgcccattcatagttgtctgtgaaatttagatgtttgaagtatctgatttggggtggtaggtcttcacccattaattagctctggtaatgaaaatccctcaagttatctgaatttgaaagattttatgtggcttcaaaaactaatcccgaataggccaggtgatgcccacttgagaagctaaggagaattacttaaaacacattctggctgcaatattattgttcatgctgaaatgcaagaagccctcactgcccaacaaggggcaaatgatcccagatcagagtagactgactgaattagatggaatattttttcaactgttatttccttcacattatggataatgtcaggcagactctggcttacccttaacttaaggacttagatcctgcatttcttcttccaagaagccatctctctctctctctctctctctctctctctctctctctctctctctctcacacacacacacacacacacacacacacacacacacacccctcggtataggttggaagtccttcctcagtactgcatttacaccctttgcaaacctgtatcatatcacctatattttatttgctttgtattctcagcacctgatgtacctgaaactttgtaaaatcagagaaacaaaatgaaacctagtcaaggttggatgagtgaaagaagtcttgaaagtgatgtgtcatatcttttgcagaataacagtaccctattttcattcaatacatgaattcgaaattctaatttatttgctttcaatgtagaatttcccaaggtctgtatatcaaaataatagtcaaggctgttctcttttttaaaacttaagatacatcttcaatttcatatttgttctctctctctctctgtcctattttgttgcttgtttgtttccacaaaggacagaattaagacttatgaatagccaaagagaagcatggcttagcccgtgactaaccataggaactatagagtaaatcaatttcttcctcatctgtaaaatgagatgattagaataactgatctgaaaggaaggtttctttctaattttgtcattctacaatcatgtatgttacctgttctatgatatatattcaggaaaccacattaatttgaactatactgatttggaatgggtcagaatgttgactgagataatcaaacttatgttagattgctttttttccttgttttccctattaaaagaagagaagcatgaataaataaattaaccacataatgaaaaaggttgagggcacctctactctcctaagaatgcaaactggtctttaagtgctttagaagtgtctatttacttacaaacggtgtaactgcagtatatgtagggttgatactgtttaaagtattttgatgagctaattagagatcatccttatctattaattaaaactccactacacagtgtctgaggagttataatagttgcagtttttatatattcttaaagggattaaaactaaaacaagtattcatcaatttaattagctttccttccaattcattcaaatggatgattgacaatgcttatgttaaatgaacttattttggaaaaagtagctgcattaaataaattataagaatgttgatatattggtcattggtttcaaatgtcaagattacaataaaaatagcattaggtagtcaacccttatttcccagagtagagggatggctcagcaaaacagggggacttatgaattaagtctgtctatgcaaccattcatagaagtattttgttgaatcaaagcattctctatgtaatgagtgaataaagcatttcaaatcaataatcatgcactaagggctaacaagtgctaggttcataaatgggctagtataatgtatgggtaatacattttttgaaaacacaattaagcacttacacaaacaaatataaagtatactaacaactgccataaaatggatatgaaaaaatgatttatgagggtcaaaggtaggaaagactatacctctgtggcaggaaagaatttcccatgtgctactttttttcttttttcctgatacagggtctcactctgtcactaaggctggagtgcagaggctgctcactgcagcctcaacttcttggctcaagcaatcctcccaactcagtttcccaagtagttgggaccacagcacgcacaccaaacctggctaaattcgtttttctttttttctttttttttggagagatgcagtctctctatgttgcccaggctggtcttgaacctcagggctcaagcaatcctcctgcctcagcctcccaaagtgctgggattacaggtgtaagacatcatgcccagctgctactttcttaatctacacatcaacctttcaaataatatattagtattgtaatggaatatatagacacaatcagatgaaaagaattactacaaaaaggaaaaacaacgaaaggcaggaataagaaataggcatgaagaatcaggaagaaaccaatctgaaagattaactgcctcgtattgagaagtagaagagaacagaatcacatgatgaatcaatgccagtaacccaagaggaaagtaagatggggaaaattaaaattcgctgaaatctaaactggtcagtgtggttatgtagccacaaagcaagtagagaagaacttaattggttttgctgactaagggctgcaggtgggcatggtgatacataaatatatgaagtgatgtgtgattaatgaggaaggggtggtttgtaggcctaactggcagtttgaaatgtagtaggatcactgttgtgattttattctaagtataatttttgcattatagctaagggcatcagaaatttgggaaattgttatattcagggttaactcttcagaaacctagaagggaaagagaagatgacccttccatgaaagggatgaaaacactgaggttgaagagactgaattatggctccctgagcactgcctgccctaagagattttgatatggctgactcaaaccaggaagcgcttggctaaaataaggtgcaccaaaacaagacctcatgaaagaggggctagtcaaatccagagcaaagagtcacttagtgtacaggtacttctctcccagactaaacagaccaaaaggattttccagaactctctcccctagacagagacagaggttggaaaatcaataccctgtgtaagcaaaaggacgtggatgtagattggcagagaaacagaaagcaaggaatacaatacagtagctcatgaagggattgaaagagggtccaaaacctgacatcttcactttataaatgagaaaaccaagctcaggggggtttacgggctcacgatcacaggggatcagtagttcttaggattcaatcccagacccctgtcactccaaaggcaaactgcatatttctttaacaagcaggcaaagtttgagatgaacaactggaaagcatttgcatatgtgtaaaggcatccaggtataagaatcaggagcaaaagatgggacagaaaatgtgagatgtgcctgataaacaccaggggtgcactgtactttgtgaatcatcactcaaacagatgatgagattaagctatgaaatggatttctttgatgggaaagagcagacttctgaggatgtgcagaaagaatgtgaccataagggaatagaaagtcatctaggaaagagacaacagaggaacttgacagagtagggaaagcatcttgatgaggcagaatcacaaaaaccaaaggagaagagaatttgggcatgtttttcaaatgcctaacttcagaatcagaaattacttactaacagagaaggacatgacccttttatttctcattcttttcaaccatccgggtcttcaggcaatttttttcattcctttctcatttcatgaattgtttttggaacgttgatttggtgagaaagggagtgcagtatttatcagcattttcattcagaaacagaacctaaaatattctatattcactaacggaagatgaagagtaaccagtttcttttatttctttgtttgacaaataattgatgcccaatagggcatttattggagaacaataatatctctattatagctataaatgtctggatccagagagccctgttttgcctcttgtcggaaaataccaagcttgtatagctggctagtaatatttccaagtactactgtttgaatttaggcataaattcttctaattagattagatttcttctaaataagaatttactgtgtacccttagattgcactgtttaaaagaattaggcactttcttaaatccgaatgactactcttgttctttttgagtagtttatggtttttccaaataatattcattaggcagttcaattacagggtatgttctattccttggttattcttagtcaatacctgagtgaaagtagtgtatccttttcatgtttctgtttagcattagtcattatttgctaacagagtagcctattgattggtgagacttgtaaaattaatggctgggaaaacaacttaacctcatggcattctatgaaatccccagagttccttggaccttgcttgcaaattactgtctttatgtcactggtttttacatacatgtaatatttcttgtttaaatcttgggaatttggctcatgtaaaggctcttcttcactcagtgattagctagtcctttgtggaatcttcagaaagatttatattaaggagtcagtcagtaatctaagagttatgaaaaaatagtttcatgaatcaaaccatgtgtgtcagtgagaatattttcatgctgtttcttttcattacattacatgacagagttgatgatttacaatgcaatagccccctctctggtagtagaacagggactaaattgatattctctcacaaacacttgtttgcaatatttgtttaaagataaccccctactatggccctaactttttgaatggttaagtgtccttccttctaattgatatatttcatttataataaacctggtttcaaataggaagaacatgttgggtggtatagaaaggggtggaatgagaacaagtaaaggtataagataatatttacatttattttgtaggaccacaaaccatgcaagtctaaagatcacaaacaatttgtaaggaagaatacaaattataccaacaatagagaacacactttctttaggaaataagacatgaaagaggctttgagaaatgggtagactttgcactgacatggagaaataaaggatggcatactaggcaatgagaagaaagaaagaacaaaggtatgcactgaatataacctgaatcgacatttctccacagaagacataaacgtgaccaacaggtacatgaaaggggctgaacatcactagtcatcagggaaatgcacagcagatatcacctcacacctgttagaatggctattgtcaaaaaggcaaaagataccaagtgttggcaaagatatggtaatggactaaaactgatacataaaaatgtgatatataggctgggtgcggtggctcacgcccgtaatcccagcactttgggaggccgaggcaggtggatcacctgaggtcgggagttcgagaccagcctgaccaacatggagaaaccccatctctactaaaaatacaaaattagcctggcgtggtgacaggcgcctgtaatcccagctactcaggaggctgaggcaggagaatcgcttgaacccgggagggagaggttgcggtgagccgagatcgcgccattgcactccagcctgggtaacaacagcaaaactctgtctcaaaaaaaaaaaaaaaaaaaaaaaaaactaaaaaggtgagatatatatacatacacacacacacacacacacacacacatatatatgtatgtatataggtgtacacacacaataaaatattattcaaccttaggaaaggaaatcctggctgtaagcggtggctcacgtcagtaatcccagcactttgggaggccgaagctggcagattacttgagctcagaagtttgtgaccagcctggccaacatggtgaaaccctgtctctactaaaaatacacaaatttagccgggcatggtggcatgtgcctatagtcccagctactcgggaggtcaaggcaagagaatcgcttgaacccgggaggcggaggttgcagggagccgagattgtgccactgcactccagcctgggtgacagagcgagactctgtctcaaaaaaaagggaaatcctgccttttgcaacagagatgaacctggcggacattatgctaaatgaaataaaccagacccagaaacacaaatattgcatgatctcacttatacgtaaaatctaaaaagtcaaactcatagaagcagagtatagtgatggttgccaggggctaagggatgggggaaataaatgtacagttgcttatcaatgggcataaagtttcaattaagcaagataaataagttttggagatctaatgtatagcgtggtgactatagttaataataacatattgtatacttgaaatttgctaagagaacagattgtaaatgttctcaccacacacacacacacacacacacacacacaaaatgaggggatagatatgtttgattgtacaatcatttcacaatatatacatatatcaaaacatcacattatataccatatgtgtgtgtgtgtgtgtatatatatatacacaaatttcatttgtcagttatacctcagtatagctatgaaaaaaaagaaataaatttgttttcaagtgttaatactgtgactctctttttaggaatggatttctggaattttaccttgtagcttcctccaatccaaccttcagtagcctgtcagtctcaaatcaggtcatagccatttgtagtatctgtcctgaggtgataccaggaatattataaatccagttacagagccagggagtggctttgttgtagtcctggtctgaaatccctattggtaagttttcttctctcagagctagcagtttacaataagcagtagtccccactcagctttcaaaatcatgttttcccccattcacaaacaacagattcttacagcagcttttgactttgaatagtgagcttgaatctagtggtccatcttgcatgaaatattttaattccctacatccacaagggagccagtttctaggctgcttgcagaagtgtgccccactagttgatgactttggtcttgcctgacattttatgtttatgttctatttcaagtccatagagatgttatttcatttttgaaagcagcaatgagtttttgtgttttctttttatatgactctattttctatatttgaaacacagcattcttgtcatggtgtgaacttactctgccacattgtctggaagtcttttcagggctatatctatcattccaaattgacaggaagccagaaataaaattatacagaaaacatggtgaccaactatattttgaatatatagagagaatatcttaatttatgtcagtcaactaaatactcaatgaccatctactatcttgaggtatataaatgctaaaagtatagcctttgtagccaaaccgtttgcatttgaatggtagttttgttgtttgatcttttgagttcctttgaattgctttacccaagtgcttcaattcctcatcattaaaataatactcatctcagaagttggctgtgaagaatatattaggatatgtgaaatccttatagtaatgctgggtctaataacaaatatatttaaaattttcttatttatttaccttagtgcaaaatggtaccagattctgtaggagatataaaaagtgctcagtacatatgtcctgcatgtataaattttattttgagttggtaagggtataaatgtaaaacaattagagaataataaagccattatgtcacacttttccacatactattttatcaattctaaaatgtattaggaattaatagataatgtaatttattgaaaactgagatagctgagaataaatgtcttagagagagacttgaggtatgttataatagatgagatagatggagagaaaacccaggtaaggaggcaacacaagctgagattaggggaggaaacgagagtgatgtgtaggatgaacatgctatatgtggagaagaacatggcagaggatctggatggtaaaaatgagagaaacagcagcggattatcatggatgagattagggtagatatatttaaaagccaaatgaaagagtttagacttaggtgaatgattttcaatagggaactgtggttcttctttggggtaataacaaaatggaaatcatatataggcaagattttttgagatagttacacataatttaatgagccaaaaacctaattttatgcccaggcaagttcaagtttgcctataagcatcttttaatttgaaacaggaatgatctagtcaggctctgtacacggttttagtgatatgagacagagggcgctggatcctcccacttgtctgacagtgaagggcacattcccattgtttcttatgttcacttgtgaaaaatgagaaatacagaatcagagacatgacctaatttaaagtccactttgcattattaccaatggaaatatcccaaactctcccagtggcccttaaatattgttttaaaaatgctgctgtgaaaacaaacaccaaattcttgcagataaaatatatttcaccttatgagcttatacagaattcacatcaggctaataaaatagaacatgttgacattgttaaagttaatgtacagtaatttagtacttgctgaagatacatttgaaatttaacatatcagaacagtaggtaggttgaaacaccttggacaccaaatagatattttcgtgtgtccttgaggagtatctatgctgcaatattaattctggaaaaccaccaaatgtaactataatgacaacagtgctgttagagttccacagaattattttcaggttttctttcataattgaatcatattttattattaccctaagatacttagattgcacaactgtgcataaaatcccctgccagaaaattgaggaaagaatgaacgaattagaaggaaataatgaagccatccccagattccagatggatacaaaactaatttcatctttaaggtcctgccatctgttctttttatttattttagcattacacatttacataccttcaagtgaagaagtcaaaaagcagacgcatttgtaatggaacacctcatttaaggggagaaaaggtcaaaaaccgtaatttcttttgtaatgctttggtggagtctagttgtttgttcaagatatgcaaatttttccagtaactgagaaataatcaggctgacaagccatcaggaaatagtaaattaggaaaagcaataaaattgtagcaaatcctataatatggtagtcaaatcgttaatgtgcttttaaattttttcttgttgttcccttatgtttgtttcctttttggtaaatttgaataaggtgtcaaaaattttcaagctggtatagtagattgaatagtgtgccccaaaattcatgtcaacctggaacattagaatgtgactttattcagaaatagtgtgttgtagctttaatcaatcaaagtaagaatctagatgaggtcatactggattggagtgggtcctaaatccagtgactagtttactcataagcagaggagaggaaacagagagacatacagaaacagagaataaggccatgtaaagtcggaggcagagccggaagccaccagaagctagggagggtcaaggaagaattctttcctagaactgtcagaagaagcatggtcctacagataccttaatttcagacttccggcctccaaactcagaggaaaagatagctgttgtcttaagccaccaagcttgtagtactttgttactacagccctaggaaactaatatgactgctaagatttattgaatgtagattttgaaatcttttgaaagcttaaattttttactttcaacattcttacatagccatgagtaaaagctgtgtatggaaatttgaagatatgagagcatgtttttttgcactgagtaatataaatcaaaccagacacatggggaaagtcaatgtaaaaatttacacatgatccgcattcctaaactatgcaaaatgcatttagctactattctaactaaagagttaatcaagaaataaagaagaaaaacaacaatataggggaagaaatgttgtccaaagttatttttaaaagaataaataaaaacgaaaaatctggtaagatcctctcctgtttccctgttgttttaaatctttatcttatttcacagagtatcagttttgaatctgaaatttaatgaagataagcaatatctgatagcatgtttatacttgcattcctaactgctacgtgcctatgggacacataagattgtgaaggtggggagagacacgtatagaattaacagctttcattttactcttcaaatttaagagttggagagtttttcttttttaaaaaatctaaattttaatgaacccttttatagggcaaaaagctttgctattctatatgccttaatcatgctaggatgtgttttgttaaccaatgcatagtgttgtgtggcctcagatttaggagtatgcttgtgtgtggtagtgtatcctatatgatttttttatttgatcagtttcttaataccattgtattttgactactattcttaaataataagacaaccattttttttcaagctgggtagagtatgtgaaatataagaaagcacacttaattaaaataaaagctgaaaattaaaatcttatcaagcttgccttattttaaggagctcagaccattgcaaaaataaatcttgctttctcatttagtttcaggtgaccaagtctctgaatccaacagttctatcttctgcctccaaatgtagcatgatatttccttcagattaatgaacagaaatacattgccattgtagcaacaatcaatcagttaaatcacactttctaaggccatttcagggattttaaattatttttctaaactattataccctgttttcatcatcaccctctctaccaaaaactttgcatgacatttaatgccctgtgaaagaaagtccagactcctctcaccctggcaaagacaaccttcactgataacctggcttggaagatcctttctgatttcctctcctactattattgcctatctgagccctcctctctgtgaagttaggctcatccattcactgttccccaaacactttatgagcatcctttcttctgagattttcttcactcatctcaccagaaatgcccatcactctttgaatgcatccatatccacctaccttgaagccttccttctgcttcctttgaaatcacagctgttactacttggcccagtaatctggcattcaaccacataggactcacaaacctgaaaaacgctgttttttaaaattgtcaagtgatatagatagatatttggatatttgtcccctcccaaatctcatgtcgaattataatctccagtatcggaggtggggcctggtgggatgtggttggatcaggggggtggtttctcctgaatggtttagcaccatccgcgtggtgctctactcatgatagtgagttctcatgagatctggctgtttaagtgtgtggcatccccacccacctctctctttctctcacatacacacacacacacacacacacacacacacacacacacgccatgtgatatgccagcttcccctttgccttctgtcatgattgtaatcttcccatggccttaccagaagctgagcagatgtccagtgccatgtttcccgtacagcctgcagaactatgagccagttaaacctcttttctttataaattacccagtctccgttattttttatagcagtgcaagaacgtactaatacaccaattaatgagtgcaatagatacatttactgactgctcaagtctcactccatgcttgaccatcaccccatgcttgatcaactgggcagttgaaatctgaatcaaagacaacaatgggatgaagtatggcttgacaactggctgaggaatgaggatgaggttccaagccaaggtggagcccaggaatacagtgtcacgataaaggtcaaatgattccttgcaaacttactcatttacattttgaatggttcaattgaacattatgataaaaaagctcaattcaaatggtcatgcaaaaagtatggtacttgattatattttattttatggtacaggtaccttctactatttcttgatatcatatgttattactgaaattcaatggctgacatggatatcaacttgaatataaacaatctgatggaaggacatttctctgacacccctcatatttctcaatatggtacaatctgtgattatacaaatatttgttattaggttagtgctagactattaggtctttgtgaagtacaaatctaaaagaaagcaatatatacttgtgttcagaaatatattcaagaataaaacataaatgccaagaactagtctttcaaaaggcaataggtacaggaacaaaaatttgaatattctcaaaaggataaatattgttattcatgaactgatagcaatatttaaatggtatcatctcctttgcagtgacataatataagctaaacactggggagacgcatgaagaatgttaaaatgtattaatcttgcagaatatactgtggcatattttctaacacatatactcaatagtgaaattgatcatttcaatttaccaatacttgtagtagtactgtaaaacataagtttacataaaaatctcatttttaaaataaaagacactcctgctattggtaaaatttgtttttatgaattaaaaaaaacttcacactgggtttttgaagcattgcattagcagtaatgtttttgttaatttaactcctcatcccttgtaacatttcaaaaattcaccactagtcataattctcttaagaaaataaaaagcagctttgagagctatagttagagtttaagacagaggtcagccaattatgtttgaccatgtctggctgaccatatggccaaatctggcctgccacctgtttttgtatggttcatgagctagaaatggtttcacatttttaaagagttgaataaaacttaaaaatatactattttatgatacaggagcactatatgcaacgcaaattttattgtccataaataaagttttattgaaccatggccatgctctttcatttatctattgtctatggctggtttcatgccatgcagtacttgcagcagagagtatatggctcacaaaggctaaaatatttattatccggcccgttagagaaaaagaaagttcttatctataatttctgagaaggaaatacaaattaattaagctttgcaaaatgaaaaattaattccagataactctcttttatgtgcaattagtcaattggaacattctacgttcaagttatatatattcccagaacatgcaagcacatactcaacttaaaagtcataaattcaataacactaacttaaaacaaattttccaccacaatatttagtgttataattttaacacaaaccaatgagcaagatactacatgccagatgtgacctgaaagtaacaacccgttggtcagaaaaaactcactggactgtgtaatctctaataagtacgaagtggtgatatctaaagcaaacagaataaaatcactctttgtggtaatcagaatgactttctaaacaaatgttaagacaaaaaaattctgccgaaccaccaaggacatcccaagcaatcattttatttttctctctgctttgctattagaggctatctgagcattgtttcttctagatattgagaaaagtacataatttctactaagtatgctacatgcattagtgttcccttaatgattacaagttgtagatctgctaagtgcatcctgaatgcactgaatgtgcaattgttttgcataaacgtgaaaagcagagattctaaataaaaagccgctatttaaccatttgcgattatgctatcatcccacaccatcgcatgtaaatgcacttttctattctctttccagttgctaaagtaaatgaccaggaacagagaaatgccctcatttcttatttattggtcacttacttccttggcttgcatataaaatcaaaccatccataaaatccctttaaaaagttgacacatttagggatcaaattatttcacacaaaattgagatatttccaaaaataggcatgttttgaagaatatctcacattacatgtgcaattgagttcttttcctgtcccaggtacagatttgttaggtgatcttaatcaaattgttgctttcttcattcactgcatactattcctttggcaaatatgtttctgccttgataatgaactaggtactatgtgaagtgttatacagaataaaaagatgaatcagacataactatgatctctaggattcgacaaacaagtaaaagtattaatcatatatatatatgtacaaataacggtgaggtaaaaaatgctgagtgcacctaagagaggtgcagataagatattttggaaagtcagagggagaagccattacctccaactgggaagatccaggaggaatttattggtgaggctgcatttgagctgtaccttaaaaaatggttaagaagagtaaattaaattgactgacaagggcatttcacaaactgacaggtatgcaaatgacaggtaagaatgtggtagatgtgtgtgggtaaagaagaaaatgtcattttttttttttgtccataggcttggatgtgtaaagtggagcaagttatagttaaatctagagacatagcatgagaacacgaagatagtgcggtctggaaggaagcattggactcagacagatataagttagaattatggccctggatactggctgagtataccagagtactttacttaacctctaagtctcttctaatgtctagaaatattacataacttgcaaggtccttgtaaagataaaaaatatatatatgcacattttataacacaatgtctggcacattatagatgtctaataaataatagctattattgtgtcaatattatattgaataacaggctaaaagttttagatagtgctgtaagaagttatcacactcactatggaaagtaccacaaggttagcagtttctgaaactaggaactatttggaaactaaagcagttggagagttagctagtgttttcaactgggactgcccattaaaattatctagcgatctttgtaaatcgtggcataactaggctttaccacagaacaattaaatcaagatctctatccgtggagcctgggcatagtactttataaaagattcccaaggatttctcaagcatacccaaagctgagagctactattgctctagatacaagttgttacaattaatatgataagtgtaataagtccagcaaaatatattttatgatcataacttgagttattttcactctgctacactagtgaatgtcacttttctagatggcctttctctgtcatagtctcctgtttgtccaaagacccatttagcaccaaacaggacccaacacaatcaaggccaaatccatgtttattgaatggtgaataatatcactgactcatattattaccattccccattagatcaaagtgacaagatgaaaaacaatataagataggtaccatgtagcaataattaaaatatttatattttgatccttgttttctttttcaaaagctatcttgcattaaaagagctaaaggttcacatcatgttcttaagggttatagtaagtaatcagctatgcctaaaaattaacatcatgaaccaacacatgcaagggtaagtgcaagactagtaacacatgtcttcagccttatcaataatattatcaataatatcaaagtagtggtcaaccacctgttttcatttttttaacttttattttgagttcagtggtacacatgcaggtttgttatgtgaataaattgcatgcttcaggggtttggtgtacagatcattttgtcacccagataataagcatagtaccagataggtaggttctaaatcctcaccctccaccctagagtacaccctggtgtctgttgtctccttcattctgtccgtatgtctgtaatgtttagttcccacctgtaagtgagaacgtgtggtatttggttttctgttcctgtgttagtttgtttagaataatggtctctagctccaaccatgttgtggcaaaggacatgatattttcttttatgactgcatagtattccatgttgtatatgtaccacattttctttatccagtctgccactgatgggcgtttaggttgattccacgtctttgctattgtgaatagtgctgcaatgtgtgcatgtgtctttatggtagaacaatttatattcccttgggtatataaccaataatgagattgttggattaaatggtaattctgtttttagtttcttgagaaatcaccaaactacttcccacagtgactcaactaaattctcatcagcagtgtataagtattcccttttccctacagcctcaccagtaactgttatttttttactttttaaataatagccattctgactggtatgagatggtaagacattgtggttttgatttgcaattctctaatgattaataatgtcgagcatttcttcatatgcttgttggctgcatgtatgtcttcttttgaaaagtgtctgttcatgtcctttgcccatgttttatggggttgttttctgcttataaatttgtttaagttccttatagattctgaatattagacttttgtcagatgcaaagcctgaaaatattttctcctatcctgcaggttgtctgtttactctttcaatagtttcttttgctgtgcagaagctctttagtttaattaggtcccatttgtcaattttttattttgttgcaattgcttttggcatttttgtcatgaaaatttttgccagggactatgttcagaatggcatttcctaggtaatcagccagggtttttgtagttttaagttttccatttaagtcttaatccgtcttgagttgctttttgtaaatggtataaggaaagggtccagtttcaatcttctgcatatggctagccagttattctagcacaatttattaagggagtccttacctcattgcttgtttttgttcattttgtcaaagatcaaatggttgtaggtgtgcagccttatttctgggctctctattctgtttcattagtctatgtgaccgtttttgtaccagtaccatgctgtttaggttactgcagccttgtggtataatttgaaatcaggtaatgtgatgcctccagctttgttctttatgcttagtactgccttggctatttggactaattttttttttttgttccacatgaactttaaaatagttttttgtaattctgtgaagaatgtttttggtagtttgataggaatagcattaaatccgtaaattgctttgggaagtatgaccattttaacaatattgattcttcctattcatgagcataggatgtttttccatttgcttatgtcatctttgatttctttaataagtgttttttaattcttattgtagatatctttcgcctctgtggttttctgtattcctaggtattttattgttttgtggctactaattcaaaatttcattcttgatttgcctctcagcttggctcttgttggcgtatagtaatgttagtgatttttgtacgttgattttgtatcctgaaactgctgaagttgtttatcagatcaagaagcttctgggaagacactgtgggattttctagatatagaatcatattgtctgcaaacagggatagttggacttcctctctttctatttggatgtctttaatttcttgctcttgcctgactggtctggctagaactttcagtactatgttgagtatgagtggtgagacagggcatccttgtcttgttctagttttcaagggaaatgcttctagcttttacccattcagtatgacgttggctgtagattttttttgggctgttattattttgaagtatgttcctccaatgcctagtttattgaggatttttaacatgaaaagatgttaaattgtatcaaaagccttttctgcatctactgagatgattttgtggtatttgtctttatctctgtttatgtgatgaatcacatttattgatttgcatatgttgaaccaaccttgcatcccagggataatgcctgcttgatcatggtcgaatagctttttgatttgttgttgggtttggtttcctagtattttgttgaagatttttgcatctatgttcatcaaggatattggctttaagtttttttgttgttgtgtctctgccaggttttggtaccaggatgaggctggtctcatagaatgaattagagaggattctcctctcctcaatattttggaacagttttagtaggaatagtacccgcttttttatacatacagtgggtacaattccgctgtgaattcatctggtcctgggctttttctggttggtaggctttttgttaatgattcaattttggaggtcattattgatctgttcagggattcagtttctccctggttcaatcttaggagtttctatgtttccaaaaatttatccgtttcttctaggttttctagcttgtgttcatagaggtatttgcagtttttgtacttctgtggggtcagcggtaatgtccctttgtcagttctgcttgtgtttagttggatatcctctcttttttctttattagtatagctagtggcctatgttatctattctttcgagtaacaaactcctggatttgttgatcttttgtatggtttttcacgcctcaatttctttcagttcagctctgattttgcttatttcttatgctctgctttgagttcaaccattttgaaaaactgcattccagattgtattttatctagaccccatatatagagatcttttaaaaagttatttcatgtttcaatagtcctacaataacattttgtggggtgatgcatcaatcattgttatgatgttaaatttaataataattttacagaaaaacacttttgtattcaaatgtataatagggaatgttgaagtatgctgaggaatatggagactgaggagtgtgtattaagaaaatcccaaaggacccatagcttcttagaatttgaaggcactttcgaaaaggcaacctacaaaataggagaaaattttcacaacctactcatctgacaaaaggctaatatcgagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgcttaccatcactggccatcagagaaatgcaaatcaaaaccacaatgagatatcatctcataccagttagaatggcaatcattaaaatgtcaggaaacaacaggtgctggagaggatgtggagaaataggaacacttttacactgttggtgggactgtaaactagttcaaccattgtggaagtcagtgtggagattcctcagggatctagaactggaaataccatgtgacccagccatcccattactgggtatatacccaaacgactataaatcatgctgctataaagacacatgcacacgtatgtttactgcggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccacatgttctcactcataggtgggaactgaacaatgagaacacatggacacaggaaagggaacatcacactctggggactgttgtggggtggggggaggggggagggatagcattaggagatatacctaatgctaaatgatgagttaatgggtgcagcataccagcatggcacatgtatacatatgtaactaacctgcacattgtgcacatgtaccctaaaactttaagtataataataataaaataaaataaaaagaatttgaaggcactttagagataatctaaaagaattgacttcttacaatttgaatggactttagaaataatctggcagaatttcttgccaaaatcaagaaatgccatttctcttgaaatctaatagcgaagaagaaaaattacttgcttctttgtaaaaacatcgaaaaacctacaaaaatatcaaagtttatttccaacatggaggcctggattttgggacttccttattaaatcttaatatattgacagcacttgtaaggaccaacctcattcaaaaatataacaaacagatggcaaattctacagtcggcagaagtaatgggggtattaaaatgctagcagcagtctccctcatggctcttgttttgacaggtgtctactcaggtgcttgtgttttctaagcaatgtttctctgttcctgtgtataagcggccctcacctttttatgagtatctatgccattgcagtatttgctatacataagacaatcacaaccattaaactgtctctaatcctttcctgttgtggttatataaattatttgtttacactgagagtacatgaaatttttataggcacaatctaggattgcatctatccagctttcctctccaataaattttttgtaaatattcaaactcatatatgcctcaatgtaaccacattgtaaaccctatctgttgctttcacagaaaccattcaagctggataaatggcccacctcatagcccagggaagaactcaatgatcagattctaattatctttcttggttcacttaatagccttctcctctctcatgggggaggccagggataccctgaaaatgtggtctcagggaattcattgcagtcatgtcttcttaaacattcatatacaaatgattcctttaaagttattcatacaataaaatgtcctagacactgtgttaggatactatgatgaatactgagggtgctatgatgaataaaggcagtcactgccctaaaagaacttgcattaaaaacaacaataaacaaataggaattacagtagaaccttgaataatattgttcttggtcaacattgttttgttacaacattgataaggaacttcccactggggccactgtctgtgtggagtttgcacgttctgcccatgtctgcatgtgttttctctgggtacaccagtttcccccacatcccaaagctgtgcacattcggttcactgacatattaaaactgtccccgtatgaatgagcatgggtgtgtgtgagtgagccctgcatgtaatggaatggggtcctgtcctgggctgcttcctgccttgtgcctgagctgctgggtgacactccagccatctcagaccctgaactagaataagcaggttgaaaaatgagtaaatgaatgaatggatagatggatacatattgtaaaaattcataaattatgtgataatcatacaaccctacaataataaatgatgtggcacaaaagtgcttactgagcccatcatatttgttgtttgtttttgagctgtgtggtggtaggaggtgcttcttacaattttcacttttcagacaattattccttgatttaacccaccactatgaccaccatcactcactgattcaccaaaatttgggtaaataattatcttacttgtttctttaatatttcttaaatgtatgtatatctcacattcatttcaatgtttaatattagaagtggtgtgggttatttctttagaagtttggtgatgttagccagccactgtgggtcacacctgtaatcccagcactttgggaggccaaggaaggcttatgacctgaggtcaggagttcaagatcagccagactgatatggtgaaaaaccgtcactattaaaaatacaaaaattagccaggtgtggtggcacatgctgtagtcccagctgctcgggaggctgaggcaggagaatcacttgaagccaggatgtggaggttgcagtgagctgagatcacgccactgcactccaacctgggcaacagagcgagacactgtctcaaaaagaaaaaaacaaaaagaagtttggtgatgtttttgtgaccagaaatatgcttaaaatcttaactcctgtttatatcaattagctttgtgataaaattggctttcattatatgtatgctgcctaaagttacagtttctaagaacttatcagtgatgttaagtgaggatttactgtatgtcagataaaaatatgaggtatgaataaaaataacatacattaatagatacagagagtgactagggcaggggatactactctagaatgatggtcaacaaaggcctgtttgtggaggggatatggaacagagacttgaaggtagcaagaaggtcattatcaaagagaagactattctagagagagaaaaaagctaacaaagtttgaagaccaaagtgtgctgggaaaaaatgagaagcaagaaagacagaattactggagcagaaaaggagtggaggacagtagtaaaagatgaaattcgagaagtttggagctgacatggttaattttacgtgttaatgtgactagaacaatggttcccagctgtttgatcaaatatcattctgagcatttctgtgaaggtgggttactggccgagattaatatttgaattggtagattgcataaagcagattgacttccctaaggtgggtgggccatatccaatcagttgaaggcttaaataacaaaagtctgccctttcccaaagtaaggaaaacttttgcctcctgactacctgtgaattgagacagtagctttctcctgcctttgaactcaaactgaaacatcagctctgcttgagctgcaagccagccatccttgagactgcaatgacacatccatttttcttgttcttaaacctttggactcagactggaaggacatcattgactttcttgggactccatcttgctgactcacctgcagttcttgtaaattagcctccataatcacatgagccaattctttacacacacacacacacacacacacacacacgcacacacatatatatatataatacaatatataatatatgtattcatcctattagttctgtttctctgaagaaccctgactaatacagaagcttaggagtagtatgttctacttactatttaaaaaatcatccgctatatggcatggtcagactgcagtgggatgggacagggataaaatcagggagagtagctaagaagctttgcaataatccaggcaagagacaaatttgtggcttttactagggaggtagtggtagatgtagtgaaaattagtgaaagtccatatatatttgaagattgagccaacaggatttgctgatgaggagctggagaagatgaaataagttgaaaattatctcacaggccttttgtccttgggccaaaactggaggaatagagttttcagtttctgagatgggaatggcttgagctgatttgcagggctaatttgaagttcagctttagagcattttattttgagaaatgtactggaaaagcaagtagggaggttgaataagcaatcaggcatgttagtcagaagttgagagtgaaatttagcaacagggtgtctaattgtgtcactaggaggagacctcctagtgatctggtgtggacatagaagatttcttcagaaacgggggtcatctcacatagttggtaagaaatatttcataattcatatagcacctaacaaaatatagtttatcacagaattcagtcatatgtagaaatggcattgaggtaattaacagcttttctgtttattttgtgtcaatttctaccaaaatcctaccaaatcataagctgctttacttatttcatgagtcatattaaggttattcaagtatgtgattaatgtgtatgattttctatgccattattgtttttagattatatagatctaataggcagatagctcatatgctatggttggaatatgtttcccaaagatcatgtgttggaaacttaatgtccaatgcaacagtgttgggaggtggggcctaataaaatgggattaggtcaggagagctctgaacaaaggattaatgttgttatcacaggagttggttagttaccatgggaattagttagttatcatgagagtgagtttgttatcaatgtaaattttgccccctcttgctcaccttctcttgtactctcctccccttccaccttcccatgtaatgacatagtaagaaggccctcatcagaggacagcaccttgatattagttctcccatcctccagaactatcagaagtaaatttcttttctgtataaattacctggtctgtgggcttctgttatagcaaaacaaaatgagctaggacatcatattaacatacactaaagaaattattctgataattatattttgtaggctaaccttaacttgaaatttgactctagctagtcatccctattttctatcttgatctgaaataatttattttggtttcattatctataaaaaaaaagtttctattttgcaacattgcaaacactgcaatagaacgtctcatactcaaattctgttatagagtgctcattaacatagatgtagcttttagatattttatgtagacttagataaattaaatagcttcccaatatacatagaaaacctaaaatacatatatattctttttatgcccatgaaaatgcaatataaaatgtctgttataaaaatgattgttatattaaaatacggaattgtatacatttagatattttataggataatgaaattgttttgctttttctcctcagcagttagagtggcatattttagagaaaaaccataaaatattggaaagagaaaaggattgagggtcccaattatgcaactgttgggatgacaccaaaaaaatcatttaacctcttaagacatcatttttccatacttataaaatacagatattgaagtagattgttaatgttctttatgagtctaacatttatgaatgctatcatttaacaggcatggggtgtgtgtgtgtgcgtgtgtgtgtgtgtgtgtgtgtgtgtgtaaatgcagttccaaaaggaagtatcattttactccaggcaaattttcattgaccatattttatgcaagctacatagtagaaatacggtcagagtacgtatttctatcatcatgttaaaaagacataaatataaaggtgccagcattttgtcagtaaataatcagagaatcagtcctgaacagtaaattcgagtatgtgtgcttttatcacaaccacaatgtttcattaatgtgttttttcttgctgaatattctcgattccttgaaataaattttaattagccactttatgcatataattttcatattttcataattatacttaattatgctcttggcacaatttatgtaatcaaataattgccatatgcaattatattatataaaatatgtaaacgtaatggaaaaaatcacagaagatgtattcacacaagatatttcctttttcattttcagctatccacattatttagtattgattttaacaatatttatttttagctcaaatcactagatatcaaagagaagattatattcttaaggggaaaatttgacagtgattctgcatagagatggtatattattaaaatacaccataagttgaacatttgaataaaagtaatatgtaatatgcattttttcaggtggttttaggaaaaataaaatttacgttttgcttttacccttaatattattgatttgtaatgtgttaattttatttatagctttatacattcttatctatactcttaattgcctatacctaaatatggaatcacagaaatgcaaaaaaatcaaagaaattaaaataaatataaaggttatctaggtcatatccacctaacactacaccttgagaaaatgatgtcctgggaatttgactgacttcacatagtcacaaagctagttcagttacttcacatagtcacaaagctagttaacagcaggacacagcctaacctcaggactcctgcctgtcagtacagggccttgtccttctataccaagaggatactcagttcagcacttataggactgtgttttcaatgatctgcttttgttttttatcttcttcccttgattgtgagatctctgaagaaagagattaggtcttcacctttgcatcctccactagagcttagaatgttgcctacgcatcatcataattgctcaacatctagctttttggaggcttttattttgtgcaacttttgtgaccattttacaaaaataagtaattgtctcctcatctattttgtggatacacaatgaatgttgacctaatgacaactggttgaataccttattgcaaaattgagacttaatatttgaaacacgtattttatttgactctacaaaatataaaatgtgttatgtacacatctaccaagaactcacactgaatggtaattgtagggtattgggtaggagccacgaggtattataaattttctggcactcccatggcagaactgtttaaatgatgaaatttcatttatagcaaaattatcctaactcaaacactagtgaaaaggaaaaataaaaaaagaaaaagaatagctgatagacagaaaactaacatgactgatatggtttggctgtgtcctctcccatactcatcttaaattgtagctcccataattcccagatattgtgggaggaacctgatgagagataattgaatcatagaggtggtttcctccatactgctctcatggtggtgaataagtctcatgagatctgatggttttataaggggtttctcctttcccttggctctcattttctctcttgtctgctgccatgtaagatgtgcctttcaccttctcacatgattgtgaagcctccctggccacgtggaactgtgggtccattaaacatctttttctttataaattacccagtctcaggtatgtcttcatcagcagtgtgaaaacagaataatacaataactatatacattttcattatcttcagcatgcaagttttctctctgaaacaactcaaaaactccatgtgtattagcattttgttattaagtaaatgctcctctgggtttctgtcctgaggttccacagggtggacatgcttttattttgtttctattgaataattcacagaaagttattaattgactaacaccaaaccaatgacaaggttgaagctcttaattgcatattgtcctcacatttgcaaatgggaaataaggcactgcccaggacattccagggggagatacaaagaaggataaactgaggctctattagctctcacattctgtgttatttttatggagtgtaactttggcttcagaggatgagggtacagagaggaagaacataaagcacctgactcctcgcctctattttctgaggtagattgctcttctagccgagactgaaataaaaaatagctctcacgtctaagttcaagcctcaccatgtcgttattgggaacaaaaagcaagtatcaatgaacaaaataaacaaaatactctgaacatgcaatatgagtctactatatctcttaaaatcaatatttttcaatgtacagatacacatttacatttaaaaagaatagttccaattgtcattctcttcacgtgtctgccacacaaaaactttttaccattacagattaagccaaggcactaccaaaaaaaaaaaaaattaacttagtaggaagaattgcaaaatgccaaatatttttctgctttaaatttgaatgtttttaatattagcatgtactttcattaaggagtgggcctactagatacactgaaggtatttgagtatttatgataataataatgattgctatataaaactataattagccaggcatggtggctcatgcctgtaatcccagcactttgggaggctgagacaggtggatcacctgaggtcaggagttcaagaccaccctgaccaacatggtaaaaccccatctctactaaaaatacaaaacatagccgggcatgggggtgtggtagctagcacctataatcccagttactccggaggctgaggctggagaattgctgaaacccaggaggcagaggttgcagtgaaccgagatcgcgccattgcactccagcctgtgcaacaagagcaaaactctgtcgcaaaaattaaaaaaaaaataaaaaaaactgtaattaatagacaaacactggcagagcagagctgcactgtcctgggctctgtgtgttgacataaagagtcaaacaaggccaggcacagttggtcacgcctgtaatcccagcactttgggagtccgaggcaggtggatcacttgaggttgagttcgagaccagcatggccaacatggtgaaaccccatctctactaaaaatacaaaaattagccaggcataggggtgggtgcctgtaatcccagctactcaggaggctgaggcaggagaatcgcctgaacccagaaggcagaggttgcagtgagccagtatcaaaccattgcactccagcttgggcaacagaatgagactccgtctcaaaaaaaaaaaaaaaaatcagacaaagtgcctaccttcaaaaaacttactgtgagcatagaggagacaaaatggcacacaaaatgcacttgacactatgaagcattagtgctaaaagctaaataaaagttagagatgatgagctcataggagttttaaaatgctagaagaaacagaaaaacttttctggagaaaatgaaacaccatgggccttaaataagagacaaaatgtaaattcacaggttgcaaactcaaatgcctatcaaagtcagctgaatattgctgggtaggaaggtacctacagtgttaccaaatttttcaagagaatctagaattctagtttgacatgtaacaaatactgactttttaaatagtgtcaattaactcaaacaattaagtgctgtataagccaataaaaacactatataattatggtctgcctgatttatattttttgtcatgtcctcaaatattagaacagggatgagatggcaagagaaactgcatgagctacatggctgtgatgagaccggatatagttaatttaaaagaacaatcagggctgggtgtggtggtcacacctgcaactcagcactttgggaggccgaggctcttgtttttcaagaccagcctgaacaacatggtgaaacctcatctgtattaaaatacaaaaattagcccagtgtggtggtgcacacctgtaatcccagctactcaggaggctgagacatgagaatcacttgaacccgggaggcggaggttgcagtgagccaagatcatgccactgcactgcagcctgggtaatagagtgagactttgtctcaatacattaaattaaattaataaataaaataaaagaacaatcagaaggctggtgcaggaggtaagtagtagaggagacaaactggggtcaggttggagattatttggggcatgaataaaagcatttatattgattctggaggcagattagagaacaagtacatacagaggtgtgagaggctaagtgtatcatcttgaataaagtcaaacttctctttgtgttggcattcatcctgtctgccaagtataatagctgagtgtaacccaaggcattttagaaatgttagaagtgtcaggaaccatgtaccacacatagacctcaaagcaatgttgctatattagtcttttttctttaacttacctgtaatcataaaatattgatttaaaaaccaagactactaatatttcacaacactatattcacttctaacatactactgtcaggttaacatttgataattccaattaaaagggtttaaaatttttataggatttaccatggcagtatcccaaggaaacatcgtaccacccagcttggccaagcacctaggccatgtttcagctgagaatttttttttaaacttcattatatgaacatttggtgtctcctataaactgacaatccagtttgttagagatacaatatgcaaattaggaaattagcaacaatttctgatgctagtcattactatcctattctccacttcagatttgcaaaaacgcaatgatgcagtaaactataccaacggatgttttgctacggctattaatggacaatattttattgtaatgttaaatttactgcaaaacttgggaatttacaatagcatacattatcctacacaatctaatataattcaatttcctttgtcctatgagaaaaacaaataaaggcaaaatatattgcaaacatactcacttgtgtgctaactttaccatcttattaactattcagtcaaattcagtatcaccccaaatgctgtgaacaaatttcatattcttcaatgggaaattgaagaatttttggacttcataatattggtgaacattctaagctttagccatgtttttctgcttaatctaatttcaccatctctcctctgttcattgattattcctattgttactccacacactgatgcctaactcccactcaagaggtactaagtgtatcagaagccattattgtaaatgtgcagttcaaattttttcctttgctgcacatttgtttatgattttctttgtagggccctttgaccatagattctcatacctaaattcaacaacaaagtcagaagtgcttttgtttggaacaccctcaccattgtcctgaggagtctacacagagctaaaaaaccactatgcaaaagttcaagggaaaccagttgatgcactgtggactgaaggcagaagctgctgacttctacatttcaataaaactattatgaattgcattttagaaaaagggctttgttgctggtttgttttgctctgctggttttgttcatgtgtttgtttgtttgtttgcttgattgcttgtttagagagctaaattacttctgtaaaactcattggcagaaagcagagggcgaataaagctgaccatcttaggttgaagaaaatcatataaacaccaggagagcatcatcaggtaatttgtattctctgatttaagctatcactctgctttatacaaagaaatttaggctgggcgcggtggctcatgcctgtaatcccagcactttgggaggctaaggctggaggatcacctgaggttgggagttcgagaccagcctgaccaacctggagaaaccctgtctctactaaaaacacacaaaaaattagatgggcatggtggtgggtgcctgtaatcccagctactcgggaggctgacgcaggagaatctcttgcacctgggaggcggaggttgcggtgagctgagatcgcaccactgcactccagcctgggcaacaagagtgaaactctgtctcaaaaaaaaaaaaaaaaaaaaaaaagtactcaacaatatgtttttctaatattaagtacatatggacaaagaattcccatcaaaatttggagataaaagcgacaaacttacaaaatgaagtgctgttgaagtacatgtactgttctggaatctttacattgaacaaccacagaaagataaatgtcagagaggagaactcatcaataactggcatctattagggattttgaaataatcataaatgccagagtttaaaaggataattttctttgactatgctactatctcataattttatacgataaatttcatgcaagtatttctgactcagtcaaatcaatcttcatctttactggacaaaaatattctgaccaataaattttgcacacaactatagtattatctatattagcactgcacaaggtataaattctgagactatattctctattgaaacactatcagccaaattcattttatagcccaatgaaaataggtgattttataacaaaaccctccgtaacatacttttaaaatgtctatccacctgggaactaaacatccattaaaatgcccaaatcctaatcttcatgatctttgcttatttggagaagcaatttattttttgtttttgctctttgcataaataatcttattttatccatgctgcaggtgttgttaaccacattttatgtatgaggaagcaagactcacagaggttaaaaactttcttaatttcacacagctattaattataaacatcaggacacaaattgagatttttctgattctagagtttatgttatttttcaaaaaaataattttcgctgggttcagtggctcacacctgtaatactagtattttgggaggccgaggcaggtggattgtctgagctcaggagttcaaaaccagcctggccatcatggtgaaaccccatctctactaaaaatacaaaaattagctgggcatggtggcgggtgcctgtaatcccagctactcaggaggctgaggcaggagaatcacttaaaccccaaaggtggaggttacagtgagccgagattgtgccactgcactctagcctgggtgacagaacgagaccccgtctcaaaaataataataataataataataatttcaacttttatttttgattcaggtggtacacgtgaaggtttgttacatgggtagattgtgtgatgctgacatctagggtgtggatattcctgtcactgaggcagtgagcatagtccccataggtagtttttcagcccatactcccctccttcccttccctgtctagcagtcctcagtgtctactgttgccatctttatgtccatgtacactcagtgtttagctcccacttgtaagtgagaacatctgatatttggttttctgttcctgtgttaattcacttaagataatggcctccagctgcatccgtaatgctgcaaagggcataatttcattgtttcttatagctacatagtatttcacgatgtatattaccacattttctttatcccaattcaccatggatgcacacctaggttgatttcatgtttttgctattgtgaatagtgctgtgatgaacagaggagtgcacgtatgtttttggtagaatgatacctttgggtatatatacccagtcatgaaattgctggttcaaatggtagttctgctttaagttctttaagaaatctccaaactgctttccacagtggctgaactaatttatattgccaccaacagtgtataagcatttccttttctctgcagcctcaacagcatctggtttttttgtttgtttgttttttgttttttttttactttttaataatagccattctgactggtgtgagatggtgtctcattgtggttttgatttgcatttctctgatgtttagtgacaatgaactttttttttcatgtttgttggcatcttgtaagtcctcttttgagaagtgtctgttcttgccctctgtccattttttaatggagtaatttggtttttgcttgtttcaaagaacccagaaataaagccacataactacaaccatctgatcctcaacaaattcaacaaaaataagcaaaggagaaaggacgcccccattcaacaaatggtgctgggataactggctagccataggcagtataatgaaactggacccctacttttcaccacacacaaaaattaactcaagatggattaaagagttaaacgtaagacttcaggctattaaaaatctagaagaaaacctaggaaatatctttcttgacatggatcttagcaaagaacttatgtctaagttgttatttatttccttctcttctcaggggcttcttgatgaaaggatgagttagtctggattctccaagaatcagatgccaacacaggattaaacatgtaagcattttgagcagggtaggaaaggtaccagagctaccagattcaagtctgatgcagagacagtgagggacgtttgggtgggagcctcctagaattcacattctaaagaaggttaataaagccatttgggagtcctcaagtcacagtcattcaatgagaggggtccatgagtctcaggaacaagtgtaccttagaactcctgctgtgctcagtcattgtctgtgaacagccctcagagagcatggccagggtacaaacatagtgatgaatatcagagctcagcagctggaaactctggccaactaccgcctccataattggaggaccattaggtgtattcacagggctgcaaaaaggaacaattcccaattgaacctcttacaagttttgtcatatttggaatattattaatctctctgagtcatattgaaagaaaagaactgttatagaaataaatgtaataaaatatgtgacagtacctactgcagtacctatgcaaagatattagctatttgttttccctctaacatccagttgattgcctgtgtacagtaggtggttaagtaaaggtattatatttaaacatgtatacataaatatacgtaagaaaaaactatacccacatgcagtatgaatataacttcgtttcaatttctctgtttagaatttaaagaatatttctactgaatttcatgttttctctttaaactgaattcatcctggtatataccaatctatataattttcttttctaccaaaagaggtatttgaccaagtgaagtactagactgacaaggttctgtctcttaaaaacaaacaaaaattacacatttctttacctgctgtgtttattcgttcatttatgttattcattcaacaaatatgtaaaactctgtgctggaatccatgctagggaaccagaaacagacactattcctacttctgcctccatttggcttacagtctagtaggaagaaatactttagccaaggttcacgcaaacaaacctgaaactgcagctgccacagtgctatgaaggacaagtgcagtctgtaatgagatcctatcataggtggattagatgcagccagggagatcagcaatcgattgctagacaagtggtgctgatgacgaatttggaaggtaataaggataggaaagaatgtccaaagcagaagaaacaaattacacaaagtccagtggtgggaagaaagatgtgggagaagtttcgtgtggagaacaaataggagaggagcaggttgagaagctgcagacatgaggaagggccaggaacatagtggttacataactgtcccaaaaggctacagctgaaaaataaacctgggtcctattcatggattctcatcacactgaatgaattaccagtgtccattttgtcacttttgcttttaatcactgttatttaaaaaaaaaaaaaaatagaagaaagtaaatagcagaaaacagggaaaatatcagtcaaccagttccaaatcattcaatagtatttaaatggcataagaaaagtgatcaaaactaccaaaacaggttaagcctcacttgctttaagcctcttgctgattcaatctatcaatccaacatcttaattattattggaccatatggaaggtagttattcaataatacgacaacataataaaaagctttaaaataaaaaaaatagtaaatctgctaatccaatctcacagagcaaaacatttaaatgtcatttgagatattattctcagttaagtatcctattcctgtgcttatggcatgacaatccgattcatgcaattattgtggagaaagagtagtaaaaagaagcaatcatccactggctcagagaccactatcatagctaagacaccctatggattaaaagagtccttaaagcataagagcacattcagagttttatgtacagtataaatgcttagctgtttttcagtgtcaggtgcctacagatttgtggtgtgtggctcattggctgacgtgttaaatccccaaaggttacatcaagcaggcccaagacttgtttaagaaaaattgagaccatgccctcagtctcttaagggagtgatattactaagcagaatacataataaatatctgccttcttccagaagaaacaggaaatattttcctattttccttactgttatttcttcagggaaagatctgatagttggtaaaatgggccatagggtagcttcactaagcatttctaagaattccgctctgaaaacttgtcggaaaagaaaagcaacaacaacaaactagttaaacagaaaactgagcatatattaggataaacaacgaaacagaaagtgctaggcaaatcactaactctcctaggaaattaaatgaaattgagataaagaacatttgaaagaaagcctttgtattaattttgtttggaaaaccaggtattgttgaagagtcaccagatacttctaaaagtcactatttcattttaaaatgcatctgcctacacaatatgcaatccttatttgacctaattctttcaataattcattagaatgacttttgtcaagaatgtaatgtggatatatccttatacacatttatatccatgcaaatcaaattttagaatatgttatagtcttcaactcacctgcagccatgattgaaatctgggccttattagaatttttttttaaattagagaaattctaaattcggccctaacaatgtttaaccttagcaggatcaagaaagagtatggttgctgccaggtgtaaagaaatgcaaagatgggcaagcaagcaggagcaagggaacagaaataggaacaagaggaaaaagacaagaaagagaagtccccaggcacagataaggaggaaaaaggtaacttataaacagttgttctgtgacatgcaaactctggagattcttattaggttctctgcataaacctttgctttcctcaagaacagttttgtttattttgttcttttaaagactagagtgagttacctgggaagccctgagtcacataattcaaaaagcagtattgctctctgcctttctctgaagacgctcaggacagagaaatggactgagctgcctgactttcttacctctgcatcacctggcacctgtctttccctcctctcactcctacttcatggttggccagcttgttttgataagaaatcctgcctgtgttccttttgtgaccccatcctggacctcagtatggtaagggtttgggcactgtgttctggcctattcttagcaattcctaaccaatagattggccaagccccaaaacgtaatgccaacctcagagtttctaaatagatggatcagggtatggcgagggtttaatagggaagacctaggaagcatctcttgaaactgttcttttgcacagcaggcacattgcttctcacctgaattatattttcttgaagtggactggggccagggattaactccagctctgatgctggctccagcgtctctttcaccaatgcctgctgccttttattactatctcatgaactgtcacctatcaatgcttgcactggagccaggaaaagtgacaagttagaagcctgataagattctctcaccatttatctgtgagatggccatttacattgctcctagggaagcaatgaggaagtctttctaagaaaataaatccagctttcctgcttcgggcctcatgaccattctcaattactgacttttgaactcagtttagaatcacccctttttattccatatcctctattcttgtcttgatttagaaaaataggaaactccaaccttaggagagtaattttagatcctatgcaaaatgcaagaaaatggattctatttttgtacccagatctaacccagagacaaggaaagtttgtttataatccagatttatagagatttataatgttcaaaacttagaaatattaagtttgaaagtctaaactgttaaagtcgctaaggcactagtgctttgtataatttacccactacagaaatgatttgtttctatggtgggtaaggaaaatgtagtttcaataaatcgttggcagttcttgccaggcactcggttttcggaagtcaggaaaggaaagcaatagcttggatacattaaaggaagaaagtatcaccactcaccacttccattgtcccttcatttttttccatgaatgggcattttggacttgatatcaaatcctatcttccacatttttctctgtatacttgttgaagttttttgtccgttaaaactcagataaatctgttaaatgttttagaatacaatagagttctaaatccggctcacggcagcctcaacccccactatttgcagcctcaactcccactattgaaacgaggcatcacacccatgaaaacatatgaaacagagcagtgcatacaatttcacaagcttcacggtaattcaaaacgtttgtaaattccatttttccccagcacgctgccagtattcacaacaaattaaattctcattcagctgatctgctaggaagcataacaaacaagagtgggcatgaaccaaagtgtcttccttttattactttttcttaccatttattttgatgttctaaatggagctgccctctgcctgtccatagccattataaccctacctgattctaggagcaactgtggtcaaggtcgtcacatcacagtctcctcccacaataaaccatctctctcataattcaggctggccctgcagtcaccacagggaacaggtccaacaccctactggaccagtagaggtggctttttcatacctgtacagtggccctagcatgtgagttttggtgggacacctactgccaaaattattttggatagagccccctttgtgaatagattcatccacctgcctgttttgcaaagaaactacagaaagataaatgtgactttgtacaaaccaataaagtgatatttatattttcttaaataatgtgagtggtaaattaactatttttgagcaataactgtcaggcactgtgattagtgtcttgtagactttgtcatttcatcatctcaacaattctgtgatagaggtagttattcttaccattttacagaaacacattcaagacagccaagtccccaaagccacagagccactagttgcaggttctaggatttgaacccacaactgtctggctccaaaggcttgtgctgttacctgtgtagccccttcctaatcatggtattaagacattgatttaaagcataatacagcaccaacatttactactatgaaccatgaacttgcctgggccattaatgaaaagactttaaaactctgcttataaaaaccaagcaaagatagtatcactaggaatcacaatattcatcttaagacttctaagccacagacctcacactcgaaataaaagtataaatcccatcataatgttaacattaactttataaggaaccaaagtctatggatcgtataaagcaaattaagaatacctagtcaatcattcaggcatctattctcaataaatcttaccacacactactgtgtatttagcatcttccagagatctttgggatgtacaagagtatatatagcacctgttctgcaagtgacctagtagaagagataagacaaatacccatgaagagttaagtaatgataagagtcaggaatgccagctgaatgacacaaataatagatagaatgagcatacaacagagatagagcaattatcttggactcttgtactgggaacactcaggaatagatagagacagaaggcagagtgaaaattatgatgcagaggtagacctgggcaacgcatgtttagaaaagcatgagtttaatgctggaattgggaattgaagttgagtgttcatgttggagatagatgcatagggataagcttagaaatgtagcctggagccaaacaataaagtcttacctgacacatactgggaaatgtagagagtatacataatcaatgctggaggaaggaaggttgaagatgttgcagcaaagaactgatataaaccagtgtttaaagaagattgttctggcagcaacgttcagaatgtactatagatgtcagagaacaaaaccaggaagacagtatggagacaactgcaggtaattgaacatgaagtgatgaagtccagggaaggaaagtgaagagaatgaactgaaagtatggttgtgataatgctctgtgtttatcaggtcccctttcatcctcatctacctggacacacattccctagttagctctggactatgagctataagaaaaaagtaggtacaagctctttaggtctctttcttttccatgtcatagggaactaaaagccacatttaagagtaaagagccacaagatggtatcagagtgtattccccaagtcactgcataaagagagctaccctggagagctgatggacaggcagctgactttgcacgagcaaaaactagacttgtgtatgttcagctattaatgtttcagggtctgttactcaaacatagcctaatctcttcctactaatacaaagataactgtgtcagaatttatagctgtgctcagggactttgatgaccctagtcttggaaataaaactaaaaatagacagcagctagaatttgccagtgacttaaaaaatggcactaacacatcacatttagagaatacctgctaggcaatgaaagcaatgacactttttttctccatttgtgtttcattagattaactgtgggttttttaatcataatattaattaagtctttgacaaaattcagaatttcttttgctcatagcaaatggcagccgtttgcataatagcagttttcctaaaatgctaaattggaagctaagtagaactacacgtaaccctgaagttacagccttacaactcttaggaagttctttcagttttctaactatataataatagaattaaagtagataagaaggaaaatgctataagacattcatctgcatgtgtcagcacagggctagccatggagaatgttgaattaagcaagcagagtttcatcctgccactcagttcacactctacgtcagctgtcagacactatcaggcagcatcctgggtgacctactggcaggtttttccaaatcattctaattgcccaattccagtacccatggatgtttctactcttggagtctctaaaaggaaggaaacaggatgaaaacaacataagaaacagtttatatgaactcagttccaacattactcaagataatgcactggtgttcacacacaaagccaaataatctgagttaaatggtcttccaacatagaaaatgcagaacaaacaagcaattatatacaatctataaagtctatgagtaattgagtgcaatttatttaggcaaaagctagcagagctgtgtcctctgtcatgatgtagctgaataccctgtgtgctggattattcttatcacagtggacaacctcacaaaaattcagcctacaaaggccttggcttcagtgatcaattgaggactcacaccatataacatgattctactagaagctaagagcacttcatctgtacccagaaacatattcaaataaataataactttagatttgtggtgcttgtcatctaatgtgctgttgtcattcttgggtgtgggcccttgggtataggctttacaatattctagtaaggtggctgcaatgacactgatcagcaactctctttttcaaaagagaagatgctcacaaagcctccagcaggattaaaagagcaatctgtgataatgcaatagaataaagctaaataactcacatggaaactaaattcataatcttggaaactaaattcatgatacactaggactgagcttttctttaactaatagagctaattctgagaacaataaccaggtaatgtacgatgacaaacttcaaactgcaaactaaattttatactatatctttattttagaccaggacctagcctgaaatagttcagaaagccttaacaaatgaccttctcgagttgtggaggagtgccaaatacacatgctgattctatgctacattaggtcactggcattttccaagaggacacctacagattctctacataggacatggacatgaaaatgccctatacatatcaaaatatttagcagcaacatgccactttggatagcattttaaatcaggttcttaggggtctttggtgggggataacgaaagggtggagacttcattacactaatcctgatcaggcaaacccaaaatgtacctcatgtggtcatggaaactatttgttttaattcaaaattaattaaatttgagttagagcagaaagggaacagtcccatagctttaattgcagacactcaatacaacacaaagactggcatcccagtgcttttggccttgaatttcggccatcaaaaccattagtcaattcagagacagagcttgaacacttgactgcctacactcaaccccatctgctatgtgcaccattgccaatacacagtccagtgtgccaatggcaccatgcattgacggttcttacagagcatgaaagatgcttacatacttccaccaaagcaacatggtatcatttctcctactggaagaatattctacttaaaagcaacactgtgaatctgtacttgcttattcctttcttattgcttcaaaaagtagaatatataacagcacaaaggagagtttggggtttgagcaaagcaagaataataaaattagaagctacagaacaaatgagtcaaatatatattgagagaagtgaaataatttatcaaggggaaaaagatgaaagcacaaaagcatggaaacataggatgtaaataattgtatttagactattttaactttggcctaattgctttcacaactgttataggagataaaattattaatctaataagcagttcttaacatattaggaatacctaggaggtttttaaaaaccccagatgtgtgggcaccatctggcccctagatcaattaaatcagaatctctggggtgggaccaggcctcaggaattttttaagagctcctggagattgcaacgtacagccatgttttagaactactgccttgaacaaaagaatgaagtatcagttgtagagacaatgttgattcactgtactgcaagaaagaaataagtattcctaaatatatgtatgagaaaagatgacttacaaagcttggaaagtttgcctaaggccaccagctcataggtggtacagcgagtgctcagatccaggaccttacgtggactgacattttcactaagatgtactgaagcctcagggcagagatcatggaaggacaggctgagtgggggaagaaagcaagtctttggactgaggagagctctgataaaaatgtcacttcacatccatctgccacagtgattcctaccatttagaaagttatgccaaggtcaccagaagtcccagatataatgcaaagcctacagtaataattaagtgttattgttattacaactacaaattatcacacacctgttgcacctaaaatgctgtcttcagtgccttacatgtatgacctctgctctgcattacatcctgcaaggtagataccaaaatgcccatattatggttgattaaagtgagtgttataaaagttaaataattttcccaaagtccttaattattaaatggcagagctaggatataaaatggctgcctgctcttttttcatttttatactatgttgcccaaaggagttaaatattttaacacaactactcctaattattttagtttagttagcagttatatcatcagctgaggtcagaagatgtgagagagatgaattgaaggcaagggtggagtatgtaagatatggtggtgtcttagttcattatgtgttgctaaaaaggagtatctgaggctgagtaatttatttttttaaaaaaagtttatttgactcatgattctgaaggcttgaaagttcaagactgggcatctgcatctggtgaaggcctcaggttgcttccacttatggcagaaggtgaaggggagcttgcataggcagaaatcacatggtgaaagaggaagcatgagagagggggaggtgccaggctctttttaacaactagctctaatggaaactaatagagtgaggaagggcattaatctattcatgagagatctgcctccatgatccaaatacttcctattaggtcccacctccaacactaaggatcaaatttcatatgaagtttaaaggggaaaaaacaccgaaaccatagcaggtggttttaaaatatgcacatcaattatttgatgcacctcccttcaagagtggagcttaattttcttccgtgtgtgtgtgagctgtatttagtcacttgctaccaatgaagagaatatggaggaattgtatgattttcaagcctaggtgataaaaggtatcactcactctgggaaaagccagctggcctatcaaaaggatatttcacaaaccccatggggagacccatgtgacaaaggactggggcctcctgccaacaaccatgtgaatgagccatcttggaagcagatcttccagtcccagtcaacacttcacataaacacagccccagtcaatgtcttgacagcaacttcctgagagatcctgacccagaaccagagctaagttgcttcagaattcctatctcacagaaactgtgagataataaatatgttatttgaagttactaagtttcagtgcaatctgttacattgcaatagataaccaatacagaggggcaagaaacagagggaggaagataacaaaaggtcaagattatgtgattcaatgatgcattagagtttgggcaatcctgaacacccaggggatacccgtgtggtagtaggcaagtcataagatatgagaaggggttggggtaaagtaagagcaaggagggtcataagttatttacaatagctcttttgcaaaggaaagaaatactgatttgagggtaaattcattttcccaggttattacatagcttgacagcactgtatgtgatgtatcaaagggcacccaagaacctgaagcaataatgcatcatccaaagtcaagtaatttacaatttactcactggcaagatgagactactgtatcagagagaatcaaaagacatccctcatcgtgtggaaagataagtcaggaaagtcaaaatcatttgcagcaaagcttgtttctgtaatagttgtggattcagaagtagtcttatttggacatatgatattcagcaggacttttaaagtccttttgctattttacatagttcaataaggttttttgtgagagtatgatgttattaatatggactgtattaatgtgaggctaagagttatatgtaatatccctttgcctatttatcttacatcaaaatggtatttatatcttaatgagcaaccatatcctcctgcagatatagatctttgagattccattattcgctcttccttatttagggtttcagttagggaatgtccagattcagaactcaagtccccactgaattccatataccatgctctaatgagtctgttagagaaacactgggaagataataggatatactacctttattcttaccagtaaatcacctccccaggtaactgttcttacaataaaactaccagctgggtggcaagtctctagaccaagataaggttgtattttagccctcttgtgcattcagtacatatcttaaaaatcataagaaagatgaaaaataaaataaactcctgctgaataaaggataatagaaagaaaaataagaaaataatttgagaaaattctttgtaacacacctctggcattgcagttaatgctataaaaggcctttgtttctttaagaaaatgaatttatcacaccagttactgataatccaatctctgcccaactggataactgcccaaccaactttcttcatttgataattatttgtaaaatatcccctttcaaaaatgtatagaaatgtctatgtcaggacttcccaaaatggttccctttgttgcaatattttccttactgccgccataacctcatagcctctaagtccttttgccaagaaccaaaggagagaagagaaagggataaaaatgggtttaaaagtaggattagagtggcaaatgagagaaaaattagtaaaataaataaataggagtgccataaattttggagaatgctctggaatcatttttcaataaccctgtgactggggtcctgagcccacttataagctcaacagacctggtctcttattgcgagaaacccatttgtgacctcaggcaggatagactaaagaagctctggctccatgatctgtgactgagcatgaaatcaacctaatggtcctgtggttttgtattcaggtatcttcactctgtctccaatcccaatgtctgccttcatcacatccctgatactgggacccttatgttgaactgcatgctttagaccctcagaaacagggtactccctcattctgcctacatgcttacctccaaggactcataaagttctgcttttcactgttatctgctcatagattttccatcgacatgttatgaattctacctccaggaccatctaattcactgttctgccaacatcctcagccaatcaatagccttaacaagtgctagttgacaggagctagatttttccagaaaggctggaattctgtctcatgtctaatcccattccatacctgcatcccgtttcctgaattccagttcttaccccatttcagactggcccatttcattgttattacgtcagaacatgtcctgagatacaccattttccttactcagtgtgaagcaacagaattaaatgcaaggcttacatttctcagaatataaatggagaaaagcttttttttcttcagtccatcaaactccaaatcaatcctgaggccaatttgtttgtctttattagaaaaatggtactgttttaaagggagagattttgattgactgattgatttaccagtctcaaactaatgttgagttgtaaatagcaatggcatttctaagaactgtgctgtatcttcaaacatgaggtgatggatgtctgtggagtttcatcacaccaggagagctgtcacaccacttgcttcattctatatgctctactggtttgctagttaacagttatacaatatatatttgctcactctccatgcaaacagataaagactaacaattaggagctcattattatttgggaaaaaatccttagcaactcagcaatatacactttaaaacaaactggtatccaaaagatgaatgatgctctcactctttctcagtagtaatgccctctttctttgagtatgtgattcagtttcaaaatatcactagcctactaactctttatgctaaaagaaaaagtctagtattagagaagaaaaacaatgaaaaaatgaagtttcatgattacttttgttaaactcttacgtaattattttcttatctgcaaagcaagagtgaatgtcagttgcaggaaaaaaaaaatgtgtccaaaactttctccaaccttaacaattcatcagggccaatgtacccgagaactagagaccaacagcccaaacagataggagtgagtaaagttattactatcatacttgtcagactgaatcttttgtctatagcttctgtcatccccaaatctttgtaacttcaactccctgaatccctatgggtttaatctgacttacttttagaaccatccctaactaagtcagctgtcatgcacagaaccagaggaaaagatcctaggaggaaggcccaggaaatgcaaattctctgaggtagtggagtgctttgcagatttgaggacaggaaggaggttactctccctggaggctggagttcaaggttacgtgagatgtgtgctaggcagaataacagccctccagagatgctcatgtctgcaggaatctttaaattcataccaaaaggactgtgcagatgtgactaatggtatagacacaaagagagaaaattaccctgggttatatagagggcccattttgatcatgggagttcttaaaagtggagacgcttcccaggctgtggtcagagaaagatgtgactatagaagagtggtcagagaggcaacagcctgaagtgtataagatggcttattgctggttctgagctgtagtggcccatgtgcaaggactagataaaggcctcaagaagctgagagtggcctggatgtcacccagcaaggaaataaagacatcagtcccacaaccacttggaactgaattctgtaaacactttaagagtaaggaaacagattctcccctggaacctccagaaaggaagccagccctcctgacacattgattctagcctagtgatgtccatgctgaacttctgacataccgaactatgagaaaataaatgtgtgttgttttaagccactaggttgtggtaatttgttatagcaacaagatacacctagatgactaagctatacaggtaccagatcatgcaggcctttcaggtcatggtagtttttcattttttttttttaagcaatggggaaaaaataacaaatattaaggaggaaaatgattttcctaaaagattactgtggaaaagatgcttcacaacctcatagagaaatgcaaattaaaacaagataccactacacacctattagaatggttaaaatccaaaacactataacaccaaatgctggcaaggatatgaaacaacaggaactctcattcattgctgctggggatacaaaatggtacagccactttggagaacagtttgacactttaacgaaattatacatactctcaccatacaatccagctactgcgatccttggtatttgccccaaaggagttgaaaacttatgtctacactaaaacctacacacggatgtgtatagcaacttcatttatacttgccaaaatctggaagcaaccaagctgtccttcacttagcaaatagataaataaactggggtatatccagacaatggaatattattcagtgctaaatgaaatgagctatccagccatgaaaagacatggaagaaacttaaatgcatattactaagtgaaagaaggcaacctgaaaaggcttcatactgtatgattccaactataacgttcttggaaatacaaaattatgaaggcagtaaaactataaatacatccagcagatgccagagcttgggtaggagagagggatgaataggtgggacacagaagattcttagagcagtaacactactcggtatgatactgtaatggtagatacatgtcattgtaaatttgtccaaacccacagagtgtacaacaccaggagttactactaatgtaaactgtgggctctgggtgatatgtcaatataggttcagcaattgtaacaagtgtaccactctggtagggatgttggcaatgggggaggctgtgcctatgtgagtgcagtgtgtatgtggtaaatctatcttccattcgattttgctgtgaacttataattaatctaaaaaataaagtctattaaaaaaagaaaaaaagatgaccgtggctcctaagtggattgtatgtgtagggtagcaggtacttgcaagaataagaaacagcaagattggagctgaattttagaggcagaactataagattttatgatgcataaggtatgaaataagtgaacgagagggagaaatcaaaaagggcttttgtgtttttggcttgagaagaagaaaagctgagagagatggggaagatcaggggaaccacagaccttttttttttttttttttgagacagagtcttgctctgtccccaaggctggagtgcagtggtgcaatattggctcactgcagcccctgcctccggggttccagcgattctcctgcctcagcctcccaagtagttgggattacaggctcacgccaccacgcccagctaatttttgtatttttagtagaaatggggtttcaccatgttggctaggctggtcttgaactcctgacctcaagtgatccacccgccttggcttcccaaagtgctgggattacaggcatgagccaccgcacccggccggaaccacagatttaagtgataatttggaaagcaaaatttccattttggacatgtaaggtttgaaacaacctttagacatctcagtggagatgcagaatagatagataaatgaataaatctggagctcagggttgaaggcttggcagttaatataaacttgagaatcatcaacctacaggtggtttcaggctcatggaacggaataatattacctaagtagagaagtatgcaagtgaacgtaggaaaagaggagaggctctgaggcattcaaagatttcagaatcaaaaaaaaaaaaatagtagcaaagaaggaggagaacatgaaaacatttcttttaagtgcatgatggctaggagggcaagaaaggagagtggttcaacagagaaagtaggcaattgtattgatactggtgagagatggggtaagattaaggcaaagcaggacagtagatttggtagcatggagatcttcaacaagaacaatttgaagggtgcaatgggagtaaaaagagattgaagtgggttgaagagtgaatggtgtatgaggaattagcattgatggataccgacaaaacatcaaaaaggttagtatagaaagaacggagatgagcagttgtggtttaaggaaggtccaagagaaggctttagattattctctttttaagaagaaagattttgaaaaatcttggtgaactattaggaatgatttagtagggagagagagaatggtgatgcagggacgatgccaccactgaaggactgaagtaaagccctttgaaggagtcaaggtgtgaaattcagagcacagagagaaggagcaggggcaggataagagccatttgtgtgccccacccacctcaattctagaagagacctctggccagtccccaggctcatctccaacctaaggtatagttcatattaaaactccaacccttcccctcccatcttttcctcatggacttgtgagtggaagtattaccatatctccaatccaaatcttaggaccagataagaataattctggtaagctatttaccccactgtaatcagtatttctatttgagcttttatttcaattgtgcatcaaagatgttaatatagagaccattatgtagaaacaaatatattttactttatttttacatattaaggtgaatcatacagcttggaagacattgaaaagatgaagggaaattgaaagaaatgcaggttaggcatttccgtagaaatcagtctaagtcaatttaagttcatgatgagggtctgatagctctcataaagcaactctcactatggaaggcctcattcaaagaaagtcaaacttttacacaaatttctaaaacagaattttgaaggatattttgattatatcattcatcatttttaatcacattctgaaaaacttcaaactttgtcttcactgtaaggataatcagtcaatttgttttatcctaaaaaaactagccatttcccttgtagatgtcataagctgcttctgtaccttttccatgatttcattttattttcttgtatgtagatttcagagaaagttctcactttctgaaacagtgaaagcaagaaagaaagagagggaaagataagttggaaacgagagaatgagagagactttttaaaactacggaatgttttacaaatgtagagtgtgattgtatgtatataaagcttagcctaagtcaccactcaaataaagaagttaccattcctgtaccattcctgtctgggctagaaatctcttaatgcctattttctgaaatttaacaaatcaaggaatcacaaggcaccataagttcagataagggaaaaaacactagactggatatctagaagccgcattttagtctgccattgccaaacatgtaaccttgtgcaaatcactttacctgtcttatttatactgatctatggttttgcctattgtataataatcactaaataaaaaaccaaaacaaaaatgttaaaattattaaaattttagacacttattctgaaaacagaaataaccataattcctttacatcttttatttaaaagctgagaacccctatataagaaaggagaaggaaagctttaagtacaatggcaactaaaatggcggcacaaacaaaacgaaattgcctccaaaacactgaacttttaattacggacgatgtcaaaatgcaatgtgttcctttagcttcattattttgaatctgtttcttgtttcccaataaactgaataaataaacagtgatttttaaaattaattatgtagtgcaatttccctcccggaaaaccaatatagcttaattttcattaactatattgtaaatcgcattactcttttggaaaacgttcaaggatgcttttatttataaaccaatagatgagaactataatgcatttatagtaagtctggacacttttacagggggcttcctatttgaaataaccaagaagtagaattcaacaatgatatttttccttctaaactttttaaagtgaaaaaatccaatatattcttgaagtcagaaatagtggcatccagggttaaacttcagcattcatgatgctaattagctagccatgactgtatgtataatgaagatattaagctttctctaagaacactgcaacttgaaattcaaataactaacgttatggaataattgtgaaatatgatcaactgatttaaacactacgaaaatgtagcacaattccctttcaagaggaagaacaagtatattctatagacaaatgccaaaatcagaattagcacatagtcaagaaagaaggtgactaagagtacactggtaaccattttgaataaatcactttaaaactagtcacagtgtgaatgagcataattatatggctctcaactctgctcatgtttttctctttcacttgcaaatcccctcaactgtcatgtttagttgtctctttgagatgttactatacatggtaacagatgaatctgctcttctgtgagttttatatttataaatgatcttagctcacgaagccatggcattaaatttacattagaaaaggtttgacccttgggtccgtgcatgcagttctctgttgcagaaaagcattacaaagctctctatagggagatctgaaaagacatcaaaaatattttgaaatgcagaaagcagccaagatgccctataccttttcattgcttgcactgattaaccgcttacataaaagaataactaaataaactaacaagtgatccccagagagaagctgtcttaacaagaatgtttaattttggccctctgagttcttctagaaggatctaaataattatgtgtaatgtctctaacaaccagagaattgccaataaaagaaattcaataaactcagtctaaagcatagattaaggtacaaactttctaggggagacaggccaagagaatattgtaaacaacagaatttcaaaaaaaaaaaaacccatttaattacagtgacttgcacttactagctacttatgagtgttgatgacaaagactaagaaaagtaagatttacaagataagattagagaattgtttactctgtccagcaaatcaatggggggaaaatatgagggaaacctaatgtactcaaattcaatgcaagatgaatcttttcagtactgaatgaaatactcaaattattctggctacatactaagtccttttgatttgtcgtggatactacctaaaagaacacagataatcaagactgagtccaaggaagtccttctgccagaggtcagcagaaaaagtttacaagttctttgcaatagcagcacaatttttctcatccttatgttttttgtatctaatgctgtaagaaaagcaataggtgtttaatatatgtatttttaaaattctctgaatcaactggtatcatctacaaatttatttttggagaataaatcataacagaaagaaaaaagttattgcatgttaccttaaatcatgtgtctaacaaaatatatacaaataaaacaaaaatattaattaggtgtttatccatgaatttattagatggtgtcacatgttctcaaaacaacttcagaagtaatttatacacgttaatttttataattaaaaaaaagaaagctgagttgcagagatggttaataacttgagcagagttttacaggtaaaggagtttgaacagaactcatgacagggaacaataccggaaaccatattctatccactttatcactctaaagtctatccagaaccctgattttctgtttctttaagttgcttgttcttatgtcttcttatataagcctttattttacaagcttccctctctcttcctttctcttaaatatgtcaaaatgttacaaaatatctgactcaagcttgtttcttcattgagaagattttaaaagttatctaaaagacaaaagaaagaacttaaagatataaaataagggcaacttaatatagtataaacaaaatatttttgtaaccggatgttaaaaaaataataaaacattttagtataggagtctatatacttactgaaaaattaattttcttattcctcatatttgtgtgaatgtatattttaattaagacatttgcaattatatttctgataatacgtatcactgattacattgtagattttttcaaagcacaacaagctcaacaaagaaaggaaagacatagaactatgcagtttgggctttatttatgcataattaaaaccaattagctgtggcaccaaatcaaaaaatcttgtttcccttgaagcaagtctttgtagatactaatactgtaatttatgtgtatatatagtaggcgtttcatttgcaagaagtttagaaaatgatcagagcattttcaatattgaaaaatgaagaaattcacaataaattatatatatttatatataattgtgccattggcgagagctatagagaaaaagtgaaacaaataaacaaaaaaaaaaaaaaaaaagaaagtgtcctacttggaaatgtagcccctgaagaagatgcatcctcaattccatctttcacttctctagagcatagaagggtctagaactaaatataatcctttcggagtgacctctggttacattgggtctcaaagtcccaaaagctatgccccaattctcacactttattgtgtgagacaggaggcatgaattgcagtctttttgttacaaaccagctgtgtcactatatcttgcaagactgcaggtacctcatccgtcaaacattgggtatcaatggatcttcaaccaatgcctttaagagtactcaaacttttatgaagtagatcaaaaatggattatcagtaaaatcaagaaagatttgttcattaagcgggaaaatgttaatattaaaaatttcttaatataaaatgttctttcacatattatcttcacctttattatctttcagcttctttctttcttttatattccaggagagagacatggtatgctattacaattaacagcacccaccctggagtcagactgcctacatgtgaatccctaccattcaccacctataattgatacagtccatttctttatgcctcagttttcctcgtttataaaatgaggataatacaagtgcttctttataaagaagccaggaggattaatggaagtaatacacataaagcactagaacagtacagacctaagcatcacataaacaatagttgggccaggcatggtggctcacgcctataatcccagcactttgggaggccaaggtgggaggataacctgaggtcagaagttcgagaccagcctgaccaacatggagaaaacctgtctctacaaaaaaaaaaaaaaaaaaaaagaacacacagaattagctgggcatggtggcacatgcctgtaatccaagctacttgggaggctaaggcaggagaattgcttgaacccaggaggtggaggttgtggtgagccgagattgcgccattgcactccagcctgggcaacaagagttaaacttcatctcaaaaaaatataaaataaaataaaataaaatagttgccataaacaatgcatacaataggaacaagtttagcacaagatctgatatttattctaaaattcaaaggtaaatactgcatggtgctccacaaagagtgccatgactttcttgtgccttacaactgaatatatccttccttctaggcctaaatagctataactctgttatttaagtaggctaatggactctataaaacagaattcatattttgtttctttcatatttctagattacataacaagtttagggggtgtggttagccagatgatggataattgggccacagctttgtttgtttttgtttatttacactaataatgatattttattaaaggctgcaaattttatggtgtatccaacaggctgtgttctgatatttaagaacctgactgacagtaacatggactacagatcatttcttaaataatgctggtaaataactgaatgaagagtggtttttataaaacctaactcctgcctaaaaggttcctttttttccctttctgggccagtgagaatcttccaggccacacccatagtacaaggacttcaccagtcacggccttcctcatctgtttctctagcctcctcttgctagcgtccatgctctcatttcatcatccatgggacttcttgtatgcctttccctcttcctgaaccttcctgtttctacctttaacctggttaacttctgaccattctgtaggagtcggctcaaggcctctcagtcttgagttttgtgttccttgttgcgctcctgcagtagcaccccatgctcacctccattagtccttaccattgaggagcaatccttgctttaagtgaattctctgctactgcatctgaagctccattctgacagaagctgtggtgtattaatcttagtatccaagaacatcacccctacttttattgagttctcagcaaaagtttattgaatgaatgaatgagattacccatcctgaatcctgataggtctcatgcttaaaatgtctgctttgtgtgaaaaaaatgagaaatattactaaatattgttataatatattattcctatgaaaataagcaaagtgtttaagcatatacagtatgctaccttttatatatataggaaaatataaagatgtgtgtgtgtatgtgtgtacatatatatattttaaaccaaaaattaataaaagtggggatatccatgggaagaaaagggacaaagtaaagcaaacaagataagttacacttctccaaatgtgctttactttgaggttttgactttggaaacatgaaaatgtttcaaataattattaaacaaaattaattcaaagtaaaacagtaattcataaaaattaaaagaaaatttaaaaagggaatataactgtgtatggattggtagtttaaccaacaacaaattattttaaaaggcaaaaaccaataacttgattgtatactcctggtgggtattttctaaggacaatgaaaaatgcaaggaaatcttaaatcatttttattcatcaaattgttaataatatgagttactcttagaatactattaaattgttgcatatatagaatcatataaaactaacacttttagtttaagagaaaagagataaacatatgaattaaaattgaaaacaaaaacctataaactcaaacttaaattagaagtataaaaatatcaacataaacatgcaaaatatttctctttcaaaacttctcttcagaaaagacctagaaacagtgactaagtgagaaatgaacatttccagtacctggactgtggatacaaaaggaaccaaggtgccttattgatatggttatgtcctggtcaggtcagaaaatataagagaagaggctaatttgtcctaccagaaagtgaaaatgtgctaatgactagtggaatcatatcaaaaggactcaggagcaaaagtgaaagaattcctattggcaaatgagataaactgaacatcataaggaacaataactgcaatggattgaaaaataccaaatatcacaaaatctatgcagtcataatgacatttaaaaacaactcaatggtcatatctacggaattttagagaaccaatcacttatcattagagagagtagcttgcattatttctgccttctctgtacaaaatgtgactcaatataaatacacacataatatagtaaggttgttctttgtagaatcagggatttcagaataaaaatcctaaaattcatatggaactacaaagtatctgtaaagctaaagcaattttgagagagaagaacaaagattgaggcatcatatttcctgacttcaaaatatactacaaagctacaatagtcaaaacagtatggtgctggcaacaaacaagcaaacaaacaaaaaacagacagaccaatggaacagaatagagcatccagaaataataccacacacatatacttaacatgagtgccaaaaaatacacaatgaggaaagatagcatcttcaacaaataatgttgaggaaactggatatccacatgcaaagaacaaaactggatccttacctcacactaacttaccacacactagacacaaaaatcaactcaaaatagattacagatttacatgtaaaatctggcaatgtaaaactcctagaagaaaatataatgggaaagtttcatgacactgagcttggcaatggggcaatgatctcttggatatgataccagaagctcatgcaacaaaagcaaaattagatgactgggactacatcaggcttaaaagcttctgcactgcaaagaaaacaataaacagaatgaaaaggtaatctatggaatgagagaaaatatttacaaatcacatatctgataagagattaatatccaaaatatatgaggaacccctacaattcaacagcagaaaactaaattatccaattaaaaatgggcaaaggacttcaatagacatttcttcaaagaacacataaacatggcaaacaggttatatcaaacagtaacttcactaactataagggaaatgcaaatcaaaattatgagttatcgccacacacctgctaggatggctattatagaaaaatacaacaacaactcaaatgtcagcaaagatatggagaacctggaacctttgtccactgttaatgagaatgtaaaatgacacagcttttgtggaaaacagtatggagtttcctcaaaaaataaaaacagaattaccacatgaccaagcaatcccacttctgggaatatattcaaaagaactgaaatcaagatggtcgtttccaagatggccaaataggaacagctccggtcggaagctcctagcaagatcgacgcagacctgcatttccaactgaggtacctagttcatctcattgggactggttggacagtgggtgcagcccacggagggtgagccaaagtagggcggggcattgcctcacccaggaagtgcaagggttcggaggatttcccttttctagacaagggaagccatgacagactgtaccgggaaaaacggtacacttccccccaaatactgtgcttttcaatggtcttagcaaccggcagaccaggcgattccctcccatgtctggctcagcaggtaccacgcccatagagccttgctcactgctagcacagcagtctgagatcaacctgccaggctgcagcctggcagggggagaagcatctgccactgctgaggcttgagtaggtaaacaaagcagccaggaagctcaaactgagcggagcccaccgcagctcaacaaggcctactgcctctatagactccacctttgtgggcagggcatagctcaacaaaaggcagcagacaacttcagacttaaaggcccctgtgtgacagctctgaagagagcaggggttctcccagcacagtgtttgagctctgagaacaaacagacggccccctcaagtggatccctgactctgtgtagcctgactgggaggcacctcccagtaggggccgacagacaactcatgcaagtggctgcccctctgggacaaagcttccagaggaaggatcaggcagtaatattttctgttctgcaatacttgctgttctgcagcctccactggtgaaacccaggcaaaaggggctggagtggacctccagcaaactccaacagacctgcagctgaggggcctgactgttacaaggaaaactaacaaacagaaaggaatagcatcaacatcaacaaaaaggacatccccaataaaaccccatctgcaggtcaccaatgtcaaagaccaaaggtagataaaaccacaaagatggggagaaaccagaacagaaaagcagaaaatttcaaaaaaacagagtgcctcttctcccccagaggatcacagctcctcgccagcaatggaagaaagctggacggagaatgactttgacaagttgacagaagtaggcttcagaaagtcggtaataacaaacttctctgagctaaaagagcatgttctaacccatgggaaggattagaaaaaaaaccttgaaaaaaggttagatgaatggctaactagaataaacagtgtagagaagaccttcaatggcctgatggagctgaaaaccatggcatgagaacttcatgacacaggcacaagcttcagtagccaattcgatcaagtggaagaagggatatcagtgattgaagatcaaattaatgaaataaagcaagaagacaagattagagaaaaaagagtaaaaagaaatgaacaaagtctccaagaaatatgggactatgtgaaaagaccaaatctacatctgattggtgtacctgaaagtgacacggagaatggaaccaaattagaaaacactcttcaggatattatgcaggagaacttccccagtctagcaaagcaggccaacattcacattcaggaaatacagagaacaccacaaagatactcctcgagaagagcaactgcaagacacatacttgtcagattcaccaaggttgaaataaaagaaaaaatgttaagggcagccagagagaaaggtcgggttacccacaaaaggaagcccatcaaactaacagcggatctctcagcagaaactctacaagccagaagagagtgggggccaatattcaacatttaaagaaaagaattttcaacacagaatttcatatcaagacaaactaccattcataagtgaaggggaaataaaatcgtttacagataagcaaatgctgagagattttgtcaccaccaggtctgccttacaagagctcctgaaggaagcactaaacatggaaaggaacaactggtaccagccactgcaaaaacatgccaaattctaaagaccatagatgctatgaagaaaccacatcaattaacaggtaaaataaccagctaacatcataatgacaggatcaaattcacacataacaaaattaaccttaaatgtaaatgggttaaatgccctaattaaaagacacagactggcaaattggataaagagtcaagacccatcagtgtgctgtattcaggagacccacctcatgtgcagagacacacataggctcaaaataaagggatggaggaagatctaccaagcaaatggaaagccaaaaaaaagcaggggttgcaatcctagtctctgataaaacagactttaaaccaacaaagatcaaaagagacaaagaaggccattacataatggtaaagggatcaattcaacaagaagagctaactatgctaaatatgtatgcacccaatacaggagcacccagattcataaagcaagtctgtagagacctacaaagagacttagactcccacacaataataatgagagactttaacacaccactgtcaatattagacagatcaatgagacagaaggctaacaaggatattcatggtttgaactcagctctgtacccccaagcggacctattagacatctacagaactctccaccccaaatcaacacaatatacattcttctcagcaccacattgcacttattataaaactgaccacatgattggaagtaaaacactcctcagcaaatgtaaaagaacagaaatcacaacaaactgtctctcagaccacagtgcaatcaaattagaactcagggttaagaaactcactcaaaaccacacagctacatggaaactgagcaacctgctcctgaatgactactgggtaaataacgaaatgaaggcagaaataaagatgttctttaaaaccagtgagaacaaagacacaatgtaccagaattttgggacatatttaaagcagtatgtagatggaaatttatagcactaaatgcccacaagagaaagcaagaaagatacaaaatcgacaccctaacatcacaattaaaagaaccagagaagcaagagcaaacaaattcaaaagctagcagaaggctaaaaataactaagatcagagcagaactgaaggagatagagacacaaaaaaacacttcaaaaaatcaatgaatccaggagctggttttttgaaaagatcaacaaaattgatagaccactagcaagacaaataaagaagaaaagagagaagaatcaaatagatgcaatacaaaacgataaaatggatatcaccaccgatcccacagaaatacaaactaccagagaatactataacacctctatgcaaataaactagaaaatctagaagaaatggataaattgctggacacatacaccctcccaagactaaactaggaagaagttaaatctctgaatagaccaataagaggttctgaaattgtggcaataattaatagcataccaacgaaaaaagtccaggaccagacagattcacagatgaattctacccgaagtacaaagaggagctgataccattccttctgaaactattccaatcaatagaaaaagagggaatcctccctaacccattttatgaggccagcatcatactgataccaaagcctggcagacacacaacaaaaaaagagaattttagaccaatatccctgaagaacaccgatgcaaaaatcctcaataaaatactggcaaaccgaatccagcagcacatcaaaaagcttatccaccatgatcaagtcagcttcatccctgagattcaaggctggttcaacatacacaaatcagtaaacataatccatcacataaacagaaccaacgacaaaaaacatacaattatctgaatagatgcagaaaaggccttcgacaaaattcaatagcccttcctgctaaaaactctcaataaactaggtattgatggaatgtatctcagaataataggagctatttatgacaaacccacagccaatatcataccgaatggacaaaaactggaagcattccctttgaaaaccggcataagaaaaggatgccctctctcaccactcctattcaacatagtgttggaagttctggccaggacaattaggcaagagaacgaaataaagggtattcagttaggaaaagaggaagtcaaattgtccctgtttgcagatgacatgattatatatttagaaaacccccttgtctcagcccaaaatatccttaagctgataagcaacttcagcaaagtctcaggatacaaaatcaatgtgcaaaaatcacaagcattcccatacaccaataacagaccaacagagagccaaatcatgagtgaactctcattcacaattgctacaaagagaataaaatacctaggaatccaacttacaagggatgtgaaggacctcttcaaggagaactacaaaccactgctcaattaaataaaacaggacacaaacaaatggaagaacattccatgctcatggataggaagaatttacatcatgaaaatggccgtactgcccaaggtaatttatagattcaaagtcgtcctcaccaagctaccaatgactttcttcacagaattggaaaaaactactgtaaagttcatatagaaccaaaaaggagcctgcatagccaagataatcctaagcaaaaagaacaaggtatcacactacctgacttcaaactatactacaaggcaacagtaaccaaaacagcatggtactggtaccaaaacagatatatagaccaatggaacagaacagaggcctgagaaataacacatccacagccatctgatctttgacaaacctaacaaaaacaagaaatggggaaaggattccctatttaattaatggtgctgggaaaactggctagccatatgtagaaagctgaaactggatcccttccttacatcttatacaaaaattaattcaagatggattaaagacttaaatgtaagacctaaaaccccaaaaaccctagaagaaaacccaggcaataccattcaggacataggcatgggcaaagacttcatgactaaaacaccaaaaacaatggcaacaaaagccaaaatagacaaatgggatcaagttaaactaatgaccttctgcacagcaaaagaaaccatcatcagagcgaacagacaagctacagaatgggagaaaaattttacaatctacccatctgacaaagggcttatatccagaatctacaaagagctcaaacaaatttacaagaaaaaaacaaacaaccccatcaaaaagtgggcaaaggatatgaacagacacttctcaaaagaagacatttatgcagcagccaacacacacttgaaaagatgctcatcatcactggtcatcagataaatgcaaatcaaaaccacaatgagataccatctcatgccaattagaatggtgatcattaaaaagtcaggaaacaacagatgctggagaggatgtggagaaataggaacgcttttacaccgttgatgggagtgtaagttatttcaaccattatggacgacagtgtggcaattcctcaaggatctagaagtagaaatgccatttgacccagccatcccattactgggtatatacccaaaggattataaatcatgctactataaagacacatgcacacgtgtgtttattgtgacactattctcaatagcaaagacttggaaccaacccaaatgtccatcaataatagattggattaagaaaacgtggcacatatacaccatggaatactatgacgccataagaaagatgagtgcatgtcctttgcagggacatcgatgatgctggaaaccatcattctcagcaaactatcacaaggacagaaaaccaaacaccacatgttctcactcataggtgggaattgaacaataagaacacatggacacagggcagggaacatcacactctggggcctattgggggttggaggactggggaagggatagcattaggcgaaataccgaatgtaaatgacgagttgatgggtgcagcaagccaacatgccacatgtatgccaatgtaacaaacctacatgttgtacacatgtgccctagaacttaaagcataatttttaaaaaattgaaatcaagatcttgaagagatatctgccctcccatgttaattgcagcaatattcgtaatagtcaagatataacaagcacctaattgcccattgatcatgactagataaagaaaaacatggtatatacacataatggtggagtagtgtttggcctaaaaacagaaggaaattttgctacatgcattacgctaagtgaaataagccagtcatggaaggacaaatacataatttcacttacatgaggtatctaaaatagtcaaattcacagagagtaaatggtggttgccaggcattgggtgaggaggaaagagaaaattgctttttaatagctataaagattcatttataaaagataaataaatcctacagatctgtgtacaacattgtgcctatagttaataatactgttttgtgcacttaaaattttgttaagaagtagatctcatgttaagggttcttaccataataaaaatattttaataaaaactttagaattccagctaataaatgaaaaaggaataacagaatattactattttacaatctctgttgaacaaatagatctatgtaataatcatcagtgactactaaagcattagatgaatagttgacagggaacttgataatgggtgaatcaggccaaccacacttaaatctaaggatcaatcttaacaccataacgaagagatattagatattatgggcttcctgatagaatgcagtagaaggaactcagcatcttgaatgaagtattcttgccaaaacatcaaacctggatctgatcaaaactctatgcctagaaatagcttacaggaagcaaaggatcagaggaaaattttaagccatatcatggagatgcattcaacaacatccaaaagtgggaaattctacaggacaaataacccagtttctttaacaaatagaatacaagtggaaaatagaagagaaagtctatcttcaaaagtatcttcaaaggtccacttcagagtgtcttttggtagtctgcaccagtctttcaagtttaaaggaattgtagacttatattaatctacaattaatttttcgatacaatatgaggaactacttttgatcctgtttcaaaaattgacagtgtgtgtgtgtgtttgtgtttgtgtgtgcatattgaatttggtgttgactggtatttgattcgaagtcatcaaatttttgctaactttttaaagtagaatgatagcattatagcatttttttttagtgcgtctcttttagagttacactgagatgaattatatgatgtttgagatttgcttcaagatgatccatgagggtggggtataactgggagtataagtaaataaactctggctttatgctagtaactgctgacactgagcctgagcgacacatacagggaagtccattaattattctcttgacttttgtgtatgtttggaaatttacataacataatgctaaacaataaaaaacattaaaatatagaattagatacaaaaaaatcctactgaggttttgatcaggctgcattgaatttatacactgattaatttaagctattgattctttcaattcaaaaatgtatctctgttcattctgtccctcaataacatttctcttgtcattagcattgccactttcatttctattttctaggtataaactgtgcacatttcttaagcttactcagaggtaagttataatttgtgagatttttttcaatttcactaatttgtaagtctttttgtgttttagtaacaataagcagtttgaaaacaaatatgaagcaattgcttttgtatacttactttgtaattttcctagttgttatactctttttctggtactaataacttttcacttgagcctcttagatatttcaggtagacaatccataatctacaaataaatacttctttttctcctctctttgaaaaatatgtgctgacaactgtattgaaagggttgatatcctttcagttgcttcctgaaatccttattttgagaggatttccatcttaaagcaaagaaaaacttgtattatgttcctgccagacttctagctctcaatatcccatgttaggaactttcagatttatatacctgatgagtttgcgcaatgatttaagttttctattcactctaccatcaattatagttcagagaacatcatcaatatcaagtagttgggaatatctaccccaacagatatcaaaacatatgtgccactaccactggaagattagataagtgaaggcttccttgattcttattttcaagctgatgaaataaggtaattaaattaaaagaaacccagactgtcccttgtcataaagcaaatatggtgaaggctatcataggaactgaccaaaaaaattaaagccaatctcaaaacatccatatgaattttcttaacatgagggatgtattttgtagagaagttacattatgatttcagaagacattatcttggcttcactacacatagcacatctgggaattgtctacttgaaagtcttggctagaagttctatttgatggcctcaaattaattctgatattgaaaagtctaaaggaagttagtacatgccacatgccaggctacttggcataactgagtaagacacctaattttccagtgggaaaagaccaaaagagttggaccaggacttcacattgatcttgttatgagatgaaaactttgccctttagtatactgcttctcacagtgacatcaagtctttcacttctacctcaagcctctgggatgacaatgtgactccatgccagtttcttgtagcatacaggctgccagacacaattatttctgacaacaggctcacatttctttcagtcaagttagggtatttgtggacaaggatctcatcaaagctgtcaccattgcatttcacctgctttaccgaatgtttagaatgaaaggctggtgcagactaccaaagacactatgaagtggtttttcatcgtccaatatgttatggatgttctctaagaagtcctggtcatgctgaatactacttaggttaagtttcctaacttgtgtcaaccatctctatcgagcataaactgagaacttataaaatgaataagagtattctagctgctgctatggctagattaatcattgtttttttttaaaaaaattcatttttattatagtagttttgctttgctggcacttaattcaggtttttcccctgtaagttgagtctggatagtgccatttttatggagtcacaaagcaccctgtgcttttttcatgctagcactccctacacacattgtaacaagtgtttatgatatgccagattagattgtaaacgccacaagtgtggaaatgtatcttttctcttaattcttcagcacctagaatgggaagtagcacatggtagacatatgaggaccagattacaaacagtcatttaaatgaggcttcttcaagctggattttaaagccagccttcttgacacggtattgttggcaagtttttatttatttatttaggctacaggtatttccagtaaggtcctcattgaaagcccacttaagctaggagccacttgcgataatactagaggtaagaaacaggaagagtaaacagctccaaataaggaattgtccccaaattgcccctgtacatgttgacaaacaccccaaatcaggagtaaatacaagatcactaccagccgggcgcggtggctcattcctgtattccctgcaatttaggaggccaaggcagatggatcacctgaggctgggagttcgagaccagccaacacagagaaaccccatctctactaaaaatacaaaaattagcagggcatggtggcacatgcctgtaatcccatctactcaggaggttgatgcaggagaattgcttgaacccagaggtggaggttgtggtgagccaagattgcaccattacactccagcctgggcaacaagaccaaaactccatctcaaaataaataaataaataaataaataaataaatcactaccttcggacacaaatgaaatttccttcagaacaggaaatttcctccaaccaattactcagattggaagcaaataagagagcaataaaaatccatctgcaacacttgttagtcaaatagagaccaaatggtgaaaaatacaccagtactctggttaattggcccaaattttgagtgagtttcatgcttagtacatactttccgcttgcacttatcacatcttgggtaacagatttgtgaatcaactacaggtattcccagagaaccataattatgataatgatatagccattaggagtagctacttctgcatcatcttaatgttttcttttcaacacacatatattgagtatccattatctgttaaaagtagaattcagagatgaatgaaacaccacaatccctgaatttaaagaatattctatggggaaaagggcaaataaacaatttaatactatgcatttatatggcatatataaatggtttataaaagtgcttatgaggaagtcaccaaaatccctagaaaatgtttatgaagattataatgttttagatacatcttatagaagatttcaccagataaaaactaaaggaagactattccaataagagagagtagcataaacagtgatttaaagtcagctagaaaatggcttgttcggggaataataaataataaatacttacagtgtggctgtattgcaggtatgcatagcatcttggttagtaagtgcaagtaatgacaaaagggtagatttaagccagatggtaaataatctttgtatcaagttgaattctttgtccttcatggcctcgcttaaagcatctgccaagtcttatacaatatgactctaccaactttatcactacccttaaccatcacttctgctggaaacttagggtgatcaccttttcctagaatagccaactcataagccagatagcaacctataagatggcatggaaaaaaaatcagaattttattctctagaattttaaacagaaaactatcaaaagaatgaactgattttcagtacaactaagacagtcacaaggtagcatgtaggcattgaagataacatgtaaagccaactccatggcgagcaaaaaccatgaataagctagagctgtgaggcagaacagaggtgaacacaagacaggtgacgtggagaaaagcaaagtggcagagcactgaaatgaagctatggatgcctctccagtttggtttccgctcttcttgaaaaccaattgtttgcctttaacaaaaatataaacaaaatgacaaccttgtgcgtcatgacaatgagtcgctatttaaccagaggtcacagtgagctattcatgggatttaaagaagacagcaacgtaagcaattttagatagtatattgggaaagtagtaagaccattctgaagttgccctttgagccattccactgaggcctaaccaaatttcaaacaagaaggaagcaataattcttttgtttaccttgttacttgaaggggaataactttctacttaaaatattatgctagccatgtggaagatagattatgtgtgctagaatattagtaatttctttccttttcagagccaattatgcacgtttcagttacttaagggaaagtctgtataattcaacattaataaagaccgttctatacatttccaacagtaggaggaacttaaaagaattgttttgcccatggcaaagaatgccatgcattaaattcaagttaataaaaaatttgtatagttcccaatattagtaaggattacttttggatggcgagatcatggttcatgttttataataaatatatatcactattataatgcaaagaaaacaaacttagagaataattgaagacttgtttgtttcctttctatttaacaaaacagattttaagtcctagtggtctagttaaatctatatgaggttaggaaaaaagttatataaagtgtcaactactgtttttcacattgtacaaaaacattgatttgacttcaaagaagacagaatgattataagaaatagactaatctcaaaggatctaggctctactcaaagtcttgtatctgtgtcgtatattaattgaaccagttacttcatctctctggtctacatttttaaatctgtaaaatgtgaattggacaaaataatctcaaaatcccaattacgtgagtctcttaagcctttatgtcactactacttggtattactacaatattttccaagtttaacttgcaaagcttgtaagccacttgaaattatgtaaaacctctcaagtcgtttagaactacccacagaaaatatataaagcctaagaatcaggactaatggcctgaacatataatgacatgtttaactgttttggtttctctaggcagaagcctagagtatttcaaaaggaaaacacaatgattgaaaattgaatacactaaatcaaaaatattttcatgactttaactaaatagaaaaagtctggcctcaaatatagccaatgaagagaagaaattttacattactattaccagattttgcatacaggcccatactgcatcatcagaagattacagatttggattatacataagtggttgcctatttgaagtttaaatttacttgtaaacctctacttcctagagttgtaaacacacactcaccctcacacaccacaccaccaccagaaccatacacatatgtatcaaattcaggttttctagttttttactataaaataacaaatacaaatttgaaaatagcaaagtattccaaagcataaatgataataattaaaaacaaaatcttgatacaaaaaagtaggaaaatgaatacagataccaatagggtatagtttgtttcttttaaaagtttacataaaattctattctatttcattaaaaattaaaagttcttttttttagaagaaacattgggctcaggaaaattaaacacctgtaagatattgaaaacatttaagtttgcaaagttataataaatacaaagtataagatgccaaagcaaatttagtgtgcatgaacacaacaccaggaagagtcatcctatttccaccaaatacattccctcaatatctatagtaagatataacccccaagaacggtagtaaaaaatattttttcctagcatttttggaggctgctgggcttgctgatattagcaggttggtctaggctaaaaggaggatgtgggagaaacctcatcaaagtgatgattcaaaattcataaataaatgaacacacgggggaacattttaatcactcccacagtagagtaaatgaaataatggcagacacccttaacgaactatacagccaaggaagccacaagtaaatacaatatatccaagcttcttccaatttaaaagttgtattaagaaatgcgtacataggccgggcgcggtggctcatgcctgtaatcccagcactttgggaggccgaggcgggcggatcacgaggtcaggagatcgagaccatcttggttaacacggtgaaaccccgtctctactaaaaatacaaaaaattagccgggcgctgtggcaggcgcctgtagtcccagctactcgggaggctgaggcaggagaatggcgtgaacccgggaggcggagcttgcagtgagccgagatcgcgccactgcagtccggcctgggcgaaagagcgagactccgtctcaaaaaaaaaaaaaaaaaaaaaaaaaaagaaaaagaaaaaagaaatgagtacatagtaagagaccttaaaatgacactagtgcaaaatacattggaggatatggataacaaaggaggacagcatctcacttttacaaagatcttcagctcccattttcaaccttgggctacagtcttaattcatacggcatccttccagtatcatctgccatgcctgaaatctgtcatgagaaatccatatctgaaacacggcagattgatcgcatgcttttattgtctctttcacgtcaaaactcaagcaatgacaaatgaatacaaatgaggatagagaaaagaggaatgaatgaacaatttctacaaatttttggagaacagaatacatggtagagtcaaggcagctacagtctaagtgcttactgaagggggaccttatgtcgcgccataaaagtcatgagaagcaccagaagtaggggtcacaaaaaagatggggactgatcttcatagagcgagatcaactgccagatttcggtctttaccccaagcaatcaaaagactaccccatccctctaacagaaaagagtttattttctggcaaattcaaacctgaaaagctacactgaagtatactaggcatagcagtgagacttgggactgacaacctaagactaaaatgagaatgtacatgttgaacttggggcacccagcaccctttccctgccttgcccccagaacactggtagcaggtgtacatcttccatgtaggagcggttggcagtcttctctgggtgtgtggggagtggagtctaaatacatgtacctgaagcaagctctctgtctaatcttgctaacacaaaatccaccaccaaaaccttgcccactggcagggtgccttcttttttttttttttttttgagacagagtctcactctgtcccccaggctggagtgcagtggcacgatctcggctcactgcaaactctgcctcccaggttgacgccattctcctgcctcagcctccccagtagctgggactacaggcacctgctaccacggccggagaattttttgtatttttagtagagacagggtttcaccatgttacccaggatggtctcgatctcctgacctcatgatctgccctccggcagggtactttctatcagtttttagtgattcactcattaatatgaatgaacacagaagaatcttaaccgtagagaaacgcctccaacatgaaatgggccaacacgaactggctaaattacctcagaagaagtagtggcaccgcagcaagcagtataccaccaaaaaaaaaaaaaaaactgcaaataatatcctcacagtgagaaaaaatggcacatccatgagagtaacagtatgctatgaagaaggggcaaaaagataacttaaaaagagctcatggagctaaccaatatgatcacctaaattaggatgggagttgggggatcagcaaactgtttctgtaaaaggccacgtagtaaatattctaagttgcaggatttgccatctctcaactctgccattgtagcttgaagacaaccatagacaatgcataaaagaatgcacatgaatgtttctttatttacaaaaacttaattttatttatattgcttgacccagtggtatcattgctggatttgattgtgccataatcttctgacatctggccaaaatttgtaataaataaataaaagattggatcataaagcatagacattactctgtaggatggaaagagataaagagatggaaaataggaaagaaaaaccaaaggatcaatccaggaaatccaaaatttgtccaatagaagtttcagagaaagagaacaaagaaaaatgtggagagatcattttttgaaacatacaatacatttgtatagaactgaaggacacgtctccatatttaaaaagctcactgactgcccaaaaactaacgaaaaaaaaaaaaaagcacgaaccaaagtatatctgtaaacaatttccgaataccaggagggaagaaagtatcatacagaggaaaaaaatagatcatacacaaagaaataagaatcagaatattgtctgattctctacagtgacagtggtatgggaagacagtaattcaatgtctcaaagattctgagggaaaattatttaccacccagaattatattacagcaatctatcaatcagtaatactggactaaaaaacttagacatgaaatttttatttcacatgcaccctttcctaaaaatctattagtggaaggtgcttcaacaaaatgagtggtaaactaagaaaataaatacatggaatccaggaaatagggatcctgttctggaaaatggtgaagtactaggtacatagctagaattggatattggagccaagaaatggagtgctgcaggcaaataggattatctgaaatgcctgagtgtttggaaagcttcggcatttgacatatatatatatataatatatatatatacacacacacacatatatacatatatacattttttttttttttttagatggagcctcgctctgtagccaggctggagtgccgtggtgcaatcttagctcactgcaacctctgcctcccgagttcaagcgattctcctgcctcagcatcctgagtagctgggactacaggcgcctgccaccacgcccagataattgttgtatttttagtagagatgggatttcaccatgttggccaggatggtctcaatctcttgacctggtgatctgctcaccttggcctcccaaagtgggctgggattacaggtttgaactactgtgcccagtccttgacatatatttttaaatgttgggacaaacaacaagccctagatacagacaaaaaagcaaatgtaaaagaggtagagagagaaagaaaataggaacaatccttaaactgcaagaaaagcaaaacgctgaatgagaatggcaacacagtctagtacaccacttaattcatcagtgtctttgtttacacagtgattgtgagtcatatcgcctatttatttaatactgtaataataacatattaacatgggaagcagggagagtaaatgatactgaatcctcagttaaaatagcaagaaattaaaatatcaacaaaattcaaaaatattataagaattaaacagtagctaaaataaaatgattgcacctaaaaagagtaattggtaagaaattgagagggaagagcaaggatgaatgtttttaatacaggccttttctcctatttgctttttaagctacagtatgtgcataaaatgcagttctctgtgcttccttaatactttccatttctcagactcacctattaaatttcaagaatcctgagaaagctaatactataagccattatcagctaataccataggattcatttgttgataagtggaaaaatgtccaaaaagaactgggtcaccacaggcacctggagacaaagtggaaatgaaagaaaatcagtaaggaagaggtaaggaggtgctggggggaaattgaattgcaggacactcagttgatgtccagagagttggagaattggttggtatggaaaaactccacaccctggtgtcagaagtgtggagtatataaaaaaacaattttcttttcctttttaatggtggccaatgaaaacccaaaaggagattacatctaaggtgacaggattatgtgagttgctccctacttgctctccaacgtcaacaactcagaaagggatttttctggccacagtatcaaatggtcattgccctcatccttgttagtcttcttcacagcacttattactagttgacattgcagtgtgtagctatttttattttttaccatctcatcaacaagaatgcaagaagtcctccagtggaaggcactttgtcttattcactactgtatccccagcacgaagaacagtgtaagagtttaataaatactcattgaataaacaagttaattttatttttattaaggatctgtggcatttgctacccgggactaagtaaatttttgctcgagttacaatattggcacatgggggctctgctgttagttgcaagagtatcctaagcattccccaacattcttaagggaactgttcaactgggaatggccacagctacagctaccaagtactaacagtataaggaaggatcctctggtttgacatataggctgatatattttagagtaatataaggacccacagactcctgttctctgctacttcattgcaaactatgcagggattctcatttgtcagaagtttaatatctttcagatctgggccctaaaataaaaacgtttttaaatcagacattgtttcagaaacaaaaataaaaccaacctatggcatagctgtttctttatcaaaatcaagattgtctattatctttctcctcctggtgactggggaatttaattcctaatgctgatataattgccaggaagtcgaattttaaaacacaccagtgtatccagttgaaactattatatacagtgctttaaaaatacaatatgaaattttcttcaaaaactcttgtcacatcagaatacatgtgaagtggatatagcaaaatgttatgataccatttaaagaacactgactgactttacattcaaagcacagtcatagatgcaaagtaaaacatcaaatattaaggtataaatttggttaagaggtttttatagtccctctaaaagtcttttctccactgtgagaaaatacaggaaatttaggaatatatataaaactagacgttttacaatgtgactctggtgccacatgtttcttgatggaatttgttctgaaagaaaagctagaaaactgatttctctcagcttaagtgactacaaatgaattttgattgctatcctattaataagaattttttgtgcctcagttagatgaacacttcaatggcaatacaaaaattagcagatttatttagcaagtaccaacaacaaataattgctgttgctaagggtaaaaaggcaattgtgatgggatgtgaagaacagaaatcctggtgatatgaatgttaaccaataaagttctcaaacttgccatttagcgcattcctgaattctctgatggcataaataccacaaagtagaagtacaactttactctaagctctaagtcctgtattactcaaaagttcttcaaatcttaaactgctaccaagaatgaatagatgccccaaatatccactttggggctggatattctgctcaaattaatgaatagactcttgttaaacatatatgccatgaaaactgactatgtgcaagttaaagcctacaatgggaaaaccaccaaatgcagaacatggaaaaagctaaagtccaaatgacgtggcatccaacacatcaatggcattacaaaatgaaagagacttcaaatacatcaaaaacaaatgcaatgtgtgggctttttctaagatcttgatacgaacaaacctacttgaagaacttgttaattttattaggtataataatgctagatggttaaattaaaaggctgttaggaatgcatcctgaaatgtgcatgtgtgtagatagataaatagagagagagagagaggttataaagacatatgttggctgggtgcggtggctcatgcctgtaatcccagcactttgggaggctgaggcgggcagatcacaaggtcaggagattgagaccatcctggctaacacggtgaaaccctgtctctactaaaaatacaaaaaattagccgggcgtggtggcaggcacctgtagtcccagctacctgggaggctgaggcccaagaatcacttcaacccgggaggcagaggttgctgtgagccgggatcgtgccactgaactccagcctgggtgacagagcgagactctgtcttaaaaaaaaaaaaaaaaaaaaagacatatgttgaagatttgcttttaaaatactccagaaagaaaaaaatattgcacttatgtgggaagaggtgtgagtatcgacgaaataaaattagcaaaatagtaataatttttggagttgatatttattatactagcctctcaacttttgcgtatgctttacctttcctactgaaaggaagaaaaaaaagtatttccttgaagtcatatagtcttttcagccttcataagtctgccactgaagtttatagtgttggctagatttctgtattcccatatttaccttaggactacctttgcaggaagtgacagtgaggaatgcaataaaacctgagaatatggattgacgctgctgcataaatgtatcttcaggtgaatgggagggagacatgttggataaccttgcaatgtctcattcattaaatttgtcttttcccagaaagacactgagagaccattttaatggtcagacctggaatattctttattcatttatctaagtcagagatattcactcataaccatatgtgaccagacagggtttttaatggagcccttaaagcaagcagatggaaatcaaggatatttcagggaagtgttaatgctctgatgaagatctggatataattacaaatgtagacatgcatatgagtattctaactagaaatgaagaaaattattttcacagctgtaggaaactctatattggcattctgacaaccctgatatattgttgggtcacaaacattaaactctttacaaaagctaaatcaaatgcgtctattggtgaaagtactttataagcgaatacacagaatatcaatggtgtattctgtataataaatggttgtggtattaaaattagtagaaaagaaatactgaggaatgtttcctataatattagtaaattctggcatgtccttggtcatgttcatgacccttgataacccttaatatatgctcatggccacagaacctatacagaatcaagggaaaattaattttgtcatagatactctgattgcagaaatatctgtaacactttataaatattgtacaatgtacttactcataaatcatgaaaatggttcctaagtaaaaatccttaaaagtttataagtcaggttttataagtcccattttgcagatgagcaaactgagacccaaagaagtttgcacagaatcagttccaaattccaaatgtcaactgacatatgcaataaacagtacatgtgttgagtccaaatgtttccttacctagtctttatgcaatctcgcatttagattttcatcaaatcttttggctctactgccctccaaggccatatgcaaagatgttgcctctgtctagttcatttgaatggaaatccatttgctattgtttgggggctaattttgcaaatcatttcataactttctgttcaaaaactacctttaaaatatttaaaaatatatcatggtgctttgaggcttaagattaagaaatattttcaagaactaaagtctcataaaaatgaaggaaagcaagagccaaatccagatttaatccaaatgtgttaaactcttggtcttgctcacaaaatgtgacccacgaaaacagttatggcttcaccatccctagggttgcttagccaataaaaatgaaccatctttactttccctctttatttcatacctccacttctatttccttagaaaagttctgttgattttattgtaaatatatcccgaatctaaccaatgctcaccacttccactgctaacaccctggcccaaacaccatcatctatctcctggattgatatggtggcctcgttactgtgtcccctgctaagagtgatcatctcagtcagtctgtgcttctataaacaaaaatactatatcctgggtggtttaaacagtaagcatttatttctcacagttctaatggctgggaagtccaaaatgaaggtaacagaagacctgatgtcaaagacagcctgatttctggcttcttaatagctgccttctcttgtagcagagagagagaagaagcaagctctctcatttctgtctctttttatccttataatcccactgatctgtcatgagggctccaataccatgacctaattacctcacaaatgctctatctccaaataccatcacattgggaattggggtttcaatatatggcttttggggacggtaaatgagaacatccgatccacagcagtgatccttttaataggttatttgatcacatactaactctgcacaaaaatctccagttagctccccgttttctccataataaagccagtattcttagaatgtcatccaaagccctccatgacctccatctccaattattctatcacttggtctctccattctagactcattggcctccttgttgttcatggaacacatgatctgcttccacattaggcctttgcactggccactccccatatatacatttaagtctcacaagctcatatccttcaaggtttgctcaggccagtttcttaatggccctaaccatcctatttaaaactcagcccacctcataccttgcactcccaatcttccttatatttttcttttttttcatagtacatatgacctactaatatactgtatatgtttatttttaattgtctgtcttatccctttagaatgtaatcttcacaagggtacaggcctttattttgcacacagatgtattcccagtgtctggaacagtgtttagcacacaatggttattcaaattaaatatttgtaaaataaataaaatatctgaagtcaacaactgttaagatatcagtccattctctttcagttatgaatttctaagtttatatctggcaactcagtttcatattggactaaaatttggcagtattgccaaactgagatttgatttatttacccaatttaaacaaaatatgtttagctatttgaagtcctataagcacaataaaataaaaagtctttagatacatgacactatttttataattgtataaatcattaaggccctggatgcattggggatatttaactcgtcaggtagtttacggtttgttctgtatgcgatattaagtgcaaaagaagttgctagtttctaaatacataatgcaatataattttgcttctgctgaaaggcaaatcagaaataatcagctcgctatagtcgacaagtaaaaggagaaaaaacttttaaaaagtatacaggcaaattactaaaatcttttagaacacagtcttttctttttctcttgagggactactctatgtctttgcagtaacttctgcagcctcaagtattcagtgtggcttagaatcacattattttgttttggatttctcaactagcctcatggataatcttccctcttcaaacaatttattatcctgaaccagatcagacctggttgtgatgccgacttaaggggtcgtgccaaagtaggggccatacacagttcctggaggctgactcagtccaagagtggctactgattactgttgagaaagagattgatggtcagtatttttttccttaatattatttcattatgaacatttttccttgtcaatcaatacattgctaccaaagcaatttttgttgtagcacatcattcctgtcatatagttttgttttatttttattttattttttatttttgtgggtacatagtaagtgtgcatgtttatggggtacatgagatgttttgatataggcatgcaatgtgtaataatcacataagggtaagtgtggtatccatgcccttaagcatttacgctttgtataaaaaacaatccaattatacttttagttatttttaaatgcacaattaattcattattgactatagtcaccccattgtgctagccaatactaggtcttatttactcactctaatattttataccctcagttgttagtattaagactaaataaatattaatcataagatccaaagggtaggtgtaaagtcagaactatgcagtaagataagatcaggaaccaagataaaagaaaaatgtctgaaaactaagagcaatgtgtgtaacacagcagagaataatattcaccgtaaataattcaagaagatttatcccaggaaaagcaaagtgagagcccacattctcagtgggttcctctgttcttctgtcaatgggaagtaaagtatgatgagcaagaagcacaaagttaatgggtcctccagcctcctggagtggctctctgcagctcttgggcaaaacagatgtctcaatgactacgtgggagagtgaggggaaaactcagagcctttcaagcaacagaggtgtgagagagaagttatcaatataattctcattagtctgtttttgagagatacaagttgtcaagcccatttgggatattaaatgataagggttcagtattacccttctgtgctgtgcaaaggagaatagtcaaaagcatatttactgttctcatgaaatttgtagtttaactatgaagacaagatatctgtgaaaagtaaagatcactttctgatcaactaagttttctcactttctagtttttgtctttgtatatacctcctttaagaatactttctccaaaattgtttccagtctcactgactgaggaaattttcaggactcaatcccatgtacaaatgttgaacattacataatcagttatactatatccattgtacttgtgactgatataaaaacatatttttttcaatagctatttattgcatgtctgcaatgtgccaagtgctgttgtagatattaggaaaaatgaagtagacaaaacattgtctttgtccttgtggaacttacatctcagtattataagtgtgcaaaccctctcttcctactaggagaaaatattatttttaatcattccttcacagtgagtttcttaaacttatttcatcagagactattgaaaagcacacactcttccatccccctagaatgagaatcctgggggagggattgggcagtctatctttttaagaaactcactggatgtttcatgtgcattcacagcttaggtaactctgggggaaagcactgccctattaagaacatactgcccaaggaattggtaatatccattgtactatatctgtaggaccccttttgattgtcattactagcctttatcaaacatctcatccttggagaatgtgaaagctctccacggttttccacagacagttcacctaacaaaaaacaacaaggcaaactttttcaagaataccattatttttaaataaaatgcctctacatggcagatgttattatgttctactttggagatgaaaagaatcgaacattattagtcatgatccacagaaccagaagatttattttaaagataaagttcagatgatgaacataaaggaagttatctcatcaaagaaggcaagactgagtaaatctcagaaatccaccatgtacaatatttaaaaatgctcactaaagttgttctttgtgagttaatgaaggtcagtatagtcaatattcagtacgtaatcctagcaagtacaaataaagttaatattattcaaatatcttacacaggcttattgcatgcaacacactgttctaagtaacatacagatattaaaatgacttaattctcaaaacatgaagtgagtttttgtttttatgcccgttttgcagatgagaaaactgaggcatagggaaggtaagtaacgcgcttaaggttacatagctggtaaattgtagccaggagttggaatctaggtgccaaaatctatgctgttaatcactaaactacgctgccttagtttttatacttctttaggaacctcagaccaaaagaaatttaggcaattctaatagaacaagcaagaatttgctaatcacagcttccttgccccaatcctttaatcggcttcattttcactgacttcttttttaaatgaagataacaatgttgttgaacaggatcatctagtggttagtggttcggcataagaatgactcgcttctgaagctcagctctagcactcgcttgctgtatgaccttgagaaagttacctccccaagtctgtttcctcatctttaaaagagaggttataataggacccacatcatactattgtttaaagagaaaacaacgtagcccatttaaagcacttagaaagtgctccataaatattattagtgtaataaatagcagcaacatcaataaagtatgaaccaaatgatctcttgattcgtatcctaacactaaaaatggtttatttcccttctaattaaaagagaattacaacaaccaaaacaacaaacgaaactatagccataaaatcaattatatcgtctgtgagaaaaccggaaaggctattggacacattaattcacttgtcatcagtcatcccctctattccaaaatgtttgtgttctaacatcctgagacaccttgcataatataatcactgtgactccaagaggtcaaatgggcaggcagttaatgcttctctgtgaaaagctcaataattcattttataaatttcagtttaaagcctgcgttgaggttaagaaaaattgacgttcggtctgtgaacttaatgtcaagctccagaaaaactctgggcagcacatgtttagcaattaagtggacacagacaataaagacgttgccaaattgtaaaacaagacttggaaatcacagaaaatgttgctagttattgatcacggtgaccattcagttcctactgagccacccaaaagaatcattcattttccagcagagagcctgctcatttgcaagataaaagagagacatttctgcacatgcccataatgttcttcaccactgggggcagctttacataagactgcattcactgaaaccaaagcaacagtccgagcagctttcagaatgacagtctgcagaagtgagctgagcgtgtgcgcggtacggggctctcctgccttctgggctccaacgcagctctgtggctgaactgggtgctcatcacgggaactgctggggtatggaatacagatgtggcagctcaggtagccccaaattgcctggaagaatacatcatgtttttcgataagaagaaattgtaggatccagttttttttttaaccgccccctccccaccccccaaaaaactgtaaagatgcaaaaacgtaatatccatgaagatcctattacctaggaagattttgatgttttgctgcgaatgcggtgttgggatttatttgttcttggagtgttctgcgtggctggcaaagaataatgttccaaaatcggtccatctcccaaggggtccaatttttcttcctgggtgtcagcgagccctgactcactacagtgcagctgacaggggctgtcatgcaactggcccctaagccaaagcaaaagacctaaggacgacctttgaacaatacaaaggatgggtatgttttgtcatttttcttctttccttcttaaaaacaaaaaacaaaaaacctctagtgtgtgtaataattctgccttaattattttagagattaccttgctctgctctaagactatgaatttatttgcttagtggcatgtttccttgtttaactatttaaaaaaacaaaacactaaagacaattctctttaattacaaagagataatatgtgatgttaagtgttatttagatttaaatttttaaaaatgaaaaatatatgcctatttttgcttgattaaggattaattcttttttggggggataacttttctaagttgtttttatttccaggtttcaatgtaattaggctactgagcggatcagctgtagcactggttatagcccccactgtcttactgacaatgctttcttctgccgaacgaggatgccctaagggctgtaggtgtgaaggcaaaatggtatattgtgaatctcagaaattacaggagataccctcaagtatatctgctggttgcttaggtttgtcccttcgctataacagccttcaaaaacttaagtataatcaatttaaagggctcaaccagctcacctggctataccttgaccataaccatatcagcaatattgacgaaaatgcttttaatggaatacgcagactcaaagagctgattcttagttccaatagaatctcctattttcttaacaataccttcagacctgtgacaaatttacggaacttggatctgtcctataatcagctgcattctctgggatctgaacagtttcggggcttgcggaagctgctgagtttacatttacggtctaactccctgagaaccatccctgtgcgaatattccaagactgccgcaacctggaacttttggacctgggatataaccggatccgaagtttagccaggaatgtctttgctggcatgatcagactcaaagaacttcacctggagcacaatcaattttccaagctcaacctggccctttttccaaggttggtcagccttcagaacctttacttgcagtggaataaaatcagtgtcataggacagaccatgtcctggacctggagctccttacaaaggcttgatttatcaggcaatgagatcgaagctttcagtggacccagtgttttccagtgtgtcccgaatctgcagcgcctcaacctggattccaacaagctcacatttattggtcaagagattttggattcttggatatccctcaatgacatcagtcttgctgggaatatatgggaatgcagcagaaatatttgctcccttgtaaactggctgaaaagttttaaaggtctaagggagaatacaattatctgtgccagtcccaaagagctgcaaggagtaaatgtgatcgatgcagtgaagaactacagcatctgtggcaaaagtactacagagaggtttgatctggccagggctctcccaaagccgacgtttaagcccaagctccccaggccgaagcatgagagcaaaccccctttgcccccgacggtgggagccacagagcccggcccagagaccgatgctgacgccgagcacatctctttccataaaatcatcgcgggcagcgtggcgcttttcctgtccgtgctcgtcatcctgctggttatctacgtgtcatggaagcggtaccctgcgagcatgaagcagctgcagcagcgctccctcatgcgaaggcacaggaaaaagaaaagacagtccctaaagcaaatgactcccagcacccaggaattttatgtagattataaacccaccaacacggagaccagcgagatgctgctgaatgggacgggaccctgcacctataacaaatcgggctccagggagtgtgaggtatgaaccattgtgataaaaagagctcttaaaagctgggaaataagtggtgctttattgaactctggtgactatcaagggaacgcgatgccccccctccccttccctctccctctcactttgctggcaagatccttccttgtccgttttagtgcattcataatactggtcattttcctctcatacataatcaacccattgaaatttaaataccacaatcaatgtgaagcttgaactccggtttaatataatacctattgtataagaccctttactgattccattaatgtcgcatttgttttaagataaaacttctttcataagtaatcccccacattcgctgttagcctcctggtgggaccaaatctacagttatagaaggtttgcacctcactggcaaatcaaggaaagaggtgaatgattccaggtgctcggagcttgagctgattcttggagatgactcagttatgggaacattttacagacaggcagagcctttaaaccaatgcctgacttagaaaagaaaattgcaggaaactatcaaaagatggtgctaggttaaagcagcaccctgagcagtttccagaggtgtctgaattacagtaaggcaagcacagggacaaagtgatgaagggttaaaatactgcaagcagacaactgcaaaatgtgaggagatgacaaaaatgtaaagttttcgactcagccttgtctctgaaacccatctctgtaaaatcagactagaggtttcactgccaatttcttctagcctgtatgtttcataaataaataaatgaaacagcattgagaagccagatttctccaccacacctcacattagttagggagttttcagataaggttcgcgaatgggaaagcagcttgctacaggcatgtggttgagagcttaccagaatttctctttccagttttttcgaagaccctaatgtagttagtagaatccttagctctgtcctgttctgttcagaatttgtcaggctgccctgttgtgttccattacatgtcctgcacacaccagtcccctaatgacagacacttcattcagatgtgtaaagagaacacattccaagacgtgccttccacccacagcctcattgaaaaggacgactttgataacaccttaataaatgtataaaacgaatcttagaggaaaaaagaccaacactatgacagttctctgttgcttttctattgctgacattacaatgtccctgcgttcatctgtattgtgaactcatccatcagtacagttctgtacagaccctgttggcaatctgcaagctgcatgcatgtttttatgtcattggtgaaagtttattgactgcagcacgaatatcatagcttccatatttgagtaacttgaaccacagtcaattaaggtttttagaaagatatatttagtctgtattctccttcatcctccaaaatgaacagttctattatagaagcaaatatcaggaactgcaacattgaggctgtttcatttaatttggcttgccaacccctacatctttaaccatgtccctcttctctgaaaacagaatcactgcagcaacaaagaaaaagtgaatggctatttttactaatttttttttattgtttgggggtttttcatatgctgagaggaaaaatctaggcaagtcaccataaaataaaattttaaggatgccagatcattaaaatcatacttttataagcaataaagaaaaagaaatagttaaagtggatttctcaaggtactttgatattgattaaatcttacaatagatgccacttcagaaaaacatcttagttacaatgtttacccatgaataattgttgaatatacatgtattcatgacaaaaagtcacatatttccaatggattaataatgcagatacttcctcacagcttactggatgactgagcttattgtgatttttttactgaagttgtaactttacatttttcataaagcatcagtaaatacatattccatcttaaaaagaaattttctttggctagcctcatttttatctgtactaaagatgtttgtattaatgaaatgcagtcttaaagtgaagaaccccatttctattctttttcacttaaccttctgccttacttgtgatggataccaaatatatttaggcaaggaatacttatatttttgaattattgcaaattctcaatgccatggtgctactagtatatataaaatatgcttgctgtattgaaaagcattcctaaaattcaaagctacttggaatataaaatatgatataacactaaatgaatcaccaatattttgaaagctgtcactttttaatgcctaactttactaataaacataataatagataagaacgaaaataaaatcccttaggtggtaaaactcattttgatttgggacatgaaattatgggaaaaaagttctttctttctcctcactctttgagaatgaatcttctgtaattctcagtatcttctgagcacagatatataattcttgtagatttaataactagtttaccactgtaaattttaaaacgccaactgccagtctcctgctcaaaagttgttgcctcacctccatcccatggtactttctggactacatatcataaatctatttgtataagtatttcaagttcatgcagattagagaaatgtgattgatatttatttttctagtacgtatttacataaaatattggacttccctcaaaggtgacaacagttaaaaaaaaaaaaaaaaaaagcctgacctgttgaactatacaacagaacacagaatactttgctttaccaaaacagagaagaaatgggatttagtctctaaacttcatgtgagtttttttccatttttattaaccccagtacacatagtgctaccacagcatgtagttaaatagtcccagtgccacagtcttgtaagcaatacttatgcaagatatattgcattgaaatgagtttgtattttccaaggacgttgacattacatcttttcaaagaatttaaacaattttttacttgatttggtgagtgaactacctaagtagacaggcagtaaattgtctttctatggagcagcagtgacctctagtgtctggttagactaaccacagctattcacacattttagctttttatcctgaatccttatgtaaacgtggtttacaacatgttttttgactagtaaatcagatttgaattttatttaattcatttccttgggaaatataattataatgtaatttttgaatgttatacttttcattttgacttttatagtaatgctggaacagaggccatagaattggtactgaaggctagaaataagtgtccaagatgaaaagcgagtaataacgcaataagaatagataagaaatattttagagtgcttatactcatcgatgctggctaagcattttgatatttttattaaaggggttaatatttttcatcagcaagatacatgtaatttaggtaggaaaaacaaattttaatattatatcaaaagagtcagcatcagtcatttactggtcagggatatgtcaaaggtgtcaaaggaggggggcctccccttccggctttagaactctccagtttgctgattgtgccagtgacctgtgctttgcctcagcgctttctccctccctcccccttttcagccagctgaacactggttctattaggctctctgacaatgatgttacagtctaagaggtgatgattcatggataatgaaattatgctctccttctggggaaggataatgcagagtcagattcatggatttggcaagaggttttaggatgctgtaggtgcatgaaatatctcttcttcccttgacatttaccaaaatgagaactcaaatcgtttatttaaagtgtggattagactgcatcagaaacaagcatcaggtcatgaagcctgagataaagtgagttccagacatggcaagtaagaatcgagccatgagaaataaaaaattcagaatctgtgttgcttcatctattcctttttgctctggattctcattagaatccagatctgtagctaacccacggagttttgctattgttgtattctcctagctacctacactaaaaatcagaggcagttgggggaaacaatgagcacaacagaatatataggtaaatttgaatgacacaagttttaagagaaataaaatggatggatgttaaatagtttgtatcaaatagctctaattaaaaatgaattaaagaaataataataatacataggtgaaagtcactgctttcctaatcataatagcctacagaattggacccaaattcttttagcctccaaaagttggtgatgattttggatacttaatactaccaataaaatctaaataacaataatttatgattcttttgcatttgagggaaatatcacagccaggcatggtagaatacgggccttagaaattaagacctaaattcaagttcctttgacacttgctaatcaagtcatcacaggtacatttcctggcttttctgaatttgaagtttctcatatgtaacacagatgtgtactattgactgctcatggtaattgggaggacgaaatgtgaaaagtactttgtaaactctaaaatggcaactacctcttcttttcaaaaagcccttagtgagatactgagtggggtttgttgttctatgtttggcatgagccaaaaagaaatcagtaacctccatgttacagaaccccaagcccattttacatcattagaagtctagaacatcgtctttgactttctgttttcacataggcacagcttcttccacctcatgttatctaagtctatgatttttatactgattatcacaatgtacaacagacataaagacaccgaccagcgaacactaaaacaaataattatcaaacacattgaaaattctacttgtatttcagatcaggcaactatagcaagggctttcaatcaggacgtttacctgtccactccctttctagtatcattgtgttcaatccttgttgactttacactggatcaatataatgtttatatggcaacatgacatcattattgagcaaaaagtaattgcatataacatgttactgtaggattagcacgcattccaggtatcagtcacatgatatctgctctgatgtttctcccctggccactccagtggaagactgtgcccaagatctcctcttagtatagaaattactattgactttatcaattataattattgaaaaatcactggataaaaaggggtataaatgtacagggacttccttttatatgtcattgcttatgcaaaattacatcattaattcatcaaagaatgacaaaaggcttcctccgctggatgtagctgctcttaccaatatgaagtagcaggtgtattttcaaaatgtttgtcatttaagaagacacagactgttcctctttgacagctgagttcctatggcatatctaaagatcagagagaggatgatggtttttcaggtggggaagcagttgtgagttttctgacattttaacttcatagggtcatgaatggacgctcttgagttagggatcctgaacacgtgaggaaaattccaggaacacagagagaacaggaatatctgggacatgatataagaccaagcaagtacaatgtattttacaattatactttctaacaacagaacttctataagcaataataatccattttattgaaaaaaaagaaaaacagcttctatcttatcctttccagcaaatgttgtaatgataattaataactttattaacaattctccatgttttctttttatttttaagggctctcacttctcccaatcaggattctcatttatcctttctctcactcttaaattgttctccttatttgaaagagtctgtaattcctatatcaccaaaaaatgtcttcctttataaaccaacacaattcagtcatttggctcaaaagagcagcattatctccaaaagaaaagttacacacttgcattaaatattaggacataaaacaaatttaaagctggctgacacttctctttcctctacaatctataaaacacctctacagtatattatgatttgcaattgaaaaaacaggatatatagttgaattacagtcttacaaagtattaaagcttactgttttcctccttaattagctaattcctagaaaacaaagtataggactttatgtataggggtactcaactatatttcaccaatcagaaacactctttccaacaatcagaattttgtcttctcaagggtaaaatatagtttttttggcctggcatataaaatagtaaggcaaatactacatttagcaaaggcaatttttgttgacatttcatcacatcaattacatctatgcagggtggaaaatacattttgtcagtaaggaggcaatgacttcaattaaatgtaaatccttagtcagcattcttggtgctaaagcttattaatgaagtgggagcagaatgaaaatgtcatcagacagtgaagctacagtatcatgaggctatgctaccttgagtggtgttcatagcttcaactgggtggccctcatgtagctaaaaaagtgctccttgtcattaatattgatctatgtactttctaaaagaaagaatatgcttaccaacagagccctcatattgactgtcttcctataagtttccctcattaatatttgatgcagtcaaccagaatctcacaagagctttaaaggaaacttgtagaatgcatcatgttgatattgaaaaagtagagtagcttttaaaattctgataaatgtgtgacaagattacaacagtgaaacctctctaaggtacaacagtgaaaatagttataacggtgaaaactctaggaagtttaccatagtgaaaactctccaagaagtttaaaattcagcgctttgagattagtgttggcatgtacttgtcaatttatgaaagggattttgcctaatgtattcaaaattttaatgtgaaaggtataaatacttggtttgtgtactggcaccaatagagggttaggtaacatcactgaattatgattaaaatggaatatttaaagatctttctaatatggcagaggacatattacatacgtatttgtatttccaccaaggtacgtatgttgtacatgcctaaaaaaatatatatatattttcctattaggtgaatatttttcctataatgtgaagatattttggtataattgagtccttattatgtaccaggaatttgtatatattatctaatgatttgataaaaagtgttttatgcgtttcgtaaactcagatagttttccttaaaatataagaacagagccctttatattgagtctgtcttcctgtaagtttcactcattaatcctatacattttcacttctttataggactgctctaaaataatttataccccacccacaaaaggcttctcaaagccaaatcatgcatctccagatccctttaggaaataatttccgatgatttaccattagaacatccctctgctagttaaagtctaatctgccagtatagtgttccttccagcctgtggcacccactccagcctatctcatgtcattcattaaaaagcagtaagtgtttagtcttttggacttttacagggaggactaagtaataaaatgtaaaaatctacatatatttttatgggctttactctggtcacttttatggtctaacacacacagatgtgtggagtctttattagtttacactaaaatgcaagagcattaagctagatatagacgaaaagagaaagtcaaagtagatttcaaaatagccaaaagctcacattatacgtttcttaatgttaaaaaaaaaatcccaaatgatggagatcctgtaattcactttcttgaaagctaatttaccctcctctaagtttgccatcacattcttaaatttaagctgacattccttctattttcctatttctaataggttttcctggtgtttttttgtttgtttgttttttggttgttctgttttgtttctctgttgttttctgcctgcagatcttaattctttgagtgcactgccttgcctgtttttctagaattcccaatcaaatgttgatcctgtcagaaagtcacagggtcagtttcatggttggagtcatcggacagatggactagattgaactctacagcgcaatctagtcaactctgagatgtctgccttgtgtcttctcagcatcccatttccatgtattttctctatttggaagtagtatccatattgaaattcctccatccagtggtgcccagagctttcttggtttcttatgcgttatcaaatatctgctcccagagtgagagcaggattactgtcccttccaagggcactcacctttaaatagagatgaaagtcttcagctaaaggtaagaaagttatatattaagagcaggcatagccagcagggttggggaaagttcttcttaggcaaagacctttgtaaagcactctgaaatcatcctctatagattcctcagtatttttctcaaacatgagtttgggcctttccaaaggagccaaggcagggtaaataatccatgtttcattcaataaactatatttgagaatttttttttcagtgaatcgccattatacaaagtctttctccttaaatttttttcatggagagacaactttgtataccagaaagaacttggactatggatccagtttgaattctgtttctgggattttagtaactgtgaaaccttgagtctcaacatcgtcatcctaataaaaatgtgtaaaacaatgtagttatcatgggattgttgcaagaaggcaaagaatcagcatttgttaaatatttttcctggtacatttcatatataatctaatactcataaagatcctatgaagattcaatgagatgatgtagataaaatcatttaatacaaaggttggcacataatactttctccttcccttcattagttccaactgctaaaaatctcagtaccacaatgcgctttgaaagtcatattacactacctatttttattttgaataacagactcctggtggactttccggaaatagaatctaaatttccataagctcaagggcatctgggcacgtagttaatactgaagagtgatggtagtacataaaaccaatgtcctcagcctcccaacaaagcccagctacaaccacctttattgccctaccctttcccatgctctaccactggcaggttctcaaagtagcccatgcttcccaatctctgtgcttttgatcaagcaatttcctttgtgagaaatgcccttcctccctcccaagtcctccagtcaatttctgagcttttccagaatagatcaaattctgctcactccagatgtcttattaatcttttccttccctcttttctgttttttttccccctctcccagagactgcatcacagtctaccttatgttagagttattaaggggtttgtatcacgatttgaggaaatggataatctcttcttttccttcttcttccaatggtggctgatacagtcttttatgcatgatagatgttgttgaattgattttctggtcattattatgaagttattattgcaaacaatctacagtaaacatttcaactctatggaaacttaattgtatcaaccttatatttctttgtgtagtcataaaaactttttttagttttaatttaatatacactttttcactatgtacactcttctcatttaccatttaacgggcttcaaaaattatagctgaccactaaacaatgtgagggtcaagagaacaaaccctcccatacagtcaaaaatccatataatattttactcccccagaactactaatagcatattgttgaccagaagccttactgataatataaagagtcaacccatattttatatatgtatcttattctgtattttataataaagtaagctagaaaaatgaaaatattattaagaaaatcataaggaaaagaaaatatatttattattcattaagcgaaatggataatcctaaaggtcttcattcttggcatcttcatgttgagtaggctgaggaggagatagagaagcgatcggtcttgctgtctcagggtggcagagtcggaagataatccacgtgtgagtagactcatgcagctcaaacccatattgtccaaaggttaatcgtattcttaggaaaatacagttttaaaggatcatgttctgatttaaattgcttgtgtgttgtgaataatctaccaatcattttttcctgtgatagttaccaaagctatgaacatttggagggatatgttaaagggaataagagctacaaaaaattgagacaaagaaataatatttaagtctagctgcgaatacaccttcatttttgtagaggctaggtagtcaacgtttgtttaaaagccatacatttgtgatctctccccgtccacatcctcctgagaaaggtcctttgctctttagcttggatgtctccttatctcagccccagttctgcaaggattcagctttagatgcattctgaggcctctcctctcttacccacaccaagggaacaccctacgctatgacagaaactaggtcttggcctctgattttacgcgtttccaaagtaactactctactggaggcctccaacactcagaagctgacaagtagtaatgctcatcttttttacctcctaaaagctgatcatgcagaaggcatgttagatcatacagaactgaagcatcttcccttttctgagtctctcctttcctcccttctgttcattcctttattcctttgcactacatttctttttctctttctcatctccacttaaaatttctttcaatttttctttctatccaacttttaagtcaatccatacaacttggatatatgccttcaaactgagttaaaaggaaaatactaatagttttatctctcatgaaagcaataattaaaatgacaccatctaataatttaatgtaaaaggagggaaaaattctatttgtattcaactcttttgtttgggcctataaatgaagaactataattttgtaaattatagtttaattttagaaataaaaatgacctcttccctaatatattttaagttgcattttaattacaatttgtaaggtagggcagacttacagaccatccatatcccttttcatgtgaagtatctgtcagcctctggaccacagtaaactttgtcattcacagagtggattcttttttggaacatacgtgataaacaaattgaaataaaacttcactttagttataaaaacttgtagttataaggacttttgagaaccttgcagtccattttttttaccttctatttgaaattccaaactaatttcattgtacttgtaacaatcttccaagaactgcaatcctcaagttctctctttgttatccacttcatggtttcactgtggtcactgcatcattttttacccctatacgcatcttgcttaagataaacccagtggttacttaattttttttttaattcttctttgttttcattctttttaaagaggaacagtaaaataagtagttaggttttgtgtttgtttttgctttcagtactggaatctgcttggtccaacttaggtagagaatcttgggctccagagcgcatagtttgaaaagatggaaaacgttgttctgaaatttgcattaatctactttagattcaaaaattccacataggctgggtgtggtaggtggctcatgcctataggcccagcactttgggaggccgaggcaaggaggatcacttgagctctcaagaccagtctggaaacatagcaaggcctcatctctacaaaaaatgaaaaaaaattacctgggtgtgatggcacatgcttggaagctgaagtgggaggactgcttaagcccagggaggatacagtgagcaacgattgcaccactgcactccagcctgagcaacagagcaagatcatgtctcttaaaaaatatatgtatattttgcatagagtgtctcatgatgactgaataaaagaagtccagtggttaactaatctataattaatcatagaagcaagaggtttctgacaaaatgtattcagcagctttaaatatgaaacccacaaattatatttccagaggtcaaatttgcatataactccttgaactatgactatctcctcacattcaactcagttttaagatccagcagtgtgttgtacaaagtaatcaatggctaaattattcccattttgttagctcagttcacagtagcccactgactggtttaaacaaaaaaaaaaacttatctgatcttcagtttgtatttcaactgtacccaagtgcagatgccatctctggtaatatgacaaaacagatttaggtttctaaatgtttctgtatgctccaataacagtatgcagcctgcagtaactatatcgtagctcaaagtgttgtaaaaaaatgcaactgagtttgctgaagaatcattttagagttaattaaaccttctccacctgtaatttaataaaaaaaagaaagcccaacatactcttaaagacgatgggggaaaggcagtttaagaaataaaagtcctctgtttatccagggaggtactttacaaggcagacagctacaccacagtagagagacaatatttcctcagctgagtcggttaattaaaatgcacagttacaacagactttcttagagcctgcagctgaatgactgaagtctccattttactccagtgtcacacagaacatgaagaggcaaacatactgcctgaacacaatttgactcactaaaatccagcactataaacacaaaatacatttctcgagtgcattttaaaagacttattatcaagatttatgacataaggatagaaataatttgcaactaggcactgccaggagaatatcttaggttcctctcaaggtaattttaagtaaaatttacaaataaatcttaaggttagagtccactttgaacgcaggaatcttcacctctttcctttcaactgtatggaatttgaatctgacaaacaacctgtctgttgctagaatttataagtgatctgaaaaaaaatcaaaggccataaaagctatttgtcaaataaactgcagaacacgatatcagtctgcagggctcatttgcagaactcatgatgagcatgggaggaggggatgctaacagctgcagccttgaccgcactgcccgtgccagccagaattcaagccgcgtgagctgagtgtggctgaaagagggagcacacaaatgacatcttagaagacaaaagcaaaaaatgacaaaagaggttcttatatccaagtttttattatatcagtacatcagcatatacagaggatgacctaaaaaaaccactttaagatagatgggccggcagagttttaaaggttttcaaattaagtctgttcgtggaagacttactttgatttcatggtgtaggagggagatcgtagacttcgaatccactagacctgaagttaaataaacctggggtgcagttttggttagcctggtagcacggcatggtatcagtttcctcatctgtaaaatgggaacaatacttcatgtcccagcacaattttgaggataaattgagataacatatgtttgcaggcacagcaggtgtcagtaaaagttagttttctcctgtcgtttgctagatattttcacaatgcagcaagttgattcaagtggtgaagtggaaattctcacattaaacacataaattgccaagtctgcaatatataaaaaatgattaaatgtccttgacgcttaccaatcattattaaatcaaacctgaaaaggatctaccagcaatttgcaagcccgttattaatatcctttaatggacttgctctattaagtattcttctgtaacaatgttgttcagcaacacaacagaaaaattctgttgttagtattgtgtttcttctagtaattcaacatcatttccatttcataaacattacttgaggaattagttccattatcctacaaatctctctttaaaacattgccataatgtctctctctctctctctctctctctctctgtgtgtgtgtatgtgtgtgtgtgtgtctgcgtgtgtgtgcatgtgtctctctctttcccttttttctccttcctcactttctcactctctctttcctttctctaccccaaacatggacatatcacaccttcccatactcagcactcaagagaacatgctattgttattacagtaaaccaaaatggtctgagaacttagtaactattacatttctagtgtgaaataatttaggcatttaaaggaagaaaacacaatatcaatatttatgtttttaaaaattccagtagagtctgtgaaatgatggctaaattaagcaaaagcaaattaatcaaagagttacaaaggaagaattccaatgggcacttaatgagcacctataatgtgcaggcacataggttgacttttctttcttcccagggcaaacaaaatagcttctcagggcaagggatatcagaaatttggagtcacattaataggaaaagcactgagttaattgactggctttggaaatttacttcacaaagcattggattttctcaagagacaaatttgatacatgtccttcactggagacatgaaaataattcgttctttttaaagactttgaaaagagcagagacgagaaaagctagaagagtttctaaatgacacaagatctgtgaaatgatagatatttagcataaacctcatagagctgttgtgtggattcattagttaattagttagttaatgactttgaagtgttaaatcttattagatttttttttacactttaacacatctgagagagaaattactcttaaattagaaactgactataccactcaaaaagaccatctttttatggtatatcttcaagatgctctttcctgttctgaatttttttcctgaaatcctgggaagcctatctacatcctgatcccaaatccaattcccccaccctttttttttttttcagtattagcattggcttccagttaacactaagcacagccttaagaaactctcacggcgaggtgttttgtataaaaatataaagatgttatgtggtaataatggcatcaagaattaaacatgctacttaaacatagttttgtacttttgtacagcaggggaaaacaaatacaggcatacctcagagatatttcaggtttggttccagaaccccaccataaagtgcatatcgcaataaaatgagtcacacaaattttttggtttcctagtgaatataaaagctatgtttatgctgtactgtagtctattaagtgtgcagtagcactatgtcaaagaaacaatgtgcttataatttaaaaatactttattgctaaaaagtgctcatgatcatctgatcctttagagaatcacaatctttttgctggtgtagggtctttccttgatgttgatggctgcagacagatcagggtggtggttgctaaaagttgaggtgactgtggcaatttctgaaaataagataacaaggatgtctgctgcattggttgactctttcatgaaagatttctctatagcatatggtgttgattgatagcattttattcacagtagaacttctttcaaaattgaagtcaatcctctcaaactctgccactgcttcatcaaataagtttataagtttatgaaatattctaaatcatttgttattatttcaacaatattcacaacatcttcaccaggagaagattttatctcaagagacaactttctctgttcatccataagcagcaactcctcatccattcaagtttgatcatgaggttgcagcaattccattccatcttcacactccatctctaattctagttccccgctatttccaccacatcttcagttacttcctccactgaagtcttgaacctctcaaagtcatccatgagggttggaatcaacttcttcctaactcctattaatgttgatgttttgacttcctctcatgaatcacgaatgttcttagcaacatttagaatggtgactcttaccttaaaggttttcaatttactttgcccagatccatcaaaggaattattatccaaggcagcatgagacttataaaaggtttccaatttactttgcccagatccatcaaaggaattatcatccaagacagcaagagacttataaaaggtatttcttaaataatactctttgaaagtcaaaattattccctgattcataggctgcagaatggatgctttgttagcaggcatgaaaacaacattaatctccatgtatatgtccatcagagctcttgggtgaccagatgcattatcagtgagcagtaatactttgaaaggaatctttttttagcactaggactcaacaggaggcttaaaatgtccagtaaaccatgctataaacacatgtgctatcatacaggctttgctgttccacttacacagcacaggcagagttgatttagcatcattcttaagggccccaggattttcagaatggtaaatgagcactggcttcaacttaaagtcagcagctgcactagcctctaacaagagactcagcttgtcctttggagctttgaggccaggcattgacttctcctctctagctatgggggtcctagatggcatctttttccactagaagattatttagtgtaagttaaagttctgttgtatagtgtaaccaccttcatcaattatcttagctagatcttctgaataacttgttgcagcttttacatcatcacttccacttcaagcgttgtgctgttttactttgcacttttatgttatgaagatggcttctttctgtaaacctcatgaaccaacctcttctaccttcaacctttccttctgcagcttcctcccttctttcagcctttgtagaattgaaaggatctagggctttactctggattaggctttgacttaaagggaatgttgtggatggtttgatcttctctccagaccactaaaatgttctccatatcagcaataagtctgttttggtttcttatcattcatgtgttcactggagtagcacttttcattttcttcaagaacttttcctttgcactaacaacttggctagctatttggcaaaagaggcctagctttcaacctatttcagctttcaacatgccttcctcattaagctttatcatttttatcttttgatttcaagtgagataaatgtgactctcttttacttgaacacttagagaccactgtagggttattaatgggtgaaatttcaactttgatgtgtctcagggaatagggaggcccacagtaagggagggaaatagagaatggctggtcagtgaagcggtcaggacatatttattgattaagtttgtcagattctatggttgtagtttgaaggaccccaaaacaattacagtagtaacatcaaagatcatggatcacagatcaccataatagatataataatcatgaaaatgtttaaagatgtggcaataattaacaaaatgtaacacagagacatgaaatgagcacatgctgttgaaaaacagagctcatagacttgcttgaaacagggttgccacaaaacttcagtttgtaaaaatcataatatctgcaaagtgcaataaaatgcagtacaataaaatgaggtgtgcctgcactctgttggataattaattctgtgagaaaatagagagggagagaattggaatccaatgataattatcttattctttggaaatagtgatcacattttgacctgcatgctggaaagttgagaaaggatagcagcagcataattaagttagcaatattttaatatgtgagagacatttgtatagtttaaacaaaaactttttttgttggcatataatatacatagagaaaagtgcacatatggtcaatgtacagcttgatgaataactgagcacacacaagttctctgcacacagatcaagaaacagaacacatcagcagtgtttcaaagccccctctagttcttccaatcactattcccatacccaaggtaaccactactgttacctgtaacagcatagggtagctttatctgttttggtactttacataaacgcaatcataaagcatgtacttttgagtctcacttatttctcatttgacatcatgttttacaagattcatctatattcttgagtgtagttgtagaactacatatttctcatctctgtccctccccattttctctccccaccacacccaggcacacacatagaattaatccccctcttattcaaatgatggatctacgtatgtacttggaagttcttgataaacttcttttttcatgtattccacagcatgaatgactcaggaattgctaatgaaaattttcctacagtctcttttcttggcgctggtaaatcttaatcttagaatattttgcatttttaaaatctattcatgtacacaaccagctccaagaaggacactgaggtaatcatctttttaagttgcccttgttttcagccccaaatccctgacttttacttaatctctccagggcagccttctttctgtctctggccttcaacttagaaagccagccctactctaatgattgtattagaaaaaacttgcataaactactttacaccaaggtgttcatgcctaaatctttatctttccaaggtatggccccaggacagtgttgtaacttagaggaccaattactctctgattactctctaatggggtatcttgtacagatgcatttcttgagttgttctgaggtcccactatattaaaggacactaagaaacagagctatcacactcaatgctggttttactattagaacattattgaaattaccatttcactatatcacaaggtattttctttatgagggtccatggggaaaggggaatggttctgcttcttctacataactttattttaaaatgtgttgttatttaagcaactgagcctgccctctttgtttcccccaccctctctcactctgtctccctctcccctgctgaaaatataaaaaagcatcagagacaaacactaataaatttccagagactaataagtttctaggacttcataatttgtattttttccctacctttctcacccttggtttcacatactttttctttcattctgttttcaaatatttttttctttttttaatcttgataaatttagggaaaatacagattaactcaataaaatatactatttcttaaagaaaaaattttaatcactgacactaagttaggctggccaagagaggaaaatgcagtcatgtggcgcttagcgacaggaataggttctgagaaatgcatcattaggcaattttgtcattgtgcgaacatcacagagtgtacttacataaacctagatgacagtctactacacacctaggctatatggtataggctattgctgttaggctaggaacttacttgtatagcaagttactgtatagaatgctgtaggcatttgtaacacaatggtatttgtgtagctacgcatatctaaacatagaaaaggtaggataaaaacacaatatcataacttgtgggatcaccatcatatatgtagtccctcattggccacaacattgttattgtagtgcatcactgtatattttagggagagggctcttctcgaaattctcaaattatgcccacttggtgaactgtgatcagacagactgaaaaacctggtagttgaggcatcgtataacatagtaccatgtacaaagaaagttttaataaagcttttctgaatgcattgaccaaagatattttccaacaagcaaaatggacagaatggggagaatgtctaggaaatatctagatcaaggataggataaaagacaaatgcacttgcgtaacaacatggagatgcgtttttaagagagcagacctgttactacatgtgttatgtgacactttgtgacaactgaccgattcttattttcaatgctctcaattaaagatctacttgggaagattttattaatgtgttatttatctaagagtcattgatttatggagcttaaccataagatatagcatggctcattttcattataaaatttatatctacaggaagaataccacaaggacatggggtgttctatcctggactggtaaaccacatatgcaatcacaccaactgatgaaattgaacatattaaatgataacaatctgttatttgctcccttcattcctatgatcctattaaaatgaagtaaaaaaaatcccagaaactcaatgtgaatccataaatcataacataaagcagtccaatataatacttcagtgaaatgttcttttcagtaaaagagagggaggagaaggtgtcaagtgtgggtctcttaattaggctttgtattaattttgagaacaaagacataattccagatcagataaattataattgtgttatttttttctttgctgttaaagctatttgattaggagactctggaaaaagcatgtaatcttgcaaacaaatataacaaatttattgtcaaacattagcaaaaatttataatctgcattgataacattcctaaagtattcaatggagccattcagcaatatgaaagaatgcaggcaaatttctatgattagtatttattcaaatatatattttgccaaatcaataataaatttactgagaaactatcagttgtggaaatattatgataaacatcccctttaaaaatcactatggccagaccaggtgctgtgggctcatgcctgtaatcccagcactttgggaggccgaggcaggtggatcacctgaggtcgggagttggagaccagcctgaccaacatggagaaaccccgtctctactaaaaaaatacaaaattagcctggcgtgttggcatatgcctgtaatcccagctacttgggaggctgaggcaggagaattgcttgaacccaggaggcggaggttgcagtgagccaagatcgcgccattggactccatcctgggcaacaagagcaaaactccatctcaaaataaaaaaaaaaaaaagtcactatggccaatatgaaaattaggacctgttaggttgaaaacatccagtctgcagtgagtataggattaaacatgattggagtaccactacgtatgtttcaaatgcttatagtatgtgaaaattaaagtccattttcttatgcttggcaaataccagcagacttgctagacacaggcagcagcctccaatttcacagggcttgtgttcccaatgcacacctaaaaggatagctttctcacatgttttgtgattctaacaatgtgtgcagagaggaatggatactgtaactatgaaatggaaaagctctagatttctgagtggttcagaatcacgggcctaaagccagacattaaatagaaaacttgtcacttcacagctcagaaagttctaacatctccccatgacttaacacaatctgggctcaacctagtctttctgtttctctatgcaattactcttaataccaatatgctccaacaaaaccatgatttaccactctttgaacgtctccttcagggtctatctctaatttgctcaaattatttcttctgcctggaacattgctttttgacaaattatattttataaccaaatttaactcttacataaactattttctgatacaaccaaaagcatttttcttccccattcaactctaattgtatattattattattttacttctatagccattaaaattttctaacttgaagtatatttacttatatctataattatcttcctttcagggaaattttacagggaggaaaaaatcttacattttttttgtatcctaaacatgcttaaggcaggttttgagatatactatatgtttaataaatgtctgtttaaagaatcatatgtgaatacatgaatgtcacacttgtgagagtctcactgagactctagtatattaaacaaaagatccttatttccctatctttgtcaaaatatgtatgatatttgagatttagttcatatcataaaacattgcatttaatatattttatatatttttaataaatgtttaccattttcagttatgtgaatggctccatacagcaaaagaaccattagaaatataaaagcatcatcctatgaagtataaaattactcctgaattataagcaacctttgtagctacatgcaaaacatttattcagctgcaactatttaatccttacaaaaacaaaaaagcatgagttcatataagggccacactgtgtgaggggcatagagagagattttagaggcttcgcacagtgcagggagtttggtcttaacccattttataggtaaagaaattgaggtgtaatcacatgagacagaatttgaattctgatctgtcggattcagcacctctcttgtcactgtgcagaaactccctttgaatgctagatttcctctgaatagatggtatgcttatttaaatacaagacaagtcattttgccttgctgcactgtatttatcacaaggctattgccagctttttctttaacattaaatacacacacacacacacacacacacacacactgtctttttttttttttaagacagagtcttgctctgtcacctggagtgctggagtggcgtgatcttggttcactgcaacctctgcctcctgggttcaagcgattctcctgcctcagcctcctgagtagctgggattataggcatgcaccaccacccctggccaatttttgtatttttagtagagatggggtttcaccatgttggccaggctggtctcaaactcctgacctcagatgatccatccgcctctgcctcccagagtgctgggattacaggcataagccaccatgcccagcccaacaccatatcttttaaatggcttactatgtttgaggcattgcaataatgtgtcccctaacgtatttaattcttacgacaaatctatgagataggtactgtttactcatattccggatagggaaactgggcatagaaattttaagtaatatattgaagatcacagagatagggcatgaaatggaatttgaacccaagtctttcttgctcctgaatccaaattcttaaccacactattggcttttgttcctctccattaatcctgaatgtgatttatttttttcccaaaaaggaaactggattacttgacctgctgtttgttcagaatatttattttagcatgtgaaacatttaatactacactgggaagggatctagaggacagaaagtggaggtaggggatgcatacagagataggctcatctcacctggcctgattaagttgtttacatttttcagaaagcccatctccaagtccagccctaaaataacagtgaaccttcatctttaatggacataagaccctgtctcagaactctttagataaacagagcacttttcagagagggagctagtgaccttgacaaattggctggctttcctctcattccagatccgtgacattcagcagctaagcctaatatgggaaacaagtcaatattttccagcatgctgggtccattttctccccccaatatttttaagcataagacaggtgcagaaatcacgtcaaccaccactggaggggtgtacagcagctgtcacacagccacacagtggcaaaagtctttgctaagatccaaaatgaaaagaatactcattgtaattgaaactatgcaggggacagagcttcccagatgcatacaaaagttctgaggctttgaaaagagacagatgtcacttttatactcaatctaagagctactacctttcaacagctcatcaggaggtaaaatcaaatcttcagagacaaaagacataagcaacgcatctgtagcagccagaaagtaaattttttaagctacgaagggccttggagacgattcagggtatgccgtcttgtttttcatttgatgacattaggatatcatacctaatggaaaaattaattgtgtgtgtatttatgtgtgtgtgtgtggaggcacgcacacatgcatgtgcatcatgatgatgtactacttaagcaataatgggccattatagaaggtaaatcaattaattctaagttgacattgtcatagtcaggtaaattgaggatctctctgaaaatccattttcctttataatctgacttgcaattattatcaatgtacccattatttacagccagggactcttctgcttggttagtgcttatgtcctactagttgttaaatattttgaaaattagccctgcttgtaatttattatataatttcaacaattttaagataagcctgatacaaaaacaggttcttccctggttagctaacctaagagtcaaaagccagcacagtagtgttacagccgttcagaatgcaaggtatcctttgaaatacttccacagaagacctccaagtagttttcaaaaacctggagctattaatatgattcccactatgttctttaccttccactgaagaaaacagagcctactgagaaacaactctagtgtacagagaaaccaaccagcaaaaccaagtggaagtttctattcaggtctgacctcggttatcttaatcataaacctgacccagttgagcctcgctgatgggctcataacttagttccctcaagatctttctgacttttgtgtaagcaacacacaaatcaatccagcatatcacttctgatatcacagaaaagtaattcttatgaagaaggaaatcattaattgtctttgaatgtgcacccaccaataattcaagttattaaagacaaaaatcttccctagtaaatgctcactgccggttgtctgaaatgagagagttgaaaatgaatacatgaatcaaggaggtttattttaagattttccatattttgatcaaatggtgatgattacattacattttttttctgtactttcccaacaaagaataagtcataccatcatgttcttccagaaagactctttgcttgaaacagtcttactggcacaccatagttagttatgactcatgggttttgtttttttctaagatagctataaacttcaaagatacattaccttataaaaataataaatattgcttagagaatttcatctattttctacataataattttatctttgaaacttaaaatagatatcatccagattgtgcttctgatatgttttatgacatgctgacactgtcctcctaagataatattagatgatataagttttatttttttaaaaattagcccaaggctttgtaggccaggttctagagacactggtcagttcaaatctcaaccagaagagctatgtgaccttggaaaaataacccacccattctgaaccttcatttcctctgctataaaatcaggataataataaaatctatctcaaaaggttgttaagactatcacagaagttttgaaatacaaaataattagaacaaagctggtgcatagtaagtgctcgcaaatactagctgttacttccattctggatatgtacatcataattcctaacttaaaatgctggtcaaaaataaaatttatgcctctactagtcagtaaatccagcctcttctaaacataaaatatttatttaaaataaagtttctagtatgaaatttgaaatatatagatttttcttaatacatttcagtatctgcttttataaattgaatgtaaccatatagtatttgacagacaaatgtgaatcatgttgtaaaccatatatttgaaacttatcttaaatttgttctgtgtctagttaaactaatttaaaaatcaaggttgctgcttcttgagctccttttgcagggctcctcagtgactgcagaggagaaataaaaacgcttaaaatagcgaaaataatgtgacaacattcaggcaaaggcaaggctactatgtacaggagagcatgttgtgcactacacggtcccgcaatggattacaatattaatgctgacctcttagggcaaactgtaggcactggtcatgccccatggatgaatatgaatacataaacttagcttcagttaaaattatgtcaaattgttaacagaaggaaaatgaggtttaaagtccattgaaaattatttttagataaatttggattaaaatccaatgtgctagcaggcctcaaaatgttaagtgatttcctgagaaactgtcacagcccaggtatacccttccttggcggaatcgactgctactttttcttttttaattgctgaattgttcaagtctttcccacaaaaggctgattattataggccttgggctacaagtagagaaattactggactagacctggagctgtggattctggcctaaacactgtcattggcttgtaatgtaattttgtgcagttttctcatatataaaacggaagtaataagctcagatctcaattaggaaaagtaccaagatactagacgtaaacatgctttggaaaacattggagcacattaacatatatagcattatcaaagtctttccaaatttcttatcatataatacatggtaaacaacaaaatagaaggaagacttcctctaacctctgaaaagtcagaaacttttcctaggtgcctttggtattttctaatcttactctgagtattgtttccctgaaaagatccattttattctgactcaggtacaatataagacaggaaaatggatgttatatacatagatcatcaatagagaataggaagaaaaagataacgattattttgtggtatcattgtatcatgactctgaataatatctatcaattactgattactcactatgtaccaagcccagtaggcactatagaaatgtataatatcttattctcacaatcaccctatgatgtaggtgataaaatacattccaaatgacaatgccaattcagtaaaattaatcatcttgcatgacagtatgcatctaagaagtcgagggagacagaattcaggcacttatctgtttggctccaaagcctacattaattccagttttcctcattgcctctcataacagctggcacagagtagacactcaataaatgttggatgaatggatatatggatagacacacgactgcatgacttctgggaattagaatttataagagcaagactgaggccacctatctagactgtcacaaactggagatcagcctccattgttcttcctcttctgtaatttgaaaaccctaggttacaagagtttcttcattgatggtataaacattacccattctcctagtatttctgccttcacagatgagggatttcaaattcttggagcccattgtgtctcaccttcatcaccaagatctgactggggggtatctttctctagtgacgctacaacatggcatttggaaatttgcttaggcaaaatttagtcattctggtcatggagtagtgctctgccagaaaggggtgctcaaatctaacttgcagagcctttaagggaattctgcagaagctgacaaaaatattaagaccctagagctatggcatttggttttgttcttgtgcattttgcaaaggtacctgaccacccaaggaagaagaacctttttgcttgttagccttcatatttcctacatgtgggggctgcatctgcccaaagagttcctctttttctaattaacacaaaggtgatggataggccagtggctgtcttgtgcaaatctaggatgcgtttcaataagccagacccagcaaatgattctcaagcttagtaaggtttgaaaaccactggtaagagttttgggagcagaggggattcttcccaagggaagtgggagtaaattgagccttaatgagtaggcattgcttgctatcttgttaatgtattgaccctgtaaaaccaactgatatccagagttaactggcttgcagagcttgggctgagaatctttgcaagttattgtcatccaggcaataaacaataattacattatttctactccttagcaaggaggaggcaagctttgcaggcagctagtaagagttgtcagttccctccagtgaaatgttctctgcaaaaagtcaatagtcaaaaggcataatgctgtcatttcagagtgaaattaattcctcttattatttttacctgttgctctgttttcctgcagagtaaatctcagtattctgactgtgtttaaaagcatctgtatttttccaaagtggttgcttaactgatttcaactgaatttggcaaatcacactctaagaggagccagaaaactgatgcagtgacaggctcaacagtaaccaatattccgtttaatcctaacccttaggagatctggcaagggcctcatcctcctacgggacaaaaagagtttagaagctttttggggaaattatgtagtaagtgcacagcaaaaagaatgcctaatggctttgctttggggaaagaaaactagtggtaataaaaccatggaatgtagaagataattcaaaagggaaaagtggacaaacagccataatgctacctagctctgtctaaattgaattcatgacatgtatctatcacacatttcctgacaaaccatctcctgatgggaaatagagaataaacaggttatgtgaagtctttagtataatgttttctttcttggtcaataggaccaactttatcaaagatatctcccacagtctggcttcaccaagtaaatcaaaagaagtgagatgtaatcttttattatcattttttcctaaatttactatttgctcatttattaaattgaaagaatacatttattccacagtagaaatgagagacaagtaaaaaatactttagaagaaatatatccagaatatgtgtgtgtatatatatacatatatatatatatatatatgcatatatatatatgcatatatatatatgcatatatatatatgcatatatatatatgtttgatcctgaaggaagattacaaagttttcttgtactcttgggcatagtgggaaggacattagaatagggtaaagagtcctgggtcccagtcccagcactggtgcttaccagagctgtgccagtctggattctgtcaggaaacagatgatacactcaaaaggagtgactcaagaaagttaatccagcaaacctttgcaaaaatgtaggccgacttagggggagctggcaaggatggtgaaacatggggacagcatcagcaggatggcatcaccatcctaaggcagaagacaaggggaaaatttgctagaactgctgaaaagtgtgcttacaggagatggtcaccagcattgcagccactactaagctaggcctgaagggagccagagaaattagagttctcctttctctctccttctgccacctggacttacgcatatgaaccctacatatggccaaatgcaaccagaagcagtgagagggccctctgaagcatttcataaaggtgagcctctgtggcctggagcagggtacagaggaagggtacatagaactagaggggccaaaagcagttattgaacacacaaactatgcaattttgatcattcatccttgctggccttcagtaccagcttccagaacattaagaatctgagccagataatctcaggagtttattccatctctagtatcatttgtgaatattgaataaaagagaaaggaagaaaataaatattctaattggcccaactgatttatttgaaacaggaagatttagcaacttagcatttattggttaacaaaccacaggtctttttttcctccacctgctttcttgcaaaaaaaaaaaaaaaaaaaaaaaaaatgcctgtgcctgaaggttatttagaaaaactcttgaaagctattaatagaaagcagatttaaactcagtctctaaaaggcttaactttgtgtactatagttctgcctttgtagaaaaataaaaagcttttttttttaaaaaaaatagcatatagctcagattattagctatctctttgtcacaaatgtgcagctgggttcagaatttgcatgtttcccaggcaaaagaattcaataagtaagtaagcgaatcctgccattttattaaatacttacagaaaacaaaagcaaagcaagctttaactcagccggaaccagaacataatccccagagccaataacacatgttaaaattccagcaccagagccaaatttgacaaaggaacactcactatcctactactcctggggcaaactatcctaattttgattctcacactcttgcattttgagatcctccaaatatgactgctcaaagaagaaggaaaggaattaaaatggggagagctaaggtttgagatttaaaatgcactttcaagatacgtgataaatgggaggttcatgaaagttccctttataggtcagatatcatttaacttgtccaagtagttacgcttctattcagacatagggagagagagtgtaaatgaattatctcctccccacagcctttctacagacccttctctcttaattatacacatccccattgcacaggtcctgccaagcgctggtatccacagggtagatgttgaaaaaagttataattactatcttcagtctgctgctattttacaccctcagactcacggcaaaagcttacagcagaagttggcttagtgtcctaatgcagcagattcaactttttgacaatcttttattctcttcaaaacctcttcctctctatagaatttcatgttcccaaatcttcagtgataatggtagcattctcagggaatgcctggattgatgatcagggaactctttgagctagaaaccaagacaggatttctatttttattcctgtttcaatcctcatgcccagtaaaaataatgagatgtttctttaaatcatttattttatgaagaggagtcaggattatcattctttccacttctgcggcaattgggccaagagaacaaaaatatgcaagggttcagaattcagtcccctgagttctaagggctctgcccctggttatttccatgagcttgggaaagagaattaacctctctgggaaatctggaaaatgaactggtgaaagtagatgatttctacaactactttcaggtctaacattccacaaccttatttgtgccaatgcccccattctactctcagtgcaactgaacttacttgtccctcattgcaatctctaatttcttaagctcgtcctaatttcttagcacacctttctttcttttcctagctttaattttctctctatccgaccagaaactcaggagtaagaaactttgctgacacaaactgctatctttcttttctctttcttagccccatcttcttctaccaaagccatttggcaaggtctccaatctcaagactccctccacatctatactcctatgtctaagtttctaagcatgagttggcaacacctcaaacaacagatcctgctacaaggctagtctgtactgagtttataattgtttcctttcagaagtctcttcaagccaggtatgtaagtttcccatgttgaccctcatagctatttgaaatttttttttctttgctagcagactccctaaaaatatttctttctctcctctttcctcaagctctctgccttctctctctgcagataactttatttttcataaagtgattataataaaaccattttcacaatgaaaatgtgtagaatttaaaatacagaagttcatttttagtttaattacattaacataaaaaatgatcacaaatctcctacaaaaatcatggagcatttttgcatttctatatcacttccaactcagcttcattttgatttataagcttgactacacatctagctgtcaaaccagatgttgtatggaaaataccagctaagtctgattgaatttttcaatttgcctcatttgaaaccctacagcaaaacagaagtagttaagaacttcaaaaagttttagagtagagaactaattactaattacaatgatcttttctcagataatatgtagcatgaaaatacaagttaattattcacaaatgactacaagagaaaagagagaaaaacagaagacatttgttaattgaatcaaatattgtgaacatattccatctttgacattctgaaagatattggaaggttcatttaaatttgcaagcatctcttcatagcataatattccaaattaaaattttaagggggaaatacagaacagaacagaatggcataggatctatggtggatagcaactttagttttaattccactttgtgactgcccttagaaaaggggggatggtagggttaggaatagtgacagtgttgataaagcataggagaaggaaaggatctgtagaaatcttgagagtgaccctaaaatgggaatggttcttaagtttttttgctaaggactactagttaatcacaagggatcctttctgagaacaatgtttttaaatgcataaataaaaatataggactataaataacttcaattaacttgacatagttatcacaatattaaaaacacaaattagtgatacagtaatagatatgctaattcataaaatgttcaatagcaaggtcttctagcaagtctagaaactgccatcatttcaaaaaaagttacgaacataaacattatctttaaagctagctataatacctgtagtctattatgacaatattggtgatttctattgttttgtatagtctctgatctccagttcatctcattctctctcttactcactccaaaattttgctccacaattctaccaaaactgctccccttaaggccatcaataaactccacattgctcagtctaaagtcagttctccatcctcctcttacttgaactgtcagcactatttgacacagttgatcacattctccttcttaacctaccatcttcattacattcaagcatgccactcactggtgattttcttccaacctcactgggactctcttgtgaagttctcttttccatttcatcttaccaacctcttaatgttggggtgtcccaggttagcccttggaccttctcttttgtgtgtaaatttactcctttagtgatttcatcaatactactgatatagacaaatcaagatgactccagatttatatccatagccttgatctctcccctgaattctagatttgtatatcctattatctatacaatatttgcatatattaagtttgaaatgtctattactccttgaggacatttcaaaggcttaatagacatttcaaacttaatacatgcaaagtgactatcctgatcttcacctccactccctccccactaaacctattcctcctctaatattctccagtccagttaatggcatatggaggccaaatgtttgaagtcattcttgatgtttttccttctctctcaaagccacttccaactcatcactaaattctatgattagaagactccacgctgtaaatgtaacttaagtctctcattttactaaccatattgccactactctggtttaagccaccgttattcctgtcttggtttattgaagtaaggcttccaccttcacctcatctcaaaatgtgggctagagtgatcatttaaaacataactcatagcagtcactttcctgttcaaaaccctctagtgacatcccccatttcctcatcatgaaaggcaaagtaattacaatgcctcaaggcctaacagaatttcatacaatatacattttctcactgaccttatcacccactagcctctctttggcttattacaggaagagaacttcctcatggtctccgtacttacacctccttctgcctataatactcttgccccaaatgtctgcctcctcaactcctctaagtttttttttgttttgttttttgtttttgtttttgttttttttttgagacagagtctcactctgtcgctaggctggagtgcagtggtgtgatctctgctcactgcaatctccatctcccgggttcaagcgattctcctgcctcagcctactgagtagctgggattacaggcacgtgccaccacacccagataattttttttctatttttagtagagatgggatttcaccatgttggccaggatgttctcgatctcctgatctcgtgatctgcctgccccagcctcccaaagtgctgggattacaggcgtgagccaccgtgcctggcccacctcctctaagtctttattcaaatgtcccttcaataaggccttcatgataccccctacttaaaatggcttttagaattgtttctccttattttactgttctccaaagcaattatcaccatataatatagtacttattttattcatttgtttatctgtcttgcccaacaatgcaccccataaaggctgagatttttgcctggtatgttcacagatctctccccagtgcctggcataaggcaagaattcaataagtagttgttgactgaatgaatgaatgaaggggttctttggaatcttatcttccaggaagtctagcacatttatccattgcagtaagactcacacatacttctacttgccaaaactatatcatactctgtaaattaaccaaaattattttaaatgtgatgcttgaaataaaacaaagctagtacttacagtatttgctatagaaatactgtaaaaactaactagtggctcacaaccacatgggacagtgcatccacaaggagatgcttcattatgccatggaagagcaagcactttgacacaaacagacttttagctttgaactccacctctgcaacttgtgagctgtgtagcactgggaaattatttacctctataagcctcagttatttgcttgtagtatggaaaatgtgattatatgattaatgcatcttaaatgaaattatatgcacaaagttcctgggcacttgaaaaagatgatcctttcatcattcctcttgacaacgattactttccaagtagatgtgagcaaataatagtgtacttaaaaatggtcaaatataagaacaggattggaaagactgtgatcagatgaactgatcacctgcagtggtagtttgggtagagaggtttactgggttcaccctaaccctgacagttcccacaaaaatgatatttagatcccttttcagggtaaggtatagagggcatgtcgaaaacaggttccaaaatagaaggagaccaagactctattcatgagaaagagcagggtgagacattatcatctgaaatggaaggtgacaaagccaagcagaatttgggctagaaagtggtgttgccccattctcaaggatttgttgttttatcagtgcatagacatcaattttttttttttttttaagatggagtcttgctctgttgccaggctggagtgcagtggcgcaatctcggttcactgaaacctccaactccctggttcaagcaagcaattctcctgtctcagcctcccgagtggctgggtttacaggcatgcaccaccatgcccagctaattttcgtatttttttttcagtagtgatgggttttcaccatgttggccaggatggtctcgatcttctgacctcgtgatctgcctgcctcagcctcccaaagtgctgggattacaggtgtgagccaccgcacccagccagacatcaatttctgtccacagtaacatcgtaggaaaaactttgtcacactgctttgggattcagcacaacattcttctctttccttagacatttaaagtatgaggattctacattgaagagcaggtcttttttttttttttccgcatttcaatctagatgtttacattggtgggggagatacacttagaagcagtgtgctttttcataaatcactctaccttgtttctctcatactttaaaattacatacatttttaaactggcacaaaagtactgtcttgggagaaggcaagaaaatagataaaatgttcatcagatgataacaattgtaaatattcataaatcagggaccaggattcctatttcctaaggaatgtgctcagcctgggagaaacctcactttagaccagtggggctcttgggcactttcatcatgacatttaaacaataaatgtatctgtcaggtgatggtggattcacttcggaggaactgacacctttgatgaccatcacaggactgagtcaccaattatacctacagcctgcacttggttttcttctcttacagaatttcatgatccctccctaaaactgataaggcagcatggaagtaggagggaaaagggaggagataaagcagatgagaggcagactgcaaacccatccagctttgcaaggactgagcttcatcgctcacagaaaagtcaagttcaagtcacaactcaaaattaaaccctgactaatgtaaaaaacctgtgtttagaaacattttacacaaaagttacattttggaataatagaaaatttaaagctattaaaaagcaataaaataagatgaattctgcaataagattgccacgttccactcttgaattaaagcaaacaagcaaatatttccttcctaaaacttcctgcctttattctgctggcttccactctgtgagggccaactgtgggtcaagccctgttctttgtcccatgccaaaaagacagctgggagccacggtggaaggcagacaatgccctggatttaggtactagtctcctccaggttgtgtttaaaaagctgggtttttttggggtttttttgtttgtttgttttttggctcggcatggtggctcatgcctgtaatctcaacactttgggaggctaaggcaggtggatcatgaggtcaagagatccagacgatcttggccaacatggtgaaaccctgtctctactaaaaatacaaaaattagccgggtgtggtggcaggtgcctatagtcccagctactcaggaggctgaggcaggggaatcgcttgaactggggaggcagaggttgcagtgagccgagatcgcaccactgcactccagcctggcgacagagcaagactccgtctcaaaaaagaaagaaaagaaaaaaaaaaaagctgttttttttttttttgtaattaaaccaaactaaatatttcccaggagggcaagacagttcccaaaatgtctaacgaacttccacgtagagaaaacggttactgattgtcccaaagcaaaactgtagcaaagcctttccctgaatttttctctcttccttccatcttcttttatttctttgctcagtcaaaggccgcatatgtttcaaaggatacttgatataggagggtagaacagtactttcagcatgcagattttttttctatgttaagtgaaaataatgatttcatgaaatgtgccttcccatcattataaaacaattttgagagaaatccatcctccttggcaattccaaagcctgttgtttgctttgcaagcactatataagtctggagaggggcctgaaattaatatagctcagtaccataaaggcagtgtatagaactgtagtcaggacttaagatttgagtcttttgcttccttcactttgacatattacttgagaggcctgtacctcagtttcctaatttgtaaaattgggataacaatagttattattttatagtgccattttgaaaaatagtgaagcttctgacagaagacctcaataaatgttacatattttaaccatcagcattaataaacgaaaacaattttccctatttttggtcagaatttaggaaaaataagttccttttaaattatgtgtagacaattaaattaatcttttaagtaaaaaagtcttattctcatttttgatgtacagaattttagcatcatctaactaatcctaaaagactttgtataatgaaatgaaaaattaatttatttgatgtcattactttttaaaataaccaaatgtcatatatttatcattttaaagaattaatatgcagctgggttaactcggctatgtaatatattttttttttcaggatatacctttcagattattcaaagaaatagctaaaaatgagctatcagattcaaagaagctttttaacatagccaactgtaggtcagttttagtgttaaaaatttaatagatcatacacctaatttacggcgagggggaagcagtggctacatttaaccaaaataagatgttcttctacaaacattaacataagaataaaaaccacaagttttggggtgatcactgataggcaaaccatatttagaacttagcagggttctaaatctgtaagaagaaaataaatatggaaaaaaacaacatgaatcagtgtgctctcacatctccatatctctgtgttacccaacatagaactatagcttatttaagacatgtttagtagcttttcccatactttcctgaattcattccctgtttcaaattcaactaaatgggagaattagaagagaaattttttgtatttggatatcatggcctatcttacatttgatatatgctattgcaattttcttaaaatataagttcatagcgcaaaaagaaatattaagtataacatagaacctggtaccactataagcaggtgattattaacactccattaggaacgttgatggttctgctaatgaaacaatggttatagcaaaaaatagactatttttctggaaacgtgagatttttcttatgtgtacaagcacatacacgcatacattagccttgacataaaccatgaccttctatttgttaacaattaaaacattgtcttatataagcccaggtcatctgctagtggatagatatagatataggtatagatagatatagatatggatatagacatatatatatatagatagatagatagatatatgtagatatacatatatctacatatgtgtatatacatatatacacacatgcatatatatatacacatagcatgcatatgaattacaattaattaatcaataatggtcccatctggttaactgcattggaaaatgacatctttccctcagcaatacaagatttcaaccactacttgcatctgcaccctctatacctttaagcagtatgcaaatgatacaaccatatgaggcgggactatgtaaaacagtccattaaaataattttcccagatcaaataaaaactgacacattttctaacatttattaagaatttttaaaaatgaacgttctaaaaatgaagtcttaagaaaattctgaggtgtgaaacataaagataagagtgccagtgagaaaaataatctgtttagtagatttaaattatcattatatttcaccaaatcctgttaagaaagaatatatcccctcgaaaggttcaattctacaacaatgagtagttaataggttcttagaagggaggaagtcattgtactactgaatagtaataaaatctatgattcagtgtgtttcaaacatttaggaatgctttttgatgaatgggttttttaacagctactgaattggatttgtcctctttatataaaagtctaagtctatactaaaagaaaagaaatttatactctgagcatgaagttaccacttggaagtagttctttgccccatgactgctgagcctgaaaaacccaatctgtttctagaaaaaacttgccaacaaaatccacagaatttattagatagaattactcaagagcaaaataccatctctaccatcatcaaataagagtatgttgctggctgtggattttggtatagttttaatttttaaaaacagtttccaaaacaataccaagaggcagtttgattctacagtatggcaagtaaggaatatcagacactattttagagtatatatctaaataaatattatatatatatataaaacacatcgaaaaaagatatacatacatattagtttgacattaagggaaagaaattaaaaaaaagagacaagatgaatttaaactagagaaaatacaattttagaaccacatttaggaaagacaaaatgaagaaactggatatgaagaaagttcatatctaaaaaaacgtggttagaagcgattggattcaggagtttctgcaaacaaaaaggttgtctcctcagtgcctaaaacagcacctaacagagaaaagacactcaatacatattcattaaaagaagaataaataagtggctatgaaactgggtatacagcaccatattgagtcttaaagttacatttttaataggttaaatttaaatacatatttttggccgggcatggtggctcacacctgtaatcccagcactttgggaggccaaggtgggcagattacttgaggtcaggagtttaagacgagcctggccaacatggtgaaaccctgtctctaccaaaactacaaaaattagctgggtgtggtggcatgtgcctgtaatcctagctgctgggggcgctgaggcaggagaattgcttgaacccaggaagcggaggttccagtgagctgagaacacaccactgcactccagcctgggcaacagaatgagactccatctcaaaataaataaataaataaacaaatattatatgtaaatatatatatttactttatgagctatttcttttaaaataacatccattgctttattttctgactgcaaaagcaaatatactcattgcagaatatttttaaaaatcaaatattaataagaaaatgtaacataatattaatagacagataaaaccaccagcaaacattcatacatctatgcacaggcatttatatttacaaatgtgaaatgatactgtatatcaattttatgtcttatttttataacttatcattacattgtgaacatttccatgtcattaaaacttcttcaaaatcatgagttttaatggcctcatatcgttccataaaatgaatgtgcaataattgaattattatgctattgatgcacatttgaataatgtataatatcaaaaagttggggagaaaattttaagcagctttatccataaaactttaattgtatcttggattatttcctcgggatacatttttatatgccaaattgctgcatcaaaaggacagatttagcatttttgatccataacaccacactgttttcatgataatttgtattataactgctcccagtagttatgaaaatttttattccatgatacttcaaactagaaattttaagatctcttttacaatttgataggtcaaagctgatatacttcaaacttgattgctggtgagattgaattttttgtttgtttattaactatttgtacttcttttgtgtgagctgcctcacatttgaggagaaaagctgcctctcacaacattcataaggcttcctgaccctagagaccctctatatttccacaacatggagagtatctgtaactcctatcagaaacatcttagtgaaacagcatgaaagtttatgaacctcaggattactacatgaacatgagagtaacagtactgacctacctcagagatttctcccacatcattattacaaagtactataaggctagaattgacttggagtcaaggcgagttccataggtttaatgcgtggcacctatctcaacaactgcaaaatcactgtaacttgtaaaaaatcccagggccactcatggacagccacatctttaaacccacacaaaaatacagacactttgattacatgaaagttagaagctctaaactagagcaaggtcagttgtggtaagaaggtattagattcaagcatccacaaaagtttatagtctgtcagtcataaggatggctattgggatttctttacagttactctgttgtattttcactttggttttacagcactatctcttaggaagtcatccatatattacctgcatacacagtcagcttcttctcgatatacagcagatatgtaacaattattctttccttcccagacagtcatggtaatattacatttgagttcagtgaggtaactggtagccagaaatactccacaaaaggtctatattcttgggtgggggggggatacaattcttctattagggaaatttttatcacctacttatttttacataaattctaataatgccaagaaaatacatttcaaagaggaaggtatagaaatttagagatgactgtgacctcaaatatccatgaaatataaccagaaaatctgcatctacataatgacactattttcacatagccccaaaatgatatcttagaaagccaaaaatctttccttatctccaggcagaactatttcaaaagataacaaatgattgcccaagtgatatttgaattataccaaaaaagagacagtatatacatggtaacaccatcctctgtgtattatttcctcttggtagtccttctgtttttcaagataatacagatctcaagaattctcaatgttcaagcaagaaaattccctcaaccaagtgaaatagaaagaagttatctattaattgtgccaggatttcagttgttttctttcctttcttcttttcatgcaagtttatttgcctttctatgagtatttgcattatttgctctttttcccctttgaatcatcttaaaggaaaaaaaatgaaaatgtatctatttggactttaattacactgggcagcaatgaggcaggatagtgaagttaaaaaaaggctgggtgtggtggctcacgcctgtaatcccagcactttgggagaccgaggcaggcagatcacaaggtcaggagttcaagaccagcctgaccaacatagtgaaaccccgtctctactaaaaatacaaaaattagctgggcatggttgtgtgagcctgtaattccagctactcaggaggctgaggcagaagaatcgcttgaacccgggaggcggaggttgcagtgagccgagatcgtgccactgcactctaagcctgggcaacagagagagactccgtctcaaaaaaaaaaatacatacatacatacataaacagtgttagaataagcataagactgtgcttaaatcccaattgtactctttataatttgtatggctttgtgccagttttcatcttctttaagcctataaaaccaggagtgtaattcactcctttactatgaggattactttatgtaatgcacctagtagagtgcccacttagagtaaacactcaataaatgacaaatgtcatcattataactgtgttggtaagaacaggtaagggtataaaccactcccacctcactgaatttgcaggcaattcctggcaatagtgcccaacaaagagaaaatataccataaacataatttattttaattacaagagaccctgtcatctctactattattataaattaacaataggttcttctctttaatatttctcatttctgagccaaaatcattttttttcaacaaggtcagagcatattcttttttttttaaacatgctaatgtacttcagtatattccattctgtaatatttgtttcaggaaatgaaaattaaattttctttaattaacccccatgactcttgaaaattttcctcattgtccttgaatctatggtctttaacagtctttataatatcttgaactctacactccactgagcttttaagctttgtttagtgttgccatagcacacctactccttatgatagaatatcgccttctcaaattaacaacatatagtcaatttattgtggttttccagtttcactggaatgaacaaagatttctttctctcacaggctaaagttttctccctccttcattattcggcttcagagttcaactcctttacccacatgacataatcagctcaaaatttattatactatatatagcatcaaagaatacatttttttagagatgaaatgaggtctatgttgcccaggcttgcctcaaactactgggctcaagcagtcctcctgcctcagcctcctgagtagctggacctaaggcacgcaccactgtgccttgcagaatacattttattaacgtaaaaatcattattttcctcttacttctgcataaatggtatttttggtccatttgctctcggagaatagttaactttgtcattaacaggcccatccagattgttttattacttcagttgataaaaatttatttcataaagtgctttttctaagtaagacatgaacataagcaaacccataatattaaaagctttatatagatacaatttaaaggttctgtcaaatagattttttttttttttttttttttttttatgaaatggagtctggctctgtcacccaggctggagtgcaatggtgcaatctcggctcactgcaacctccacctcctgggttcaagtgattcttgtgcctcagccttctgagtagctggaattacaggcgcctgccaccacgcctggctaattgtctgtatttttagtagagatggggtttcaccatgttgacaagtttcatagattaaaaagtaggataaataaatacagtagagagaaataacatttcagaaatgtcagtattaaaaactaagtcaaccacaagcagttttacatcatgtttacaaaatatgctataatagtaatacacttgaggagggttaaaaatggttctttttttattgcttctcagccttttggctaagatcaaatgaacagttctttttctaattgttcaaattgatttcatagtcttgtaatctacatatttatgaaaaataattttaaatctcttataaatatcaaaaatgtcagtttccaattgaaataaaacagtattgagtaaagactataatgtatgagttttgaaaaagaaaattgacaattagaagaaaatttcataatattcattgtactaggactttccacatttttgatatgacgctaacatcaatattacaatgaattctcaataatttgtattaacaaatgacaagaacaatctgaactaaattgaacaataaagtatctgtaagcttagaagcattaatttcatagtaactaaacttttggtaaccaagcaattctatatagaagacttttaagtatgcccttctaagtttgttttagtaacattctcatttataattagcaatatataatttattttttaaagtgctaaattaaatacactctcaaataattttgttagactattaaattacttattttgtttcaagacggagtctcactgtcaccccagctggagtacagtggtgcgatctcggctcactgcaacctccatctcccaggttcaagtgattctcctgcttcagccttcccagtagctgggattacaggcacccaccaccatgcccagctaattttttgtatttttactgagatggggtttcaccatgttggccaggctggtcttgaactcctgacctcaagatttatccccctcggcctcccaaagtgctgggattacaggcgtgaaccaccgcgtccagccttatttatttttaatcaactttattgaaatataattttcataaaacaaaatgcataaagtatacggtttaataggttttaccaactgtatacaccagtgtaaccaccacacaaatcaagatataagaaaatttctatcaccaaaaaagttgccctgagtctctctgtagtcagtcttcttatgccctaccagatagccactgatctgtctctatcaccacagattaattttgcctaatttcgagcttgatacgaatgaaatcattcaatgtaggtttttgtttcttgctttcttttgctcattacaagtttaggcctacttctgattcacagcttctggtgacataggctggagaataagttattccttaagaagaaaggagtaatctaaaaaagtgcttcttagcagttcattcattttaattgctgagtaatactcccctgtgtattcctatacagcacactttacgcattcacctgttggtgttgatggacatttaggttgcctccagtttttgactattgtgaattaagctgctgtaaacatttatatacaagtcattcgccagcatatgtttttatttctcctgggtaaatatttagaattgtaattactggttcgtagtgtaagtgaatgcttacctttttaaagaatcttctaaactgttcttcaaagtggttattccatttcacattcccatcagtaatgtataagagtttcattggttcatatcatctactaatacaacacttaatatgtgactttttgtttttgttttgtcattttaatgagcaggaagttatattctcattgtggttttatttttaatttccctaatgactaatgacattgcacatcttttcatgtgcttaccaaccatttgtttttttttttctgaagtgtctgttgaagactttcatctatatttagttgagttgttttttcttcatattgaattctaagcattcttaataatacattttttttaaggagaaaaaagtattccagtccaggtcagcacaagctctgagtcaagaataggtctaaaatccacagatgcaattctgaaacaataggcctggaatcaaaggtagctcttgatgaagaggagatgagtaatctggtattttagactccattaagactcgccattttgtagctgaccaaaagggtcattctttagtcccatttaaaatcggcatttcatcatttcaaaaatcctgcttcaatctaagcaaattatcatgtgattctgcaattgatagctagctcaataactgatttatttgataagagggaacacttagaaaatatacagctctcatattttctaataaaggtattcacatataattaatagtaataagtactatctgtgagtagtatgcacaacatgcatgctgctgtcttttgcaaagtattaaagcagatgcctaagcattgtaggtaaggatgtacttgacttagttatgatttgattaaatgttccctgttcagattggcttctgaatcatcagctactggtgtaagtaaaaataagttggaaaggtttccctttcctgaggatttcaggaaaagcttcgcaactatttggctggatattgcaaatcagatcaagaattgggaagcggtctgtctttgacttatcttgcactatccaattctatgagtctatgattgtcatgtacagagcacttggcttagtggtttgtgtataacttttcaggattagtggtggcattgagctggttcatccacaagtttatctggttctccatcaagctaagttcgtcctatctgcagagcagacacagtatttctgctctttattcttggctgtttcctctatttagcactcctttctgtctgtttttctaagttaacacatgatattttggtattttaaactccattaagacttgtcattttctatctgaccaaaaatcttggtcttcttcaatcagtatatcaatacctccttataggaaaatatataaaagtcatttattctaaagcataaattatagaccaataactgcttaacatgctactgcagttaaaaaccagagttgattcttttctaccaactgccctctttaatttccctgtataaaaggcccaataataggtcagttagtccacaaaattttgttgaatacttactgttaggtgctagtagctttgtattaatgaaacaaacattgttcctgcctttgtaaaacatatgttcttgtgagaaggactttaaaaataatttaaagtaactcatgaaataattataagtatttctaatagtgcaggtgagaaacagtgttggagaacatagaaatggaatggcggcactaatatagggaatcagggacgatacccctgtaaaagggatatttcagctgagacctgaaattaaggaactggtaaggcagaaaaagtagagaagaacatttcagacaaagaaaaacatgtcaaacatcctctcgactctggaacccacatgacctttccatttttctcaccaccacttctattcttgccttcatctctttttctatagattactccaatagcctcattactagcctaccctacaaagtgttgaaagatgtcttcatataatataactgtaatgacatcatctcttcctaaaaatctacagtgacttccctaaagaaaaatggtcatattcccaagtttggcatttttggcccttttcaatactaatcaaacttacttttccaatcttattttcatgacttttctgccacactgatctatttactttcttcgtcaatacaattttattctctgaacttagtgctgttttctcattattcatttcatctagagtaagtctttaaatttcatgtaaatgattattttattggtaaaatgtataacaagtcacaggcctcttaggagatacccacgtttttgtttttgctcttgtttttgtctaaagacagtgattgctttccaaataactactttgatgtgcttatcatttggttactgaaatgaaccaaaatttaaatttctagtatgggcgagtttattgggcctttcaggtgaaaatcaatgtaattttatatctacaaatgcttccaggagaattagccaatggttgatagttccattgtctaaaataatgacctaatataaatcaatgggaaaatagattaaggcttgaaatggcaagatttgtttaaaggacctataatgggtagaatatataaaggttggccgggcacggtggcttacacctgtaatcctagcactttgggaggccgaggcaggtggatcacgaagtcaagagattgagaccatactggccaacatggtgaaaccccgtctctactaaaaacaaaaaattagctgggtgtggtggctggtacctgtagtcccagctactcaggaggctgaggcaggaggattgcttgaacctgggaagcagaggttgcagtgagccaagatcacgccactgcactccagcctggcgatagagtgaaactctgtctcaaaaaaaaaaaaaatgtataaagatcatatgatatgaccctcagcctaagcttagcaataaaactttagaaactacaagagtggcctctgttaagagctcacagaaggaacaattttctatgcttcactgtcacgtgtaaaatagaaagccagaggtacttcagcattcctatctaaagagcttccaaatgtgctctaaatttgtagatgtaagctgggccttgtatgttttaaaggttaaataaatcttcagatagctatctactattgttagataaaggagtcaactttttgccatagcaaagtaaaggaaacaggattctcttttctgagttgggtggatagtttttgtccataattctgtacttccaattgtcactaaagatatgtcatgctttatagcctcctatatgtctggatcacttgtgctttcatttggaaacaatacaaaatagtttataaatgtaagtatccttgtttaatacttatggaaccaaaacatattttaggaaaaatgacacttagtcaaacttttattcctaagtgtggaataatcaaggttgtatatagaaatccatactttagtataacatcatgagtgaaataaatttgcacacacatatatatatatatacacacacacacacacacacacacatgcgatgacgttcctgaaaatatgatcctagataattaagagaatggggagttgctattcaataggtataaaatttcagttatgcaagatgaataagttctagagatctgctgcacaacatagtgcctagagttaacaatattgtattgtgggccaagtgcactggctcacacctgtaatcccagcattttgggaggccaaggcaggtggattacttgaggtcaggagttcgagaccagcctggccaacatggcaaaaccctgtctctactaaaaatacaaaaaactagctgggcgtggtggtgggcgcctgtaatcccagctattcaggaggctgaggcaggagaatcactttaacctgggaggcggaggttgcagtgagtctagatcacaccactgcactccagcctggatgatagagtgagactccatctcaaaaaaaaaaaaaaaaaaaaaaaaaaatatatatatatatatatagtatggtgtacttaatatttttaagggagtagatcttatgttaagtgttcttaccacagtttttaaaaagagagaaaaaaacagagctgaaagaaactataaatagcaaataaaaattagcaattcataaagttccagtgaataaatacatttactaaacctgtcacattattttataaaggatttttatttaattaaataaaaagtagcatgaaagcaaggcctgacatatgcaacaaatgtggtcctaaattattgcttagcctgaattattattaactgtattttatgtaaatttcacaaagcctattatttgaaggaagccattactaaatcttgactagcgacaagtcccttgttaaatagccactcctcacatacttatttccttttttttttttttttttttttttgagacagtcttgctctgccacccaggctggagtgcaatggtgcaatcttggcttgctgcaacctctacctcctgggctcaagagattctcctgcctcagcctcctgagtagctgggattacaggcacccaccaccacacctggctaatttaatttttgtttttagtagagacagtgtttcaccatgttggccaggctggtctcagactcctgacctctagcgatctgcctgcctcggcctcccaaagtgctgggattacaggcatgagccaccatgcctggtcataactatttcttaagtaggacttttagaattggttcatcctaaagtgagataagcatacatgtatttgtgaaaatagtattcaattgagttttaatttgctcacagtattagaacacacctatggaagttttcctcatttttatgtatatttatattaaaagaaagaatgaaaaatttagtaatgtaagagtttctggcataaaattctgtatcacagaagctggaaaatttcggcccagggtgcagactcaggcactaacttgggggctttgataatgactctgccatacttctggccatgcgacctggaagaatttgttaaccattctatccctcaattgccacatcagtaaaatggggagtataaacagaacttagaacatagatgtttgtggggatgaataggattatataggtgagatacagagtactgttgtgcacacattgagtgcccaataaatgttagctataatctactttatcactatcataatagaactacagctttttcaaaatttcccaaaattttattctatggagaaaaggtcctttgaaagaactgacatttcctggatttgaaacactagactgaaaaacaaagtaaaacaaaatagaaaaagcctgtttttgtattttgttgtgttctgctttgctttactttcctcaagtactgttggaacaccagggggttccatcaagtttttattcttttgtgttcaaaagaagaggaaggaaaacaaggttatgcattggcactggagacacttttttccctaaaatgtttagaggcctagaatgtacctaataacttgtaaagcaccaactgtatttcctggttactaatcaaatttgtttctatttcatttctgagccaggaaggcagacacaagttataggtaaatgtcaggtgctttaactgacctacggcagtcaataaccagtctttcctcccctgatgaagtcaattactaatttagagaccactgtgttccttgtctcttctcctaagccaagtataccacaagtcaacaaagataattctttcagcagccaaacactagggcgaggaaatgcttactgtctgcttgctctgttagcagcaaactatatagggaagccatcttctggctcacacagagaaaagagaaccctggcactgccacagctgtcactggccttttctgtttcccaagcaaaaatcagaattgaacaggaaccaaaactattgagaccttccttctgtttcccaagcaaaaatcagaattgaacaggaaccaaaactattgagaccttcctacccacctgtgattaaatgagccaaatgagtagcaacgtggcagatggccctacagttaatgagattcttgcaagcccgcaattctgttgaaataaaattttgtcacttcagttttcagtacaaaattgtgccaactgaaccctccaacacttttctccaaaatgggaatcgtcaatctcacaagggtccattgtcagaggacaaccttcatgtacaagagtgttcaagataatcttgaattttgtaatggtctggaattgctatgactccctgtacaccagaactttcttctcacacattgatcacttcaagcatccacagtttttctttttctttcttttttatttatttatttttgagacagagtttcactcttgttgcccaggctggagtgcgatggtgtgatttcggctcaccccaacctccacctcccgggttcaagtgattctcttgcctcagcctccctagtagctggattacaggcatgctccaccatgcctggctaattttgtatttttactagagagggatttctccatgttggtcaggctggtctcgaactcctaacctcatgtgatccacctaccttggcctcccaaagtgctgggattacaggcgtgagccaccgcgcccagccacatccagtttttctagtagtttattcctaaatcaatatcctgactacagttaagcatcctaaaaatgaatgattacatttatagctgttttctttacaccttcatctatatctctaaatattgttctgattagacctcctgctttaaaacttcatcagctcactcaggcataagtcaccctgcattctgcactcttctggattttgagtccctttgaattgccactgaccatatgacttacccatccccatttccatttccatttattttttttggcacttcaacctcagtatctttctcctcctcctcatttacagcatatctccattgcacttctggccaacttccatagcacattttcttccttctgtagctaaatctaaatctgcagctgttttaatatggcatctgtggttaatttttagtacaatattgcacatattgaatggcagtaatgcccaatgctactgcaatattatgcaagacatcaaatggatggaacctattaactcattgcaaactcatgcattatgaacatggcatagcacttacctgaaacatacagtacctgtatggagaaactacaggttccttcaacgacttaagaagtgaggacatcgagcacattgcatcatcttcctgctgctgcagtgttctataattttcccacttacttgctcccaaagttgcatcaaaagaacaaagagaaaatgaaatccacaggaagctcccaaaggctgcctatttggctcagctgtctgtcgatttttctaggttatgagattgctcttggtgacttttgacaatatgagaacacttccctcacctttaatgatgaggcaaggggctccatacacataacattagatagatgagaattccacgaaaaaggataagccatccaatatgctagcatagaccaagatcttaaaataaatacatttgcattctggcagtttgaacagcagagttatttggaagaatggcactaaagagaatgagcccctttaagggcagccaagagctagattttgctagttaagcatttaatgtaaaacagaggccaattggaataatcattttgtactggaaaaaagaaacacaggctttggagtcaaacagaattagtttcaaataccagccttgcccctcagtagtggggtgactcaggcaagttactaacttctctaaatctcagttttttcacctctaaccaaggataatgcattccttacacacttcttgagaagataatttgatgtaaagcacccaggacaatgtttggtgtatagcagttacttcaatttttgaaaggtggcatacaaacataattatagcaggctttggcaggaagaggtataaaatattatcttaagaataaaacagtaggtactgaaattagacaaagacaattgaaatagaaaaaaattgttaaccttgtgaggttatataaaatagaataaaagagatcaatgaatagataaggtcagatggcaaaagataagctaagtaataagacaaggaagaataaaaggtgagagaaaagaaaagtagcaaatagattaaaatgtcaaaatacaggtatgaatggagtcttgcctttccagtaagatattatgagaacattagggaccctaagagagaagctgaagtccttcagctgacctggtaggaagaaggggagaagcataagaccccagggacacaatgcaagctacatcttaagcagactgtctgcagagggcttgagccttccagctctgaaggcgccctcggctcaggcagcactaaaggaaatgcactaatgagcagaagggcaggttgctgagagcagcgactgccgaacttcctggtcaagcaggggttttttgatttcataaatcaattacaatgtgctatattgatttcacaaagtcagcaggacttaaaaactaatgagcaaatttttttattattatttttgaaaacactgcagtgtctacagctcagcacactcggcagaaagacaaatggaggctttggctgccacagatttcattccatcctagccccctcccagccatgttcctcatctcagcatcagcaaagaatcaggagctggcataagaccctggtgcattatgccaacaaatctctccctggtatctgaagcaggggcagccccaactaatgtgtctgtgtttaggcactagtgagttttgtacgggtgcccaggcatccccagatggagcaaacaaggaaaagaacaagaaacccacctaaccaaggatataaaatacagaaggactgcatttgtgattgtggttcttaataggtagccactgccattttcttcccaaccatggtaacatctaaactggagtttttattgagctatttattttgtacaacatcaaacataacaaaattgataaggagattattctgccactcaacccctggcccaatgccaacagcttcagaaatgacctcaggtggagggaggcatagatagtttagtctttctccacagcaaaataaattatcccatgatacagtttttaggaaaaaatgcaaagtgggggataaatacattctgctaaaattttgctgttaaaatgtactacctgttaaaaatgtaccattctagggttgaaaaataattaatgttaaaaataatagctaatgttttagcacttgctaggtgataggctctatgctaagtcctttgcatgcactatgtcatttaattcttagaacaacggtaaatggtagatactattattatctcaattttatagttgatgataatcgaggcttaggtaggctaaatatctcctgagtgccatgtggtaagtgacattatgaagtctcatctgtttacactagagcctgtgttcattccatcagtaaatagttattgagcacctaacacatgccaggtactattctaggagtcatccgctaccaaaaaaaacactttttaagtcaagacaatgtatttaccagaaatgaaaatatttcaacgaatgatgacgttctttcagaatatgatttcatttattgtcaggattgagaaccagaaatccagaagatagttgataaactggctaaagggaaactaagagaataccaaacattattcttagtatgtgaatacaacaaattagagtgatgggggaacaagaaggaaggttaaaagtctaagaagttaattttttcttgcatagaggaagcagataaaattgaccaaatgtaaatatgagagaaagagtaattactagaagtaacactaaggaaataaaatctgtgtttcttaggaagtcattttgtctcacaaacacaacaaagccatgaggatagattaaaaaataaactgctacataaacttgatcttcaaaatacttctcaatgcgttcatgattccttttaatattattagagtaaatagtaaatatagcctgcagaagttttaccctcttaattttcattcctttatgctttttttcttgtatgtacttgatgactaaagtcacacttaaatgacttaagaaaatgtgctacaaagaaaggaaaacgaaaatttaaataatttatttttggtaattttcctttcactttcacaaaactcacaaataaacagaattaggtaaagacatgccccacaaaatactgccttttactgacacacattttttgctctgttttggtgctttttttttgtttaagtacaataagaacattaattcaaggtaggcacctgcctagatcccaccctcatttcctacaatcctctctcttcttcactactgttgagccaaaatatttcagttctacaaacatacagagctcatccctgcctttgtttctttgtctcagatttttccgttgtctagaatgttccttcctagatattttccttatggctgccttctgcaagactaacattatctaatacttcaccacaaaggtatttcctaccacctttatcagtcatgggtgagtaaaaaacaaatcaggtactcatatagtttatttagtaaaggggtgatttatagtaatatagtgattatttattgttataaagtttaacaatatgatagcacatataatgcagaattctgtactacaagagccagggaggagtggttaccaagggtgagagaataaaggaagaaacagttcctacagctcagaacatgaaaatataggggaagggtgcccaacaggaacctggccttaggtaaagaaaaacactgccaatcagtggggagctggcagggaggatccaggggaaagtatacccagccctcctcctcccctagttctcaaatcttctgcagatggttcccattggtcaaacacaaccagaggccagaagtaaggcagaccaacgacagagtccataaagtttggtcttctggagtggaaagcagaatggagaagggcaaagagaccaggaagggcaggtggaaatgatcatcaagaacccaatcccattgcccctagtcacttcctaccacattctttctgtttgtttatttgtttgtttgtttgttttttgagacagagtctcactctatcaccatgctggagtgcagtaccatgatctcaggtcactgcaatcttcacctcctgggttcaagcgattctcatgcctcagcctcccaagtaactgggattacaggtgctcgccaccacacccagctaatttttgtatttttagtagagacagggtttcaccatgttggccaggatggtctcgatctcctgacctcatgatcctctggccttggcctccaaaagtgctgggattacaggcgtgagccaccatgcctggcctcacattccttcttttaattatttgcattgtacttacaattttgatattttctttttagtttgtgcatctgtttaactaactataaattccagatttgcctgtctggttaatcagtatgtcccagagattaaaccagtgcctgtatactttagatataattacttgccagattaattaaaatagcaagactgctgggcatggtggctcgtacctgtaatcccaaggctttgagaggccgaggcaggcagttcacttgaggccacgagttccagacagcctgggcaacatggtgaaaccccatctctactaaaaatacaaaaattagccaggcatggtggcacatgcctatagtcccagctactctggaggctgagacaggagaatcgcttgaacccagtaggcagaggttgcaataagccaagatttcaccactgcactccagcctcagcgacagagcaagactccatcttgctaaactaaactaaaataaaataaagtagcaagacctctgtgattaaaaacaatacattgaaaaaactaatcattcatgaggaaatactctgtagtttataggagaatgatacaaaatgatacctcattttacctgacaagaattttagaatgaatcaactatagtcaactataccttgtaagtcaacttttacaactccatggctatcaggctaatcaggttgatttatcatatctagcaaaacagagatcatactacctatctgcagttaacatggcagttaaataacacatatgatagtcaatcatttctccatcaattaatctattaatttaacagatgtttattgaacacctactatgggattacactagacactgtgaatacagaagtgcaccaaatagccaaaaatcactgtcttcatgaagtttatatttgaataaggagtcaaggtcacatcgtcagaatgggcctcactaataagctgatacatgagccaagatctgaaagaagcaagaagaagaaaccaagcagatatacaagattttctggagagaaagaatagcaagtgcaaaagtcccgacgtgaagtccttttagcattttagaggacagcaagcaggcaaagttgtctagagccacgtgcgtaggttttgaaacacggacacagggcaggactaagggagagggaagcagaatatgttgtaaggacttaactttttctctgaatgaaacgggtggccacaaagtggcacatgacatgacctgattgacattgtaacaggggagcaaggcagaattagagagacagttataagagtatcacattgattcagatgagagatggaagaagtgatcatagtctgtggacttatatttgaaggtagaggtgaaatgatttcttgatgatagaatgtagggctgaagaatcagaaaggagtcaaaaaatgctgaggcttggggtcttagcaatccgagatgcccagaaagactttgttatttgtttgtttaatttattttccagttaactctgaaaaagagaggctcatccagttgttatttacctcattgccatgaaaattcatccagttactactgtctcattcccaagaatcattgaggaaatgtcttgtccttaagctttgtatagttaactttggaacaccatttttccattcaaagacttaccattacactttaaacatagaatataaacataaggtaagatgctggcaaaataaaaattatgaactacttcatttctgtgaatttagctcatgataactaaatttggataaattttgcaaagatggattttgatccagatttaagatttaatcagtggctttacaatttaagttagtttacaatgaattaaaggaactcctttttatgcagagggttttaaaaaatcaggttttcaatttttcaaatgatcttttaaaaacatttctatcataacaaatgtgggttaccaaattataaggaattagaatataatcatatgctttagtatcaaaactttatttaatataatttagtctttttgtcaataatttattattctttaggatggcagagactgtatagtatcatgaaggaacacaggctttgaagacagaaactaagctcaaatttccaattcctttgtaacttgctggcatcataaacttggatcaggtttcctaatcttcaaactcaagtatcttcattgatttaaaaatgatccccaaaataatactacctcacaggatcattgaggtaggattatattcacaggattatattcaagttttctgtttgtttgaatttagctcatttggaatttactaatttaacagagattatgattttggtagaaattcatcaaagcaacatttaagccaatacaatgattttctagctattacacaaatactcatctaaagttaaagtatacatcttttactgacattccacaaactcagtcattcttactgagtggaaaagctccaacttctgtgtattgtgtgtttttatttggcagtcactttgacaattttattctgaatttaaatctatttttagacctgcatgcattattttatatagtattgtgaagaagctgatatttttgtttgatacactatgttatgtcagtgcttctgattgccaaaaccaacagttcatgtttaaaacctttcagaacattctgcagtctgattaggtcacctctgaatactaggaactaaaatgagaccacagctaagaagaaaggagacaggtgcaatttttttcctacttattctcatttcctaataataatataatcaatagatcattataaacctctttcctgaaactctgccctcctccctgtttctctccaccctacacacacacacttaaatacaccgggttcccctatttgctccactactcactgaaggatcatcttcctcttcatttccttacacatccgggtgcttcctgggctttggtcctcgatgtttcctctcacttaaaaaaaaaaaatcccttttctacctctcttttatcagtctcgttacctctcatagcaagaaaaagtgtttttttatttcctgtatttcctggaaattgtatctgttttactttgatggctcttgtctagcagcaagaaatgaagaatccgacttggagtaaaatctttttgaaggtaatgccaagcccttattcctcttctttctccaattgactgtagcagagggccctcctaggggtcaatatttaactctttaattaatcaactgttattttagaatacagcataaagttctcacatatttaatatatgtcaacttattccctaaaagtccacagaaacaagcattgtggcagaggaaaatttattgaaaaatattgttccaaaatcttgcttcttgattatatttgtaggtataacagaattagactactttaatagctgaattcatttttatttcattgtggaataaaatgagtgctgcagatgccacactatggtttgattgttatatatgtttggtcatgtgggattagcctgatacatgtatgaactcaaatatccatgttagctaacaaacaaaaggagtgggtaaagagatgtgtatatatatacatactgaaagaactttttctatatatgagtgaatagcttacctaacgtaacagtctttacataataagactacttatttaaattttaaaagaatttacctctagatgggtttttgagtgaatttcctcagaaaattcattttcatggcacagaggattatcatacttggctgctggtctgagctcatccaggaaacagacttgagtgcttttattatccactagagtagatctcaaagaacagaagttactctatgattatttagcggcaataggacttaccacagttcctggcatttagtgttcaagaaatatttgttgaacttcattaaaaaattaagatagccacctcaatatcttagtttatacacacattttcaggcacatatatattatacgaagagaaatgcaataataatccttgcataaaacagatgagaagctcatctcactatgagatgggttggagaagtcttcattttctttaagagtttatactcaagcttgtcagtagacatcattaagctgttatgagattccttctcttgctcagttgaatctgcttcatgaaccaagtcaggttctcttccatggcaaaagtaatgaggtggggccaatgtgtcccattgtctcccaatatccacagcagccactcaacactgtagtgctgtggccaggtgaagggactctgaaactgtagtactatcctttgaagctaccacagttcttctcctctatgctgaattaaccacatccttgtttccatttaaataagaaagatgcacagaggttcaacccacccattattgaacatattttgcatatggaatttctaatcaccatattattccagggatgtttgcagacggaacctatttagatttttttgtacatggatgcctagagaattatggaaaaaactagaaatcatctagttctagtctaatacccacatttagcattcaaggtaactgagaaataaagaggtcaaatgttgctcaagatgactcagcaagttaggagccagtgtggaccagataagtgtccttttctctacaccatgtggataatggatgtttatagcaaagttaacattgaacctgttgagattcatgtagataatctggaattttatgtctcactacttgataatgttcataaattgaattatgtaaccaaaatctgtcctttaccaatacagatatcctattcaaggaagtaaaatttcactagtatcatgggcatctttagcatgtcaatttcagtagaccaagtagaactctagttaatttgttttgaatggtgaggcaaacaaagcatcattattcctatgaacatttaacagtttttgagtaatcatgatggcatgtattgaacattttggtgaaacaaatatctgctaatgatggaaatgtatttgctagtggtacaagtcttacaagacacgctgcagaagaaccttcagaaaataacctctgaccttgaagaacagatgttctaaaagcacacaacataggggttttgtaaatgagcagcactttggagtttttccaacttttcaaacattcagggaagtaaaaatgtcactatgccaggttttctaaattttcatatttcaaattagtataatttgagggaagttatttaaatgatctgcacattacttatcaagacatatatttctaagtgccaatgtccaggaattagtttgcttttctgaaataatatttaagataatcctttttaaaattaaaggatattttatcaacataaatagcctactcagaaaattatatcaacactaaatcacaggtaacaccatcatgttttatctctatttattttgatttttgaagtaatttaaaagggtatatttaaacattataaagtacactaacaaataaaacattttgtagactcagtgaaaacaaatttatttatttatttagtttttgagatggagtttcgctcttgttgcccaggctggagtgcaatggcgtgatcttggctcactgcaaccttcgcctcctgggttcaagtgattctcccgcctcagcctcctgagtagctgggattagaggcatgcaccagaaaacaaaatattttattcatcattagtaacatttgccagaactctgtgctgtttaaacttcataaagtatatcacatgtaggatattttctagttttctagtctcttctgtatatatgccagaataatatcaaatactttcatttaatcagttatgattattttataccaaagaaatctcattctagaaaagaaggccatctattcaccactcctgttggccattaaccttcatacctcccctttcagtgttctgtcttgggtcttctttcaccgtataaatcccagggttgatttgatccagtcactctgcagcaaacatccttgtatgtctctttgtgaacgtcaacaattaggatatggacttcctcagccttatcagatgttgccaaattgctctccaaagaactaatatcaatttacattccagccagcagtgaatgaaagttccagtttctctacctcccagacatatgtattgtcatgctttaatttttatcatctaatggctgtgagatgcaattttattattgatttaatttttatttccctaatcactggtgaagctaaacatctttttacatgtttatttgtcctttggttttgcacttctgtaaatcaactgtttatatcctttgcctatttgttgtttctttgagcttctccctccttctccttttcctattattcttcctcctcctcctcctccactcctctttctccttcttcttgttcctaggagttcttagtattatctgaataaaaaattctttgtcagttctagttttatgcattacaaatatgttcttccagtttgtggcttgtcctttactttttttttaatggcaacagaaatttaaattctaatgaataaatgtatcagtcttttcatttaacacttaatgccttggatgaaaatgttttatcccagggttatagaactattttcttaaatgttcttatcacagttttaacattttgttgatcacatttaagtctttaatcaatctgttgtttgtattttttcataatgtgaagcaagaatctaattttaatttttccttatggatacttctcatttattaattaatccactagttcttccttcttctcaattttaatgcctttttagtgatacaacaaggcttttatgagtgaggactgctttgaggctttgtatcctcttcaatttgaccatttttgtatcccggtactattattatactgttttaattgttatagctttataagttttttggattggtgtttcagttatttattgctgcaaaacaaaacagtggaggttttctaaaaaatcattattttccatgattttgtgggcagccacaaaattccgtttcccatggtatcagcccaggcactggacgatcatgaggtccaaaatagcctcattcgcatggttgactaccacagtgctagctgacaaatgggagctcagctggggttttcaactaaagcctttgtttttctccatgtgggtatctctatgtggctatttgagctttggaaagcatgataggtgggatccaagaagaaatattacaaaaagcaaaggcagaaattgcagatgtcttaaagtctagcctcagacatcactcaaagccacctctgccttattctattcctacaagttgattaaaagaaggtaaagtagactgcacctcttgatgggggagtggcaatgtcactttgctaaaaagtacctgggaaggaaaatagtgttgtgatcatctttggaaataacaatctattgcattctggcaggacaagccttatcatttcattaggcttcttcaacaccattttggacccttttccttccaactatgaatctataaattttagaattaacttgtctggttccatccaaattttataatgtgatttttgagtgaactttcagataacattcttcaacaaatgtttattgagtacctactatgctcttgcactaatgatacataaatgaaaaaaaaaaaaaaacagataaaacctccatctttcattgagcctgtatttcggattatgtggagaaaattaaaatatttatgacctttgttattctaataaatatattttgttttgcaaatttggttaggtcttcttttatgtccttcgtctaagctttataatttcttcttatccgatttattcttagacaaatttttgtcttgtttctcccaacatttagactaagctctttgggcaaatgttttaactttttgtcttctgatagcaccaagtacactgccagatatagcaggacaatgtaacttggtgaacagactgaataaaaactgaagtaaaagatttaattttccatttgtaaatattaatcatgccaggtcaaactatcttaaccaagttaagctcctagaaataagtagcattcatgtagtaagtgagttgccatcactatattcttatagaaggtccctcgtataaaaaccagtaagtaatgtaaaggagcaactacccaggtactccagtggttaaaaggaaaagatgaaaagaaagaaggaagaaaggaaaatgctctccaagctttatacggacatttaacgtagttaaaaatgggtttgcctggcctttgctaatcacacctttagctaataacttcgaaatttgcttctacattaggtacagtgtggaacaaattagctcacttaataaatggaatgaagctcagtgtgagtctctttaaaagcacaagaacattcctatttcatccctcaattaccaaatatctgcaattcctagttttgcatcatgctgaacttctaaagtaggaaaaaagcagttgaagtaatattacaatagcaaatgatacaaaaatagcattaagtaccaaggatacctaaagttcattatttcaattctttactctcaacaagggcagatctgacactgtgaaaattgctgacaaaatcatgacttaccaccaaacagaattttcaacatttcaagttatgattaagataaggaatagcttgatgactatttcactacattcaatactatttatagaatacagctgcagggctttgtatatctaataattattgtgaagaagttttacaaaacatcagtcctttgagaatttctatacattgtacaagttatttaaaatctgccaaatgttacaatatgaaatgtaaaactaggaaacccaaatgcaacaagtggaaaacatgggctcagctaataccacaacacactgccaagatggaactctccacaaggtctatcttcctgctacttctgtcctggtatttcccagagttcatgccttctcattccaagtatatgctaaatactcctaaatctagatctctagcccaagatgtgtcagttgagcaacagacccatgtttccaattcctctgaggtgtcattgcttgaatgtcacagaaataatgcacattccataatctcaaacataacccatgatttccatactctcctccttttgtatttctctctccgtgaatagaaccaccatccacccaggcctctatgacagaaccttgggtgtcactgaagacactttttcctctctgttacttctcatatcaaattggttaccaagtcctgggaattacacaggatctcatctttttccttttcttcatacccactgccatagccttggttcaagtcctcatcatctcttacatggcccatggtagcagtcagctagcaggaccccctgcttctagatgtacctcttttaatccattctccaaacattcaccaagtgatctttttaaaacacgaagcagataaagttacccatacctacctgtttaatacctttcaaaggttaccaatattcttgcaggataaattacaaatccttaacattattccctggctcttgtctacatctctatatttttttattaagttcaggttctttcctcatctgctacctatccatgccagacaactaagactcagactcagtctcactaatttgtagctttgcttacactgctccttctgcttaaaagatcttcaaatcttctcccctacttgcctttaacctgatgaatttctactcattcttaaggtctaatacaagcattactgcctctacaaaccttcctgaaatccacagaggaaattatacacttccatctttgtttcataaatctaataagaactaatatttatggagtactgatattgcattagacattgtattcagtggtttattacattattgtatcctataaacataaattattttcacattaccttactattatatcctacacaatcacttgtaaattattttagtacgctttattttacctacttatttacatattttgtaatattatcctactaaactgaaaactacttaggactgaactgtggttcatcttactctctattgcctaagctacttcattgcacaagtaggtctcaaagctctgttgataaatgaagtttaatggtttcaaggagactgatattatataattagagatgttaacaaatgcattaaaaattttaacgcatcttgaatcaaagcaattatctatctaacttagtagctgtgcaacaaagtaaaaagagcaagagtgccattaatatatctcaaagataagcttgtttaataatgcatgtttgggctgggtgcaatggctcacgcctgtaatcctagcactttgggaggccgagacgggcagattgcctgggctcaggagtttgagaccaggctgggcaatatggtgaaaccctgtttctactaaaatacacaagaaactagccgggcgtggtggcgcgtgcctgtagtcccagctactcaggaggctgaggcaggagaattgcttgaacccagcaggtagaggttgcagtgggtcaagatcgcaccactgcattcagcctgggtgagagagtgagactccgtctctacaaaaaaaaaaaaaaaaaaaaaagcatgtttgtgtcaatcacttatgtgtttatttgagttaattagcgcctatgcagttttctgcttgctcaacttattggaaaaaaaatttctaagggtatgtgcaaaaatattatctaaagtagcatttgaaattttgctctacaattacactgttaaacacagtaattctaaacaattccatgtgaactaacatctgtaaatgttcagcaattatccacctgttgacagtctgtaattcagctttgtgagtactactggtttgtgacattaaatcaagaggtttaatattttatcttggattaaatgcaaaagataatcaagaataagacagacatttagctgcctggatagcagttatagatctgtttatattaatactaacagagagtcaaacagttcccaaaacttttagatgtgatggcaagaataagagcagaagatgatctgcacatcaaacagctttttcgtctttgcttagtgtcaagcatttggcaaaacaaccctttgtattatttcagcatttcagaggcctaattttccatagttgtgactcacatatcctattcataggcagaggtcttataaaaatgaatgtgactgatacaatctcttataaaaatgaatgtgactgatacaatctgagcaggaaatacttattaccaaatgaccacaaattctttcttgtttgtaaaaattaatttacctgtgttaaattgttttaatcagatttcattttaaaactagcactttaagcatgatttaatctaacaactgataaaacaataacatttcaaaggcatatctagaacagtttaaaccaaattcttgtctgttcataagctctggtaaaacttttagatccctgctatttagtaaatctcttaatatgtattcatgtaactaaatactcctatacactgttttcctaaattcagggttctggatgttcttcccctcattattaggacaccatctctctgttctatcacatttcttcccaagcaagtttgtcatctaaatacctcattaaataatcttataccttattccgtcataacaatctataagagaattgttccccaggcagaggaagtcctcaaatttgttgctatttcctattctcttcttaattagtggctcaactatccacaaaatcacccaagccagaagcctacagtcatccattccactccatccccacactcctaattggtgattaagacctattgactcttcctcctgaatatattgcaaatctatttgttcctcttcaagttcactaccactgcttcatcattcatcacttggattattgcagtgatttttctaactggcctccctgcccaccaggctcagtttcatcccctcatttctcccccattccagctcattcttctacaacaattgtaattatatttctaaaatgagatggctgatgccattcccctacataaataagatgcaaaccaaattcctaacacggcattttagcacagcctttgcatatctcaccagatttatgtctcatctaccttcccatatactccagtgctacaattctttttctataagcagaaataagtgcctccttactctatgtttacttagcatacactgttgttttagtactagttgcaggaataaaattcaaaatagaagatagaacaatattttttaaagcacaagaagcatagttaatgtaaaagcatagcacaaaataaaatgtagacataaatcaaaatatatcaataacccaataaatacaaagggactaaatttgcaagtaaaggacagatattgcaaattatatttttatgctttttgcaagacacacaaataaaatacaatgacacagaaaagttgaaaataaaaagatgaagaatgacaatgaacagaagaaagtgagacacttgtagagaggcaaaaaaggcacattggaaataaagaagtttctatggaacaataaagaaggaatcagcaaaaaatatagtaattccaaactcatatgtgagaaataacattgtccagaatatacaaagtaaaattgagattagaaagagcaattgtcacagatcaacaataatgggagatttcaatgcacttttcttataactgatacatcaggcagcagaaggcattagtggattgtgggagatacaaataatgcaactaagaagtttgttccaatggctatatgtaaaaccatggaccctacaattagagaacacacattcacttaaatacataataagctttaaaactgaacatatacataaagcaaatctcaatcaacaccaaaaattcagtatcactcagaacttctgtgcatataagacaattaaattagaaatgtatttattactattttagttataaagaaaacggaagacagggcaaaagttaataaaattggaacactatagaaacacagaaaaccctcatatttcaaaattaaagatatttgtactacttttatttatcattttcaattgatggtttgcactcaaatatttcattaagacttcagttatttcaagaatttaaacatgattttatgcattaaaaggtatcagttaaaagacctgtgactgaataaaaatgtaaatcaattaattaaaaataggcattgctaaatcgacactggaatctgaaattatcatgggccttctgcctaacattttcaagaaaaaacttgggattcctgaaaaaaatatataatcaaggataggtaagcatctaataattaaattaagatcatcaatttgtattacacagaaaactgggctgttgtcatcttgtatggatcagaacatgattatgccataaaatccattcttctagcttcaatcactattgtctctcttttctaactatagaggtgatcagacagcatgcatcccttttaggtcacaaaagaaatcctattaaatgccaacctataaatggtgcttccggaaacataaactagatcagggttagtttgggatgaaataggccttaacttagatagaaagtagaaatgaataatgtacatttcataagtctttaagcaaaaaacaattggcaattttactgtattttatcaatttatcttagttgaattttatatcactgacagattacttgaccatcaatttttctgatttgtatactaattctagtcttattttcctaaaatgttttcctaataacagcaatgtattcagaaattgtaattaaaagtcattgaaggtcatctgatttgttgtgttggctttagatcagtgactagattttcccagtcactgctctgtcagctttaatacaatgcatccatttgtcttactaacacttcaatttatgggatagctgtttttcacaattaaaactactgaagctttagtatacatggaaatgatcatgatagcattttctccatatttctaacaactctggaaggctctattgtaaaaatatagggccttccagatgactagatctggtttcctgaagacagcttttaagattgctatatgagctcaagagaaacatttacaagaatctttagataaattactaagtgctgcagaagtaaaaccatttggaatagatttctaaactcctcttacataaataattggtgagtgattgaggtaagaaaaggctgcccttactcttgctgacccaatagacaagacagctgatgacgaaagttgatggcgaattggcacaagaaggttaaatgcaggagaaatgaaaccgatctacttattgtgatgatgttgactgctacctagttagttctatgagagacaacacctacttacacaaggtcttccacttaattgggcttaaggccagttcagtaatcacaaaattacaacaagctaaaaattacaccaatcacctcctccaacctctgtatctataaagaaaccatgaacttatataatttacccaggaaacaggagtcagatctgctgcctcctattacaggagtctttacattcaattaaactgaattagatatatgaattcaatagaagaaatcttgatgtaaagtcaattagtataaatacaagtcctccctcaccccacacctgacaattacaataaaattctatggggagcgcattatgaagagtagagaagaatgccagtgcaattctgtaaaagctaaggcaatctgagaatttaattttggtatgtctagccaaagtcaattactcatgaacaacaggctggaaagtgaccaagggctgactcagcagctttcaaactcttctgttgagtttaaaaaataaaatgcgaaagtagagagagaaaataggaaggaatagtccaagaaaggacgataaaaattaaataggccaggtgcagtggctcatgcctgtaatcccagcactttgggaggccgaggtgggtggatcatgaggtcaggagatcgagaccatcctggccaacatgatgaaaccctgtctctactaaaaatacaaaaattagctaggggtggtggtgtgtgcctgtaatcccagctactcgggagggtgaggcaggagaatcgcttgaaccagggactcggaggttgcagtgagccgagatggagccactgcactccagcctgacgacagagtgagactctgtctaaaaaaaaaaaaaagaaaaaaaaagagaaaaaaattaaataaactaataataaaatcataaaatctgggctgtgagttcacttctagaatgctaggtactcatggaaatttacctaaaaccaaaaaggtgaagtaggagctgaagacaggggtgggggacagaaggatggggaaatgggaatggggggcacagacaggtggaaaatttagaggaatatagaatttttcaccagcttgaagtaaaactttctaattattttaaaaaaccttataatatatcattactatgtagaattaccaacagataaatttagtctttaatactcaaaaagaataattttataaagaaagttaccacaagacaactttagtggatcctaattgtattcataatgcaatttacaaaactgtgatttacatacatcttgtcaggcacacatcaaggacacaaaaggcacactcacactatctcaaagcatgtaataaaaaagggtgctataggaaaagaaacccaccagtttctactgactgtatctcttccttttctttctgtttagccttgtcatcattaccaaggagcttgctcattcctaaaacacatttgctacaaccaggcatttctctttcagtcagggcttcaccatggctgggaaatagacattgaggaagcagagagtgcagaaatgggtatgagtcttagagtccgaagacctaggttccgaggaggtcaccgtctggttgactgaccatactcaagctttattaacttttaggagctcagtttcttcacctaaaaaaatgagatcgttggattcaatgatctctaagctctctgacttgaaatggattcaattcactaatttcccctttttgaattttcctcatattctcttaaacagagtcgaatgggaagctttttcaaaacaataagtaattatttcttatctataatattctacttatatatcaaactgccctcgcctttgccaaagccctcagtggacaaataacttcaaataactactaattctcagagcagtgcaagtcatctaggatcattgtttacattctatacatattgaaaggctttctgtaaaagtgagaaatgttttaatttttaatgataggaaaagtaatgctttctacaaggttgaatctaaatccaagccatagataagagctactttaatttaactggtatttatggttgaggagcagaaaacaaaaagaaaaaaaattcctttgaaaatgtttatttatgacagtctaaattactcctttgacacaatgaacacaggtaaattatctcagagctgtgtttaatggctctaatggctagctgggtactgggccatgtatttcaggatgcctacttgtttataaaacttgtttccaaaaatcaggctaatatagtactaagttaccaagcagaattttttttttaattccagagtcactggccatatttcatatataattgctgggttaaataaacacaattaggttttatttagcatgtatttgattatgaatgtcttcatataaataaaaaacaattttttaataaactagactaggaaaggataaaaacttagtatcattattattctaaacataccaaggctcaagttttcattacctaaaatatactcttcgtaagacttgtggctgccgaataaaatacattcatcagatgcagtattgctttcacggtaattatgatactatttataatgccatggttatgttcataggccactaacaaacatatgcagtcttttagctacaacactcaaacataattacaatgcccctttccattgaaataatctatgcatcccgccacagtgacttcattccttaccaggatgcctgctgaatcagactgccccaattattcaggcacagtgcctatgcttatgactaataatattggggaataaacgaaattaatgtccatgacttcctgaccattttggccaatctcctttctttggtgtcttctgctttaaccctaatactgagtaatcttgaactattcctggcataaaaagagcttcacatactgtacaaagtcttcaagccctacaccaatatttcccatagtatgttccaagtatttcagtcttaggggatattgctcaaaaaaatcagagtgcggagaggttccaagatcgaatacttttgggaaactttgcatactatattcccaatccttaggattctcctaatctattcatatactgaaggctcttataagtcctgaagtaaagaaatattttatctacatttaactcacgcaattgcaaaacttacttaaccatgaaacctatttcatattactttttcaagtgagtcttattaacataaaactagtggcaaatatttgggtgtccctgtcttcatgcagaatttgactgcccaggtcctattcctctagagactagttagattctggccagttaactggagaaatcaatacaaattgagaggttaattttgttaatagattcatgtgttgtctctagcagagggtggttgattttaacatacatttgcaatgcatcagccaaagtgcagcataaaacggaagagaataaactgtgagactataccttgcacatgttttttattgcatgagtaagttctatatcaggtctggaatttctgtactcaaaggacttatattctgaagcaacaattacaaatattgagtggaggtaatatttgtggacattgaatcaaaccagttttctcacctaacataaataacttacctgcattttgatgttaaaaaaaaaaagccacctgccaagatctggctgtggagccatggctgtgtatcagccatgtatttgagtagtgacaaatacttaattaacagggtcattgaattgagaagaaggcctgaattttgatttctacaaaaaagtttcagagaaagatttttgctttaaaagtctgactctttataaaatttcttcctgtctttaaagaaagtcaaaacatggacaaaagccacaagccacctatcaatattcatgtgaatcaaaaaattaaatggtaatgatgaggatgagaaaaggagagaaatgtatcttgcttccctgttaaaatgatgacacatgtaaggacagccccatggcatggtgtctgatacttcatctctgttagctttttcttcccataatgcttcttccctcaaaaaatgctgatcacagaaattttgaaacacaagatatttgtggctttttttttcagtggaaaccatcattattgcctgtaaccttgatccgttctaatagaggactacagaactaatcctacaataagtcaagataactgatggcattggcaagtagttgaaatccttagtctaacaaatactgctttcaaaagactagtatactcactgataaatgcctttttaacttatatcatgtcaattatttgctattcattatctttataaaatatttcctggtttggggaactctgcaagtttcttgtttctgatgctttgtttaaacatatacaactatgtatgttcagtctgacaaagccaccacttcctccagccaaaagggaaataactctagtagaacgcagtattttaagaacagattttgttgttaggctgtattacccccaaagaaaaggacaaaattagtaagactgaatttgttactatttactcgccaaaccctcaaggtagtttcatagagataatcacaaaaacaggaaatagtacacaatgtgggattggtgtttttcctacaagctccttttcctatggattattttttttccaatggagagaaatgcttttttacctggataataaattaaaaagtggtttcttgacattttactgcttttatttattccatttaaagaaaatgatttccaaagccagacaatggtgctgttcaatagaaaatgatgacctttaattaaaactctgccccttactaattttcacatctttaccaacctcctcatcaatgtggaagaggcataattgaagggagaaaacacctgatctaaatacactttatctaaatcacttcccccaagcagacattctctatctcagttcctagttcatttccttcattgtatttcctaattcaaaattatttctttcttcacctgttcattgtgcctgtgatcacataggccataggttttatatgggagggagctttgtagactagtgacttcccagtgttattgctgaagaaaggaatagataagggaagaggaggcaaaggtgaatatatctgatgaatcggaaaaaaaggtatgtggtctcaaatcgcaattaatctctaaatgtaacaagcaaaagcaaaagtaatgcttttgtttattttactccatctttttttttttttttttttttgagacggagtcttgagctgttgcccaagctggagtgcaatggtatgatcttgactcactgcaacctccgcctcccaggttcaagtgattctcctgcctcagcctcccgagtaactgggattacaggtgcatgccactatgcctggctaatttttctatttttagtagaggcagggtatcaccatgttggctaggctggtctcaaactcctgttctcaggtgacctgcctgccttggcctcccaaaatgctgggattacaagcgtgagccatcgcacccaacctactccatgatttttttgattatttattttgaaattattcagcatcttatctcattattccattattacagtaattatctaccacctgttgaacagtacagtgccaggtactttacaaacaactttgcaactatcttgcaaggtaagaactcctgtgcctgtttcttgcagggaagctgagttgcataaagtgaagccacaaagtcacagagacaggaagtggcagagtcaggatttaagtttacttctgcctgattccaaagctgtactctcttctctacatcacaccacttaactattaagtggtgtgataaagaggtatgcttaagcctcttaaagtatctgtcttaccaaattgctaataaactttgcaaaagtcgaagctagaatctatccccctccaccccttctctttctccctctttctgtgctatgtatatactactctacatcttgaaaagagtaattttatcttcatttgctttgtagtttattcaacttctatttccaaaaacttagctttttcctgggacaaatcccccagatgttttctattctcttataacttcaacctctacctgctaaagtagaagtctcaattatttaagagattcagaattatgtattataaagtttacaaattatgtaataaaaatttaaattcatttaaaacttgagtaattatgatgccatcagcacactataagatgtaaacattttaatggtgaaatatttaaaataaatatctttgaatgttcaaattctgtttgatacatttgttctctttatttcctcaaaattacagtcttaaatttttttttcttttgagatggagtctcactctgttgcccaggctggagtgcagtggcaaaatctcagctcactgacacctctacttcccgggttcaaggcatcctcctacctctgcctcccaagtagctgggattacagtcatgtgccaccacgtccagctaatttttttgtgtttttagtacagatggggtttcaccatgttggccaggctgttcttgaactcctgacctcaaatgatccaccctgctcagcctcccaaagtgctgggattacaggcgtgagccaccacacccagcttacagtcttaaaaattatgtattgcttattggttcttcactgtaggttcaagagcattgtcaattatgcctctgtgactcctaaaccagattttaccttcaaattcttgggtgtcagttcctgtttagcatcaacacattgaactgaaattagactgtgactcaccatgtatttccaaggaattaacaaattggctctttttcctctcccactatttggatattgaaattaaagtagctaactttaaaataatttcttgatttttaaattacccttgaccaactttttattggcttcaatctgactttttttttttaacataaaatagcccttaaatgtatacttatcatgatttttttcatttctaaaataagagataaaatatttgacaagcaggactttcacactgtaggcagttcaactgccactgaaactttaattaggtcaaacttggaatctaaaatcttaaaatgatatccagtaaaagggaaaacctgaaaacataaggtaaaggcttttttctgaaacccttgccagtgtttccctgtaaatgttacagccttcaaagaccactcaacatttcccaccattttaaaatccataatttattacaaataagtatagtagaaaggttctattccatactgaatatattaataaaaatagtatttttaaaaaaaaagttcaaaaaattgtcaagtaactcaaaagttacacataacataaaaaccattcacctcaaaatagccattatttcagatattttgataaaaatatatacaaaggaagctacagaggaagaaaggccaacaggtaatgtggataggaactgaagatcagttttgttaaaatggactcaagctacccacactatattaaatatatgtaccatattaaatatagctatacttgaattaatcacagtataagaactttaaatgaaattaatgaatttactaaaaaatgagatgtttcttttttcttgtttttttttaatgcccatctttatcctgcagtagagataaatgtttcttaacactccaaaatgtattgtgtaataaaatattgatgagttcaggaaaaacttatgctttaaaaagttgggaccattacttgctataaaagctgaagaaatgaacatattaatgttttatcctaacttccatcaatttgatattatatttttcattgttcattcatagtttctattttattcaataaccatagtgctcatggtttttaattttcgttctgaatttacattgattaaagatttatattcagttttttagttggaatccctccatacctgaattgtttgtcttgattcacctcttagtaggctgaaattcactacagcttttttgtttgttttgttttgtttttacagggtggctattcaatttttttttacttataagaacaataatgtatttgttcataattgtgtgagttagcaaggcaattctcatcggggctggcctggctcatctctgaagtcatctgccagttttgaaggggattgatggtctaggatagccccattcatttgtctggctcttacaagcttgttggatttagaagccccagctaggatagcacatctctgctccatgtagtctttcatcctccagtaggctagctcaggcatattcacaagtggtagcctcaggattcaaaacagcaaaataagacagaaggccccagtgcataagaatctttttaagtctttgtttaccttattgtttttcagtgttttcttgttttaattttccttaatgagggtttatactatcttgtgtaacttcttatgggcttgaaaatgtttgtgcatttgaatttatatttaaaagataacttgggtgggtataaaaccttggtatatactttcttgtactcagaatttttacacataattctataggattttggtatttaataaacctgtgggaaaactaacctcatttttctctcttccatgtgacttgatattcatgctgaataaacacatacatgtattcattatttttaatatttattaaccttaccgtgatacagaatgccattaaaatcatatgtaagtctttatttcaggaatttatcttctactattttaatattcaagaatacaaattatatttatattggatcccttttttttcttttccacatctttcatcttcccataataaatgttgtgtttttgtgcatttgaactaaattttatgggatttttttcaaagcttttctccatatttctaacttggttttcagtcacatttattccacttgttgttattgcttctaatatttttgtctatgaaagctttcgtgtttctctcccatttctctcctgatatacataacctctttcatctgtttttcattgaacctctactttgattctcatagatattttttcaggctttttgtttgtttgtttgtttgcttgtccgtatcatatctagtataatttccctgagcgaatgggtaatttttatcctaatcttccaatgttttttgggaaatttctcttgtgatttttttatacagctctttgttgtgttattatctctttagtctcctttctatttgatggttgtagattgagagaaaaaacaggagcagtttgcagtctcttgtttctcttgctagacttttttactccattcctctgtcaccaaatctcttatttccttttcccaggtcacacctctccatctggagtgagtggctaaaaacatatccttttgcatcagagactttctatgttatggtttgtacgtactgtctcttcttccttcttcactcctcttcatctctggcattctctggttctgaaacttggatctaagcaagaaccctgtcattctagtatagattcttcttcagctacctgtcctggaggctttagggattcaaacttgtccttccattactatatatctcttccttctgagtcagggctctttagaaccttcaagattgtgactcttgcttttggagaattatttatcatactctaactagtactatggcattacaagaaaaataaacacacacgcatatgcactaaagcagaagattacacatatcatttataaatacatattgttctttagaaaagttattattatagttatagcaactaacatgtctcataattgtatgtaggcaaatatacctccttcccacattagttagaataatctttggatacagtaacagaaaatccaacaatgttttaaaattgttttaaaatatgttttaaaatataaaagggtttatcatttacctttgaaaataaaaagtcaggaagtagtgtcacctaatgttggattgctgacttaatgatgcctaatatctctccaattatttttggcttatcacctcatagtccccagatggctgctatcctgtaggtattagatctgtgctcaaggcaagaagaagagtggggggagcactagctacaatcatcctcttttaataagaaaacagaagcatctttaccaccgccaccaccactatcacttccagcaagtttctgctcacatatcagtagctgctaggaattttccaatgcttttgtatagccatgcaagaaagaagagtgttagcaagagctttcgactcagccaaccaacaatgtttgccataccccaaatgctgaactcctccacagaaaggatttgagcatatccatatttgtatgcccagttctcagcagagtttgacatatttgtagatactaattaaatatttgtcaaattatactcctttatggttaacattatttcttctaaacctaacaattgaattgacattttcaaaaacacatttaccatgaatcttagacaactataatataatagagaatctacaatataaatctataaaatctcatattattaaactgaaattaagattatttgtcaactatgtcaatataggccaggcgcggtggctcacgcctgtaatcccagcactttgggaggccaaggcagacggatcacgaagtcaaggggtcaagaccatcctggctaacacggtgaaaccccgtctctactaaaaatacaaaaaataaataaataaattagccgggtgtggtggtatgtgactgtagtcccagctactcgggaggctgaggcaggagaattgcttgaacccagcagacggaggttgcagtgagccaagatcatgccactgcactccagcctggggcagagcaaaagtctgtctcaaaaaaaaaaaaaaaaaagctagcctgttctgtttttaataataaactattcagaaggttacaaattcagtagaatacacaattgctagtgaaaaaacagaaatttacccatagagtgcaattaggaagccagaaagtgctttacagtgctgcattgtctttctggagttaaacttaaaactttactgtcaatatttatggaaactttcattctattccataacatgtacatgttggtgataatataaatgagtattttttccctaaaatttttagtagaatttcaccctaggctatgtgtaactttaataatgatgatgataatgatgacgatagcaaatatatagagtgcttacatgtaccaggtacttttctaagcactttatatgtatgaactaatttaatcctcataataaccctaggaggtaggtattatcatcaaccatacatacagaagagaaaatggaagcagaacttgaggaagtaatttgcccaaggacctacaggttgcatgtggcagaggtggaattcagtcccagatcatcaggccccagaacctggcttcataaacacctgcccttgaaacccactatggagccccaggagtacccatccatggttttgaccaacattacctcctctgtcatttcaagaactctataggcattatctttaggtttaatatatgaggaaacagaaacttaaagaaattatggtaacttgccaaaaatcacaagctccgtagatacaagtcaaacacaactctctctggctctggagtctacattcttatccactgtgcagtgcactgtactgacagaaggggaaaaccctacagtgtgtgatgcacttcctatgtcacagagtatgaagaatgtcacaaggtcacggaatttcagagctgaaagggatcatctagtccaacccattcatttcatgggtagagaactgaaacccagagaaaatagaaatgccaccacctcggtgccagatctcctagatgcccacctacaggtcagtcctctctatagtatcttctccccttttccctttaggttgatttttcatttaaaaattatttgatataatataaattgttatagctcacaattgtgaggaaattataaatatttgcctttatgattttagaatgatgaaaacctttgttattctgcagactttctccaaagctttatttcaaaaagcatcattgttctttttcatcttagaaaacataaaacctacttgcttgtcttcaggaaccctacgaagataaaaattatcacaatttatacccaacatacctaaagaaccctgtccattgtgccctcattggttgtcctcttaacttggacaaatgtaatcacgtctttgatgtatttccagcttcacggtggttttggatatacacttctgtaaaatgatcaagatttttgttggaattcacgagtgtttgttaaagttttattaaaagcgatcctagaaaatataactagagcttactataatatgttctgcaggtgggaaaaatgttacagctccatgaacataaagcaatcattaattagcagcaaagacacgccattttcaatcttatcttttcatgattttaaaaaaaccaacacttttcccttatattttccaggtaaggcatcttaccagttcttatgcactgcaatggccactaggtaatattctttaagcaatactgttatacatattattatattacagcaatcctaaacgagataggaaagacatcatctttcattttctacatggagaaattaaggctcagagaagttaggtgaaaagactaaagtcaaaaatgctaatgggtgtaagaacctgactcaaattcagatctgtcaaatgcatctggtgtctgtccttaatactctattaagttgcctctcttcatttaataaaattctctaccattcaaaattaaagttgtatatctataatgtttgctgtttatttcagtgagtagttatttcagtttttaatagatatgttttcctttattaggatttgttaaaactaaaaaaattaataataacttcaaacaatcattgttatcatttccaataagcaaagcagacaatttaaagagacagaattctcagacatgcaatgctatttcaaagtccattcacgtgctgtgcaaaaagtcacattaaaacactttatactgaactataccatgacctcggcaaacacagtactcctaaaagcacagttatacttgttgatggctatgagtacagattacttccttttcttgatacaaaagtattaaaagtattaataccatacagttaaatctgaggaataattaatttgaaggaaggtaataggcaggtaaagcagctcagtataatcaaaattttcctttaaagaggttgacagttactctgatgtaatatcctggaagtttttttccaaatgtgcacttctgatttgcatgaattttaaagtcattactggtgaatacagaaaagatacaggcccactctcacaaggatgtagattgatctctgatatctagccttcccagtgtgccatttggggtgtgaaaaggtaccccagagccccaaggtctaaaaacccactaaatcagggtttcccaggactgctgttttataaacactccagagaatttgtctctaaaaacaagtgatgaaggacagagacaaaagggggagtgtaaaaaataaccttttttccccttaaagcaaagaatcaacattagtttgtattttggttcattgtagaagtcgatcactattgtgcactaatcatttcactagaaaaagtatttcttttcctaccattcttcaccatgcatgctttagtgcttcacaggtgtacaagtgattttcttaaatttataaccacagtagacttacatagatcccttataaaattgatgcagcagtggtaataggtttacacaaaaattgtaatttatgtcattctgttttgttgaagggaatcttggcttctatttacagctttaattaactactgtatacttcctaattgtataacctgtgagattatggactatataacttaagaaatatctttatctgggaatcccaggtggtgcctgtttgtaacatatgcattcttgaaatatattcttctagacaaaattagtttttagattaaaatattggagaagatactgttcctatgatctcttttattttgtacttcaattccaaaatttataatgtatttgccaaagactttctttagtagctaatggaaaaaaattctaaagaagagatggtggtaaggctgtaattttttaaaagaatgactattctttcattgagatgatatatgtcctatataaaaacttcaagtaataaagagaagtttcagaaagtttcactttaagtcatccaaattccatttatcagaaaaaaaacagccatctctaccaccaagtaaacatcattccaaacatagctaaatgtttaccaaggtagaaaaatggtcagagagatgtatacatacataagccttaattttgaaaaaaatgaaatcaaattatatatgcattttaatatttaaatgttatattttcttttcctttaatttgactaaagaaaatttgaactaaaaactgaaattcaggtaaacgtttcttaaacccaaaacatgttttcttttctacaagggcactccaaagttgaggtaaaaaatggaaaaactttaggaggttagaatcatctgtctatttcaacattaggtagtagctattaaccccatgctatgtagttagggaaattaactgatacctcttccaatattaccttgtcacatattaatcattttcattaacatgctttcattatcatagtttataccatttatatgctattctctaatttctaaagctgttattttttatccatagatagatttgatgctaaccatcttaaatcagagttcctccattcttgagctactgatgttgactcatcatgtatgtgcatgcacatgagtttaaagaagagctccagggttctatattgtctaagttttgtttcagaatgtctttctcttgatactatatttgactgaaaataaaacttgagtcatacttcccctccttcagaattgtgtagtaattgcttctctgggttctcatattacgtggaaattgaaagccaacctttattctccttacatgtagctggtatcttttccataaatgttcatctggttgaatatttatccttggagttcaggaaacagtttaaagtatctctcagtattcattgttctatctaaaattgtcctagaacagagtatgaacttcaatttgaagattcaaatctttgtaacaattttcttctttttattttttatttttattgattcatttttttctgttccctattcttaggatcaccaattacgtacatgttgtctctcttttccctgtcttccgtatctttcttcattataaaaacttcacactgttcatacacatttcattttgtcagatttttttccaacctagtatctatgcttgtgactttgttttcaatcaagtttattctatttgtgttgcttccagtgtctattttatttctgtcatttttttcatttccattttcattttttactgaactcttgttctgttttcactgcttttattgctgtatactctcttctttgaattcatctgtctcctttctgaaccctatttttagaatacgtatttgttgtgatatacacttgtgtcatttatttgcttgttttcctctccatgtgtgaaacagaaaatggtagttttatgcatgagtttatccactgttccctttctgatcgctactcctctttgaatgagatagcaactgaccaagtagtacaatggggaggggaagaggaaggggatagctggaaatgtactgaggaagttggcagccactatttcagcttacgaactcaaacatcttctttccaaatattttattttcttaacattgaaagtagttcttccctcgtttctttttgtttgtttgttttatttaaggagtttgcatggatcacagcaagtttccctacagcagtgtaccacctacttcttccaccttctttgacagactgcctgggctgaaagacaaagtggtagagaatagaacgaggttgttggcagaaagtccctctgaggcttcccttccctaccattctagagtctcaggcgggatttctacgtggttattctctacttttcttatgtatcacgcagaaactaagctctctttaatcaaaaactaccaaatatttttgggggaaaggcacctattgataatgtctgagtcaacatctcttagtgggtttgattatctatttcaatatttaatatatggacttcgtaatttgtatcattgcagttgtgaggcttccttgctttcttggagatgacaatattttccctcttttttgacttctttgataattttagtagactttgagaaagtaagaaaaacacctctataacaatatctaaaactggaatgatacgaatattttatatcctatcaaaataagttttaccatcaaaatgtctggttcaaaataggggatttctaattagttcacataaattgtatctactgaataccttctatatatgagaagaacctagacacttggctaggtgcaggtgtctgtacaaaaattaatgagccaagatctggaatctcatggagctcacagatttatagctaatcattgtataataaaatagatgtaacaataactgagcaaacaatatattcatagtatgaaaatatgggatttaatattttgtgatttccaaagtgttttcaggtccatttaactaatattcattgagggctatgttagatctaaaaacattactgaaattgccaacttcaaataaactaggccaaggttaggttagttcccaagaacacagtgaggttaggttagttaccaagaacacactgacatagagaaaggctgtttctgattagaatctaggattctttctaccacatcctgttgctctggaaagaagaacagagttgattatgtggaataaaaagaaatctactctgtgagccacgattagtcctccacataccatgctggcatccacaatctatcttttgtgtaccacactgggaaccacaatccatcctctatggttcggcctttaagaaatatactgtgattcaccctcttgcagtaacagaaactcatatggctctacctacaacaccagccatagttctaatgtttggaagtggaggtatttgaaaatatttctttcttacaggacagttagtaggttaatcaaaaaagttgacaaaatgtgatgtcacaaaaatcatctgtgtgtgtgtgtgtgtgtgtgtgtgtgcgcgcgtacaattttatgtgtacaattttattttgagatggagtctcactctgtcacccaggctggaatatagtggcccaatctcggctcactgcaacctccgcctccagggttcaagcgattctcctgcctcagcctcccaagtagccgggactacaggggtgtgccaccacgcccagctaatttttgtattttttaagttgagatggggtttcaccatgttggcaaggctggtctcaaactcctgacctcaagtgatctgcccaccttggcctcccaatgtgctgggattacaggtgtgagccaccatgcctggcctgtggatatatattaaacatatattttaacttaaaatatataaatgttaattcacttttcaagtgtttacagtagggccaagactttgtattttggtagtgattcactcactataaatatgtacttttctgtattttccactttcatttatttttacttaaaatgagagcataaaggcatatgaggccaactacagcaaatgtctatgttttatgaggtagtttactcttcgctttcacccatttctgatttgattcctgattcctgattttcttcacccaactttttaaaggcaacaccccttaagtcttatcagcatattcaaattggttataaatgtccaaaaccacatttgtattttgcatttctagtatgttacatgatatttgattaaattacataaaaaatctagtacaactgttataaacatgtttgggaacaaatacagatgacctttaaataaggtttcaattcaactggtgagagcagtaatagacagacctgctagtgttgttacctagtgattaagtctgtgggctctggagccagaatgcctgggtgtgaatcctgatccattacctactagcctttttaaccgtggacaagccacttaacctctctgtgcctcagtttcctcatatgcaaaatgagaatgacattaattaaggttttgttgtgaagattaaaggagttaatttgagcaacgcacttaaaacagttcatggaaggtgttaagtgttgtgtataaatattagatattattactacccaggcattcagtgtataagagacgccagtcaatgtgttttgcagatgaaatggaaaacactagctaatctggcaagtgggttaaagggaaactattaagacaaactctgattttcagtatcagtttgttaactagtgacccttattagatcataagtatcttgagagcaggaattagatcttctgttccattcactattacatatctaatgaatacagtgcctgcacttactaaatattttctgagttaattaatgaatcaagttcaaatatggtaggatgataaggtttttacaacaggatatcaatactacctcataaatatgggttacttcacatttgaaaccattcttgccacttttctttttttaattttattttattattattttgttttgagacgtagtctcgctctgttgcccaggctggagtgtaatggcgttatcttggctcaccacaacctctgccttccgggtccaagcgcttctcctgcctcaccctcccaagtagctgggattacaggcatgtgccaccacgccaggctaattttgtgtttttagtagagacagggtttctccacattggtcaagctggtcacaaactcccgacctcaggtgatccccctgcctcggcctcccaaagtgctaggattacaggcatgagccaccgtacctggtttcttgcctcttttctaattgattcttgcaagaactttatcgtatataaaattatgtacactttataaataagaaatatggagtacaaagaggttgagtaatttgttccaggttacacagtgtgagtcattgatatagctggggctcaaagtcaggactcctggaggtctccctatgtaatgtcatcccttccatataaatagtcttaaaataacctcagttaatcctttgtctccatgaataccatctaccctgtttgtcctatttgacttttgatgctccttactcactttaagttcaaattctaagcgtccgtttatgaacaaatctgttcctcttccgttcttgcctaattttctccattgctgtaattctaccataaaaacagccaagcatgagattaaatgcatttatgaaataagaacgtcacttgtttaatttgctttaaatacctcacctgtgatgcatttaacaacataattgtgttaataccaatatcaactgctttccctcactgtgtcaagaagtacagtagtttagattctaccaaggtcaccttctcttgcagcacagtcccaaatcgccttacaataaaaaacatgttgtcaaaatcaatgaatggacagaattatagtattttttataatcatagcttaatgaaattaaatgggtgagccacctcaatctaagccaatctttaaaatatcatcctaacaaatgaagcaaataagtaaagaactattatgtgggaggggaagcaaggggttgacaagcgctcaaatatacagcctcatgttaaattatattattaagagcacaagggcttctttatattcataaccattcttaataatatgtcccttctgagcttttattatcttctcttatgaatggatggcagcagggatattgtaacttatctcaattgtaagttaagctatgtaggattcatctctgttcacttacagagtctaacaatttatcccctctataagtttcacaatagtcttaagtttattgaactcaaaccattcaacaaatatttactaaattttgttatgtcttatccactgtattgggcactgtagagaatcaaagattgcttaaggacagccccttacttcaacgaacttaaaatggaatggaaaattcagatttggacatcaaaagttatttaaggggagaataagcactaaaacctgggttttaaaaaggcataatgaaaatacaaactagattaattctaatggaatgaccatgtaagtttcagaaaggtgtagtatttgatggtttcctaattagtagggttggaacagaggggcttcagatgaagagatgagagtgactaatgcatggaagaggaaaataaggggcctcaggaataagagtatgacattgtggctaacacttacactacccggaagatagtgtgagaaaaggctagaaggctagttaaaccttgactatggaaagtctgagataccaactgaagagtttgcccttacttgacagttaacaggtattaaaacttctctttgtttcatttttgcagtgggttgattatatacattttgtaactattactctgacaggaggagataaaatgtgacggaagaggaaggccagtcaggctattgaaagtaatttaggcaaaagtatcaagatcagaaaagaagttcaattatccaacacaatactgggaaaaaaaagctcaactttgtcaattattaagcaaagatatatacagaatatagtaccatttcacacctttaaaattagccaaaaatttaaacaataattgtgaggttaaaatgtaagaagcacttgtatacaatcagtgaataaatcagtaaataatacttttggaaagaaatttgatattttaaaagtcatatgaaacatatatattttactgaaaatataaaattttaaataccgttcatacaaagagtcactgtcatgttatttgtgacagtaaaaacattaaaaaatcctagatgtctaacaaaaattacaataaaaaatttgatgggttgctatgtagctatcaaaattataatcatgaaagttatgtagtgatatgagaaacatgtaaaaatggaataaaattgtatctatactattattgcaactaaaatgtaaatatatattccgaaaaaaatggcaaaagtacatataaaattaaaagttgagatactaaaaaatttcctcttaagatttctggacttcttaaaatgtgcacaataagtaatttaaagcattaatgtgatgctgaattaggacaatggcaatccaaatgaaaggaagtactataaagggaaacatggtagaaataaacaggagtgaagtactaggagtttgaagggatgaatgaaaagaaggatgcagacttagaggctgagagcctggtagaatagtcagagaattaaaagtaaactaaaaaggtttattcatgccagttaaagcaaacaagttctgctctaattgttaagtcgcaatagacctttcctacgcatttggaagtacgaagtgtatttctgaagaaatatcagtgctaagacaggaacttggaccttccctgaagtagcttgtatttgaagccaaaggagtgggaaaaaaatatatatcaaatttaaggatgtagaacaagaagagaagacaactttggaaagaacatggagcaacacttccaatataaaagataggaaattcaaaaaagctacagaagcactctggaaatgaatagtcagtgttagagatccatgttagcatactgccatggcaactgagaaaaagctttttgtacacacatgcctctgtgtgtgtgtgtgtctgtgtgtgtgtgttctatgaaggaacaagttatccacatattatagagaagtagaaaaggaaaattgggaaaacagatcatagaagttggctactccaagatgaccctagaaaagtagttttcacagactaataaaaataaaattttcagagatgacaaaggaaatggcaggaaggtcatgaattttaactatgccttcaaaaaagtgaatttagtaaggttgcagtgtacaaagtcaatatacaaaggtaagtatactattttttaccaaccacaaatgatgaaaaattttaaatatacactgaaggccgggcacggtggttcatgcctttaatcccagcattttgggaggccgaggcgggcagatcatgaggtcaggagatcgagaccatcctgactaacacagtgaaaccctgtctctgctaaaaatacaaaaaaattagccgggcgtggtggtgcacgcctataatcccagctactcaggaggctgaggcaggagaatagcttgaacccgggtggcggaggttgcagtgagccgagatcatgccattgcactccagcctgggcaagagagtaagactgtgtctcaaaaaataaataaataaataaataaactgaaaacaaaattttctgagtgaaatttaaaaagactgaaataaatggagaggtataatatggtcagtgattggcatactcaatattttctaatgtcacttttccccagttgagctatgtatctaattcaatgccaatcaaaatccaggtagactttttgtagaaattgacaagtagattctaatatttatgtggaaatacaaagaaccagaacagtcaaataaaggaaaagatggtatggtaaacttaagatagtatcaagatcaattctctaggtaatctacagtgaataggccacagaagatagagacccagggaatgtgaaactgctgaaaaggttctatgtagagtagaataagacattcctccatgaaaagtttcctcatggcttttcatgcttcctgaagtcaagaacttcaggaaagaagcatcaaacttcagcaataattccaacccctgacaatccaccaggcttatccatggatcttctatagagaacgatgactaaaatctacccctagagctgattatttaatagaatagctctaacttaagggatctatgataatacatgattcttccacttctcatacccaagcaaagtctaatgctgtcagacaaggtgatgatcctcagcttggaaagacctaaagtgggaatgctaattcctgtctctatactgtcattagaatctatggagaaaaattgagtcaatatgtatcgatctatttcagaactactaatcttcttacaaagacatcaaggaaaaattacatagaatataaattgctgaaacatgaattggattttacttaacataatatacaagaaagcatgtaagactgcaaggttaggatacaggagttttacaattttgctacagattatgtaacttcaggtagaatgacactcaatacttggatggtgttactatgaaattcatgggtaagaagttgggctagataatttctaggattattttgggttattactcaatttctaatcctcagagtctatattaatttcctcttgctgctataacatattaccacaaatttagtggtttaaaacaacacaagtttattatcttccggaggacagaagtccaaaatcagcctcactgagctaaagtcaagtcagcaggactgtgttccctccagaggtctaggggaaaatatgtttccttgcctctctagcttctaaagactactacactccttggctcctggatccttcctccatcttcaaagccagcaatgtggcatcttcaaatttttctcctctctagctgcttcagtcatctcattgtgttctcgtagagtctgactttactgcttctgtctttatattttttctctcttaccatgaccttcctgcctccctcttacaaagacctttgcaggtacatcagtgagcccacctggataatccagtatcatttccctatctcaaaatccttaattgttctgcaaaatctcttttgctgtgaaaggtaacatagttgcaggttctggtgattaggaagtaaacatctttggtgggtggagggcattatttggcctaccataagaccacgttaatatatgcttcaaagtcattatgttttggagttatgctataaaatcattttcctaactttgaaagaaacaacaaaatgagccatatatgcaaatgggtgtaaccagcaaaagttaccttagaaaaatagataattggttcattgatcttgttaatgctcagatattggtaaattatttatttggaaggaccttcagagcctactaaacattctttggcatgtcattgatgttgctttaaatattttaacttgctcaaaagttatttataaccaatattaatgaattttaaaagaaaccacaagaggccgggtggggtgactcacgcctgtaaatcctagcactttagggggccaaggcgggcggatcacctgaggtccggagtttgagaccagcctgaccaacaagaagacaccctgtctctactaaaaatacaaaattagccaggtgtggtggcgcatgcctgtaatctcagctactcgggaggctgaggcaggagaatcacttgaacccaggagcggaggttgcggtgagccgagatcatgccattgcacactccagcctgagcaacaagagcaaaactctgtcaaaaacaaaaaaaaaaaagaaagaaaggaaggaaggaaggaaggaaagaaagaaaagaaaccacaagaaatatttttcagtatcacccaccaattggcactgaaagtaattaccaaagactcattcagttaactaaattctggtatatttgcatttttaagttgtttgattagctcataagcctattttgtaagcccatgcaaaaaaaaaaactcctctccccaaactaaaaacatggttttgtaaaggccacatatccaactttttacctcccctatataattttttgatatacttgttctctcctaagtacaatgcttgggaaaataagatcatagattaccaatcactcagaaattccagacttcctatataataataaaagcaagtttattaaaagggtgaaaatgtattttgcatcttgttatttgcaatgttactgagaatagctcggtttctgacttttttctttaacccctggaggaagaatatttttaaaatctatatagcaagttgaaatcctctctaaagtactatataagtactatatcattacacaacaacaacaagtattgttcttagttacattttgaaaatccagacaagttataatgcccattaacatatgttcttaatttttactcaaatactgatgatcgctataaagacacatgcacacgtatgattattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcattcatagatgggaattgaacaatgagaacacatggacacaggaaggggaacatcacactctggggactgttgtggggtgaggggaggggggagggatagcattaggagatatacctaatgctaaatgacgagttaatgggtgcagcacaccagcatggcacatgtatacatatgtaactaacttgcacattgtgcacatgtaccctaaaacttaaagtataataataattaagaaaaaaaagagagaaaaaaatacttatgaccatctggcaatccagattcaagtagagttttaagaagatgaattaatatttttggaacattttgtaaatatacattttgtaaatatttttatatttgtaaatataaaaatagaactaatgaattgtattaaatactatttaaaataaaaacaaaataatataacaaaacaaaagaaataaagcagtgttatataagtaatatggaaaagttttaaatcttcataaagctaagagggaagacattcaagaggaacatgccttcaaatagctccttatatattagtcaaaattatctctcaagaaagaacagtcttctgaacattcatattgaaggaaaaggagcttaaaccctgggaggaaaccaatttcttcataaagcatctctttcagtttgagcaaccagtgacgaaaaagtatattaacgttcatttaaaacctcttctgtctggttcttagttgttcaaagagttgattgacataaggagagatttatgaaaaatgaaacaaactcttctcatgtgttaattaaaagagttcagaaacctaaaatctacaaagcttattttcctcatatatctccttaactctgagaggttgtaatttaagatcacattaaaatagaaaccatttagaagagggatcatgccttctttattctgtataagacacagttaattctgggttctcagaaaataaatgatgataaaacatctccttttaccaattcacaaataatttcaaaggactcagccaaatctgaaaactctctgagagcgtagatttttgccttctacttcttttatatcccttatagcatctctagaattctgctgatagagtgagtgcccaataaggtgagaagacagaagagggaaaggagcgtaggaagtaaaggaagaaaacaaaaggaggagagatgaggaaaggaaggatgagaggaggaaaaggaagatagagctgaatgagtcacctagatctttttaattcccctcgtggaactcactgaaagttttacatctgacattcaactgacattcttctaaaattggtattcctggattactttaatgactcagaaaatattaaatacctatatttctgtcaatgataatgacttgccttttttttctttcatgacttttttttttttttttgatacacagtctcgctctgtcacccaggctggagtgcagtggtgtgatctcggctcactgcaacctctgcttcctgggttcaagtgattctcctgcctcagccttccgagtagctgagactaaacatgtgcgccaccatgcccagctaacttttttgtatttttagtagagacagggtttcaccatgttggccaggatggtctcaatctcttgaccttgtcatccactggcctcccaaagtgctgggattacaggcatgagccaccgtgcccggctgacattttcatataattgtccataggtatttctgagattgcctaggacatataatatgtccaccagagtacctacaaagagtatattcgttttttccttttaaaactttaaaatttacactgatagatatttgctgtttgcttctgaatgataagctcttaatgtcataatgatgatgatatcactttatatttgtatagtacttttttgtttataaaatctccatctgttttctcacttgaccctcataacaaccctgtgaagcaagtaaggtagctggtattaactgtatttcatatgtgaaaaagaccagctgaagttcagagggaactatccaaggtcacactgctatattcgtttattcttctgatcctgagacattttgcttttctctactgatgagtgtatgctgcactgcattggacaactttatatggagcccaaccttttcttttcactggagtttcccatccactcttatttcttcagttttgtggtttgtcattgtttgtttgttgttgttgttattttgttttgttatttaatgtaatggcacaggcagataaattaaattttgtctttatggcaacaattttatggattgactcagaagctacagaatagatttggagagtacctatcatccacagcttgcatgacttccagtatttaacatttctcaaccaaaaaatttagggtttgacaatcagtctttattaaaaaaaaaaatctagaaggtagtacttgagagtggatggcatctggcaaactaggaagtaaagactttaggcaaatagtcaatgaaatcgagcagacattttgaaaatagaatgtagttatgtcaaacagcatgtgcaatgagaattttccaggccaagaaggaagtcagagataactgatacaacaagctagttctacttaaaaaaaaaaaaaaaaagttcttggagtttattttcccttaatatttagcaaactatttagaacatttaaaatctaaaacgattaaggtcttctaggaaaaatggaagcaggctagtgaagtcattttagcatttttgaggtttcctcccaagcattctacaagtaattacattaggaagataggaaatccctgagtagactattagtagtttagtattaaaatatcaaaattaatgagtcattttaacattttggtgcaagcataaggcaaaactcaactttttattgtaccacatacttagaaattagagtgcctcaaaaatcaacagcaatcatatcgcaactccccactaagtgttttctctgtgctttccattaataacatcagactagcccaggagtatatgtggatgtaagagcacactacggtgagttcaaaaggtgtgctttgctgatctttctttatgtctctctactgttcagcataatcacctcttttattagctgatgacttctatccaggccattactccataagctaaatattagcagctatttgaaaaggttcactaatgtaccaaatattcttaaataaaacatgaatttacagttgaaataagaagtttcaactaaacaattaaaacaaatcccaaatccatttggaggatattaagcaaatttgtaagcaaatagggtcatggatattttggagctggttcagagcaggttgattgataaatggggaagacctataaagagaggttaaagcagttggcatttgggcatggttgagggttggtttagttactgtcttaggaaaagcatgataaccggtgggtactcatctacttgagtcaagtatacacaaacacaaacattatttaagctatagcacttaagattttgaatgtcacaagtgagttttaacattgtattatttaaaacttacgtaggttacaaaagagaggtttgggatggctttttctcattgcctttaaaaataaattttaattttcccaaaagacttaagtgtggctctactaaagcgtaaaacaaaagatatttttacaaattaacttttaactctgtgattctatatcaaaaaccaatcaatacctgtgatgtccaatagggtagccactaacctcatgtacctatttaactttaattaaaattaaaagcacggttcctcaatgacactaaaaaccattctaaatagacacgtgtggctactggacactgcactggacaatccagatatagaacagccccatggctggccaaagttctgtcagacaacactgacctatccaaacatattccaaatccttcataaatgcattaagatatttgtgccctgtatttcaaacactttgataggtaaataaaattaatttttttctaaaaaacaatcttgtaataatcatatagaaggtgtattttaatcatcaaaataatctgttttcaaagtttagctaaattaataacaaataagcttgtgctaaagcaccagttggatggtttacaagggaagtcagacattcatttattgcatttttacacttagcagcttcactttaaagcattctgctctacataatggtgctctgttaaacaatgtttaaagttaagaaacatttgaagtcgagttctaaagcaatctgcatatgctatcatttaatttataaacttttgaagcacttttaaaaaccctcttaattataaaattaatgaaatatttaaatagctcaccagttaaaaatttaggccctgttgtgaattaaggaattaatcttgaactatatttatacattatgtgtatataatatattcacacccacacaaaaaatatataaatacataaattaatactgaagtgccccaaaggagtgattttacatattgtatataataattttatatatttttatgaagataaatatctgattttgcatattttcatgaagatattatgtagatcaatatatttgtttatcaccattattatttctccatagagataatgaagctgaggtagaagagataatttaatccagaatatcagaaaagtaccggtcagatgcggtggctcacgcctgtgatcccagcactttgggaggccgaggtgggcagatcacgaggtcaggagtttgagatcatccttaccaacatggtgaaaccccgtctctactaaaaatacaaaaattagccaggtgtggtggcgggagtctgtaatcccagctactcaggtggttgaggaaggagaattgcttgaacccgagaggtggaggttgcagtgagccgagattgcatcgctgcactccagcctgggcaacaagagcgaaactccgtctcaaaaaaataaataaataaataaataacttagctgtgtcacacacagcctctgaacacacattttaccccgtcatacttgacttctgttttcacatgtttgtaaagagtttaaactagatgacttcaaaagtaacctttacttaataaagttgtattattccaggtataaataaaaccctctgatttatataaattgatatatatgtctatatataacaatacatttgtctaggtcctttcctagtaaaactgttcaacatcaaatgaggtagaaattcacaggttttaaatttttcagtaacagagaagggaaaaaatgcaagaagtcaagtggtttgcagatgatagaaaaaatcagtgtcagatctaagaatatcattcttcgtcttcacttctggctacattatccctttctactatacattgtgcttatcactaatgtattgaattaacatgagctcacttcaaagattttcaagaaaatttatcattttcctgataattaaaaaggaatactgccaagtaatgtcactaaaagactgacagggactacttaggacctttaagaggacataatgtaacagcacttttgcagaagtcaggttattagaacttaagtgttggaggtttgaaatacgcccatcaacctggtaacaaaactgtcagaattaacaaattgaaatacgcactttgagtagactaggaccttagtttccgctcaaagataatgtaattcttgtgttaaagatctaagaaatgagtgagaattactctgttcttagagttctgcaatgtcacaagatcataaaatcctgaatcaagaaggacagatcagaggtcattttgagcagcctcttttattgggccacaaaacatgcttatccccatgcaataatggcattctaattccagtctttatcaatagtaacaataactttagcaattactttttaatctcagaattctagaaatctgagttctaacaaaaacacggtgtatataaaatggtttatggccatgcataatttgtctgccttcttttccagtaaaatgaggtaggtcatgtacatttcatattttagctcatgaaatcttcaccattttcccacaaggtttgtttccactttatatgtgagaacctgaggcctagaaaaaatatacaacttgcccatggacacacaactagcaactggttatcagccaagatttaagtcctctactttgactccagaactgacattttttatattgtgcttcattgctttttttttgtttgtttccagaacaagggttacctatgcagaggtaactgacatatgaaaactatccttagaaagaaatcaagtaaagtaaatttgcctactttcctcaatagcccatttcgcctccaataaaatcatatttaacgggttgatttccaaagtatgagtttgttttacaaaatttaagaggaggaaaaaaagaatatgggtgggatttgtggaggtcctgctatagttaatgagaagatatcacaaatcaggtaaaaatactctctacagatttcttttatgtttgcctcacatactgccaggtattaagcatcagacagatgttattgatgtaatttctacagttacaatttttcacttgaaattcaaaggtagttaacagaacattattcaaattgaatctgtatcatgtttaaggcttctagcttcattatataatatcctgtgtaaaagaagccaaataataaaatgtctttgatgtcaacaaaagcaattttcctttttttatgtgttctcagttcaattagctcccctatcagaccacactgaatccttggctctcagttactaacatacaagcttttcagctgtatattaaaacaactaaggttttggtactgcataatgacattttctatttaattttcagcacaccatggaatctgaagtgattcagaatggctggcttttgaaattcctttgaactaaataaagcaccttcatttttacttgaattattttacagtacttttaccaatgcctaaaggaacaaagataacagctatttttttccaggaggattttggaaactcgaaattcttaaaagaactattttaacaaaaataaattgaaggaaaccgactgattttaattttagagatcattgctttcaaatatatgatcttcaagtcctcttgaattttgagctattttgaaatcaagttctatttgtataaggctttctctctgaggcaaagtgttatgtgagggtgctttccagcattcaaaagcattatatctcaggtcttaaccatatttccacatgtgcacatcttccatcaaactgtggctcatagcacagttatgcaacacaaatctcgatgcttctctcccatcaatttttgaggaaatttttgaagagttccccaaatcagattattatctatgtatcaatacttggtcagaaaaaattcacctgaaaaccattactgtatactgtaccaatacacgatgtaaataaaagttgagtgcagtagacatagttcacttctactacttataacacacatagtgcctaatatgtgccgagcactgttctaactacatattgtaactcatttaatcctcacaacaaccctatgaagttagtactattattttccccattttaaagagaagaatactgaggtacagacagatcctaaatggtggaactcagattcaaacccaagtagcccacttctagaatctgcataagtaacttttactgtatagtgtttctttttgttttttttggacgaagtctcactctgtcgcccaggctggagtgcagtggtgcgatctcagctcaccgcaacctctgcctcccgggttcaagcaattctgcctcactcagcctccctaatagctgggattacaggcttgcgctaccacacctagctaatttttgtatttttaatagagaccaggtttccccatgttggccaggctggtctcaaatgccttacctcaagagatccgcctgcctcggccttccaacgtgctgagactacaggcgtgagccaccgcgcccggcctatactgcttcttaaaaggaaaaataagctgacacattgttagaactgcagccaaaccagtgcttttaattacctaactagtgccaatggactagtttcctatcctttaccatcctgtactatcctttgcctggttgccagggcaaccgggatcactttctttaaccacactggagcttattctgtgtaatcatttgccaagcaatcatttgccaagcaatcatttattcagtcattcaacaagcacaaatcaagtgccttttatgtgcctcacacttgtaagtgatgaggatacaatgcccaataaaatgttctggttgccctcaagaagctgatattccttcttgcaatacttctatgttggtttatgatctatcacatcttctagtgtccagtgcctatactctctagtgtcttaggctctccctttctggttcctgggtattgtcatcatttcaatctcctaccctccattaacacatttatattatcctttccactccttcaatgccatcatccaaattcaggtctttactaataacctacaaataaattacaagaatggccgtgtgttctgttctccttacacctaatctttctcaaacgaacttatttaaccacatcaccaccctcctactcagatgcaaaaactgactctctagtggctgtataataagtaaatctctttcatgtaatattaaatactgtttacaatttgacccccaacctaccatatcagtcttgcctcctaccatttgcttcagatgcactccagtctaataaaatatatctatttgcagttccctgcttaccatttgatcatgttgacatatctcttggcaatgctatttcttctggccttcttactgcctgaaatatgcccacctatgtctatactaggaactcttggaaggccccgttcagaaatcacttatttcaagaagcccttattgaggtcaccagttagaagtgctcactgtattttatgaatactgatagctccgcatagcccaatctaatattcacctgtattgaattatctgtgcatattacctctgctagactgtcctattccttgctgataccaagtacaagttccttacccatatgaatatatagatatgtatagcatagtgctctgcatatagagtatctatatatatagtcaaattaagtaaaactatgatttaaaaatatgctgcaagtcactagatttcttaagaattgcatataacatcatcatatttactgttgtcaaaatataatgttgagaatgattcagaagggaccaaaactgaagctaaggagtttggaatgactttatatttatatgcgttatttaaagttaagttcctttgaagttgttgctcttgtagatgttggtatttttttttaattttgaagttggggatcagggagaaagtaaagaatataggagaaagtttacttgttttttaatgtgaatcagtaaattctaactcggagaactttttgacacacaattccaaaaaccctatcagaagctttgacaagagaagcagaaatataaggaaaatttaaaaagcccaagaaatgctatcagttcacctccctcagtactcaaaattcaatctttcaatcaaattaggcaatagacctgaaccacatcagctgagtacatcacagaaatgctttcactgtattgagctttaatgttattcttatagcttttatcaacatttgctttaaaaaaaaatccatagctgaagcatgcgtctgcattttacaaagaaactgtccagtacattattctatattccctatttagtagccaacattagaattttaattcaagttatgctttcactttctcctttctgaaaactagaactagacaacttttcttgcttttcttttttgacaaaaacaatgctttaataaaacatggatacagaattagagcaattatgttaacagtatggctactgaatttgcatcttctaacctctttaggcatgaccttatttctattagagatattagaccttagtagagatagtctcaattataattgttttacataatttggggatttattttattttattttatcttattttgagacagagtatctctctattactcaggctggagtacagtggcatgaccatggctcactgcaacctcaacctcctgggctcaagagatcctccaccacacccagctttttttttttgagacagagttttgctcttgttgcccaggctggagtgcagtggcgcgatctcggctcactgcaatctctcccttcagtttcaagcaattctcctgcctcagactcccaagtagcgacacctgtaaccccagcactttggaaggctgaggcgggcaaatcatgaggtcaggagtttgagatcagcctggccaacatggtgaaaccccgtctctactaaaaatacaaaacttagccgggcgtggtggcagctttttaaaaaaatttttggtagagacaaggtctccatgttgcccaggctagtatcaaaatcttaagctcaagtgatcatttcaccctggactcccaaagtactgggagccactgcacctggccaggggttttatttttaagagtatactttttaaaggataaatatcgaggctgtgcccattcatttgtttatttatgcaataaatattatcttttttcaattctagagatacaacagtgagcagagacaaaagtttcttccctcaaaacacatataattctaactctgggaaatgaatattaaagtaggataaaagcaaaatatataaaacattggataaaaattgtgaaaaaaaataataatgcataaaagaggaaggaaagggtagttgttttaaataggaggaaatgatacttggttgacaacccaaagggagtgactcattcatctatttgagatgcaggcgatctagtcattaagtacagagaccttgggtgttccggggctacctggagaccaaatggttggagtgaagtgagcaaggaagagaggcatttgactgggtgaggatcttggagtttattataaggactttacatttgactcattaaacaagtagagagatgttcacacatctcaactaatagtaataggtaatttttaaatgatgtttacttgtaagtaatgtgtcagtaagcatcagcaaaaaatgttactttagagatatttaatcatttagtttaatgccatcctttctcttctttcatgtactcagcaaaatcatattcagcagttactatgtggcaacactatgtggcaacaatggaaatctaaaaaaaaaaaagaaaaaagaaaaaaaaaacataattccaaacctcaaagaaatgtctctcaagtggcagagataagtattaattattaaaatttcttttctttagcttttaggtaagggaaactatataagatgtttaggtagaggagtgatcatcatatctgcatttcaggtagattcacatgtagaagagatttgaatgaagtatgactggatgcaaggagatgaattagaaagctgtgaaaaatgatgaaaacctgaactaagacactaacagagggtgaggaactaagtagaaagttacaatccatttttagaatggagtattgacaggactttatgactaaataggtgtaggtggtgtgagaggaggaggaatcaagaataactcccaatttttaacttgaacaaatacatggatggtagttacagtcagtgagttcagcttaggacaatttgagatgtattggtaaattatgattagctgacagttgatattatggaaacccagagaggttgatagatttaaaagaaggtccaggacagaaacccaggaataccaacattcaaacaggaggcagagaaataattgttcattaaggggattaacatgaataaacagaaaaaaattcatgtaagccataggagacgagagattttacatctaataatattgttgactgtgtccacctgtagtggcaaacttgatgtgattatttatttcgatttaatagtactgtttatatgagtattgtagagcaagcatttcagagcaagttattatatttataaagattatctgaaattcagttggataatcctcctgaatataaaatatattgtattattttattgttgttgttgattagccattctaaaaaaatctatcctcctaaaataaaaatgcattgtaaaattatttccttcagtccttcaaatgtagtcacttcaatgtgcttttaatattttagtttacttaagtcactatatgtcaattaatatcatttatgaggaaagaaatagcagtgctacaaagaaacaaaaatacgtactataagaagatgaaaatatatgtccattaattagaaaatcctaggctactgtgtgagctcaggaaaaggacaactcatttatgaaaatgaggttgatatatattctgatatcatggaaatttcaatggattataaaatcagtggaagctcaatgctttgaagaatacattaaatgtgcataatagcagctagtatatttttgttatctggtctttcaaccaagtacttgtcaaccaagaattgcttacaaaattttcctatcaattcctaaggtgaaacaattaacagggttaacagtccaaaatcattagtcaggtcattggcagaaccaggagttcaatatgagatattttttaaatgtctctctttatattgtctgatacttaaaatctttaaaagtaaatgcataaaatgaaaacatcaatatgtctttatatattatgttataataatacatacaaatttagtagaaaggaacaaattaactataaaatccagataacttgtagcatatgtaaaaaatagtcttttgagaagattcatgatagatattaatttttcaggcataatcaagaattggaatccaaacagtagaaaattcgtgttagaaaggacttgaggttgctatatcagcagatatgttctcctttatttttacagtttctacctgtcatttgctctataataatacatgaacaaatgcctcacactgagattactatgaaaccataagctatactgttaccatacttaacattataaccaaaattacaacttcacaaactgtaactcgaggaaaattacaggttataccaagtgtagcagatgtatagaactgtagcagctgttagaaatcctgaatattataccttatgaaattatatttccagttaacataaatgctaaaataagttatttattctaagaagttttttctggagacaaacatttccctgtgcagcagaaaaagcctagtattagaaaagcctgctcttacaagtacattcgaatgttcagaaattcaaatgaagcatatgttgtcaattaatccaagtatataataatttttaaattatgcctctatttacctatgggtgatgcataataatttattaggagagttgttgatactttttttgtttaaaaaataattattagataactagctcagcatcatagagaactaatatctagaggttagaggtgaaaattagtaaagggaccagaaaaattaaaaatcatgacagaacaccagcattatgtaaacagttaagtaaatcaggattaagaaccatcccaaaaatgcacctgcaaaatcgaaacaagcaagtagattgtttagatctacttgcttagtccactgcttcagaaatcagcactgctttgtttaaaagataattattgattgctatgttatataataatcttccaagaccgttacagattaatctgaatacctatgacctcaatctgaatttctatgtcttagaagttttggagatagccaacccaccaatctgtcataaagcatattagctgtctgggggttaccagttcctcaggaatgtcaccctgtcctgtcctctccatgtgctgatcatgaggagggttagtgacactccacacccattcatctctctcttttttttggtagtgtaatgagtacagcaatcattctagcagtatttgctatgacaacatcattcagccccaacttatgccaaaaatgtgcatgttaagtgaagggaaacaagctctaatggtgccctttaatgttctgaagacacaggtgttctctgtgaacttgacatttgctcggtctacatgtgatcctaagggttccagataagatgaattactgtgtgaaagtcctcaggcattttctcacagataaatagcatgaaattttgtgatggagagagaacaacctcagtagtaactaggtaaagattgtactggttccccagttgataatgggagccactgcacaaaggtcaaacaatttggatgcaaagtatccaatttgtcatcacaaattggatttgagagtgccatgaaaatgatgagccagcacactgcttctaccccatggtgacatttactctctcttacccactctcccttagttcttatggattcttctgaaaatataagatggaatttttttctagatggattagagaaaatatgtgtctatattttttaaacagtatacaatggtgacattattaagatgatgacactgatggtgatgcaaattaaaacccctgagaatcttcactagatgcagtaataaaaaggttaaccaagatgtcaggaaaaaatgcatcctgaaatatcagcgtaaaagcagaatccattctctgtggtatttttaaaattataccacatgatgttaaattataagcacacatcagttcaacctagcaaactttcattgaacaactatgacatacaccaaagagacaaagataaaaaagaccttgactgacccttcaaggagcttgcaatcctttttaagtggcaaacatttatgccactaataaggtgatataagcattttatacttttttttagatttagaaatattacagtaggagaaaaagcagatctttttacacacacaaagaaaacacttagaattgtactgataataagattagtgttatttggtccatagagatgccaaggtatgtcagttgtctcactgagaactagggaattcagccaaaaatggttcctgatcatgttctgccagagcaaatagtactgaagaaaatcaaacttgtcagaatagattttctgagatgtgatgagctagtgttagaatgtgaaccaactagtgcttgaatgttgaactatgcttccagccttatggagagttaaggctccccaagctgcccaaggggccttcgtgatacctgttttgttactataaataatagaggttacttagtgaatgccaaaagtgatctaaacattcattagtattaactgtatacctatgttgcaaatatcaccagaaaagatattggaaaggtaatcaccatcaattcttatattcctaaagctttcttccagtcctctttttctcctttcatgaaatagttttcagacgcagtttggaaaacaagtatagtaattgactggctcataaaagcaatggaaattaaattccagctgtattgtcattttcaaactcatgtttttggctacctcatacctctaaagcattaaaattggcatgtgtctattaatacattcatcaattctttcattcaactcaataaaattgagttcttaccatgagctaggccttgatgactcatagataaataagataatattctatcctccagttttgcttagaattcagtaaggaaagaatgacaataaagtgctgtagctgatatattgtattcaggttaagataggaaataaggctgtaatgattcattctccccctgtgggattgggatcacattcataaaagcaattgtactggggtatcaaaaagtttgtgaggttgaaacagaaggacacattgggcatatatagtagtttgataaaattgaagtaaccttaaagtacgtgtgaagggataggagacgtgagcagagctgaggctgagagacaaaaaaaggcctatgtggtaaattcagaatttagactttttaataaacaggagaaaactatgaaagaagaggatttttggacagaaattctaaaatgtgttttatgtatacattaaaaagaacaaacctggatgttagagggctaatttgagggtaatttcaatagtgcaggggatgagcaatggaagcctgaacccaaatgggcatctctgtgatagagaatcatagaggaatgacatttgagaggcaggacagacagagctgactatcagttggatgtgagacatgaataaaaaacatgatttgactcccaagtttctggtttggataagcagttgaataattatatcattgggaaataacaagagtatcacattatttgagttttccatgtcttctaagcatgtagatttttagatctggagctcaggagagagatttggagtcatatatgtataagacatagagtgtggcagtggatcaaatagtgtgggcaagaacatataaggtaagaaaagggcttgatgaaaacacagtactgtcagaagctaggaggagaaaggaagtcatggaagagaaggaacggaggaaaagtcaagtagggtgaggaaaggtaagagtggggaaactattagaggaaaaaaaagaggtggtcagcaagtttgattgtcatagaaaaagaaggaagagtaggactgaaaatgtttgctggattcagaacaaagaagtccatggtgtcagttgtcaatgattagatagtcaacgagagttaatttagttccaatggaaatgtgaggaataggaggtagttaaagggcaatagaccagagggtttaactatatttcctgtaacaaatttgaatatattcgaacgctataaaagaggagccaaataagtgaaaactgagcagctaggtctccatacctgaggaatcagcaaccggtggaatagtacaaaagcaaagtggaagaagtagtgttaaataggaggaagcaagtcaggaaatacagatataaattacctgcaggtgtgagggctagctcttgggagatttcatgcctcaaggctcactttctttctttttttttttttttttctgtgcaataagatctgggtccatttccaacttttctccctatagctcacatacttgaagtgtgccaagaacaccagatatggcaacatcccacagatgatgaatggtatgaaaatggcctgagggttctacatcattcatatattctctgatcactagagatttattctcctatgttctctagcaaaatgattacagaaccacagcaataatagtggtctgctcaattagccaaaacatgctactgaaaccctttatttgttccacagaaagaaatgatctaaaaaaatcttttctgagggagtaggttttcctcctaagctgcatgtcatttagctcttccaatttcttctagtatagggtttatttcaatgatttctctgcctaatgtgatgctgtaacactctgaatctcacatctttcctcagtcattgatgtgctgatcgttcagtctgccagatcattaacaatgatttttttttaaagaacagttaacaccaattcttgcagtaatgcctaccctttaatctcccactgctcctaaaaaggaatcatccatctttatatgtcttttcatctatcattggtatttgtgctttgttctttgacagtttcagtcaatctgattaggttttatgcacagcaactcaatagcacaggataattatgatacagtgaggactacttttttttctgtttacttctatatgcccaacattctgttctgtaggcaatctgacaattggagaattttaatgcaaaaataatctctttaaaaaaactttcaaaaatttcaacctctattttagattcagggggtacatggacaggtttgttacattgatacactgtgtgatgctgaggtttggggacacaaatgatcccatcacccaggtagtaaacatagtaccaaataggtagtttttcagcccttccctcctccctctttccccccaactagtcgccagtgtctattgttcccatttttatgttcacatgtaccccatggctagctctcacttataagtgagaacatgtaatattaaagaaaaaatatggctgcaacatagtaggcaaaattcattttcaaggagatcagaaatccaattgattatagcctaatccaaataatttattatttaacaatttaacgagggggaaggggatatttccaaaacgtttaaagtttatttctcataggattttaaaattacctggcactataatatggaaatagagagtagcattaacttgtcaaaaattaataaaaacttgcttttaagaagaggacaaagggagtcaaaatggattgtctaaaatttaaatgcaatgttagaaagatcacttttgatgctatctggaaagtttcccagattccccattgagctaatctctgtgagtgctcattataagaagtgatagctatccctctgtctcagagacaggatttgtcttattctgattgacacagctcatgttatattaagtttgtgaaatgaatacaaaagctaagataacttttgtttttaatgacttgcacctttttttaaaagaactcttagggatgttataaggataaagtaacataatagatattttgctcagcaaaaagcatgattcagcctagcacagtggaaagatcatggtctttggagccaagaaaaaactgaatccaaatctaagtaacctcagctctgccactttctagctttatgacctcagataagtttcttaccttcttagcgcctctatttccccctgggaaaaacggggataaccagaagctgtgaaaagtaaataagatttgatatttaaaaccttgcctaatgctgaccacatctaggagacgctcaataaatgttaatccccccaggttcccaatagcatagcttttgaacaagtttatagatgccaaatatgaaagaaataaatacatattaaagactaccagatacgtgatgctacctagttaatgcttacatacagtaaatgctgaagcatacaacaaaatacaaaatgttttgtatttctttcccagacttgtagtggtattcttagttcttgagattactctaccaacatttattaaatacctgttttgtgacagtagagtataaacacagataagaaaccatctttgttcccaaggagtccatgatatactttaaagaaccacaggagattgaaattggcagaaaccctggaggtcaccaaatacctccattttttaaaaaaaatttattcattttatttttgttggtttttttgttgttgttgtttgttgttgttgttgttgttttacaaacccttgtgttgcgagggctgactttcaatagatcgcggcgagggaactgttctgctacgtaggaaaccccgacccagaagcagatagtctacgaatggtttagcgccaggttccccacgaacttccattgcgtgacgggcaagggggcagctgcctttgcggccagaccccgtttcccaggactaggggcactccgcactggaccctagtcctggcgcgggatggggcggcccccaggcggggatagcgggggaccgacatccgagaccagccaaggcccccctctgttttttttaaagaggagaaaccgaactggagaaagtttcaatgaattactctataccacattgctagttagtggcagctccagtgaagccttcctgactcctaacacagtgacttttcctttaacctggtcccccaaataataagctgtaaaaagatttactggaagaaaaatgcacaagaacttctcgagtaggtcagatttctttttttctctcttaagtataaccacatcatgtttgatccattgaatttctgtaatggtagtgtatcattacataaaataaaagtgaaaaagaaatacaacaaatttcagactgccttatgaaatacaatagctaagcttaaatattcacagggctaatcccagaaaaggcagtctggactcggttatccacataactacctctattatccatttcatattagaatgtagaattataacatagttaatggggtttcaatttaaagaccccgtgtcatcttattagcctatcatctgccctattttctccttaatttaccttatgtttatacaattcttatctcagggccacgttgctaccataaatcaaatatgccaggtttcaagtttcagcatatgagcacagatgtgagcgaacagcttttgatcactcagttatctctaccagagtaactgaaacagggattctcaacacatagaacttctaatccaggctgacctcaattaactgcaagctaatagacattgccacgatatcttcctagaagaacaaggggattcctggaaagaaaaggaatctatccgtctttcatcccactggtcaatacctttttctcagaatcaattattgacattttataatctatgatcttcaccaccgtaataagacttcaggaaaaaaaaatgtaatttcagcagaaaagattggaagcatggtactagggatactatacattggcacaggagaagataaatgtattgactcagcattttgttaccattatccttctctctaaaatctagttctgaataaataaaagcagggactcagagcctggcaggatatcttgccctgaatgcatggcccataatcgaagctttcaacaggactttttgggtgagtagataggaattaagggtccaaagaaaatttgggcactgccttccttttacattgatgacttaaagaagaagaggtacattagtaggtaaagaagaaataattaccaatttagaaagagggtacagagggtagaaaagaaatagtctaatgtttgcaatatgtttggaacatatattcagggtccaggagcactgcctgtatctgattccttgcttctgcttatccagagatgagtttagacagaggacaatgaagacagtactcagacagtacacttatcttctcccatcccaatatatagaatctctagtacaatgcttcaatccttcctgctgaaattgttttaacattttttctggagccttatgggagtggtggagtctctagatgtgtaaaatgccaataaagaatgcttactgggaaaggtattgactagtgagattaaagacaaatatgctcctcttctttccagaaattccctgtgcccctaggaggagactgtgtctgttaaataatgttaactccagaaggaaagatcaaaaacaagagagaacaatgaaaggatagtgctaagtgtgaaagaaaaacattaaggaaaggagtcggagggaaagtaagagtgttactgcattatatttaaaccagcctgtcacaaggagaaaagaggcagaaacatgtgtgcttcttgtctgaccacttatctaccaaatccagttcttctacctttaccttcatcgtttcaggctctcgtataggcaataaatggtgtcaaagattcagcaagttgctactatatatttatgaaataaattcacatatatttatgaaataaatacccatcagctttcacatactaaaataattagtgtaaaagctattacattaaattaaattaaattaagatttcattttctagcattaacaggtggctttccccttattccttattccatggtaacatacccttctaaaaataaaagtttcaaccagttttcctgctcttagttcaatgtcatcctaaaaacaaaaaaacaaaacaaaagtggccctaacacctactgggtgttaaaagataatcttggattagcagataagctttctgaagtgggaaagtgagattgagcaaggggaatattaaattgtcaagaacagtaccatgtgttctttctaagaatgaaaaacttagaaatttgctatcagaagtgaccacctctctaaatagtctagaacaaaaaataaaataatttattttgtaaaaagaaacatcttcccttcacggtcttcctccctttcctacctctgttcatcccctgccatgttcatgaggtacaaacaaaaataacagtaggattaacctggaagaccctactcatgaaaaatcatttatataaacgaggaagaaaattctgcccactttctagcatatcaaggaatattgttaaacgtatttaaaagccagtctgtgattttgcatggctttattaataatgttcttgagaaaacaaagccagtacatagataaattccttacatgatgatcaacaccaaggaaacctcttactgttctcagacctaacataaagaatgatgattttcattcactgtcaggtacaaaagcaataatatatgcaaaataggaatacaggaaatattgcacagctcactaatatactgcaagttactaatgggaaaaatatcaaaataccttaaggactattatatacattatcacaacactcaaagaatgaaaatcacttattcctttgaaaattgggatactttttattttgagagctgcagaaaaccctatgacgcactacatagctctcacagtaaatttccaggatcaaagttcaaaaacaggtacatgataaaatgagcaaagtgaggtagacaacagaaaatgccaaaatgacaataactgaaaatattaatttccaagtattatatctcataacataatagtaacatgatgtctcaccgttcccagctcatcacatgttctaaagctgttctcctcctttttataaaactttattatcctgctgaagtttcactcatacaactagtcattccttaattttatacttagttattccttagttattcttagttattccttaattttattttcttttaacatagttattttatagcaaaaatttatgatgataactggttttttttttttttgtactcttcttatcttaaaaacaccagttagaaaaaaatgacatttataacttgtggtctatggaacaagatcagtaattattccatgcaggataatgttagtatactaagtgagacagcatcatttagaggaaaagaggacaagaaaagatgatgatggtagaaacaggaggcagggtcagttatttccatattgatcatgtagaccgtgcctgataaggtaagaggtctattattaatcaaccaattcaaccaatgatgaaggctcaacagaaccccaatgtcagggaaaaagcattaaatttcaaatcccattatccaataagcagttatttatgaactacatacaaaatgtaaactgaatttctaagccacatacaactatcagtataattattctataatctaaatatatccttgactctaagaatatacatatttcctactacaaaaatttactcacccagtttactgataattaattccaccaaggttgagatgataaaacttcaagggtttatttcacaaggttgctttgtgtttaacttgaacaaaaaagggaaaataaacaacaaaactaaaacaaccattgaaccaacacacctgaattttcaggggtagaattttaggaagaaaacagtccctgacaagtacaaattctctacatagaaaactgcctattcggcctcagtctatacacaaaaattactactgcacagattctgtgtagtagcacaaatagaacaaaggtcaaagattaaatgtaggtatgtgcatgtgttttatatatattacaaatatagtaatatatacacacacattttgtattagcctatgttattctaagcattagtcttagcatatgctgtgtttcacatttagaaatccctaaatgtgttcagaactgagggatgtattattcataacttatctttaaatgtattatttaatgcagtatccatttgtaagttagtagatgctgatctcaccaattcattgactgtggctaggcatgcacaaatttcacataaagatataaagctaatatacatttccttcctctgatttccattgcccggatttcttgcactaaacttttctgctgtgttgcacatagtgcatgcagaatgcatgtagaacatgccctgaagaatctgcaatgcagataagaggaaagcattattcccaatttgcatatcacaccacacacagtaactgatttgtcaaatatcaaacaatttacatattctaggcctcctgctctccctttcttgagcgttcggtctactttttctttttgcaactgaattttatagagaggaaaatatatctttagctaaggtgatgtaatttgaaaatataagtattagatttctccaaatgacttaagaatattagaaaagaaaaaaaaagtacccattcagcttagattgcagaacagacagggagcttaaacagcaggctctgactgaaaattaaatttaagcttccagttactgcagcaaaacctaagaccaccttccctctgtagctcgagtgggagacattgttctgctgtctctctaggctctttggtacgctgaggctgatgtgattgcccagactcgtgtcctgcatggaatttaaactacttttgtaacagcaaaaggaatttactgacttcctctcagattgaaagcagaaatgaccactcgcatcaaattatttacttcgatttgtagcttatttaaaatgaggtaggttgtgattgatgttgatttttattcaatggctcatctattctgatatttcagtttcttaaaatatttatgcaaagttttgtttggattacttacatacgtagcacaaatgattctttatttgccatggtgacagcacaaatcacattatttgcagaggttggggagtcccacaaatcagcccccacaacaacaaatatttatttattgaactcttggaacagttacaaagaaatataagagacagtttctgttttcaagaaccttacaatatgggaagataaaatatttacagatacaaattaaccaataaaataaagacagagatacaagcaatgccacaaagccaaaatcatagtggagattctgccctggcaggaatgagatctcattacctgggtgaattattattcctctagttctcagtctgtctctgaaaaatgaagacgtgaactaaattttctcccaattcaacagccttaaaatttaatatgaattctcttacacctaaccttaaatgtcttcacaattgtactctatgtcttatctatggaaagggaagttagtagccaccaaaagatatttcaattgatctattttcccttggacattttaacagctaataagccaagaaatgctatctaatttccttacacatcttttttcttttttcttttttctttttttttttttggtgacggagtctcaccctgtcaccgaggctggagtgcagtggtgcaatctcggctcactgcaacctccgccttccaggttcaagcgattctcctgcctcaatcaggagatggtctcgatcttttgacctcatgacctgagatggtcttgatcttttgacctcatgatctgtccacctcagcctcccaaagtgtagggattacaggcgtgagccactgcactcggcccacacatctttatacaagaggagtgaagttatacacattgtagtctatcctacaattttttttttttttgagatggagtctcactctctctcccaggctggagtgcagtggcaccatctcggctcactgcaacctctgcctcaggggttcaagtgattctcctgcctcagccacccaaatagctgggactacaggcatgccccactacagccagctaatttttgtagttttagtagagatgcagtttcaccatgttggccaggctggtctcaaactcctgacctcaggtgacccgcccacctcagcctcccaaagtgctgggattacaggcgtgagccaccacgcctggcctaacctacaaatttttaaatgggattttgtttggaggggtcgttgagagtctatttttcagataaagaaaccaccttacctagttacaagcattgagttttctttccctgctaggtcctctaccttatctgtggtaccagccaaaaagtcaattatttttaactccgagaaaattctgactgcaaagcactgcctcttcctactcagtacagatgatcaaggtgggataacacagaagaatcttcacacccactcatcactctctctctctctctctctctctctctctctctctctctcattaaaagcactaagcggccaatgccttactgtctattccatgggcttcactaggctgtcccttcttaggcctagaacgaaatgggcttcacaaatagaaattattctaatccaaataatatttccccaagtctcacagtgcaaaacaccacagcagagagcacatggtgatcaagaaagacagcattatcataaacatttgtatttcttatgctaacagatcccattcttccagtctgtggcattgtcccaaactgccccatcaaaggttctaaaatatgcttagggcatctctattaagaggatgaggagaaaggaggagggggaagatgctaacaactaaatggtaagtttttacataatggtacatcctgccagccaacaagttttactacaaaaacaaacaaacaaagaaacaaacaaagtttacaaatcctttctcttttttttaagttttattgattctgctgaatgaaaacaaaaaacaaaaaataaatgtttatattagtcctaaatgtaagtttcgtaaattctaaatgtaatacagctgaagcaataatagtactcatttggctcacctaaagtgccaaaccatttacctcaaagtatgttcattgtacttacactgactatgtgtttcagttgtaaagaaaaataacattaaagagcaggtatagaaatttagtctataacacatacaaaagctagagctataccatcccctaaaacatgaagaactttgtaatactgctttgtaatggtaatataattactttatcatagtattctgttttctgggaaccaatcatcttttagaatattaaggtttggtcaaccttcacacaattaactttagtacaagcatgagaaaataaggctacctacacactaggatgcagtgttttccaaatacgctaatcttagaacactatacaaatacaaatacaaatttgcaggacattactggaaaaatctgattccattgatctgaggtgagatagaagaagttggaatttttttaagagtatctctagtaattcttattttctggcagacttgaagaacatttttataatgtactcaaaaccaaatactaagaattttagattatatttgccaggctgcccatcagtcagtatctatatgcatatcatttgaagaagcttgaaatagagttagcattaaaaatagttcctccattatctatcacacaaacagcataaattcttttgttttcatctgaagcactttttgctctttgaggatccttttctaaactgtaaatttcctggaaatgctaccagtcaatatctttgaggaactaaataatagtccttgaagagcaaaaacaaatgaaaaaataaatggtggtaagcaatggagaaaaggagtatgaaacgaattctgctaaaggaattgcaagatggaattgactcattttcccattgagattaatcttttgaagccaaaacaaaatccgaggaccacagatgtaaatgagcatgacttgtatatctatgacttgtgctagaaagggctatattgtcatgattacctcccaaatggtcaatgagactctggctaaccttccctaatgaccttatgtcatccatatatcttaggaaaagtaactccctcccctacacgatatctctaaaagagcccactgaccagtttccttaattctgtccatctttgcagattacagacacttagtatttaccgtttcaaaagtaagcagcttagtatccatcgctcctttataattccacatattcacgtaagaaggcaatgataattcaggaggtacttcaagatcagtcagtgcctcctggttattaaaaaaaaaactttataaataaaaaggctgtaccccaataatataaatttgtcaacaatgtggagatataaaaatttaccccagaacatcaggaagaaacatgtagaataaaagtactgaaatgtaacaaaagcagagatgtgacctataggttcctttaagggtaagcttttgtgtcacacaaagctaagtgaccaatgaggacagcaggatcacaccattgatccaccaagtcaatctgagcttcttcaatctctggcctaatgcttcattatagcatgaagttcccccaaaatacactaatatgggttcaacaatggcgactttttaaagtaaatgcttggctattaatgccttattggttccctaatagaaaagggcaatgctcatatgattcctttcttaccactcttccttccaggttcaatatgatgcagtatttccaatggcgggagacagaaacaatgtcacaaagtgggagaggcactaagaatgagatctggcaccacttactcttgtttctatacaatcgaagtacaacacttctcaattttctaggcgtctttggggagagatcttatctctcttaatggtaccaactcagtaacccaaactgttcaccaatacttcttttaagtagttgtgaggtagggagtccaacacttcccaagagatcctgttagtacattatagcaactacagggaatgttttacaaatgactgtcattataatgttaaatctaacatatatgccaacccccttagtttatacaataactttcctccaaaaatcttaattaaaaataaaatatagctgacttcgttataaagagactcattaaccaggacattgcagtttttattttatcaaatagaaatagtgaaaatgaaagatgacatattttagagtcagcacatcctgggtccaaattccacctctcctgcttcctacctacgcatctttgagacagctgcataggctctttgcatctcaactttccacataaaatgtggcaccccacatggaacataagtttgttttttatcccttccataggtgtcaccattagtacaagtattaaaacttctcataatttcccattgagttttcatattattggaacaaactcattaagcaaagattttatgaggctagagtaaaaagagagcagtcaaactatagacacagaaagcagtcatggacagagattcacaacagaactttacacagttcctgtccaaagggataattaacaaagcaaataggtaggtgttgttttaaccaaacagactaagataatgaaaaaggaaaactgcagctctggaaaggagacaatgccatttgcaggctagaaagttatggaaaattttctaagcaataaaaacttaacatgacccaaaatataatcaacacaatattttgaaggcagacaatgcttcagaaaagatgaataggatatcacttaccatgggctttgttctttgtaagaatttcctggtatttttgtgggagtaaggcttgggaatttcagacctcagagctaacagtgggcagaggatgaaagatgtacctcaaaggttcttaaaagccataaggatatcaggggtgtcttaaatttccccaacaacctccatatccctaatgataagttgccactgtaaatggctgttgtgtaatccatcatgaatatagatttagttattgactgggaattctggtcaaggaggaatattttcaggttttatttacactgatgataatgtgtttcctcatgagcataatactgtactcttgcctcacctcttatgttcttttgccacatgtaatatatgtatattatattgttgaggtggagatgaagaatgcttgtaaagtattggaaagaacaatgtcacgtttttatgtcctctgagaaaataaaagggtagtctacctacagcctgaaatacatactgtcgcccattcatggaatttatatcacataagagttgattaactgagctttaataaaatatggttggtatacaagttctaattcaagaactggagtgcctgtggacccactaggatgtgtttaaggaaaatatgtttgggaattcctttggtttgggtgaggcaatatttctctggcttgcagttacttctatgcataattggtcattgttagtcttcccaatgtaggactggattacaggaatgctcgtactacccatttttgcatctaattttatgttcacaattttgcattatttttcttcatgagggtctctcaaattgtataagcttcaggcttgtgaaaccaagatccactcctgatctgtatctgtaaacactgtacttcttaagcatcaaaggacaggtttgaataccatcaaaggacactcacaaactttctaaaatatccacattcctaaggataacaataagggcattccaaattaagtggcgacagaaaaataaacacaaacccaacagtcctccacccacaaaattacattatacagtaactttcaatcactatgatctcaagagctataattaaaatagcaagttcaagtactttatatgacaactatgatatgaataaatctgctagagcaggatgaaacaaaagacaaagtgtgtcatttacttgtataacctgcatcacctcaggaaggtgcatatgaggttacatcaatatcaagtgagagagcaaggattatgtggtggcctgagtgaatctgctcatgctcctgggtgcaaaagagtgggaactgactgagactgattatctttattccttcttgacagcttaattaagttctctaattagtcacagtcattaagcactacatcagcaattctgcctcctcttggattggcttcttctctagtctaattggttagaaaagttagctgatctaaaacattgtctttcaattttgggaaatcttctttttcacttttattgagatataattgacaaatagaaagagtttatattcaaggcatacaatgtgatgttttgatatacatataaattgtgaaatgattgccacaatcaattaatatatctattatgtcacatactgtgtgtgtgtgctgagaatacttaggttccactttcttagcatatgtcaagtatactctaagttattattaactatagtcaccatgctgtgcatggtcttcagagcttattcataactactagtttgtaccccttgaccaacatctctccatttctctcactctgggacccctgctacctacccttctactctctgcttctgtgtattcaatttcttagattgcacatataagtgggaccatgcagtagttctctttctgtgtctggcttatttcacttagtataatgtcttctaggtttatccatgttgtctcaaatgacaggatatacttcttttttaagactgagaatactgacccagcaacacgaggttggtttacttcaagaagcaccctcaggaaagttgtaagtttgctgaactgggtcctcagccctgtcctgatcaccattttaccaccaccaccacgatgagcttcttcttcactctctctcccactctcactattctctcagctattcatcctttcacactgtctcagtctcttttgccatcccttgaggaaaacaccaccaaagattgaagccaaaatatgagagttcatactctaccccacaaatcagttcttacaaagaagacttcaaagaaggtaatgctctcaaggatatcactttgcagaagtgatttcctataattccagaatgataggcaatcagcaggaaagataagtgattgcgcaaagttccccacatcatagacacacctagaaaagtacagtgtccccaagacctgtcatgtctttcaactaatcttttcttgcatgctggtgtctcttcactattatatccaatgcagtaatatatttaatacctcgaattacagttcctataatcttaggaaattattttgtgatcacatttctaatcacagcatctcatgaaacacccccaaccactacactgcaacaacttacaaaagtattctgggattatgcagataccatatttggtcttagtctatcacatcattcttactagagaactttgttctaggcttttgtcagataacatattgttttatgtattacattggtttcaagagaaattttataattcttattcttttttaaagtccaccacaggtacaatttctggctgtaaatcactactttaaaacaacagcagtaaattagcagtaaacaacatttgaagtaaattacagcattttgaaagaaatatctttggccctttctccactatattcagaactgagtgactggcccatgaactatatccctcctcacaaggtatcattcacatcctccattgccctgcaaggccccttttttttctgtgcgcagaagcccagagagcactttctacaagtttagggaacatgctgatgtagaaacatgaaggataaccacagtatacaagtagtgcaagctatttctctttttgcaagggttacctgttgtgtatctaaggaatcgtgactagacttgtaatgtctgcatcacagagcatctacaaaccagaaaatctgagttctaggctgttttctaatgattcttagacacatatcaatttctaagatcataaaatgaagatacttagtatgactacacctgcctatcttctaggcaggcgtcaaggacattgtaagccataaatcaccaaaaaaaggcaagaaattatttttatcatgactaaaaattttgttttccctcctttagtctttaaattctgctaatgcagccttctaagaaggacatttctcacaaaggattgataaatatctgcacacacaaatgagtccacttagtcttgagaatctaatcctttagtcataattatcttggtctccatgcagtctaatttcagagttctagtaacaaggtaacataacatccactttctaaatgccctcaagttggtcacattataagattaatgagccagatcaccattttccaaaaataaatacatagaaccttgatttgaattagctaaatgaattgacatcatgttagtgatgtcaaaaatggtagagacttctatttcagcagagaaaaagcaaaataatattttaagaccaatgaggtttaagaaaatgaggagtaaataaagaattgaaaacaattaattgcaaaaattggaggggtatttgggcacagacagattgtaagagacactcgatggcaagaatgaatttaggtcgaaggtaatatgaaatttagccatagaaaatttttaataaggatgatatgtcgtcaaagtatatttggtgccatttggaaaatgactgagtcttaaaggatttttaaatgatttcctttttttaaagttgtcatagtcagtttgttctgatcttgagaaagtaaatctgtcttctgatggtcaagtgatggtttccctgaacatccaaacttggtcttcatgaataaggaatcagaatggagaaaaatctgaaaatgcataatgaacttttcagtttagctatgttaatctgtctcaaaattaggagtccatgacttttatttatactaatgtatatttgcatatataatagcatgtatgtctttattttgctattaagtcattttgcaatgaagatatgtaaatattttaggtgccatagggacaccaaaaaatagaagacactgtttctgtttctaagattctacaaatatgttgagggagataaaattagcactaataagaatggcttttttaggtgaggcacgatgataaaaatgtcttttttaggccagacacaatgactcacacctgtaatcccagcactttgggatgccagggcgggtggatcacttgagcctaggatttcgagaccagcctgggcaacatggcgaaaccccatctccacaaaaaaatacataaaattagctgggtgtgatgacatgcgcctgtagtctcagctacttgggaggctgagatgggaggattaattgggcctgggaggtagaggctgcagtgagccgagattgtgccactatactccagcctggtgacagagaccttgtctcaaagaaaagtctttttaaaaaaattctgtaaatgtatacaattaattgccaagtgactaaacagaagacaagcgtatatgaaagtatgttctagtattgaagcactttcatgaaattttaatttatactcaagtacataaaagtaaatgtttccaattgtggcagaaatagccatgctcatcaaatattccagttagttttctaaatatcccagtaactttgcagttaggcagcaccagataacacattctagttcatgggcactagtggaaaggatttgtgtcacttctgggttaaggtagcaaaaatctcatgtgctgttggcagtttctctttctttaccatgggttcctgtctctctctctctctcttcttctaccatggccagtgaggagtctaggcatcattccagatgatgtagctagaaaactgtggtgcctctgtcagcctaggttcctgagtgactatggtccttaaaactaggtgtgtctcccagtacaaatggttgtgtacatatatgacatgaaaaagaaatacatttttgttttaagctatgactttaactagtttttttaaattgtttttgacagtgcagcatagactagcctatcttgactggtagaacaaactaaagctgtgtgaatgaagaaaaaggcatccagaagtgacctgtcaaaataacctcaaagagtcatgggaaccttccttagtgactcaatgaaattttattttaatacacttgaaataaaaattcattaattctattcaatcaataaaaaaaactaaggctaaaaattaacggtttggggaatagcagaatagtgaaaaataacagagctttgagagagttatcaccttgcttcctctatgatacctggcatattaataactaccaagactcagagaagctgaactgaatgaaagcattttacctttattctccccaactattagcttattgtccttcctttgcctccctaagaagttacatcaggtgcatattgctacaccaatatgtgaactacatgatgacagcactatttacaaaatagaaacgtttggttcatcagcaaagtaatttttagatgtggtatcagagttcctttattgttaactccccctgtcctgggtttttatttttctctctcctgcttctctccataccatttggctcttcttatctctgttctgcatctttagctggagtggaggctgcacttcccttgtcccttaacaggcatatcaaaaaatgaatataagggccaataggaaggctacctgtgaattgtagcaatgttttagcagaagagaaaggatgttccacagaagtgattccttttacctgtcctcacatctggtcaacataaaagggatgatgaaagagaaacgatatttcagcagttgtgtgcatattctaatatgtatctttgtttctaaatagttgatgcattctagcttaatccttaataagaaaggacagcttcattacaaaacaaattcctcattggcagataagcagatgagagggagaatatttaacattactgataaagaatcaagttatgttctagattcatgcagagttttatagaattggtgcaaagtattagaaaatttataagaaagcttatttactgtaaaaaaaatcaatcttaggaaatagccacccacacatttttcaacctacttccccaaaaccatagtataacccttagaaagaacattgaagaacagataggaaggggaggtaataatatctttaagaactcactaatatgaaccactttatatatatatacattatctcttaggatcatataacaaagtttgaggcaggtggatgatatttgtatccccattttatagataagaacgttaaaacccacagagagtaaattgtttaaagtcactcaagtactaaaccttactcagtgtgatcaaaagcccatattctttattgtaacttatagcatataagctcctataaggaaaatcacttactaaaaatgtcttctcttctgtacatgccagcagtgctattcctcaaagcaataatctgcatagttttaaaattagtggtgctaaatgtcagcgatgactcatgctttagcattatctcttaagtatgcaggtgataaactttaaaaattaagtacattcattgtatttcaatatttctctagccattctttttggttgaaagtgtgtgtgtgtctgtgtgtctgcgtgtagatatggggcattaaggcaggcaaacttagaacacaaaatataaaaattgggtggggaaacatctggatgacctcaatatttacctaacattcttctttgcaaatgttctgaattgtctcatcaattctgcatcatctctgcccccttatacacttttccctgcattgcctggaagctacactcccagaatttcttaccagcatggttccaaatttgattctgctaatgaggtacacttgcaaaagatttggaaggcagatgagaaagaaaaattaattttcctccaacaacagctggaaggcaggtgtcagacctgaagtttgtgtgggcttctgaaaatcaccaacttcagtgcccaggtagccaagatcagcagcaatttcctgcagtttttttagctctctcatatgctgagagttaatcgttttgtttttttttctgatcgttgtcttttaggctttccagtgctatgtaagcacctaatttcctaaagttaattacttctgacttgaaatattaagtgtgatttctattttcctaaccaaaccctgaccgatgcagtatgtccaataagaactcattatcagactaccaggaaaacatattttaacacaggcttacaagaaaaacagttaccaagtatggatgctcaagacagccttaaagcaatgcctagtaagaagtgctttataataactctgatgcaagatcacatgtccaatttttaaaagatgtattagttcacatttgttgcattaaatgattttggggaacaacatagcctgagataggacaaaactgagaatcaaactagataaagctgaatgtgataaaaatatatgcctttaaaaagttaggggtctcaatcaggagttaaattcattaaagaaaaggttatgagtactccaagttccaacagtgaggcagggtcaagagttcactccagctggcacgaacaggcaggtaatagaggacctaccaggtttaaatggggaggttatcactgtcagatatgaagtggctccaatgaaaggttgggaccagtgaatatctgccttagttttagataatgcatatgacatggctttacccactgaccagtgctctttcgagaataaatacttagacacctaatacgtatgaagtcacacagataattggcatgagccaaatgagggttacttgtactctatataaactcttacatactctcttatcagtagaaatttctattgagaggtggcttggagaagatctctaagttgctgaatcccacaaagactttaaaaaggtagaaaattctaaaaggatgatgctagcaatcaatcaaatactctggcctcctctagaaggaaactgatttgatatgtttatgggtgcatttaccttctgcacacacactcgtcagctaatcaacacaacaaaagtaacacagtcagttggatggaattttagagtcatctccctctatgcacgtgtgctttggcaaaatcaggtacaatatacctgacgcttcagcttttcacttaatagtgcacttatttctagttagcccttgagtcatcttcccagatgtgttagcctatcaacttgtttttttcatgaatatgataactacttatctttcatcttacatcattagaacatttgaattgttaaaattccacatatttcaatatgatggtgtcctgtaatctctgaagtcttgggttactgagtctgctgtgtgtctgaagctacactatgtattagcattcttgttaggtttaatttcattttctacaatgatccatcccttgaagctccacaaaaaatatgcagagcatatttattgctagtactagtgtaaccgaaattaccaaaatctatagaattttcataaatttatgtattttagaataaattattataaaaagaattaaaggatgtttaagttcacaataaattttacatcatctatagacactgaattattagtcagcaagctttctctataacatttataattagaaccaaataattttgactcttccccttagtcatcatttgtgttttaatttctgtccatgtcaataaggttattcacagaaggcaaagaaaaaatattttttaagggtttgttttgctaagttacatggggagtcagaaattcagttaagatgaactgtgtgaggtattaattgaaatttaagtgtataatattcttgagttaggtatggaagatgacagtaatttcaatctcacttttacttcacatacattagatgtggtaacttcttttcagtcagagggacagatgaattctctaggaaatttatatgtaagtatttgcaggtacctttaagctagttctgaggagaaaaaagttatatgaggcaagaagaactttcaataaagaaaatgcatgtaactgcccagaccctccttggagttataaaagagccatataatttccacagcttccatataccaccaacacttatggtcctacatagcaagtcccataaagcctcagtagacatgtgacatcccgaaaacagagcaatgcccatgatcctatgacatgaggtaagaaattcaaggcaccatggttccctctgacacctgataaactgtatgtatttattttttcctagaaaaaaagggtatttgacacatatcgggagacacagtttcaaatcccacgttgaccatacacatgctgtatggccttgggcaactcctttgagtctctgtttcatcatttaaaaaccaaggttaataattcctatcttcacagagttgtgataacaataaaaatatattatgaaaatgaggaggctttataattaataaaggtataagggcattgattattttctcaaccctttacataaattagtagattattctaatcttgtgacagagaaaataaaataaatattgaaaagtattatgacagaaactagctagcttcccaccacatctgttccatcttcttcctgggcccacaggaagtataagcttcccactctcctttacagttagaaatggcaatatgactgcattctaacatgaaggaagtggtgggatatttccagtcttagccaataaaattctccagtgcctggtcctccatgccctttccccaagcatgagccacgggaagagaactccaaggtcctagataaaaaactaagccacacgataaaggaggcatatatgtgaatgaccaaatggaaagcctcttactgaccaggaacaccagttttgaatttcacatgtgcaagttatgctaaaccagtgagattttggggtttgtctttgacataattcagtaggacctcaactaaaagagggatatagacaagttaagtgtgaaaaggaaataccaccctcaatcaggctgccattcaaaaaaaaaaaatatgccaccaagtatacagatgtcaactatgattgtcatattttgacaaaatattattagaaataataattgctcattttagagaactgatgatctatgaggttatttagggtctgtgtgaaacttttagttctctcaatcatctggggatcatgagggagctgagatgagatctaactttctcaataccatcaccagtgctcgtttccctatagcacactgctgtgcccactgaagtcactggctttttttttttttttttgagacagtcttgctccatcgcccaggctagagtgcagtggcaccatctcagctcactgcaacctccgcctcccgggttcaagagattctcctgcctcagcctcccaagtaactgggactacaggtgtgcgccaccacatcaagctaatttttgtaattttagtagagacagggttgcaccatgttggccaggatgatctcgatctcttgacctcgtgatccgcctgccttggcctcccaaagtgctagaattgtaggtgtgaaccaccgcacctggccaagtcccttgctttttaagatacagttagtcatgcagttcttgacaaaaaaaaaaaaaaaaggtacatacacaccaaccattacagaagccaaaatatcaagtctagactgacaacctctgcagctacactgaaaccccacatcactaaataataaaaaatcctaatgtgactttctcatcttgaataattgttaaacaaatattatccctcttcctttctgccttctactctttatattcttcattttggaaagttttgtttatgaactaaaatattcgatattatatttagtacttagacacatctcttctagcttaccatctagcagaaggaaatgtaaatagtgatgttatattaaaaatctgcctttaatttaattttaaaatgaagggtaatggtaaattaatatggaagtttggacatgagcaatatttatttggctgaataacaaaccctctttaaagtgaatcctgtctcttaatttaacagagtgaaatttatgtttttataggcaattatgtgtcaattcagagaatctcagatttaaaagtggcaaccacttctgaatgaaaatgctttgagtatatttgtgtgatctggatatatttttcccagaaagtcattatgtattcataaatgtgaataaaaaccacatatgacataagcatgtcatataataaatcttagcaaactatatggagaaatataccacagaagtgaaacaatttttaagtatgtgtgtatatttatatatttgtctgttcgtattagaatcattttatgacaaatggaataattcagtaaccactttaatactgcatgtttaatatttattgagcaataaaccatatactaagcaaaaagttactaaccctcccccaccaaaaatgatttgctcgtattcactttttcccttatctaatgctgcaaagataattactttgtccctataataacatttccacaattcatttcaggaccagtgattagtccacaaagtttggcaggtttcagatcagaaatatgtgcataaaaatgctgactatttgaaagataagtaaataaattaagataataatttagactcatgttccccaagcttatctaataaaaagaatctcctagctttttccttagagtacatcctaggtaacagctaagagtcagtattattaacaagctcttaggtgattcaaaataagaaactggaaaacatagattcagactaagctcaattatcctattcattcatttatgcagtcattcattcattattttattcattcaatctgggcacactatgtgctggatacaacaggataaataagacatactctcagtctcatgaataaatgcaatgaaatatgacaaacgcttggctgaaagtatgtacagggtccattggcaacacaaaggaaggaggtgtcaattcaatctggcaggttgggtaaaggtttgtcctggcttcacagggaaacccacatttaaaccaagtgtcaaattagtaggtaatcaatcaccaagtgaagaattaaagaacatcctagtaagagaaataaatgccgggttcattgtgcagaatgtatcagctgagtatcaaattagaagacaaatctttttggaaactatttagagaaataatgagagctaaactaagctgagtcagtggaaaatagaagagaaggggggaaggatatataatattagaaaagaaggtggattggacctgggaagtgactggatgtggaaagaggaaagggagggattggagagtccaaaatagctccaaggctgcataaaacacatatagatggtgacactattttcaggtaaagggaataataaaagatgataaggtttgggggaaaggtaggaattcagtcttgcatgtgttacgttgggggacattcgatggatctgtctgttaagtagttgaatacgtaagactagaaccctggagagttctgagtttagagacacagatttgaaacttaacaacaggtgaatagtgagtgaggtcttaaagtggttaaaatcacacaaagaattttatagtgtgagaagcaggtcaagaacagaactttggacagttcttatattttagtaattatcagagaaaaaaagacaagaagaaaatgagagtgacatcagaaaagctgaggggagagagttttaataaaatgagttatcaacagcaaatgacccaaatatgttagaaaaagactaaaataatccatcagatttgttcctagagtggtcagtgattaagaagtggtatgagtttggaccaggcattgtggcttacgcctgtaatcccagcactttgggaggctgaggcaggaagatcacctgaggtcaggagttcaagaccagcctggccaacatggtgaaaccctgtctctactaaaaatacagaaattagctgggcctggtggcaggtacctgtaatcccagctactcaggaggctgaggcaggagaatcacttgaacttgggaggtacaggttgcagctcagatcaccactgaactccactctgggcaacagagcaagacaggaaaaaaaatatatatatgtaaaaatatatatgaaagaaacagaaaaagaaaaagaagaagacaaaagaagtggcatgagtttaagaggaaatgggaggtaaactggcaacagtgaaagtaggctatagtctcaaacttgattagtaaagaaaaaagaaaaatatgcagatgaatgatcaaagtatacccttttttaaaaaaattagagaatctcagaattaaaaagagtttggataatcatctagtgcatttcttttaccccaatgcagaaatgccttccaaagtctcccttacatgtaatcatccaacttctttatttgaatatttccaagaataggaagcttattaactcaaaaaacgctcattgtaattaacttgtttttgaagtataagattttatatatattatatgtatacatatcatgatggtgaatattcataaactgaatacatctatgtaagcaatatctaaactaagaaacagatattacaaggtgtacagcagcccgccccaccccaccccaccccaccccacccagtccctgcccagagtaaacactatcctgacctaaatacatagattagttctgtctgtttttgaaatgtctataagtagaatcactcagtatatactctgttgtgtctgaatgttgtgtctcactcaacattatgtttataagatttactcattgttatacatggctgatattcattcactctcacaactgtatacttctactgtatgaatattcaaatttctttttacctaaggacccattgatgagcatttctgttttggcactattacaaaaagggctgtttgaacacttttgtacatcttttggttaacatgtgtacatatttctcctgcatgtatatctagaagtagaattactgggtcatgggatatgcattgtagatgccctcaaaatttttccaaagatgtttccatttatacacccactagcagaccatgagaacttccattgctctacatcgttgaccaacacatattttctgcctttttcattttagtcattctcgtcagtgtgtagtattatcacattttgacttaatttgcattagtataatgattgttgaagttaagttctttttcacacatatatatattgcaatttggatatcctcttatgtgaagtgtctgttcaagacttttactcacttttttattggattgtcttttgtctttatcttttttatttgcaggagttcttatgtaatctgaatgagtcatttgtcagatgtgtgtattaagaatatcttctcccactctgtgactgtcttttcattctcttaatggtatgttttgatgaacaaaagttcttagttttaatataaaccaatctctctctatatatatattttttatgtttgtgtcccgattaagaaatccttgtggcggggagcagtgtctcgtgcctgtaatctcagcactttgggaggccagggcaggcagataacaaggtccggagatcgagaccatcttggccaacatggtgaaaccccatctctagtaaaatacagaaaattagctgggcatggtggcgtgtgcctgtcttcccagctgcttgggaggctgaggcaggggaatcgcttgaacccgggaggcggaggttgcagggagctgaggtcacgccactgcactccagcctggcaacagagcaagaccccatctcaaaaaaaaaagaaagaaaagaaaaaaaagaaatccttgcctactccagggttacaaagatttttctgctatgttttcctctatttcctacctagttgccctgtttactatattctttttttctcataacttttctctgcattaatcaaacatccatttatttatttgtagtaacatgctaactacactttcttttactgttcttttagtgtttacctgaggaattgcaacatgcattcttgagttggttctatataattattacttttagtatcttcccagaattgctaaacctagaagttttaaacttcatttatcacttcttacttttgcaatggtattgatgtcacatattattctgtatgtattttaaatttcacaaagcatcactcttattgttcaatatagttcacattcatttgtataaaatgcatttacactctccagcattcttcaatcactcagatatttccaaggttctatttagggtcattcttctacttacaacaattccctttggtattccttttagtgcaggcctcatactgattaattctctgtttttgttttgtttttgtattttgggtttttttttttttggtcagaaaatgtctttgtttcgatattttcaatagatatatttgtattagttacagaattgtaggtttgcagttatcttctctcaacactacatttcatttatcttctcacttcttttgttaagtcaattctcaatcttgtacttagagctctttaaagttttttttgtttgtttgtttctttgacttcatttaagatcttgttatctggttttcagcagttttactgaaatgtccctatgaatgtttttattgtatttatcctgcttcaattttgctaaacttcttgaacttgtgtgtggcggtctttccaaaattttagaaaattcttggccttaactcctcaaaaaatgcatctccccgtgtattctctcctctcctttgggacttcatttttacttatgtttaaaaaaattagcataacacaaataccatttacacaatatctaatttttccctttttctttctatgctttgagtattttttcagttcactaaacttgtattatactgtgcccaatttatcatatgtccctagcaaactcttaatttcagatagaggtaggactttgttttgtttcagttcaagaatatgtgtttgattattatttttattaattatttttttgagacacagtctcattctgttgctcaggttggagtgctgtgcacgatctcagcgcactgcaatctctgcctcccaggttcacgtgattctcatgcttcagcctcttgagtagctgggattacagacatgcaccaccaagcccagctaattttttgtatttttagtagagatggctttttgctatgttggtcaggctggtctcgaactgctggcctcaagtgatccttccaccttagcctcccaaagtgctgggattataggcataagccaccatgcccaacctgtttgattattttctatgtgtcccacttctccaatcgaattttcttttccttcactttttttagtccaccttttaagtccttgccagttacctgtaatatctggatcatctatgtatctgcttcaaatgtatactttttcttttgattatttgtcatgtagtttcacctatttgtatgtctacgtactcttttattgtatgatagaaattagttaaagaagaactacagaattccaaacgatatcttccaccagagcaggtttctcactttcgatattaagcagaagagacagaggctggacgtctcaagccaaccaaggactcagctgggttggggctagattgcagttttagtggaatgtagtcttccccttgtttatctatacttgtaagccatgacactccctggattttgattgaaagcctggtatatctttatcttctgggccctgaaaaagttctctttcagaagttttcagctcatttctttatcttagggccctaacagctacaaaatttggtaaatatcttcaaaaagagttcaatggtatgtttgagtttggtgtctccaggctgccaagtccttttgtttgtttatttcctactaaaattctactgccttttggaagctctgcctttggcttcctatgcagcctcaaaacacagcaaacatcccttggagaaagatgtgtgttttagatccctcaagtctccagtttgtcccagccttgcagtatcactaaaagttttgctaacttttcttactccccaaagacaccttccgcctaggcccagtccagtcctcagaccacactcagaataagcaaatgccctcagggaaataaatacatgcatgccttggaataattttcccttctgaaattttagttcttttagtccttgttgcttccacagctctaggaactatatctaatttatttggtttgtacagaaaaactggtcctatgacctacttgaaaatcaaagctattacattttaatagctctgattagtttttaaaactctattgacacaaaattgactctcccatattttccattaattggctaaattttgaaacctggaacagtattttaccttcaaccatattgctttttttcatctatttaagattatctcccttaaatatgtttttccttcagtctaaatatcaccaaattctaaacttctattttatgtttaaatcctttgccatcctgatcatcatcttcagtaaaaactctcgtttgtcaacatccctcttaaacaagtatcaacaaaaatcctagatgctatgattaagcccaataaagagaaaaaatgagagagtcatattaaaaaaacagagatacaaaataaagaggaaaaaaacgagagaatcacacacaaaaaataatagagatacaaaagaagttatctagtgaggtgtttttaaaagcacatgaacaaaagatcaaaaaaaatcaaagacagataaacaaaatagagatcaaaaaaatgaaatgaaagcttccaaaattctcatgaaaaatgctaagcataatgaaaagaacattttgatcctttctaagtctttgtttcacaattacctgaattcattctcacaattcaatcacattttactgatgagttaacttggaaaatgttaagtaacttttgaccaataacaaaatgtaactaatagcagagtttctaggtttggatacagatatttatttcgcacagctacactcagatctactgaattatcaaaataatgccaagtagccattttaactcttttttttttttttttttttgagacagagtctggctctgtctccaggctggagtgcagtggcgccatcttggctcattacaacctcctcccgagttgaagagatcctccttcctcagcctcccaagtagctgggactataggcacgtgccaccatgaccagctaatttttgtacttttaatagaaacggggtttcaccatttggccaggatggtcttgatctctcgacctcatgatctgcccgccttggccccccaaagtgctgagattacaggcatgagccaccgtgcccagctgccactttaactcttttttttttttttttttttttttttgagacggagtctcgctctgtcgcccaggctgaagtgcagtggcacgatctcggctcactgcaagctccacctcccgggttcacgccattctcctgcctcagcctcccgagtagctgggactacaggcgcccaccaccacgcccggctaattttctgtatttttagtagagatggggtttcaccatgttagccaggatggtctcgatctcctgaccttgtaatccacccacctcgggttcccaaagtgctgggattacaggcgtgagccaccgcgcccaacccactttaactcttttcatacaaatttatctagagaaaatgtccttctaagaatagacatttctattattcaaagagaaatctgtgtagattctgtcttatgccagctaaagacatgtatataaaaccacaaaatacattcttaatattatgaacataacataatttatttatgtatgtatgtatattatgaattataattcatttatgtatgaaaagcacacatttgagaatcaagctacctattaaaatggtctatatttaacacacagacatcatgctgaaaatgggtagctctctacctcccttttgcatattaagcaatatctgtgtaattgattctctctcttttggtacttaaagatgcatttggcacttgagaaagctatcttcagcttctaacagtaagtttgtttcctagagctgtttggtacctgaacaattcagatacatttgtagttactaaggctcagagaagagggatacaaatttggttgttttgtgttgcttctaaggatttctgcacacacacacacacacactcacacactactatttaaaatgctcttaactgaacaattttaaagaaaaatataatggtcagaaatcttaaattaaaaaaaaatcaaagcctactttatccataagtaggtaaagcaatggttacatttaaaactgtattaacaagaacaagtatttcattccaccattaggaaaagagttaccctgagagagatgccagttttacttaaattcattgtaagaggtaaatgagagcagagttgacttgggtctgggcacaagtaggacacctgccactattaagatggaaaagagataagaaaggtgaagttggaaatacttaagattctccaacgtcacgagactacatacttgcagttctgccaatgtttaacattttctcaaagtaagatatagacaaagtgctccagtctaggaaatcagatgggcccaacctaccactaggaggaaaaggaagctatgacattctgaagtttggcacctcgtaagtgcccactactattaattgcattgaatatgaactgaactgtgggttcactaaaagcatgcttctggagttaggaggccttggcaaatgaggctaaaaattaactcacacattcaaagccatctatttttaaaatgcatgataagcaacacaggaagcttttataactagccagcaaaatctgagctttcaatcaacaatttctttcaacgaaggtgtggagcatggaaagaatccagaagcacagatggtattttacatctgcacatgcaatttcctttttctccatttttatataaacctctctctttttttaagaatgatagaatttaccagtaaaatgcagaactacttaattgcctctagaaatgttcacacctccatttcacatttttagcagcaatttaactgcctttaagtatatgtagaaagatgggagggtggaccttttaagctcccctgtattacaaagtgaataatttcagaagattcaattcctccagagagctacaatttttccagcacttaaaataactgcactccaccatccttatctctaactattttcctaggattaatgctaacttttcactggatcttaaggctaaaatgaacttcagagatcatgttacttcagtcctctcctcaaaatatgagtaatcatgatccagtagggctggcagcttgttcaaggtcactttgctgcatagcacaggggaaaggagcaaagtccacctgcatcataatccacaatcacagagacaaatgtaggaagaccaatacatagctgtgtctccaagaatctatttccaggactccatcagaatgccaagcccttcttcttataaagtaagtcagattcatttgagcacatagagaagcctgacttttaaaatctaaaagcgtttctttaaaaattgaatacaaataacaggtttcactgtcatattacattcaaaccaaagataaataaggcatgaaaataatattggatagaatgaaattccaggtaaccaaacatggtacaggggactgaatttgtacatttaggtaacggggaaaataaaaatactacaacataaactaagagaaactttcaaaagcaatgttcaacttacctttagaaaaatgctctactgaaataaaatcaattgacatatcctctgtttttcatactaattcctctggcccaaacctctctcttgagctctagaattgaacaaagtacctccatgacatctccattggactatgtcaaaatctcctcgtctttatcacgtctaacaccacactcaccgccaaagcaacttgcattgtctcttgtttcaggcaacgcccccaacatgaagatatttgtgcatccagaaatctaaacattcctctgagacctcctaatcccttcagcaaatcctgaccctctacctcaatcactcctgaaacctgctaaatttcctccatctctgtggccactccctgcatccacactgccatcttgcttctctcatggatcttccagtagcctttgaacagctttgcacatgttcgctctggacctttgttgtccctcctctccagaatgaacttttgtcaatgcaaaccagttcttatcactctcgtgcttaaatccttcattggcttccactggctttatgataaagtctaaatccttcaaaatccctaaaaatttataaaatggtccacaaggaactagtggccctgatggctttttgagtcccacctgacccagtccctttgccccactcccccatcctgccatatccctgtagtctccagtccaaccattctggaccctctgtcccctgcctgcctctcatcctttgcacaatgttaccttggcttgaagcatgcttcctcccactttctacttgattcattcatctcaactcttgtgaaactttcttaggaaaatcttctatgatgcaactccctgaaagactggttccctgtatttttcctctgtaaccaacatcaaaatttgtaatcttatatttgtataactattgtttaatgtgtatccccttatgataatatctatttctatttattcgctcatctcactagcacctaagacagtaggtggcatattatacatactcaatgatcatttattaaatgaatgaattaataaagagagaaaattactaataagagacaaaattaataaagaaaagatagaaatctttttatctagatttctagattaacagaggaggaagggaaggggacagagagagaatataagtgatttacaacacaaatctcaccaacagcttagaaagttcaattttatgtgtaactatctgttactttggataattctgagctagtaggatacatcctaactagaccacagaccagggtcatacttggaccaagtcaatcccagttacccaaacttcagtcagcttaacagctctctctcaggagtaataacctctaacaaaggtattctgaaagtctccaaataaaagaacaccacttttaggttctttgcttgatctcagtaaacatcctcaaatgggcatgaagagtgatcttcccccaattcaagttctggaaagacttaatgtgtacttccaagactgtaccactatagtgcctactaactggccaaggtacagtgtcaaaagccctaaagcacaattgctctaaagtttatgtgtgtgaatatttgttctgtaaggaaatgagaaagaaaatgatcagaaagaaaaatatttgagagagggaccaacaaaatgttactccccttaaattatttaggaaaacaaagtcaaggcaattattatgatttataaatttttttctgataccttttttattattattattatttgagaaggagtctcgctctgtcgcccaggctggagtgcagtggtgcaatctcggctcactgcaacctccgccccctgggttcaagcaattctcctgcctcagcctcccaagtagctgggattacaggcacccaccaccacacctggctaattctttgtatttttagtagacatggggtttcaccatgttagccaggatggtctcaatctcctgaccttgtgatctgcccacctcggccccccaacgtgctgagattacagatgtgagccaccgcacccggccctctgatgtcttcttaacatcacaattctcaaacttcagagcaaggttagcaggacacttgtaattttgacaatgcaaaagcagagagagacagaatatgccaatgcaatgcagtagaccacttcatttgattatgtgacttagaacactggcataatttggctcccattaagagttttctgaagtttggatacaatttctaagacactcttaatccacttcaactagaatgtacactatgaatttcaagccaccaataattcataatatctgggaggaccaggaataatccatatttataagtttcagagacaagatttgcattccccttttggtttctctgatgttctgctggctgtattttttgtgtggggatgtatgcaaggttaacttatgagcacacgctgtgcacaagaaactctgtgttatagaacaaggggaagagtcctaggaatttaagaaactatcataaatacagacatcatggccatgtaagccatggcttggcttgctgccagttctctgccacagttgcagaaggaacacagcgatagggcagttcctagatataatatctaacagatgagcaatctacataaaacatttatttctaagtttagaaaaccccaataaagccaataaattcgcaaatatctcccgaggatcagaggaaacaatagaaaaggcaaagtattacaattaagcatctgtgttataattaggaagataaaacataacaataagatagtcacagcccagcgcggtggctcatgcctgtaatcccagcatgttgggaggccaaggtgggcagatcacaaggtcaggagttcaagaccagcctggccaatatagtgaaaccccatctctactaaaaatgcaaaaactagccaggcgtggtggcgggcacctgtaatcccagctgctcaggaggctgaggcaggagaatctcttgaacccgggaggcggatgttgcagtgagctgagattgcaccactgaactccagcctgggtggcacagcgagactccatctcaaaaaaacaaaacacacacacacacacacacacacacacacacacacacacacacacacacaaagatagtcactaacacacagcagcatgtaagaagtgtcaagagaggagtaaaataaaaaattgctgtagttagaggagggtggttgtacaaggttttggttttgttttgttttctccaaagtcttcctacagcatgcagaatttaacctgcctcttgctgggatccaaagaggcagggagggcatggcaagaagaaccagaaggggtgacagccccaagtgcttgtatttcgttaaaaaattccctcttctcaagaaagaaaattattccttttacgtgagctactggattgttttgcaggctagagccattttctgctggattgggttttgaaatggtatttttccatttattttacagtatcttatgggggtggaaagagaagtatcagcaggttaatttctacctttcacagagaatctgctgtttacaatgtaagacaaaactaccgaagtatgggacacaattagggaagtcaggaacacatttaaataaactgatgttaatgaaaaaactgaattctgcatataattcccacttagaatgttaggtcccagcatcgcaatacatctactgacatgagatttttttttctcctcagagaggaaatttatgttttattatttatcattcctatgcttaagcttgcttattggatttattcaataggcatcatcttcatcatcttatagatgtgcatagaaaaggtgaagtaacggccgggcatggtggctcacgcctgtaatcccagcactttgggaggctgaggcgggcggatcacgaggtcaggagatcgagaccatcctggctaacacagtgaaaccccatctctactaaaaatacaaaaaattagcccggcgtggtggcgggcgcctgtggtcccagctactcgggaggctgaggcaggagaatggcgtgaacccgggaggcagagcttgcagtgagcccagatctggccactgcactccagcctgggcgagagagcgagactctgtctgaaaaaaaacaaaaaaacaaaaaaacaacaaaaaaaaaaaaacaaagaagaggtgaagtaacttacctaaagctaaacaataaatcagcatcctatattagaatcctcagtcccttatatttaccctagttggatatttggcacttaaactatgatgctttccagtaataagccaacaattttaataatgtctaaatgtttctctctccttcagttctgacagacagagcttatacatttttgagcacatcaatttgattgcatctcaaatacagattaatgtggaaacagtaataattattggagaaatgactgttggcagggcatttaaaatgcttaattctctaagctcatttcaggtatatactgaacagtgatatgagagtgacaagcagtgaaatatgtagaaaaagaaaggacatgaggagtttttcaatcaatcagtagtaatacaatcatctctttcacttattgagaacttactatttcaggaaacacaaatatattttctctagcactaacaacaaaactgtaagatgcagattattatatccatttaacagtgccaatattgtggctcagagaggttaattaacttgcccaaggtcaccaatctaataaatgatataaattgacccattgtttccaaccctattgatagtatctgacttcaggctctcatcatctctcgcctaccattttgctatgcctgtattctcatatgtatacctgtcactgttgctccatatacattctttgctcctgccattttgagtagttctagtctcctggaccagctatgctgtctcatgcctctgcacttctgcctagaacagtcttcctacttttctctgaatgagttccttgtcttccttcaagactcagctcaagagtctcccctctgaggtctttcctgatcctagcccagcagaggtgatcatgccctcctctggagccagtatatagccctgtttattcactagtttactcactagttatgtttatatgcatggatccctattaaagacttagagctccttgaaaacagtattcatgttttatctttgaattaccagcacataacacagttcctgaaacttaatgttcacaaaataggagtacctaggctacctttgttagaagtttaagctggacccaaagttgattgcagattgcagtcagcattctcaagaaccaattttctttcaatgctatagagaggattttttaaaattaaaaaacagagaatttttatattacattttaattaaaaattggatctgctactccttcatttgctgttcatttcccctgttacatttattaattatcaaatatattagttggttttaaccgctgcttgctcccttgtagtccatctgtgctttcttctcaataatgcattgaagtcataagtgctagatttattgccttggtgattttcatggcacaaattgcgatttcgctagcactgagcagaaggaagagctaataggcaaggcagaaaatgcctaatcaatatcactcctggcataagtttaaaaccctaaacccccaagcagattttgcaaagggctatacttaaggccataatctctagaaatgcatttactatagtaagaagttgagaatcactttctttcctaccaaattctcaattacttcacaagcctcctaggaaagcactaaggtctttgaataactcagctggcccgcaggagaaaaaaggaaaccgtgcaggaattagataggaatatgttatttccaagaagggccctttctcctaaagatacatccttttttctaaagataaaataaagtacttctacatcagcatagagaagaggatttctgaatatgagtgttaaaagacatcctaaggattagatatcagtcatgaaactgattggaggcatgttctaaactgggtagtctgggggatggaccacaatattatgagtcaagcaactaaccagattttgttgactagaagccacccacctcctatattaactacatcaatgaaattaagtgctcatgaggcattaactggattgctgaaccagacaggcatttctgctatagtcatgagttctaccagaagccacctgtgtgttctcacaaaaaagcaggtgttcacctaagggtcaggagaggcaagtgtgatcaggggaccagtgagcatcctggtataaagaccttcattactcagccttttaaactttgaatccctttaaatatccataggtctacctaatttgagaaaaaaaaaaacttcctttattcgaaaccacattgctaatgtcctcaagtaaaaagaaagtgtctaaagtgcaggcttagcaccataacacaaatataagccaaatagctgccttttcatttaatacactatgaagaccaagcaatcaatataatgattaggaaacagttccaatcagttattcaatgttctttcttggggctaccatctaggaaatttgtctcagtgcaaaaaaaaaaagtatagtcctatcttcctggccacccccactaaagcagaataacctgatcccactgtgttatgtttcgttgtctacctcaacacatttcaacaatgtgctaattttaactacatttgagttatatgtgaattgtttttattttttagaatttgtacattttaattttccttgagaagaagctaagaattattcagatactagacagtgatagcagtttcacaataagaacttgtgcatgtattaagcaaccatgtggctttccctctaccctatcaataatacatatatgtctcagtttcatgtcccttaataaataattaagaaatcactaaaataaacagccaaggcattcaaaatacattagttctccccatagacattgggatggttcccattacatactttttaagagtctgatttacttgcaaaagctacacatattttattaaaatgtaagtaatcaaagcaaaatttaaaagcacatgaaaagaataaaaataaagataagaaaaatctaatcagttctctattaggaagggagagggacacagtcaattcagctagaaatataatggtttccaaggtcaatgccagttcaaggaagaggttcgttgctttgcaacacttttcagggagaaggtaggatcaggagctccagtgtttccttataaacaagcacaaaatatgatatattaaaacacctatatttataactaatctcaaattcacttatcacttttaacttggtattcatatattcagaataataatagaagctcagagatttaagcaatctatcctcatatgtattgttccttgagttatcctcaaatggttggcaaaaatctacacctggagtgagaattccacaaatacttacagagaaggaaaaataataggaagaaaataccaaagatgctcctgttgggcaacagtcactaaccatgaccaagttaaaaatttttatattatctaattgactatcacaacatcatgaatacattttaaagctaaatctgaagtggagaaccaaatattaaaatatatattaatttaaatattgtttataattctactctaaatttcattcacagcagaacaccctcagccatgagaaaaaatcattttcaccctttagattagaaaatttcctgatcctacattagatttccttaaccatatatttttacaagattcatgatcagtcctgcctttccaatcttactacttgggtaacagatactttgataacttttataatggacacttaaataacagagtaaatagaatgagaaataataaattattgctattactcataaaagcataagattaagctttttcatagagaaggctgtatcgcataaaaaatctgcctagactacgtttataaattaaggttcatcctttccttcattgctgattttatatcattcaggttatagattagcagtataaatgataggatctaataataagaaaaccagtttaaaataattacatgaaactccttcatattatgttatatttgtgccttgtatgttataaatatcaagacatgtcaaaggagttaaaacatattctctaagtagggtatcctaatgatactgaagatcttaaccttgagcttcaaatttgctgtccaaatatggtctgaattatttttaatttttaattgcattcaatatctactttgaactgtgagtgaaaagcaaataattacattgttaatgagacaagatacactatcaagaataacacctcacattttttatgtagtttattttttaacttgttttgatcaaagccatagttgaaagaaaattgtctacatatatatgtggctgatcacataatagtaatcaaaaatatgactagtcttcttgtttattatttataagaaacaaaagaaatactacatcctatgaaataaagtaagaaaaaatgaaccctaatttgtaaatgctagatgcaactgtgaaaaaaaaaatgagagggactaaaagtaaaaaacataggtaagacactgagaagagctattcaccacatcaccctccaatattacctccaatcagtcaacgttagtcaccctcatataatctatgtgtgctcataaaatttagaagttgatctttattaaaatatcaacaagaagtattttattgcataagagctgtattgtcagacttacttttaaagtttatgtttgtgtcatataaaaatttgaaataatgagttagtttacctttacatattagctcatcccttattatgatattttcattacaaatgtaaatacatagacttggttataatctattcagttccctgccaatctttccactctcaagaattttcaaacttttactaatacgcaagcctgcacaaaccctgagaagtctttattctctattgaatttacaatctagagagatagattatgttaatatcaatgaaataacagcaatatataaataagaccaacctggccagcttaaacatgacgttatctatataaagcctcatagcaacagcagaagatctttccctccactctcatcatatcctacacataattccaccctaggaacatggtgtttaaaatggcttgcttgtaaaatcagggaattggtttcattcacccaagatctctaggatattcaataatgatggatggatatgatatggacagatgaatgagtggatagatggatagataaatggatgaaggggtggaagaaacagtatattttttttcatacttatgtggatataaatataaattttgaagaaattcatagcaatacctcatccctataaaatgaaactcatctgaaggattttctttaaaaaatgttacttgaactaaaacaggtgcaagatttttatgcaacctggcagatgcatacagaatatcacttcatttagttgggacagaatatcacttcatttagttgggagataatctcaaccaaagtctcaattaatttagtaatgaagttgaagagaaattcaatgcttatcagtaagtaatcatatcatttgaaagcctgtttggatgtcagctgcttgggttcagcaaatcctgaaatgctcctctgcaatatccaagtcctgccaaagcaggacaaactatttttagatgaggcatgtcaaaaacgtagtctgttttataaagaatgtgaagactacatcaatatagtaaggaagaaaatgccagttggaaagcaagtgggctattagaagtcatgagacacacacacaaacataaatgccaatgttcagggaaatcatatatagagcctctctgtgagaccaaaataccctatcagtcatagatatggagagttctttccaccagttgcttctataacaattccaaacactagtatctgttatgtttgtttgctttataatttttaatataatgtaattttcattctgccatacttatataaacctagaccaaaaacattaactgatgtagtgttattataagaccctccagtggactgttgtgactacaatttccaaggggattaaaaaaaggaaaagaagaatgagatgttttcatactgattagcaactgcacctcattgcaccacagtatgaagaaacggatttggaaacacagcaccaagattagagaggcttttgagccatagtttcaatttaggtctcatcactttacctggcaatagtaccaatttagcaggcactgggctgtgcagaaagatttacatgtaaatgaacacactttggggcattttgctttgcctcagttaaagagaaacatcacttttcattggcactacaaaaataaaacagaggttaacacagaagggtccagggaagagtccattagtggaaaagctaatttggcagctgcatcaaactcctggagatcatgagcagtgcttctaggaagcactaaagaatttgaaaaacacagatattgtggaagttattagatgataaagtgtacacataacattttgcaatttatagggggaaaatcaccaaattaagggatgattatcttatttttaatattcttttaaaaagttttatacatttagatacacaattcataccttctctaatataaatatattaaaataagtttaaaataaaataaagttttaaataaaaataataaaggatttttaaatagttaaaatcaaataaaaaataaagtggatctcaaacatcataatgcagtgccatgtgcctcatcattagtgtggatttctgctcactcattttagccctctacctctaagctaatgtcataatggcctggatccttacataattcgattttaatagattatctcagtcatatagttcctataaagcccagtcaccgggggatggaggtttgtgatttcttctcagactatattaactaacccttactcttttctttcattcattcaagtattcattcattcaataaatacacatatagtgcttaataagtataaggaatcatgtgagacaatataaggcatggagaaatatgattagtcatagattcttgtgctcaaaaaggttatggtctaatatgagataaaagatctgtgcaaataaagacataatctaaaaacagacatataataatatcatgtggaaataccatgataatttaaagagaaagaaagcaagaacaagagtgagagagtaagtgagtgagtgaatgagtgaaaaattgagagatgccaaatggggagataagaaatgcttttcctacatggaatcctctgtcttctgcttgctaggcatgtattggaatggcttatgttccatccagaacccttcaggacaagaacttggcatatggcccagagaaggcattcagcaaaccttcactgaaggaatgagtgaataaattaacgaatgaatatttctctttggttttgtagacattagcatgtgaatttataaaaacaatgcatatagccaatccatatttattttttcttgcaaaactgaaacaaaatgcttcataaaacacaaaatatattcaaaagtggccacatcatttaaatagttaagattttttattgcaaagataaacggtgcctgcattacataagactctccctgttacttagatggactaggggcattactgaaagacaaatttgcaagacacccataaagctaccaaaattcagaatgttttttccttactctaaatgcattttgatgcaaggagaactgtgacctttcaaatagaactcttaagtttttttcactttatattttaactttgcaggatttcactataatgaagtttttgcacaaataccactaaaagaattattattatgttcctgcaaaaaatattttgtctctcattattctcgttacagacacttgaaaatctgcaaatttatattgagttcctgccttattatcctatactgtcagccctccatatccataggttctacatccataaactcaactaactgcaaattgaaaatatacaagagaaaaacaaacaataaaaaataacaatacaattaaaattaatacgaatagaacaatacagtataatgactacttagatagaatatacattgtattaggtattatgagtaatctacaggtgattttaaatatatgggaggatgtgtgtggattaaatgtaagtactacacaccattttatataagggacttacataaacctaagggaccccccataggttttgctatcgggagtcctagagccaatcccccatggatactgagggaggactgtacttgtgacctcagaatagtaactgttactttagttggcaatttagctcttaagaaaatataaaaattaagtaccagggcctggattacatttaagaattataaaggttattttcaaatgttaggtgtttaaatttaaagatagacaacataaattcaggctcttaattatgtgcttcttgaaagtgctttcttaaaaaataatttactagtagaatcaagataattaaaattaatgatccaacagcctgttgtactcacaccaattaaccattggaatgctaaagagttctaggagatagattgctcttcgaacaaataaatcagtttcaaagtaaagtatattatctctgtgggggagtctataaagtaaatattgaatcacttctcagcaatatggactcttgccaataaatctcaaaaacaacattattttcaaagaaaaaagatggctacctcatttggcacacataaaggatgaatgatatagttagtcgaatcagccaatcagagtatacatatgtgtatatacatatgtgtgtgtgtgtgtgtgtgtgtgtgtgtgtgtgtggacagaaacacatatactgtatttgtctcctaggccccccatccattgccttcctttactatcttgcaccatttgtccatccctttcacaagcctataattttgccagagagcagaaattgtgtcttcatcatgtttgttctccatttcccagtcctgtacttctgcagcacctgcctagctatgttttacataaagaaaaaattcaagacaagtatagtctcatatgaaacaaaataatcaaactacagattaattcaagtttctttttgcacattttgttaaaaagaaaagctaacatattttaactggaaaatatctgccaatttctaagtcaacacagggatctaactttaaaaaccccaaaggtcttcctgaacatttttacacatatatgtatccaggagtatacttaaggttcctgtccccatcttgagtgttttcgagattggactcttctttctatgccttgtattggtcaatatgtgtgtagtaagaagcagagaactctgattttgagctgtcactatcttacccacatcttaaatccatcataaactacgtttctttcctgaagacccaatgtgcaaagaagcatcataaaactacagtataaacataggaaatcttaatgttcacactaatggaaataagagctaaatgttgagaattagtgttacagagaatcagatgcctatattgtgttcacctctctaggttctaaggccagtaagaattagatagagtgatagataagcaacaaaatgtagtggttaagaaggcaggcaaccacttaggcaactcactagacgagtgattttatacaaattatttaaactatctaagtcttccttttctcaactgttagtcttagaaggcttaaaataggcaacctctgtccagcatgtagtatagtacctgtgctacatagtaaatgcttaatgaatgaaaataatgaagagaatattagagacgtgtccaggccacgcatcaactgacagacgcaacaaatgcccacagcttcttcaggtggctaggcagagtaacagctgcagaaatcctaaagaaactaaggtagaacctgcggtaacatctaggccgtccctgacactttgccagggacccaagctgcagtgtgataattgcttacactatttatctcatatagcacttatattttatcaactgccttaacacttagaaaccaaaatagtgattagtgacaaaattttcaagctgggagtcaagccggtagaaaggtattttcaatcaagagtttcttaatattactcaaataataccaaagggacagctttctattttgactctaagtaaaactaccagcctgtatataaaggtcaagcttcataggacaaaataaacgttgctagccaatctccaaacacacatcaaattgcgcataccttagcaaaacccaaagctagttatgaaaatcagcttatataaatgaaacagatagtagaggcatcaaaatgaaaaagaataaagtcatcatcaagtgtattttttagaaattaaaacatttctttaagtaaattgagaatttaaagacagtgtgatacatacacaaacatacatgcataaatatatacatgtatatatttaaggaatatatgtaaataatatatttaaggatgccaatttcccagaataaagtatactttaaatcccacttctttccaaagacaaagaataatgcttcagacatgaccaccccccaaaaaaaggaaaacaaaagaagaaagtatttactattttctacatattgcttacatttaaattaaaaatatagctaatttcctccaggataaatttataaatgcccagttttattggcaattctacagattagggagaccagtcatagtcactaaggtgaaaaaggtaatgatactttgagccgagatagtggtaacagagatgagagatgtgtgtgcctgtcattgatgtcaagaaagtaactggcaaatcatgggacatttggaacaagagacagggagtcaaagtagatgggcaacaagtagattaagctgacttaatctaataagtattccctagaacaaaatagggaccaaggaagaggaaccagtttgtattcagagataatgagctcagtttgaaacaaatttaaagacaaattagagaaatatcattaactagaagaagactgaaatgcctatttcttattttatatgttagtaggtagaaataaactcaactgaaaaccccttaagtttagtagatgaaaaataaaagtaagaaaatacgcctctgaatttcaagataaaatgcagaaaaacatttcgatagtgacaaggactacatctaaaaaactgaatttcttcattaagaagtctgtttctttcactgtatgcagatgatcaaaaatgatatttacaaaaaccctaaactatcatcttttcaacaacctagagagttagaaaacttactagataacattcagccttacaaaaatgggaagatttcccctgtgatatatgaggagagcatgagaattctctcaatgagtagagatatttatacatactaaaatctctattcagacataacacttaccaagcaaactagagagagaattctagagaaggaaaacatggcctttttgttattccttcacaaaagaagactgtcattttctgttcttcagagtattttgtactttaaaaataaccttttctatccaacagaagagattcttgagtgaccttaaccaaattatgagaaattcatatgaatgttcatatatatacaaagatatttgtacaaatatacctagatattacttatatagttaatatgtggtaaaaattattatttttacttaatcacaacttagaaactttaaaaaactattcttatcctttataatcacaaactcaaatattacatatgaatgggaaaaagaccattagtaattagttatttttaaccatctaactttgtactttttatgtgaaaggtacatagcattgatgttgatacgagacagtgatatgagacttggcacatcactggaaaattactgctagggcaaatatcattgatgtcaagacactactagtgtagcagaatcgaaattattcctaagggaatttcctaaataatgggtcagctactactactcattattacaatagcatataacgattttcttagctaagagtatacatgataatgctttctagagagtaagtttttatacccctgaatctccacaattcatagccttaagaagaattacctttcttggaaaacggtgatttagaggattaaaagaaaccagaagtaatgataaacaggagtttagcagggtaaattcatggagagaaacttaattctcagaaagatatgacaagaagattctatggacactttaaatagagccttccaacaaaagatctggagaagcaaatgccttattagatttaaatttcctattgcccttccctgagcctattccaactagctagttcagacacttagggtaactgtttattttatgaaataatgtatttgggtaaccttcaggtaggttgactaagtcatttattgtcaaaatgggacgataagcataaattgggactgtactgttgaacaccctaatctcaggagagaccatgttaataaaaattaggtaaaaatggagaaatagagagaggttactgtgaaaaaaagaaaagaataaaaggacccaaagtcacttgatggttatgtgaagagaatggaatttattgtgagttggtgacaggaagggatctacaaggttgagtcaaacagatttgtttttttaatgccagctggtagcctctccattactacccagcgaccagtcattttttggtgcaaggacataccctcccaacaaaactgaaactcccccccaacaaaagattgctgaattcacagtcgttgcccaaacctctgcatcaggtatttaccctggtgtgaaaaataccatatgcagattttaatttcttatcattttagatttagtttatttgaaacataaataggtttcatcctagtcacactcctttttcaaattatggcactaacacaaattgtcatttgccatattctcaaacaactgactataatttgaaagggacggataatctcttcatggaagaaccaaagaatacctcttaaggcaataccgtgatgtcaggcagcaggtagtgcactgctacttgagcagaaaatgtgttgcacactcagcatctgacttcctactcgaattaacttatgtaaaaatctaataccctaagctgagaaagtaatcaacatatgatgttgatatagagaagaaaagatattacaaacaatatatgtaatatttttcatgaggaagacttgctctgacaaagaataattttctcattataaataattagaagcaaaaatatccctcccttacaaatttagataatagagactatttttatttttattacatttaagaatcattgggttcctaaatggatatcctacatggatattctaacgaaataagtatttccagatagcatagccttttaatgtcatctcattaaacagtgaactaggtcttttaaattgaagtaaaatttattttcattctacatattttaaaatacatgatagcaattgtatttaatgtaaacatctagtaaattattatttatagtaattgggggaacagtgtataattaaaaagaaaattactggccatattctatacctaaatcacttggtccttccactgatatttaggttcttcatattgtcaagcatggtgcctcatatatcacacagtttcaataatttttatccatctgattagccacaaaagaataaacataccttgtactacatctgtatacaatacttataaattaaaaattgaggaagaaatgacttaaatttaaccaaatattttatatattaaaaaattatcttacttgacattccaataaaattgtcagtgcaaaatattcataattcaacaaagacttacctgaacacaatttgaaaaatttatgagtaaatgtacacacatgtgcatacatataccatatcatgtatatatccataggtatgtatactatatttacatgaatcttatatagatgtcatgagtatgtaaaagtggtccaaaactgatgtatcaccaaaatttgcattttccatacctgatttaaatgattttgaaactataagtaattggctttaagtttatacatatatgtgtatatacatatatgtttatatattatatatgtatctgtatgtgtgtacccctatatatacacatgggtatatatccaatgctaactctcttaaattttcaaaatcatttaggtcaacctgggaaaaatctactgtgatgctgtattcagatatggctagctgttacattctacttactgatacatcttactatgttattttattgttaataagatagaatcaactttaaaatgcactctcaattacatggaaatgatatatgttaaacattcacgttgcttataagttccatcctaatttcagaaataataaaatgtgaaaaaatgtggatttatatttaaacagtataatcatggcataaagtatttcaaaataagacatatccaacagtaagaaactcactaaagaaaataatatgtgggatttttaaaacagatcatcagagctaactatttaattgataatggttcaaattaggacttgcactctgcataccagtcagtagccttgatacattaaatcaagcaggaaattgtgtgtgcacacacacacacagaataaatgtatcatggtttattatttttcataaatcatcaccatagaaattacaaattattcacagtagagttaattctaagtaagccagaaatgattctgcatatatgaggcataagtttccatgacgaataaggacaagtatataaaatcctacagatatatgacccataacacattacagagcactgatttcccagaggataatgtaaaactcgtgtacccagtaacagttctatttttgttctcttctataactcaaatctattcatgctgcacatttacttttacataaaaatgtattttagttatctgggctatttcatctgtgacaacaagattcttatttattttaaatggaagtatcctattttattcttaagcattttctttacgatctttcagtcgccttgaccattttttaaagtatgtgatatctttcattcacgcatcagataacttcatgttttaaatcttaaaaatccacataaataggaagagttactctggaattttcatttaataagctggattacatttctctaagaactaagctatatatattttatatgccgaaatattcatattataagcaaataatcttaaaagaagtgattagttttattttttatttttttgattacttttattaaagagataaaaggtaatatttgctccaggaattttcactgaagtagaaatacatgtaagtagaactgtagggatggaaacagaagtggcaaagacggttctaatgcatggagagaaggggaaagaatgtaaagatgcagttaataaaaaaataatacctaggccttctatttttcttagctttggactctaatctcagctaagatcagaaaggaagttagtctgatgtgctcaaacaaatatacattctatctgttcaccaaacaagaatggcagaagcttttatcctccagagaattcaacagcatgaattagtaattaggatattaaaccaagatcaggactgaaggttcctgaaatctgcctactttttaggacaagtttttatcttattgaaaaagaaatgggaactatctctagactttgatatctgattatatttcaggctcccctttgtctgtaactgtgtttcccttctcaccatggtcatgcttgctttttccctcacttttagaacttgctttctttagttggcaagggagtcccttcctcatgtatactactggttccttcaaactagcatcatcctttgatgctttttggactttcataggaaccatagatttttcctgggaattctctatgctcatctaaattttagatatatggaccaaactacagacattaatattttaaggaatcttcatgataaaataaatattaagaagtcatgggtaagaatagccagaatggcttgtctagataattctcttctgcaatggttatcgaagtgtggtgtgtggattaatagtccagcatcatataggaacttgtaagacatgtggattccaggacctataccagacctactggatgaaaaacttgggtggcagggggttgactagttaaagaagtgggtggtgatttttgtgaatgctaaagtttgagaatcactcttgttctattgtatcctaaccaaataataggataattaacactaataataataataatagtgtttatcagttctaaaaacacaattattttcccagttagcgaaagcaattttctgactgttccaataaatcttttatcattttcagaaccatgtaggctactacttatccaaatcttctagtaaagaattaagcagtttcatcccaggatttaaaactgttgcactgatctcaccatataggaatagggggcattagcgggataatatagggacacctgggccacagggccacagatataaccatggaggttagtcaggtcagcacttcagtctctaaatctttcccctaaagttgtccatatttttataactgacttttctcatgtcatttttccccagatacctttatcaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaatgaggaagatgtgttcattgtggactctaaaaacaaaacaaaacacaaaatcccctgttcaaataaacaaaaaatccaagattgattcatgaaataaagaagacatgaattgttttaagtctacactttgtaattagctaagttgtgcagtattttttgacttaaacagagtatgaccctgaaaaataaaagaatctttttttttcaaaactcatcctacctacctgtaaaaactgtacaaagctaatgtatttttcatattgtaaagtttcaattgtagaaacaactggtatgtacagtaccataatttaattacattttactttaaaaactttacacatttcagtttctaaaattttaaattaacaaaaattatttcttgtgttattcagagttactcagttttgtaaggactgttttgttactgcttttgtgcccagaaaccttgactctaaaattctgtgctgtgcgaaacatgcacgatttttattatgcttactgcgtagaattttatctacttgttccagaaataatacattaaccaaaaaggatttaattgttcagacttgtaagaggttcttcaattacataggcaggtttttcttaaaaatgaaaaaaaaatcaaagatttttttaacagttctcagacttaactgttgccttgaattacagcctagtttctaagcagtgaaatgtaatgataaagagggatattttaacatatttccgaatgaatgactcattatttcattcttttgagtaaccattgttaagggttgggggaaagcatggacaaaacatcactggaaacaaaggctgtaaccacagcaacagactttgtgatacagttaaaaggtgcagctgccagtgacaaataaaaacttttgttacatctcattattttcaggccaaggtgggagtatagtgcataataattgtacagtagcaatttttatcctaattaacccatagcggtttacctaaaagtaaccatcagtcagtgcaaaatgtgcctggttcttaagacaactttttatttagaactgtgagaccggtattttggaaacatttcaaaggaaacatatgaatttgttttgcgttgtgcactacatcatttctctcctgaggaagaattttaaacatgtacagctcattcaatatagatatgagccatggtggagaactttatcactcaagtagacggtaaacatccttaatatgttctaaattgtttatattgctatccataatgggattcacctccaaattatcaaagaaataactcagagtaatttgacaccagcccagatcatatattgattatacaattgtattataaagttcattcaaatcaaattaagaaaacctgagtctttagaagctgaaataatcaacttgtttgtgctgtttgcttgacataggttattgtttgaaaatattgttactttatcaatagtaatcatgcattcttgtgtttttttttaatggaaaactgcaagtttcaattactgttgcactagaagtgctttttatgttgtcattttatattcatgccatcaaaagtagattgacaatacatcaatctaacaggggccaatcaaaacaatgaagaaaagaataactgaaaacaatgtcaaacttttaaatttttatctcttccaaagaagttatatctataaaatctagttttatgcaggtttgtcacagcaaatgtaaaagcggattcaagaagaatgaacttaaaaactgtggagcaaatttttgttgaaaatatataaagtcagaaagaaaaaagatgtaaatgttggaagaagcaaattctattactaattcaaatgaaactaaatgtcaaacacagtacttgtgtcaactatttagcatcccagattttgtaacatattttgcataaattatttgctcttcaaaaatttttgtcattttaaatctaattttaatctttatgttttccattttctaatttccttgcaatgtattattcttattcttaattctctacattgaaatttggctttacgtcgttagcaaatttataaagggttataaagctatgattcgtgagtctaaaatcaaatgcaaaattttatttattatgtaaaccaaaatgtcatttgcaagttttctcattagaagttatccttgcaaagatagaaaaagaagaattaatttgtgtaaacaagcacaaattaacatatttgttaataaataggtttatctactaataaacctatttctagacacattcaaattgataatgatttttagaaatgttaaggttccaaggagtcttacaagtgtatgcccttgatttcctgaaggaaaccactttctttcttaaatattttaaattcatctaaagtgaacgactataaatagaagcaatcaccttggaaccacagctctgtgcaaccaaggccctaagctacaccaaatacgccaggaattttgagacttctcatctttaaattcaaccaaaagggtctttagcaagaaaaaaaatgctggatgatgattattattatttttgcttaatttttattttgccatgtccaggttaagggtgagggtggtgacaatctgaaagactgtgtctggaatctttatcacatatttccaatttatttcagtttttgtctaaaacttgcatttctaacctatcttttccagcatttgataatctcccatttcctccttctaacccccattcctatgtctcccttcctgtctattcctcaccgatttaaacaactgaaatgtttacttatgtttggagctgaaaaatggaaagtttcacccagcatggttacaataacagccagcagctgcagcaaaccataaagttatgcagtgttttgaagttcacaaaccacattttacataaattatctcattttgtcttcataacaaccctatgaagacacattaatctcaaagaaattgagctcttaccccaaaacacagggccaataattggtgcagttgaattattctcaaaatttacaggctgttagtctttccactgtactaaaagatttctttctctgatcagagcaagagaacttccagagataatggatagaatgaaagaatatatatctatatatatttgacatgttgtttagtaatccctattttaattcaattctccatctgtaaaatattagctaactgaattatttctgtgttctactctgggctctcacattaaaactctgttcaaaaagtttaacaagtcacatatttcttaacatacaagttcgtttgtgaatgtgcagaacagatgctcccaagatgtggatgcatgtaggccccgaggtacagacataaaatcaaggaagcacaaggaaagaaaccccaaggaaaaaaccaaagaccttctaaattgagactgcataattataaaagagatccatagtacagggttgaacacatgttcaacactttgtcaactgaacacatgttcaattcggagctaattgggaagacttacataaaattctttttctttttttcttttggcaagatttcttcttaaaccatgaaattttttttacttgtaataatagagaacaattttctccattttcttataagaaaaataaaatataatttatccaaattgatgtatagaacctaaaacatatgctaacttgcaaataatatattttactgatcaactcatttttgtcaagtctctatttctagtccctcctgaatgttttggaaaaccacaaaactatacagattaatacaaattacatttttacaaggaaagaaaacattcccaaatttaacactcaagactaatcacataatcctattttgaactcagatctctctgactccattgactgcttagaaatagtaaaatctttttgaaaaaaaaattttctaaaataaaactattgtatatgagagtaaaaatatatttgtttttgattgttcctgactagaagacagatatcatctctcaaactaaacactcaaaataagaaattgaattcatgaaaaccaatacctgatgtgaattgttgttattcaactgtataaaagaaatgcagatgttctgggtatgtcagagcatgcgaaagaagaagttatgggactggcaggtatttggcctcaggagaaaaggtgaaaattttccagaatagatataataacatcttatattggcacagctcttaacagtttataatgctgggtaatataacaatctcctaattcatcaaaaagtctcaaggtgcagatgaattggtcttgcaataagaaagagcttccaactcctcccatgaccttcccaattttccccaactgtctctaaatagggaggcgccaagtacaaaggacccaggagcaatgctttcaaaattctgatttaccccaaaggtagggtacctggacaatcaacaattgggcttcattttatcatcaacattaatgggaaagaaatgtttaaaaatttaaaaccaagcaaacacacacacgcacatcaaagtggtgatgagtcttttttgaaggtctctcatgacttgcattatagttttattgtgagataggaggcaacttatatttaatttatttagggtaaatttcacattttaaaaagtccaccattgacttttttattctatgaaggacagtgatcttacagcagcagagtgcctcaaccatctaggacttaggctactaagtttcttcctcctagctctcatttataaattttgtgttatatgatatttgtcttcctgaaaaggtgagtgaaaatttattttgtgtaaatcaaataatatttcaaatgtatcaagagaccttgtgataaaggaaccttgaaattgctttttaatctaaaatattacctgctaatttatcttttttaaattgatttccatatatcttgtgttattataacacagcacacttgtactacatggtttaaaggttctgcaagacagtcttttcctcagtctataggaaatgacggtctgattccaggttttgagttggtcagttgagcagtttcagtcatttccacttactgactttatctggattaatgtggaaaatagtagtaagacaacatggatggataaatttgacaaataattttatttgtttaaacttttgccacctataatatccttgaagttactattaagaggtcaagttgactccaaatcccttgtgtcaatactagatttactgaatcagaaccactgggatggatcccaaaatatgcattaagacatgactgaggtgatactaatgcatgctaagttttgaaaaatagtgctcaaatgaatttatttttcctaaatcattcaattgctttctattctaaagtaaaattgtgaattcttgtgctttcccatatcaatgtgaatctagttttctaagcctgactgaacatttttcttgactgaggaaagcataccaaaagacaactatatataaaatgctcaggttgcttcctgacagactgttgtttatagattttattccccattaactctttcgagaggcatatctgaaaagtcttaaggcttctgggttagttacttgttagttgcacccatgaatataacaactgaaaagctggaagtggggagaaaggcaggaagtaaattatgatgtagcaggcactatgccctcctctcatttttaaatcattttaggaaagaagtataaccactattttaaagaaaggaaaataaggctcatagtaattaaataatttgccaaggctcacacagtggggttgaagattcaaatctagatttgttaggctctaaggatgtgctcctacccccatcatagcacattttcaaaagtgagaagagattataatcaacataatgaggcttatatatattattctgaataatttatacagaattatttattctgtattcagaataaattcttattctgaacacagcagaaaaagaatttgcctatttccaaatagaaaaattatcttacactgtgtagagacttccttcaatatcctaaaccagaggcctaatggaaaaaacaacaacaacaacaatattttcttgaagttttatacatggttccctaaaaagagtagacatttgaaagaaaaatccttcaaaacataaatacccttgaatattgatgtcatatttttatttccaatcatcttagcccttttataaatttacagccaaaattacagccaaaattacagccaaaattgataaagaaatatcaataatataaccttcaactggctgaaaaaaagaggtcaggttgccaattttaccaaaaactatatggatgaatggtcaataaagtcaccaagtacaaatgacaaggtggagaaaaacaccaataatctacagtcgcaaactgtagcaatgacatggcttgagctacagaatatttcctgtgagtgattttaaatggcaatattccttataggagtattataacttacacagatgatatgggatctggaagcatactacatcaaaagaggctgaaagataacctttataataaggcagactctacttgtcctactcagaatgtaatatgtagtttaaatataaaataaatatcatttccttgtttcattacttcgtggagatggacaaataaaattattttttgaaacttatttttaaactcacatcttgaaaaacatcttcctcagtctcagctattcacaaatgattcttaagtagactctcgactccattagtgtctcaggagctttttattaaaccattgagttatctcttctatctctccctgaactccacaagtgcaagtaatcccattggtttaattacattagcattttactccatcacaggatctgaacatatagcatccatgaaaaacatacttctataatacacacagcattcaagagccagtaaagcactctgtaagtcatgcctcctactaaaaatgatcacgtctataactgtgataaaaactaggctataaatttaaaacaataaatccagcaaagaaagaaattctagcacactggatctaatatcattgtgtcttctcattgtggcaccattaccaccatacagaaatgttatctgaaatatctagaataattctgattgtggacaacaaagatgctcctggtatctgggttgaagatgtggtaaaaaacaacaaagaagacaaaaattacacataccaaggtaagtgaagggcatgtgatttattattaaataatctgccagtaattttaaaaactaagacccattattaaaatttacaataacatttatgccatcaagtgtcatcataaaggctaatgtggatatttggaatataagagaaatgtggtatttgtgatggcaatacatattaaatgatagatagatagatagatagatagaattaattctaccaaaagagagactattaagaataaaaattagtccaagaactatttctattatttctctagagagaaactgaatagacagagaaaaagatttaaactaaatgctacatgttctttccaaggtcaaatttgaaatagtccaaaactataaactcttgaattgctgcttcaaccatatgagtaattacattaattcacatacaccttgtcaaaacctgatgttgagaaatgaattgtaattttaaatatactccatctgttcttgctgttttacatcaatgatatatttgctttcaattacagatccataaatataatgccctaaacagtctgatgaaaatgtggtgaaagattggtcaccgctgtttttctgttctaccataaggcaattatcagagtggaatggccaccacaatggggagctggaaatatgatttttaaagtcctctctagaggtcttattttatattcacttataaattaagaaaattattgccttgaggcaaaagcctgagagcccataccagctctagtctgactacacttacaccagagaggtctagggaaagacactgaacatctctgaacttgcatattatctggagaaaagactgagatccttgtgatgtcaacatttttccgcctttggatgtgatggaaacttaagttcagtgtattggacatccttcaaaactccctgccagtttcctctttaacaaacttcaaacctgagtttcttgagccaccattggctttgacacgcagctatttaataatgaatccttgttacacttcatcattttgtggaagaattacacaactggggttgtagcccttagcggcttttcccttgcctttggatccagttatgggataaaatgtgtgaacttgacatgacacattggtactaccacaggggtactggaagaagagccttctaacagataaacattttatgtaatataaaactgaaatgtagtttggggccacttctttttaacttaataatctgatatagttttcagataactgcatgcttttctgccactgagaatataaatactattgtctgtaatgaaaacatggttttgttgtcatatactttcgctttctgaggacagatttcagacaactgattgtgttctgtaattaccaaaaagaatgtctatttagtttcagaaagaatggcttaatgccaaacactttaagacaaaataacaactaacacttactgaatgtttacttttctaagcattttacgggtgttcattcagtcaacattaatatggcaaacagaattaataataatcctatgaagtagatactattgtttttcccttagaaagataagaaacggatgcacaaagcaattatataacatatagctattaaattgtgcagcaaggattcaaatccagttgactgatatattgaaaaactgacccctctaactgctcatttaaggtccactgtatagaccccaatgctaagttcaaaattctacctatttaaggctatcactgaagacattttttcaatataattaatgtgtttattacatacctaatatatgcctcttggaaggtaagaaaattttagagatacatgagtatatgacatagtccctgtgcccaagggacttacagtcttagcaaagagaaaagacatccatattcaacagaaataaaattcaagaactaagtttaatacctgcaatcataaacagcagttaggagaagataaaatcaaagttaataagtttgttgggaatatctcaaggcaaaagtgataaatgacatagaacttcaaactagcagtgaattcagatgggcaagacaaagatgagagggcagtgaagggagaatattatatttttatttactaacatctattattccaataggatttgttaaattcatgcttctctggaagagaaagaccaggctcaatttttgtcctgattgcctaaaagctcagagccaaattaaatctcttggcctttctaggcaagcctacatatttcccacatttttctgaactctaattctctttacatttctattttatcttctttgaggtgggggaaaagaatattaatcctttgtttaaaatgttatgtcagtttcaataaaatgttcatacaacattttgaagactgatccaggcaatggcattaatttcaaataattatgtgaattaaatcaaacaactttttagaagctaataattgtaacatcctccaacaaaatactgtttggcacaaatgaaaacacggcctttagattgattgactttttcttttcaacctttttagtctttatgttagtattggtgaatattaaccagaatttttatttcaaagagtaaaaataaaaatcatttttgattgctacattttacaaacaaacaaactacagtagaatattattaaagaccatgatcaaaatcatttaggtgatagtgagacagccaggtgtgagggggtccctggcaaaactccaaacaggtctgcacactgggaaggtgcactcgggtgcagtcacacagaggttccagtccatttgcagcaaggaagagcctggcccctcctcttcctgtgtggaacttgggattcaagcggccaagcaggaagtgctctagcagggactctggccttgcggagagtccctgtttcccccttttcttccttttcacccaataaaaccctgtcttactcaccattcaaattgtctgtgaacctgaatattcctggccatgggacaagaggcctatctttagctgaaataaggaaaagtcctgcaacaatagcaaacagaccagtactagaatgtacatttacttataattatttttcactagagtgaaatatttttaatttatgaatgcactgacattaaagaatatgcagaattatttctgccttaaaagtataaataattgtcagtaaagttgtcatttaaaaagtacagtcaaatatatatatttctaatctgaaacatgatacataagaagctactttagtttttttgaatttttttaagttgagaaatattctcttcatcaaattctggacaattaagttacagttacctctgtgtttatttggtaggtacaaattttcattcacgggtatttgttcaatgtgtcttctatatattttatactatataatgatattttgatatttttaattcaaatcaataaaataagcatttattcatttttattatggtattccagtgactatgatgtgagacacagtgatcaaatgcttatagtgaataaataattgtgactcaatgtgatatttctaaaaatgaagtctgtacatgatgctgtgaaatgattgggtttgctgaaaatcagaaaagacctcacagagtaaatgctacttgagaaactttaggtttgccatttataaaactcaggtctgtctacaggctccacatccagatcctaactaaaatttagaagtctttagatgtctgtggatattatcatctggaaaactgggactctaatagtttctgagtctagtattttccccatatagctactcagttttttctagtatatatgtcaaataaaattttgaaaaaattaccccttcccacaatctttgcaaattaatcctcaaatgaaaaggatttaatttagctattccatgataaataaaaaatatgcaattttattgaataaacttaaagtaattaataaattcaatgtactgtcagaagttttctgttttgttttgtttttaaaaatgtccattaaaatgctacctatgtgggttaaaaagcctataatacaatttctaacttcaggaatatgtgacaacatgtagaaagggtatattgggctgtgcaatttaaattttcatcacctacaggttatggcataagactgatatgaaaatgaatgagaattaggttatatgtagagtcttttgtcttttgttctattactataaaatatttcatttaaaaagtagggaaaaaattactaaggtggtgaatttgcctgatataccaataagcacagttgttttggaagttgcttggtaccactgactttttgcttctttaaataagtatttctttccttagcaaacacttctctttatgagaataccattactctcaaaagattccaatgtttattttgtgcttatggcactttttaatttaaattttcaagaatgcactttgcattaagatgaaccaaagtagtattagtgaattcagcaaccagttcaaggcatagttttctgattttcctacttaagaaaatgaaggccaggcgtggtagctcacgcctgtaatcccagcactttgggaggccgaggtgtgtggatcacgagatcaagagatctagaccatcctggccaacatggtgaaaccccgcctctactaaaaatacaaaaattggctgggcgcagtggcctgcgcctctagtcccagctactcgggaggctgagacaggagaatggggtgaatctgggaggcggagcttgcagtgagccgagatcgcgccactgcactccagcctgggcaacagagagagactcaatctcaaaaagaaaagaaaaagaaaatgaatatattttaattttagaatttcagaacatgtccgtattaactcgaagaaagttatcatgaataatgctattttaatgaatgctgagggaattgtgcctaatattctaaaatactcttgagaattatgaagagtgtgcagtatggcaaaggcagccatgagaattcccaatatataaaatgtatactgtattcaaataattatttctcaaaagtataaattttcactctagatagttttctacagggtggcacatgctatgtggtagtaaatgagcctgtaaaactgaactcattagacaataactacttctattaaatacctaaaacacccttaatgtgaatgttttgaatttatttttatatgtgtagagtctataatttgttagtgactataaattaaattataacaacctttagcttttttaagtttcacaattgttctgtattccaattaagaggctcaaaatctagtctgggaaactccacttggcttacaaaaaaaaatcaatatgctttttatttcatggggctctgggattgttaagattagcatgaaatactgacatttacactcctgagtggactagaaggggagcaggatggaatgatgatggcaagtaattggacaattggacagtttccagaaaggctttaagaaatactattaaatctccatctgctgattgaaaattccaggttcataaggtataacaatagctgaaatacaagccttagatgatctctatctttcctttgcaggtttgtaccccacctactttgcaagaacctgtgacaattttttaattaaaacatctgcataattaaacattttaggctaatgatgacaagaagacaggccatattttattacttttgttgaactgcccagtgtatattacatttgctataaattaattactcaaaatcctgccttgaaaatatctgttataatttttaaaaaaagaaaataaggaaaagagaagaaatagattaaaaattaaattagggtcttacacttataatgagatggttctaaggaggtaagacttaacctaaataagttttcgttcctttgaattagtggaataaatacatcttaaatttctccattccattaggacagatcacaggtgaacttggtgagggagtaagcgaagaacagttagagttgcagggtcctaaatcaaccacagggagaataatatattactctgcttattttactcttcctctcctcttcacgtttatgtcttcttcagtatttccttctcagtttgagttttatatagcatatgacatacacatatgtgccaacacaatgtgagtgacaagactggaagaggaaaagcttacattaatttatcttgaaaaatgaaatgtccaattatacaacattatagagtgctaatagctcaccaaataacataaataagattatatttcactcagtgccagacctgacaaccaaacctaggttccaaagtaagcctttctttttatcaatagattgaatatactagaggttaagaaaattcacataaggccgaatctcctctttaaaaaatcctttggcatttttcataaaaacagctctttgcccgtggctcaatttaggactttcacaaatcccttgaataatgaaggtcttggttttacatgactgtttatgtgtggtattctatgaaaggtccaaaagcttgttaaggacaattgctaaaaaaattaaaatatatcaagattatttttgtcaaaccaatatgtgttagaaagttatctattgaagtgtattccatatacttaatataatattattataataaatggcaagataaaaagaaatccactacaggatattcccatttctctccagagtcatggtatcaacagataacacgccagtctccccaggataccactataatttaatacatgcaaagtatccatctaatttacctgttactgatgaggaaattccaaaagtaagcttctcatcatagcaaatcctgaagaactagcatttaagctatttcattatggggtgaaaaaaatcatcatttagaaataaaagtaccaattagtaacaaattatgtacaagtcactctagcacagtgtatttcaatcacttcagtaatttttagcctcccaaaaaaaagtgtcagaaatgaggcatgaaaagctattaaatgaatcattcacacgttgaatagatgttgtcgtcagtttgttctctcaatggaaataatgaacaactgatttatttataactggtcattatgataatacaccttcatgttccacccttttcaatatattatggatatgttataactgtcttattttatagctgatctaaaatcatatgcttccattaaaatttcttcttttccaggctttcccttaattttaatgttcctttggcttggggtgtaattaaaatgtttttactgacttggttcccttgtcttttttttccttccaattttctgtctttttgcctggtggaatttatccatatcttaagtgtatgtaactagagtctgaaatatgaattttaagtagctgcagaatacatttatgtaatcactataaagtggatcttgtcagcacttatttagtcaagtttaccttgttttccttctgagataaaggtaagcagaatggataaagtaagataatggaagctgatttgtatttcagagaaaaaaattcttggtcttaagagtcaaggcaagaagacttcattcgtttttcattctttttttttttctaaatttcagagcagagaggaacatttcccttgaatgttccagttctaacactgtaattaattttgcagggttacattcaacaatttgtatgttttgctgcataacactctgtatatgcactggactctgccctcaatctgcactgcaggtttatataggaaaaagccttcagggattttcttctacatttaatcaaaactctttttgagaaatacatccatcacattatggaatatcattttttaaaaaaaaacatgtgagtaatgtacttcagagctaggtctggaaaaaagattcccttgggaaatggttatgcttcatccccagtgagtactagaggcctgtaacacaacctgtcttctctatacctttgctcagaaacccagaactgggttacattcgctatcatggtgaccatgttaagactcccatggagtgtcccagctttctcctttgtaaatactttttatatactttttctaatcctgttttgttaatcctatatcatatgtcttttgtaatatgttctctgaaattatttagagagaagtaaaaggtagaaatgaggaaataaaccagagatactattctttaaaagaattttttttatttttactgaaatggtggcattatcttaactttaggatgctaatttttttcttcctaacatcatgcccacgtaccattatctcatccctgactcatcttttaaaattttagttcctttatttgcaatttacatataagatgtgtggaaaaacccacagatacacactcacacagcacgccactcttctcatatgctgttgttcagacataaagatcactaagcaaaataggagataacatttcaagactttctccactaacagaaacatattctcaggtgatcggttagagtccaacaaggtttattttcaaaagagtcagcaagcgttagaaatgaatttctcaacaatttttgtttttaagagacagggccttattctgccacccaggctgcagtacagtggtatgataatagcttactaggctgggattggaggggcagacaggcagctcagaaaaagagatttaggctatcagagaaggtggaagaataaatgtttggatataattatcatggcttattatctacaaggtggaatttggctaactttgttaataaaacaaggtacaaatcatttaatgacaacctatagacttttagcttacatttagaaaatacttaaaaagaatttttccagcctgagcaacatagtgagatccccatttctacaaaaagttttttaaaaaattagctgggcatggtggtgcacacctgtagtcccagctactcaggaggctggggtgagaggatcactggagcccaggagtttgaggcttcagtgagctatgatcacaccaccgcacttcagtctgggtgacagggggagaactcaaaaaaaaaaattcaaaacagatattagatgcaagaaaagaaaaaaaattaatgtatatcaaaatattaaattctgttcccaattattatataattcctatatcaccaactttctttgaaaattaaagactgaatttgtaccaatgtactaattatatatctataattggtatatttaataagttaaaattttggaatataaggcctctacatttacattttaaaaatattcttagacaaggttctggattatatttcaattctgttcaaagagtaaaatggaaatgtaaaaacagagatgtctccttaacagagtgaaattaatttacaaatctaagcaatataaaaacatgagtaaaaatctaatttaattgaattattaatattaaagctagtccacacaaaatgtatttattctggagtctctgtagattttttttattgtttttcctgctgccatcaacttttgttatactataaatatggatgtaactgtacctacataactaccagcacacacctaaaattaaataagaaattttaatccagtagttcttaatttcttttctaatcctaagtacttaaagatataacacactattaataaatcaccatagtgatggttcttaaaggtgtgtgtgtgtgtgtgtgtgtgtgtgtgtgtgtgtagcatgtggggaaggtgtcctggagaggatacaaccttctgtgattttcctctgctaagaatcagccctgaagggtacaattcaattacctctttttttaaaaaaatctcagatcttggcttgggtctgaagcatgaatcatgtggagtttaatgcagctttgggtcaaccctgatcaagaagaccccaggaagagtgtgggaaaatttaaatttggataccccagaaatgggattatgtatctaagaatcctatatagcatgtcttgtcgtatgccatttgtgtcagctcagaacttccacagttctttcacaagctcagatcatatctcttggagccactttggtccctacacaccacagattccatctctgggctaatatttgactaacttcaagattatgtcaacactgtctatgcctcatgcaaaagcctcatggaagcaattaatctaacaacagtgcaaacaagacgactataatcacccaggtgatcatgaaaaagaacatgagggaaataaaaatgagatagacagattctggaagcatgctgtagatattatgtttttcagtaacagatttggggactgttgtggggttgggggaggggcgagggataccattaggagatatacctaatgctaaatgatgagttaatgggtgcagcacaccagcatggcacatgtatacatatgtaactaacctgcacagtgtgcacatgtaccctaaaacttaaagtataataataataaaaaaataaaataaaataaaataaaattgatgaacatgggtgctacatgatacaagtatcaaaggaatttcagacttgagtaattctgaagcccacaaaattagccacaggatttatcttttgttcttcatctactagaggaatggatgttacaaaccaatacaatgaaattaaaaataaaaataaaaataaataaacagatttacaccaaaacttttaaagaaatttgtgataggaaatggttaagagggtggggagagagggcaaaagttgggtcttcagatcctacaagcagaaaggggctctcttttaggtcagagctgatctttagttgttttgtaatgacatttcatctgacacttcctaggccaaatatttaaatagacacctctaaagaagtttagcaatttgatcctctctgcttgctcatttatattatttctttaagttacatttatgctcagtattcctatgcttcataggtatttgacaaaaaaatttaaagagttattttttctttctttgtttttttctttttctctagcttgctaaagaacaatcagccagatccaactagatgagtcaactattccccaggcataactcctggggtcatatcaattgcatttgcagcagtggtataataatttactataaatgtcttaaattacagcatttgaacacgtgccaggaaataatacttttccccaaagcagatgaatcatgaacctgaaatacataatgcacctcaaaggcatttaaaattcttctaaggagtgacttattcagatgatagaatgttgaccatttgatttgagtggtgaccttccaaaagcaatgaatagcatttcaatgattttcaaatgttattatcaaaaataaagtacgatagatatataaaataggtaaatatagaagcttctctagtaatgcctcccttgggaggtagggagcctgggaaccaacttcaataagaatcttggcttctctgcccttagtttttgtagaagggcccttctcatatgtagaattttgcctctccaaaatagctcagatatctgtgagggagtttggttgaatttgagagtctgagagcaagtgatattagataaagtttatataaaggctacagtcaacatcacagaacaactcagtttatttagaacagccagttgaaataaatctaaggatcgtagcacctaaccatctggaagtcagttttgaaaatatatatatatatatatatataatatataaaatatgctttatgattttgtttatgtgatttaagtagatctatgagataagtaaaataaaaattaaaaattctatagctttactttatatgtgtataaacacacatgtatatgcatatatattgttgagtctactaaacagtgtgcttctagatttattcatgcattcaataatatttattgagaacttactatcttcaagacactattagagatttaaaaaataaattagatatagctgatggtgtaaaagaggcttaaatgtgattcatctcaaaatcatcagaataaataagacagaaaattttaattactggtagtaagaaacaaagatgatgaaaacctaagccaggctgccatgaattgaacaacagagaaaaacagccctgggtctgatcagtttgaccttcagcaatgtcagctcacttctttgggattctgcttctttatctgaaaaataagggaaatttaaccatgtgatcttcagagtcccttctggctccaatatttaaaaaaaaaaacaactatactccataagtatgatttaaaccagaaggttcaaacctcattcttcacttgcgatagcttcgctgatgaataggaatgtcagccaacattccatctcctttccctttcctgttccagtttgatggaggtaccagctagcaataaaatagcattgaggagttgggactcacaaaaagaattgtatccaaaaccacaatactgtgactatggaattattgtttctttaccctaacatattaaaaatagctgatgaagaaaaacaatgaaaagaagactgtaaacaagtcgaatttcagaaaatacctgggagacaagtgtataaatattgtttgaaatttttttaaaaaatgaacattcaagtatttcattcagaattttttaaatgtgcaaattcaattataaagccatggtgatcacaagatacaaggtaaagttttattattaatttgaaatgtcttggtttgaaaaaagtttgatagtaaaatcaaggttaaatgaaatatcatgaagctgtgcaattaggttaataatgaggtgcctcagggatcagtgctagcacaggtgttcagtatatttattaatgacttagaagagttctgaataatatggaagcacatttggatgacttcatagatatttatagcaatcaaacgggtaaatgactgcttttcatgaccgattcaagagcaattatttaacacattacagcaaataatcaacaagagcaaattaatgtgaagtgggtggaattacccaagttttcttagcatgctaatagctaactgaaatagttattgcctttcagacaacagtgggcgcatctaagacatctgtccagtaaacagcactttaggaaaaaagcataatcaataaaggttggaataaagaataatgcaaaagaattatctaaatcaataattattgctgaaaatttctacacaccagagacttgctctactgaatggcactgttggaaaagagtgtggtttcccaaaccacatgctaggattatctggtgtcttagctggtgattttctaagtagttttccattatcatccattcctctccgatatccattcactggcattcccagatgcctctcaggcaggaataaaacttacaaggacatgcccttctcacttctgctttgctctgttctaaaggatttcattgatattaacttttatgttgaagatctcaaagctttggaaaaattaaaagtcatcccttttcacaagaaagatggcataacactattcaataatagcatgaactctattatatcctccccttatcccaaagttaattattgtgcatagaaagaaaacttaaatgtagcatcatttcagttataattcattcattccaaaatattttctgagtgcctattttatctaaagcacagtagtaatagaataaaaatgatattaataaaaatatttggagcctgccctaaaaacttagaaagccatgtctcccctctcatgaactaagcatttctcaatcctagtccatataaactacacataaatgtcatcaattatatcataatttgaaatatatgaaaattaataagaatcagaactgtttatgtagaaatatataataacatttttaaccaaagcatcattttccgctgccatttatcttttgtaccagagaaaatattatgaaccctgaggtaaattttctcatatgaaatataacttagatacttccccaaattttagagaaaaatacaatttctggactgtttgggactaagaaagtaggccaatataactggagtaaagccaaatactaatgaaaacatcaatgtgtgttcatattagctctacaaaataaccaaccagcaaatccactgacagaatgaagatatgtgtgaagtactgagagtgagaatttttctttttctttttttggaagatttggtaaagcatctctattctctatttatgtccacctgcaaatttcagatgtaaacatctagagtaatataccatgatcacataagaattcacagactttcagaatctcagtgttaaaaggaaactcagacgttaaccattgtttgagctatacatcttctctacatcactggacatactactaccggagataaaaaaaacatacacacaaaaactcattaattaaagccaaagacttgcagcgaaaagcaaattttcagcaattaagtaaacaatgaacctctgttagaacctcaaacatacttactaatgagatttaccagagggtctggaattatctatttaaaatataaaattacaacttggagaacaattcacttatcagaggtgtgacaattctgttaatttttctttctaaatcttttagtatctatgggtttttgtgcagtgtgatttaaatataattttagtaagggaaaacaagtagtgaatgagaattcattaacaggtggtcaaatgcaaagagtctatcaatcatgctggtatttttaaacatcagcaaatttaattccatctctgggggagtaaactcattctctaaggtatgtgacacatcgtatttatttttaaaggacatttcagagtgttccttgattatgaaatactgcaagtatttcctgccttaggtttcctaggcagacaaaaaggcaggcagaatccaccactgcaaatcagataattctaaaataaccaaatagtgtttctaaaaatgagaacatttccatatcttagctctagataaagagatttgtcatggtaaaaccaacaaatctgaatcagaccttaaactatgaaatagcacacaagagggatgcagaattttgtgctgaattacaaagagaagtcagatctgcaaatccacaatgacataataattaaataaatttaatcagcttttactgaattccagtttttaaatgtcaggcaattattatgaaatgactttttctacttgcataatccattgtgtattatatttctaccctgaatcaagtgaatgacttgttagtttgatcaaaaattatcactttatactacgagggaaagcaaccatcttatccaaactacatggcattagactgtataagcttcctttggtgaagcaagatatatatattgattttatcatacacatagactcttcaaggtcaaatagcaagttgaagggagaagaagtatcctgaatgaccattaatgctcttctataccatggcttcaaaatcttaaaatactttgcatttcacaagaagttatgtggcatttgaaaaccctctgaaatgaaaagaaatttctgatccccaaatggagtagtcaagaaaattgagcactttccagaaaataaaagactcaatatttcagggcaccctcctgcatgacaaggagagttacaaaagagaaaagccaacaaaaacatctcacctactgtatatatcttgtttattgcccattttcttgatgaatattataggaacatacagactgataagattcccttaccgtacaaagaaaagttatcctgttttgtaatgcgtaagtctttcctaaacacagagactgaattttggttgttattctactacgtggagaaagaactgatgttggtgaaggtgagttgcaatattgtaccattaacgtataaataaagcatgcccattgctggtagttatcccttcccaggtttcaaataggaactgggattttaaatatttcagaaataatttcttctaagtctctattgtcattgtatctctttcaattttaccacaccaatgatattcactgagcaagattccaaaacctttataaaagcattcccttgaataacaccttaaatcttactctgttctaaatttttaaactaataatagtttatctgaactctcccaactggtcaattctgtcataaagctacataaaaaccatcttccgtattgcagattatttttgaccaatcgatggatgaaattttggctattcttgttaacagtgtctcagtgtaagcattgttgtagttatcagctttgtaagaagtttatggaaatgacagaagctttggacatgtactcactgatagacaccagaataaatcatgaacaaaaccaatttgatagagaatcaagggagtcaaactgtaaatggtaatggcagattacccagtgcatgggtgagacaatggcatccaaagagatggttagcctctatatacctcctccatagaccatgtaatctgaaactcctagccgttagattcattcctctaagataatggctgcaagataaactactttagttgaaagtatcatgtttggaacacactattgagtagtataggataactttcagtgccccgcagtgctggccacagtacacgtaagttccaaaaaatcattcacaacctcaagtgttcagagggtcaagcaagtactgggcatgaaaaaataaacaggcaagtgctaatgtcaattgaccagcagcctcaatgtctgcaaaacaatagagagcagtgtaaactgaggtaagcccttgtcccatctaaaagggacaactaccactgatctccagagaactgttgccaaacagggatataggtccatatcttccaggttttctagagaggtaaaaaatctgaattttttatgtgaaatctctaattttcaaatgttagaaactaatttaattgtgtagcacgctcttagccaacattattctgagcaaaaaaaaaaaaaaaaaaaaaaaaaaagctgagggccagatttggccaacttgttggcaatttcctagaatgccagtcaaggacgtgaagaagggagattcagttgggatgaggatgagttctagactgtcaattaagagaccaggtaagggctatagatagcgtctttcctaagggaaaggataagcaagcagactctacatatgaaaacctaaatgcagtaagccacttgttatgaatagtacattttaagaaaatgtacattattcatttttttaaaaaaaggtctttttaattattttattttctaactttgtctttaccctttgtccaaaaaaagatttacaataacataacaaagtcttcaatagaataaaagtaaaaataaattatgaaagacctagaagaaatgatgttagtaatagtaacctaaagtacaccaaatgcacgctgaatacagtcaaaagaacaaaaatctcattagccattaatttataaaatggattattatctgcatggggcgggggaagatgtgtccatttgcaaagtctattttcttttttaaaacatacaatttggtctgtggtgtggatgaatctatcttgttcataactaatacagtaacaaatgctgcatatcaaaacaaaggagcattattacttattttgactctctagattatttgtttccagatttaaaaagcattaagggatgtctttgtgagccaaaatagagggcagaacagatcccttcctacttaggattttaatactcccttgcctgaaagggaaagatttttcaataataagaaaaggcaatgtgagttacaggagcatcggtctgatgaggccatatacaggatatcttaccatcaatattcctacctaatgtgtcagaattgtacagctcttttttaaaaagccacattaataaaaataagcacttctaccaagacaaattgattgttgtttgttgttactctaaaggaaaggaaaaaaatagggctgcagcagtatcagcaggtaggtattagtgtattctagtctaatttcaaccccaaatccatactattaaatacaatttggaaaggctcagctgttagaggatcagagtatgtgcagcccatatgtaatgaagaaacactcctgtaaatcagtgaatgagcaccatgcattctgatgaaccaagtatagaggctgaaattttaagtaggcaaaaagctttctctccttacccagcattcctgaataaaactgataagctacagccctagagaccaggtctctgcatttaatttgtttaacaaatatttattgagtatctgcttgatgtatgctagtcctggaaaaaaattattccaatgaacggccagttaattcatgccaactaaatagtatctattctatgtgcatagctacaaaaatagcagagtcaattcaccactgcagcataatacaattacaataacagctctagtttattaacaccattatttaattttattttgtcttataacaaaaaactttttactttaaatcattaacagccacaacaaaatgctgccagatatctgaacacattttctttaacccatctacactactaaacctaaaattgtacacaataaaattccaccttgaagtaacaaccttggagcattgcaaaatgttcaattataaaagataaagtaaattttcatagaatggtgtacttactgagaaagaaaagcatcacacatacatcaaaaagatcttcaatgtcaaagaaagaaatcaaaaattttggtccttgtaatcttgaattaatcagataatgtaatgcattagaatgctttcttctttctactccagtatttcaaccaagtaggttatactgtttccaatactacaaatatgctatcttaagggtactaaacacagccctgaggacaaggagagaaaaactagaatctagcatcaaatcttctgtcaattacacatatacacatacacacacgtgtggacataaagtgtaaacttcagactagcctcacctgaaaattagttagaaatccaaattctgaggccccagcccaggaactctaagggtggggcccagaaatctgtgtttctacataaaggggattctgatgcatgctgaaaatagaaaatcattgctccaaaaataagaaatgatactataaaatgttcagacctctcaattccaaaattgacataatgtttcaaattttaaaaatatgaaatgctactcaagctcatagctgttacttatacttaattatgattaatgggagccagtcttctcgcttcctctagttctctctctcctcctgcgtgtaggggtgtgttagcggtgtgtgtgtgtgtgtgtgtgtgtgtgtgtgtgtgtgtgtggtctataaatgactgtggaaggttctatgtaaacactctttactcccaatcataaacaaatctatatggaaaatattacaaaaaatcaatttctagattacatttgtcacatggagaataaccaatttctagtcacttgtcatgggtgcataacctattaccagaactgattcacggtgaattgactagctatgtcaaaaggaagatctgcagtctacagagaaataatccatttagtgttcgaaattttacagtaaaggctgccaaaataacagaatttattacatatttttacaggtatattaagctataataaattcgtcattcctaaatcaagataattcatttatagcctattcaaaacttacttaaattaatcatgaaacattaaatgcaaaatgtttttttcttcacataatgtcacaaagtgacatgaactaatttgccaacatgttttcacagtattgttattctgacatatactaacatactaaccaaagattatcaccaataatgttggcattcatggctaaaggggcagtaataattttatatctacaaggactgaattaggcctctcagacaggaggcttgggaaaaatcatttttcaagttaagccaggtgagtctgtaatcaatgaccagagctctgctggaactgcagtgcctcgaaggaatcaagttaagttatgagctacagaagaaaatattgattcttgcttttacctgtttgtttcacaaactagaatagaaataaatattactaattttatgttgtaaatatttaatacgttttttcaatagtcactatagaatatgtaaggaaaccaaaacaaccacagttgaaagtcctatgacattagcaaagctcaggaacttggcattttcccagtgatgatgaataaaattaaaatactgatttcagtgacctgagtgtgactgtcatttgtctaaaatatacttattataatgtagtaagaatgcgcccgggaaaatacgttattcccccaaatctcattttttaaaaaattcattttataaaaaaatgaatcattagcaattgatgttctttccaaatattttagtgcccctaaagcctaaaagtgtatcctagaataaatttataccattcctcaaacttacatctatgaatattaaacatttattgcttgactataaaacttttctccagactatgtcagtatctccacttataaaaaattagggaaagattaaccaaatagaactgaagagaatagaatctacagtggggttgtaccgtaaacgcatataacttacacaacttcaattatgtaagttgagaagaaagcaataatgccaaagattggtctgccaatttgtatggcctggacagagtgtgaaatgggaagtgttaatccaccatgccctcataagcacaagtagccctgttgagggtgattatgatatttaaaggtatgtcttgtcatatatcacaacccttgaaaaaaagtcaagtatttctgatgctcaactagaaaaaactggctattgaacttactgagacatagtatattgatccccaatatgccctttttaagagtactttatgcttggtttttcacgttctgttaattctggaatctaacctctgaatacagtgcaatgttttcctgtggatcaatcatatcatgaaatgcctttcacagcaaagaaaaacaaaagtgtctttcagcataaaagacattgtggaaaagagaagaaatactaattttattatgtatctttcatgagaggtttcaggacagcttaaaatagtaaggaatctctgacatagcttcagaatgatagacaaacaagacagataaaattatttataagaatacaaaattaggccaggcgtggtggctcacgcctgtaatcccagcactttgggaggccaaggtgggtggatcatgaggtaaggagttcaagaccagcctggccaacatggtgaaaccctgtctctactaaaaatacaaaagtcagctgggcgtggcggcgcgtgcctgtaatcccagctactcgggagactgaggcgggagaatcgcttgatcccgggaggcggagccaagattgtgccattgcacttggcttgcagcgagccaagattgtgccattgcactccagcctgggcaacagagcgacagagcaagactctgtctcaagaaaaagaaaaagaatacaaaattataattgttactcagattccatctcaaagaaaatcttcatgccagcactttcttcaatatatctcagccacaaggcaaatatatgctgactaaactctactttcaaagtgtggttaagagataggtggtggttgagaaacctcctaaaaagatccatatacattggggtgaattcatctttgtccaaaaatgtaaccgttgtaccaaatgtaacctaatgtaacaatgagacactctgagccttgctggatggtttaactagacaggtgttctgggaagccacataatgacaaccaagtaaatgaggaaccaaactatgcactgtttgggagttttcagattttgtttttgtttttttcttctgttagggagcagaaccctctctaacagaattcttcactgaattccatcaaaccttttaatacagctacagcatatattttctgcctgacaactcaagtgagtaaacactaaacactcatttctatgtatttctttatttcctcatgaagaaataattattttcccgctttattttgatgtattttgtacatttgtatttagattttaacccatgtaaataaacatttatgatacaaccccactgtagattctatcctatctagttctatttggttactctttccctaattttttataagtggagagatactgacatagtctggagaattattgacttattatacacttcatttttaaagctaatgaaaacaataataattcagtacataaataataaaaggagttccaaagtttgtgcttcataggagaaagaccattctcaagccctactaatcaccttcacttacataaaatgaacatcatcattccaggatttaagctacatgtcccaagtcttctttccttctctagcactgacctcgcattaagatgattgagagtggaatatccattctttccaggaaaagatgaccctataatcagagatgtggtttgatcttctgcaatgccagcaaaacaatcagacttcatatcactccccaacatctgagtcataacattgagaatataacaaaaataacattgtgtgggaagtaccgagattcctgtctaggtacatctgtaccaggtacagtcaagctccttttcagtctctccttaggacctaatctcaccctcactcattttttacattatatctgtaacaagtaataaacatttcttctacactctgacttagagttattattcaaacttggtaggaaagaacttgagattgtgatcagagactttataattctgtgtgtgtgtctgtgtgtgtgtgtgcatgtgcgtgcacatgtacatgcatgtgtatcaaaaagagcttgggtttaatcgttcacattaattaccccacatctttactacccatgtttttcctcacatgtcctcaacttagcaaatgacactaaccaatagctcaaggtcaaaactctggagtcattcttgactcctcctcttcatcatctcctatatctaattaatgttcaagttttataaaattcacatttaaccttgtgatggttaattttatgtgtcaacttgactggccatagggtgcccagatactcagtcaaatattattctgggtgtttctgtgaagacattttagataagattaacatttaaagttatagactgagtaaagcagactcagtttataattttaaatgttaatcttatctaaaaaagattattccaaaaggatgtatggtttttctaaaatcagtccttcatagaaagcccaattctatttctacttttaaaagtaatttatttaatttctacatctctcaactgggaaacaataattccaaaataatctgatccttttttttttaaagaataaccatgaaatattcttccccaggttaacaaaactagtagcccacctgcaatattctcgatcacaagcactttgcaggctgcactatacagagctacttgggtagaaatattttccttttgttcctttaacagctttacccctttgacaagattttaaaacaatcaagtttaatttttccaatttcttcctcagtattactttggcaaaggtttgggcattaagtgaggtagaaatcaataattctccaagtaatgcttgccccagaaggtgtccacatgaaaataaataggtgtcctgagcataaaatattttttataaatacctatttgagggaaacaaaaatcttaatgcctcaagtatttaagactttttaaaaagtaaaagaaaaaaatacaattcctcatttaatggtggaataactacatctagtaagatttttttccttttccttctaaacatagaaaattaatacaagttgaaactaggctaatcatgaaaaagtgtaaattaaaaatgtacattaatttaaaaattcttctgaccacatgaattataaaagactgcaaatataagggaggaaaaaagaactgtgaaaattagactgctcactcatttgaaaccctttgataaaaagcactctatcttcttcggactgccacccctgtgagggaagggactgtgacattttgtattaatctctacatagcacttgcctctgtactatgcctgtgacagtatttcataataaaaaattttcagattttttcagtggaaccatgttcattaaataagaaactaacaagatgtgtttgtcatcccaattgccttggaacattaaccatttcatttcaaatgttaccactttgcttgctaaatttacttattcctctaagtttaaaagtatctcaaatcctgaaatgactttataatttagctgttaattttctctagccacttgcttttaagttaacaacaattctgacactatagcttattaaccacaaacagttatgaattaaatcaagtataatgtgcaattaaaactcagatgcagagtcaaataggatttccccacgtctacataagaagctttgaaatgcatacaataatgacacatgaatcattactattatagagatgagaaaaatgttgaatactaggattttacaatcaaacgagcacttgttatttactagatagtaaatttcaccatttacgtttctttacttccttatgccctgtatgaaaacacaatagaaacgaaagtgctaagtgaagtctttcagtattttaagaagtagaaaaccttggttgagacctcactccattcaaacatttagcaaacatccactgatcacaatctgtagtcaatcactgtgctactgaaatatgtggccaccatgattgtgacagttaaggaaccatctgtaaagaatgattcttgcctggtatttctcacttattctgaaaaataaatcttgactagaagagagttatctaggatccatatagaagcatacttagatattttctgatatataaaatgaaaaagagaatgtcttgcaaagaacagaaattaaaagcacatgaaggacactgtctttgaaatctaccccccttccaacatcatgcttgttcaagcacccatcaccattcctttaaagaaaccctcctttaaagaaacctcaggagggttcctgcctcagtgttgctcctctatgaacctccttccactactaagagtgccatctttctaaaacctgaccagaacatcacggtgccttaagccctcagtgtctctttcccatcaactagatgaaatccagtctccttggtttgtatgatgaggctctttgtgatctagatccacttatagggcaggcagggagaagccaccctctatgagggaggtgaggaaagagtaacccataacttttgctatctcaaaaggttgctgaccctaacaccatttaggcaaagctggtcaatggggagatattggatagactcacattagaagtcactctgagaaattactaagactccagatcataattcccaaaatttaaaattagataaaccttctgaaatggacctgtgacagataagagtgtaaatctgaagaaatatactcaatacaagggcctaacgatttgttgaagagatcttttcaatacattgtgtagcttatgttggaagcctttctaaattaatacattttagcatagttatgttgagcatggaaatgggaactagaacggtttataatcctgtgatctgagcttggagcatcaatgggtcctggcctggaacctgtcccacagcagaagatgaggacctggtagacgatatccaacacagcactacatacaaatggaagcactgacagtaatacagacattggataccctttcttcctctgcttgaattgcattaacttctggcattttggacaggcatcaagaaggtaagtcattcaagaaggtgaggaaatgaatcaaggatggcacaaagataaatatagggcatgcagagtctagagtaattgattcaaaaaattaaagaaacttggctccattttttaccttatcctgcttatacttgcaatacctctgggcattatttttcactcttcttcccttcctactttacgcttaccaactcagaactcagaatacactatgctctcccatgtctcctcgttatgctctttcctttgcctagaatgctctaggaagccttttctgagccaagagggttgggttaggtacctttctttggtgtttccattgtattctgaggatgtgtttatatgatacaatttattcaagcagcttatcctctatatgcctctatttcacttgtaaaatggagacaataatagcatatactccataggattgttttggttatcaagcaaggtaatatatgtgaaaccatttaaacaatatctggcacaaataaacaactatataagtaatagctattgtgttattattattattaaaacacattatgcttttatcaggtactatgtggcagtcattatgccgggtgttggtagaccattggtgaacaaaggaggcttggttcccactgcagtgatgctatataaaattactcattcttcagtatgtgtctccatgcctcccagtgtcagagatcaatctttgtcattttttgtgtgttatcagcacctagaagaggatttatcacagagctgggcatataagaggtgctcaaaaattatttaaaaataaccccagaaagtcctgagcagaggaaaaaaacatgtggcttgtagacatgcaacagcattaaactcactgaaattatgtgtggctgggacccaggttaaatgagaataagtgaaagaaaatgcagctgaagagaaggaagcctagatcacagtgggcctaatactatgagaaagagtttaacttagaatgggaattcagaaagcattttaagtaaggagtatcatactcatatttccattacagaaagaatggaaactgtgaaggccaatgattggaagaaactgagactagaggtagaaaataggatggtatttgcagtattctgcataagatgtgatgaaaatgtgatctaagatagcatcagtgtgaatagacagacaaggatagagcaaaattaagacaataggtctgataggccaataggatacagcatttgaagaaaagacagaaatctaatatgactcttatgtttctagcttgggtgctaaatacattgcaaagcattaagtgagatgataatatgagaataaggttaggattgatgcgacaaaatggagatcaactgctgaattttaggcatatggaggcatctatgagattaagtagaaatctaagagtcggtaggttatatgcacttaggtatcaagaaagaaaatggaaagtggtctttgctggacaactataaaacctggtgtaaattaagagatcgtgtttccagggagatgaaagagaaagttaatcatggattaaaaagtatatgtagatgtacaagaaatcgaggagatgtacaagaattgacgatcctttctagtaatattttagtcaagattatcaactcaaagtaaatgagagggatatgggttacgaattgaggtggttagtgaaggtttgagagaaatggaaaagaaggttatcaaggacacataaaatatattaggcaaggaaccaacctaagtgtccatcaacagacgaatggataaaaaaaatgtcgtatatatacacaatggaatattattcagccataaaggaaaatcatgtcattcacagtaacatgtatggaacttgaggtcattatgttaagtgaaataagccaggcacagaaagacaaatgccacacgttcccactcatatgtgagagctaaaaaacttgatctcagggacatagaaaaaaggaccatagataccagagactgggacgggtgagtgggggtgagggggtatgaagagaggttggttgtgggcacacacatacagttagatagaaaaaatatgttctaatatttgatagcagactacagtgactatacttaacaacaatattatgtatattttaaagtaactagaagagaggacttgaaatgataccaacacataaaaatgataaacactcaggtgatggagacctcaaataccctaacttgatcatgacacattttatgaatgtagcaaaaactcatatgtactccgtaaataggtgaaacattgtatgtcaataaaagagaaaaaattaaaaagcaaggaaaggatatatatatgcttgatacctaaatgcatagtgttctatagccttagctagagcatattgcctgatatatatatatatatatttatacacacacacacacaatggtagatacatacatacatacatatatatatatacacacacacacacacacacacacaatggtagatatatatatagcaacaatagtagagaaacacagaaggtaaatggttggactgatttaaagctgaagctttacaaagtcgtggtgaagaaatacaaaggagcaaaggaatggagggagctgcatgcctagggagcatccattgctgagaattatgccacatagagaaaaaatgtagttagaagaagggattaacaggcttaagggaaaaaaatgaaagaatcaggagattaaaactctaattaatttgaagagtaaatgcagcagatcaactcaaagaataagaaggtacgtcttggagtttaagatttcagagactgaaaattctaatacatggaaaagacctaacatgtaaccatatgaaggagagctgaaacttgcatttttgagcatctgtaggcattgtgcttggcattttacatatgccatctcatttgataatgattttctttatttagagagacaaggtcttgctatattgcccagaccggtctcaaactactggactcaagtgatactcttgcctcaaccttctgagttgctgagattacaggtgtgagccactacactcagcttgattcattatttttatagatgaaaagactaagtatgagtcaagttacatgatttgcccaatgttacacagttagtcagtagccgaactgggatataaactctagcctgtgtaattccaaagcatatactctttctagaataacacaccaactgctcaatgtgagaaggttgtcagggaaaaatggagcaaagattacttgaagtaagtaaattaaagaattctgagactagatggtggatggggtgattcaggtagacacagaagtcattcacctgacagctaaacttgaatggaacaatctattagttaattccataatcattgaaaaatgtagagaagtgataacgagactgataaatggagtatcccatgatgagctctgctacaggttggcaccatgatgggtgaagaacacaaaaaaaggaatgtatattactgcagcatatcatgaatgaatttcctaataaaataatacgatggatgctagagattttatggggccactctcacaaaccctctcattaaaagccaagttctgggaaactggagctggtggattcctcaattcctgcttgttacattgaccctgaactttgagcacccatcaagagagcaaggagactggaaatctgcatccattcagttttattaagcttgtatcctagatatctgcatccattcagttttatctagcttggatcctagcttgcactctttgtttgctagtttagtgataggacaaattaaaagcaactttaaactaaggctgagtcatcatcctacagtcttctaacctctaataactgctgaggagtggttagttcaggatatgggatatccagaagttatgagttccaaagaaggagggatttttatatgacagagaggagtcactctgtagacacagaagtaaaaggcaaggtgagtgattgcccactaccaccgctgagacccatgattcctagaaggtgggaacataggcagacaccattccatatggtggcaggatagagctatcttttaattaatagaaaaaagatagaggggtaatgttccttaaggtgttctggtttgttttcaagttgatatggttctggagaattatgggaagggttgggagatgaaaaacaaagggaggaaatatctagagatacagagaatgaaatagtataatgataagttcattaatgaatatgggtgactcctggagcttgtattttgttaggttgacacagatggcagggaataaaagaatggtggtactaatttcatgtgtttccttgtatctctgacataacaaaaatatagtctttcagctgagcataatccccgcttcacaatgagagtaaatcttttgtgtcacaacagacctgaccagatatatgcagtaacaacaatggacatacaggtaagtcacaatggctcatgcctgcaatcccagtactttgggagaccaaggttgaaaggattgtttcaaggccagcctgggcaaaacagtgagacctcatctctactaaaaaattaaaataaaataaaataattaaaggggtatggtggtacatgcctgtagtcccagctactcaggaggctgaggcaggaggattacttgagcccaggaattcaaggttgcagtgaactatgattgcaccactgcactccagcctggatgacagagtgagatcatgtgtcaaaaaaacaaaaacaaaaaaaccaatggatgtacatgttttggaagggtaagatgatcatatatgccctccacataccaacaccaaaagcattgatttaaatctcacactagtctcaatctcacaaatatctcagttttccttataaataataaaaaaattaactcattcaaatttcttttgacccaattatatgtttctactttactatgtatttgcataacaagtttcaagaaccacttaagaagcaaagcagtttatctttcttcttgaatcatgaatgcctcttttaaagttcacataatggttatagaatattctagtattcataaacaagatttggagaacaaggtcattttaacttttcctttattttttatttagccttcaatcatattcctttgaagcttttaacttttatgctaaacaacactgctgttctgatttgagagggtattttttgtttggttatctgttcatctgggtttttttgtttggttggtttttttaccagtcattacatattccattatcccttatattttctatttttagggtaatttctattttccttataccactattatataattatattctctcatatggtataaagatttatgtgtgtgcttccaaagctataaatcctaaaaagcagagagtgttgctgctacctttatttattccgctttcaggaaataaacaatagttacactatatttttaattaaatttctatgtaattagaatttttagaaagttaatttctccttagaaagtaaatttccaaaggagaagcaggtaaacgatagtgcacacaagagaaaataaaagaatgattgcaatattctaattacaagaacactagaaaaagagaaagagagaaggagagagagagagacacagagagagaagtttgcattttctatctcccaccagcttctggccatattttcaactagtattcctacattaaacaaaatcaaggaaaaatactctagaaaagtctttcaatttgaaggtaacataagcttcctccaactatactgaacttcctcaaaaaagaaacttgaatctatgaacccagcacaagaaatcttgccagggtgagaatatagaaagaaatcatcctagcagggggaaggaagagtaaaagccaaattgccttaagtatttggatgtaaataccaaaattacagggacaacatctctcattcagagaagaaagaagagaagatgatgagtattagttcatttttagttgagagagtagggggcatataaaaaggaccaggcaagaagtgactccaacctaaactccaacatcagagtagaaacagtcttcccaccatttcgtacttgctcctctgggtagctgtggctgaagatcaagggttggatgaggagaggcaggaggacagacccgaaacattcagaaagacagatgcccaggtcaacaggcctacagcagtaacagtaagtgttgcatgaatggcatttggcagagatgatcgctctgagggttaccacaagtctacagatagatggaaaagtatgttagctattgtaataaaagtttatatattgtttatatattgtttttgtcataagaaaatgattttgttgcattttctgtattaaaaaaatatcaaacatcttggattgctcttacacagttccgcaaatagattgagcctatcatgttttaattttgttaattttagtaatcttaactattaacctttacacttggaagcatgatttgtcatctaacaaagtgttttcctatagttactcaatttcatatcagaggcacaagataaggttgagaaattctgctcctatatatgcaagtcagaaaaagttttagttttgtaacaaatcatagcacaaaacccatttgaccctagccacctcaaaattgtctcattctcacaaccaattttgaagacacacatacatcttttctctccacataatgttcctttgtcatagccactgaatagcatgaactaacagcggtcctgaaattgtgtaggcttggtaaagccacctgcagaggaataaatatgtttaattaaatccttttaaaaaaagagtttaaacagtattattccatcttccaccctagccctgccaatgtagtgattatatgtctattaaaaaggagggcttgtatgagttatcatgacatgcatcactagattgtagataatagaatttagtatgtaatttattttatatatttatttaaatatataataaaatataatcccagaatacaaggtcctaaggttcaagcttatgcacaaaattgtgtcctttcttgggatatgccatcctccaggcatggacatttgcttacaaaataaatattgtatattataacaggaagagacttcaaaattcatgattgtttattttttccctttcagatgcacctccaagaagaaacattagatttatatatgtatgggtgtgagtgtgtgtgtgtgaaatctggaatggaagtaaaactgttaaaatccatgagaagtcttgaattaatgaagattcagaattaggaaacacagtacacatgtcccataaacaaagaagccagcagtggaccccttcaggtagtcatcaaagaacaacataagtggatatcagaaataaactttcccaggatttaacaaaaataacatttctcatttataaatcatactgttcagtagatcataatctgtagcaaactaaataagtagatccctgtcctctgaaacagaattgaaactgctgcctgagcatctaacttatctatactgctctatcaaatatttcttaatcagttttagcatttgtttattttctctcttctgaaacaatggctaataagtgcccagcactgtccctgacacaactcacatacgtgctcattaaaataaagctatttaaagtagacattgtcttgtcgtacagcactcctcttctaaaaattattcctttcaaccagagggttcaaatggcagctgccagcttctcagatgatttgcccataaatgagcacccaacccaactttctgggttttttgaaaaaaaatagtggccttattgttattgttttgtatgtatatcttagtgtccaccagcatccatgcattttcctctgtgggatatcctagagattttacagaaattaaatttcctaagtcatccatctataggggtagggacagtggacagggcactttaaaattatttttcttggaaaacagaaatgagcacggatcttagaaagctcttatatatttagcagatgtaaatctgtttaatataaatacaaaataaaatcatactcttaaagattttcaggtacaataaaaaagctacagtgtgaaaataaaagatacatatgtgatttttaaatttgacattatactttttcacaatatttcaaattcagattaaaacatttaattgattttatttatttattgtgatggagtctcgctctgtcgcccagactggagtgcagtggtgtgatctcagctcactgcaacctccgcctcccaggttcaagtgcttctcctgcttcagcctcccgaatagctaggactacaggcacatgccaccacgcccggctaatttttttttttttttttttttgtatttgtagtacagacagggtttcactgtgttagccaggatggtctcgctttcctgacctcatgatccgctcgcctcagcctcccaaagtgctgggaccacaggcacgagccaccatacccggcctatttttattttttaagatggagttttaagatggagttactgcaacctctccccttcccggattcaagcaattctcctgcctcagcctcctgagtagctgggattacaggtgaccaccaccacacccagctaatttttgtatttttagtagagacagggtttcaccctgttaacctggctggtctcgaactcctggcctcaggtgatttgcccgcctcagcctcccaaagtgctggaattacaggtgtgagccactgcgcccaacctaaaaaatgtaatagatttaaaagccaaatataaatccatagtttagtgaatattgaaataaggctataaataattttataatcagtgtgtttataaaacagcgtatcattatggtacagaatttaaaagttcagaaaaaaatgtaatgcttaaacttttgtcccaatagaaagcttccattaactcaaagggaaatctctgagaagtattaatgtttcctaatgaacattatggaatttctaagcctacattagacacttgcaactttgatctgtctatagagtgctttaattcttcaagcaattttttagaagtctccaagtgaaaatatattaggaaaatctcttactaaagaaatgcagtaggattgatgggatgttttatttcttacctttgaaaacatcccttatttctagcctaatatatacagacaacacatatctacatttattcattcaaattgctattgaaatagccataaaaagaaaatatcttaaaattggtaagtcatcacttctttataagatggttttatttgtaggtcaattttataaaattctctttttgagtgttatggttaataacatatttaaagatttaaatccatctgagagtttaaacaaattgccactatttatgattattttgtattagaatagcaaaatgggctgcattaatagtccagctctaacacagaagaagcattcgatttatattaataattacatataactggtttataaattatttgcatacatcccagatatatatacatgactgaaatttaaaataatttttttaaaaataaaaagacttctgaacccagatctactaattacatgtacaaagagagatgccctataagttggaagaaaaacaagtataatttaaaagacagctaaaatgtatgaaaagcaaacacgtttatttttaaacttcaatatggcccaataacaaagactgtgatattagtgaaaatggtaaaacaaagtcctttttggtactataaatactaatattctaaggacaggtcaagtcctatttggttttatgtgccacgtgaagggggaaataccagttcttttgttattccttttcctggtgagagagggccttcaaacggccaccacagtagcctgcatgaacagtgctttcttacaagacagcattgctacattacattgcatctttaggcctatttaatgggtgaggtgttgatcatatgccaagaaagacataaagagaatgaggaatgtacatagaaatgctattaaaatgatcccatgcttgagaagagaatcaagagctaagaaattaagaaaaacagtttctgctttgaaggagcttaaaataggacatcacctcaatgtagaggcatgctcccttgccgtctcaaagataatatttggtgatcagagccagaaaaaggaatctaaactacttgtttttgtagttagctctgtcatttaaccatagtctaattatccagctctatatattaccataaaaaaatctttaaatgtacaccatgtaacaacacttatcaacctaagaggaatgccaattaatgcttgcaaaggcactctaagattttttttttacaagcaagtgctatataacaacaaaatatctattactattctatctttccaaccaaagcaagttttgtcctcctaggattgctgggagcaaaataaacccgacgtcattctcctaagcccaattggcagcccagctgtgccattatccccgggaagtgtggtcatgtacggtaatacccgcattatgtgacaatgaccaagtcaaaattacccccttggaatagagttcagcctctgaaaatgtagaactgagaagacatgctgggttcaacagagtagccatagtgagggccatttttgtttgataatggccctaaattactgatatcaacttggcgtctaagactcagggcaaaagcagctattttctttctatggaacattcaccaaaaatataaatgcagctgccttagtcttgattttcttccctgtttttatgggatatataaggtcacgactataaatatagataaaatttatataaaacaccaaattaactggaaagcattttatatattctaaaatatatccagggtgtttttttttcttatttatagattttagaggcacataaaacctaggccccaagccaatttacagtttaataaacagctgcatagttgtgaattttctggtataaaatataccaaaatgataagaggctggtaattcagtgcattacctacagcaatagcttgatgcaatttttccatatgcttgatttataaaaacaaactcattttctggaaatggaagattaatcttcttcaacaaaattttctttatgaaaatgaaaaaaagtgttttctataccaagaaaaaataacatatattaggacgtagtcgggggcaggtgagaggaaaaaaaagagatattattggagaacaaaaactatatccataatccctttctcagataactgcttattgacttttttagaaagtagaacatagtcaaggttagtaaaaggtatattctcttctcctccacagttctgtctccctgggtttccttccaaaaaaaaaatttttttaatgtgtattagtacatactcacatgaaaaatacatgtgtgtatatatcaacttttgttttttcctattacaatgagtgaacctgctgggttaaaaaatacaggcattcctcagagatactgcaggtttcgtatcagaccatcacaataaagcaaatatcacaataaagcaagtcacatggatttttttggtttcccagtgcatgtaaaaattacatttactctatattactgtagcctattaagtgtgcggagcattatgctaaaaaaaatgtacgtaccttattttaaaaatattgctaaaggctgggcgcagtggctcacacctgtaatcccagcactttgggaggccgaggcgagtggatcacaaggtcaggagatcaagaccatcttggccaacacggtgaaaccccgcctctagtaagatacaaaaaattagccaggcgtggtggcatgtgcctgtaatcccagttacttgggaggctgaggcaggggaatcgcttgaacccgggaggcagaggttgtagtaagctgagatcgtgccactgcactccagcctggagacagagcaagactctgtctcaaatgtatatgtatctctctctacaaaatgctaaaaatcatctgagcctttagtgagttgaaatctttttgatggtggcggttcttgccttgatgttaatggttgctgactgaccaggatggtggttgctgaaggttaggggtggctgtggcaatttttgaaaatgaaacaacaatggagtttgctgcatcgattgactctttctttcacaaaagatttatctgggccaggcgcggtggctcatgcctgtaatcccagcactttgagtcaaaggccaaggcaggtggatcacctgaggtcaggagttcaaaaccagccttgccaacatggcaaaacaccatctaagccaagcgtggtggcgggcgactgtaatcccagctactcgagaggctgggacagaagaattgtttgaacccagaaggtggaggttgtagtgagccgaaatcacgccactcactacactccagcctgggtgactgagcaaggctctgtcttaaaaaaaaaaaaaaaaaaaaaattatctgtagtatgtgaggctgtttgacagtgtttcactcacagtagcacttctttcaaaattgtagtcaatcctctcaaaccctgccactgttttttcaactaagtttatggaatattctaaatcctttgttgtcatttaaccatgttcacagcatcttcactgggaatagagttcatctcaagaaaccactttctcatccatagaagccacttctaatccacgataactacgtcatgaaaatgcagcaatttggtcccatcttcaggctccatttctaactcagttatcttgctattcctcccctgctttaatttgtggtatcttcctccactgaagtcttgaaaccctcaaagtaactcatgagggttggaatcaacttcttccaaactcctgataatgttgatattttgacctccttccatgaatcacaaatgttcttagtggcatcaaaaatggtgaattatttccaaaagattttcaatttactttgcccagatctatcagaggaatcaccatctacagcgagtatcgccttacaaaatgtatttcttaaaaaataagacttgaaacttggaattattccttgacccatgggctatagaatggatgttgtgttagaaagcatgaaaactccatttatttctttgtgcatctccatcagagctcttgggtgaccaggtgcattgtcaatgagcaatattttgaaaggaatcttttgttctgagcaggtttcaacgttgggtttaaaatatttagtacaacatgcagtaaacagacacgctgccatctaggctttgttgtttcatttatagaggacagtgtgggtttagcataattcaagggccccagaattttcagaagagttaatgagcattggtttcaagttaaagtcaccagctacattagcatctaacaaaagagttagcctgtcctttggagctttgataggcattgacttctcctctctagttatgaaagtcctagatgacatcttcttccaacagaagactgttttatctacattgaaaatctgtagtttagtgtagccaccttcatcaatgatcttatctacatcttctaaataacttactacagcttttacatcagtacttgctggtttaccctacacttttatgttatagagctgacttatttccttacatgaaacaaacactgctggcttcagacttttcttgggcagcttccttatctctctcagtcttcacaaaattgaagagggttaggttctttctctggattaggctttgtggctggtttgatcttctatccagaccactaaaaccttacatcagcaataaagctgttttgttttttaatcatttgcatgttcactggaatagcacttttaatttctttcaagaacttttcctttgcattcacaaattagctagctttttggtataagaggcctagtttttggcctgcgtaagctttcaacatgccttcctaactaagcttaagcatttctagcttttgatttaaagagacgtgcggctcttcctttcattgaatacttagagggcactgtagggttattacttggcctaatttcaatattgttgtttcacagggaataagcaggcccaaggagaaggagaaagctggaggaatggctgttctctggagcagtcagaacacacacaacatttatcaattaagtttactgtcccccatgggcatgttccatggtgcgccaaaataattacaataataacatcagagatcactggtcacagaacaccttaacatatataatactaataaaggttaaaatattctgataattgccaaagcgtaacacagaaacatgaaatgagtacatgctgtcagaaaaatggcactggcagactttttccctattcctgaatcagttaacccaaaagagttgtttgatggggtagtaggtgtggaaaccttggtaataaaggaactaagctgacattattattttttaaatttttttagttttttttttttttgatggagtctcagtttgtcacccaggctgaagtgcagtggcgcaatctcgactcactgcaaccttcgcctcctgggttcaagtgactcttctgcctcagcctcctgagtaactgggactacacgtgcacaccaccatgcctggctaatttttgtatttttagtagagacggggtttcaccatattggccaggctgttctagaactcctgacctcgtgatccacctgccttggcctcccaaagtgctgggattacaggcatgagccactgcgcccggcctgatattattttttcatacggtatctattataaatatatatttgaaatatttttcactattatcctaagctaataataataggaacaaagttaccacatgtgcaaaaagctagatgtttagtcagcaaatatctctaatatttatttgcagttcttggttattaccatattgaggatttattctaccttgaaggttaggaaaaatgccacttcagagaaggtttgctaggagaaaaaatttcttccttggcctaatatatttcaattgttgtcaggtgttccaagtgtgaattactgggtattgtactgaatcatcttctatggatccatgtactgcaccttccaaccaacacctctaccccagcacccctccacacacacacactcatcagatactttcttgaaatttgcattaaaataatgttgaaatgacttggctcaaaagcattaagtgaagaacaagacttagaaaaagcaaacctttcattattcttctctgcattaagtgcctagctctctgtgaattgcaacatttttaagaacatatccatagtttgataacctatagatacatagaaattgtctaagtgctaattttccaaactaactgagaatattttaagtgtctatctatatacctctgcctctaggagagtagcaaagagattcaaatatgagcatactcgtattctccttgcttcaggaatctagacgaacatttttacaaaaatatatacacaacactgttcatgcatattatagccacacatattatagcactcacataaacccatctcagagaataaatgaaattgttcaaaaaagagagccagttagtaatcatttgggactctcaattatgggcaaataacgttcattctgtataaaggtaagtacaggattggtgggatttaagagagatgcttgcataggcatctcttaggcaatctgggtcagcttaggcaatctaggtcatttcccaaaatattaaagaaaaaacatccagaaatttctggaaacatcatgtactataatttatatacagtcatgcatggcataacagtgttttagtcaacaatggaccacatatacaactctggttccatagattataataacatttttactgggcctatatctagacatataaacagttaacattatgttaccattgcctacagtatctagtacagtaacatgctgtacagatttatagcctaggcccaataggctgtaccatatagcctaggtgtgcagtagtaggctataccatgcaggtttgtgtaagtcccctctataatgttcacacaatgacaaaattgccaaaggacacttttctcaaaacatccccactgttaagcaacacatgactatacatccacctctttctacatttaaatctttctccttgctaagtttaaaaaatcataaattgaccctgttcaaattgcaatttgtagtcttttaaatgaatacaacttaagtagattagaatgaatgcagcactgagaggcaaaatagcctgaagttttaagttctggaccagacaacttggtgaacttttacaagttatttaacctctgtgcccattttctcatctaaaagcctgggataataataacacctatctcacagaatggttatgagaattaaatgatgtataaagtttctaaaacagtaactggtactgagtaaatattctataagtgtttatcaaccacataaaataaatatttcactaaagcacaaaatgtattcttttcttccagggtcaaaatacactaatagctcttcaaatagcctgctagatctaacagtaattgatgaacacctttaagaataaactgagataaatgagaaaagcaagatatttttgtattgcaatattcagattgtttcctggtcttcagtacacgtgtaaactttcaaatcaaaatagtacattttacactacaattgtatttgtcttctgttgttttgctcttcttttctcataatcaggctcttttttttctagtcccaggaaattttggttcaacattgaactcaaaattacaaaaatgtgaaaaaaatgtgtaaacattactttcatagcagtttgctaatattgaagctgtatagattgaacatttagacattatttgcatttcttcaaagcctagtatcttattaggtaagcatcaaaaatatatacaagaattactcttgtttcttcaataacttcagaataaaagcagaaattaatgggatgggtgggccacatggttatcaccaggaagttattaggacctaacagcatctgaagctggcccttatgatgggaagagaaatggaaaggattcaacaacaactaaaatgtctgttccattaattatcacttgcttataaaagctatatatgaactagaaaaataaagaagatcccactggggaaaaattggatttaggacatacatacacacaaaaacccaaaaatacattgttcccagaacaaataaactgccattctcattgcatacagccatcctcctaaaaccaaatccagccttaggaaaaggaaatatatttcctgaatagccagcaacctccttgaggtcctcttgaatgaactaatatacttctccatgtgtgcccaagccagtgcagaaggaaaaggctgactctctgtcaccagtgtctcgtagagggaagtaatatgatcatctaggtacctcacataaattagaacagatggaagtatgagtttctctttaccagatcatggggttaggatggaatgactttgattctcccaatttaaatcctagcttgcctgaaaatgcaggcttgtccttactgtaattccttcttcagaaaaatatctttaatacccaataagcatagagaaatgaaaatactcagataagatgcatttactgacaaacatatcacatcaaaatttcctcatccagtgcactaccctcttcttacatgtgggagcaaatgtgacccaaggtgaaatctacataaagatgaaagtgaaaacacatagcaatttataggtaatttgtaataaagcttgcagtaagcattactgccaagaaatgcagtaaatccacaataggacttctatcatagctgtaagaactgggtttgtgagagtttatacatttaagctaaatttctcatatttcccattttggctcctcttatcttcagcatattaaataatgaaaaataaagcttaaatctaatcttcaaagtataaattgtcttatggctaaattcaacatccaaattcagccctccactgtgaccattgttaacaacactcaggtaatgtgaaaggcaagaaaagcaggggcctgacataaaatatatttttcaaagtaaacgcccaacataaaatttatccaatattcccagtttactctcaggcagtcatgatgcttacttattttacacattaatatagcttgtgaacatcactcatctactactactactaggtactagggacaatcatggcttggaaaatgcaattcttgtcttcttcaactataagtaaggggacagtttgagcagaaagtcaaaagaggccgggtgcagtggctcacggctgtaatcccagcactttgggaggccgaggcgggcagatcatgaggtcaggagattgagaccatcctggctaacacggtgaaaccccgtctctactaaaaatacaaaaaattagcccagcgtggtgacaggcgcctgtagtcccagcttctcgggaggctgaggcaggaaaatggcgtgaacccgggaggcggagcttgcagtgagccgagattgcgccactgcactccagcctgggcaacagagatagactccgtctcaaaaaacaaaaagaaagtcaaaagaaaggtggtaatatgaaacttctaaactaagagttgatttcctgatttgcatgtgaacatggtaagtagcttgtccaacatcacagagtaaatgctagagtctagaagttctctgagaacaccaaataaataaaagtatataaaatgcatagctcagtgcctggtccatagtcaatattcaaagaatgcagctcctgcgccgatcaaactctcttagtccaatttgagtgtaatacactatcaatcagcataccctggcattttgataatgtttttcgagtttgagaattataaaacaacaaataatgaggcattcttatttagaattttaataaataattcacactattcagaaattttacaaatcagaagatttcaatgcacatttattgaaaatcacttccctaaatcaaattatctaaaagagcttaccaaaaccactgagtatagaaaggttataaaagatcgatttacttaaggtcaattatgcatatgaataatttatctccagtgtttaatgttacttaatctaaggataaaaattatttttaattattaaacttggaatatcaagcaatctctctttaataagctaaacttattaatgcttaaatgtgtatttggaaattccatggaattttgatttgcaaacatcacatataaggtacttcaatatctacttttaatttgtctgaaatgaattaccttgaatatacttaagacatatgctgtatgtaggaaaaaaataaatatgaatgaatcagcatgtacagaaacactaattttaatcagaatatgactttattttggccatttgcttaaataccaagtagtttatttgtttgaggaacaaaatattcatctccactttaatgtaaatgcccttcattccacaaagatcatgttagtaacattcttgcagattctccaacggagaattaatccaattataatgccatttcaaatttaaggttctaaaccagaaaatatagtcaaaaagaatcacaacaatatcagagttgagatcattagaagtcttcaacagctgtaagaacattctcttttcaatgatgctgtataatacaaaacttgtgagagtttactagcccaaagtcagtgataaatagggtaataagacatggacagattccattatctgtatgcactcatcatggggagatgtaaggaggccaacaacacatcatgtttaacagatttatcagccttattttgagatttggtatgaggggaagaattttttaaaagatttacttggaagacttcattctcaatctacacggctatcctttcttttaagttcataaatggatagtaagaggtatgtccccaccctgagttccagctctacacacatcttcaaaaaactcttcttcagtagataatggaattttttcccatgatgcacagatggctaattcccaaggctgtcttcacacagatactttttcttcatttcctcctaaaactaaaaattactttaaaaattttttttcaagaccatgtttccaatagtgcttgtttttcttataaggtgagaagaaaggccttcctttggctatctccctcaaaataattcaattaggaatacagaacattaaagagaatccttaaatgtcaatatgcctttttgtttaattttcatctgtatgtagaaccacgagaagtatgccatcaaattttccagcactgtgcaaacttacagtgaataaaaaaaaataaggtaatgtattttattcctttattatttcaaaaagcaagacaacgagttaacaataacatgacaccaagtatcatatggaaaagtggaaaagtgcccaatcactttaattaggtttataaacaaaaatacaagacatcaagtcagataatcaggaacaaaacaagcttcatctccctcatatgacctcagaataatcagtaatattgtgtatcccttttcaccctggaaaataagtccttcaaattccctttctatggcttatataaagcctgatgtgctccccaaggtttctgtaaatcaccataggcttacatgctcagggagctaagctgcagcttctatcaaagcagttcagtttacggagtatcacagcattctgcagagcagcatccatatgtacaagtcagctcttttccatgactcacacaaaataaaacttggtgttcgaagttttgaggaaggaaatatacatgatagaatgcaaacttaagattatccattaaaaactcttgttcttataggccactccagccattcccctaggggataacatgctgtgtcatcccctttctgttgttcctttcttctccagtttccccctattctgccctccccaaaagaaagtctgaagccactagttgacaattgttgttttccttgatgtggtctttaatttagctccatattgtaagagtttataatctaaatcagtgtttgtcaaactttctttttagcagaggaaccttttgaaaagtgaaattgtacaccaaactctaacatatgactaagagagtagagttgctgtttgaagtggaggcagggagtgaacttggagacttcccttcagcctcatcatctacctctcttgtctaatggctcccagtcactcactgaaagatcaggtcttcatatcatcaagtttgaaaaatattgaactacatacagaataagaagaaactgccaaattaggtacttttttgtatttaagaaataagagaagatgaatcaaagttgacctaaaaattatgtgcccgttacactgggagaaagataacaccattgatagaaatcaataaattgggaaaagcatacattacgtttagtgtcataattagtaatctataaatgtggatttatttcataatgcaattagatgaaatgcatataaagatggtgacttatgaaatgacaaagaattctaaagcttatcataaaacttaagcattttcaaatgaataataaatggccatattcatcaatgcctcccagtattataattacacatttttaattaaatctctgttgatataggataagctaaattaaatttcaacatctaactataaagaaagggactatttataattacccacaaaatagcttctacttgttatactttgccaaagagaatgattatactttttcctatctttcagtaaacctttatatagcttatagctgtctttccagaaggaatctaagttttttataaattgaagacaactaacttatatgagaaagagaatgaaactaacgtttattacatgcctaccataggcgaggcactgtgctgatgcttttatattaccagttttcaattcacactacatactaaaatcgcccagcaatcttttttttttttctgagacagggtctttccctgttgcccaggatggagtatagtggtgtgatatcagctcactgcaacctctgcctcccagattcaagcgattctcctgcctcagcctcccgagtagctgggattacaggtgcccaccaccacacccagctaatttttgcatttttagtagagacggggtttcaccatattggccaggttggtctcgaactccagatctcaggtgatccacccaccttgacctcccaaagtgctgggattacaggcgtgagccaccacgcctagccaggaatctttttacaaaacattttgattcatgagtgtatcctccagagattcagatttaattggtcaaaggtgggggccttcacttgagaaatttttaagcctctcatgtgataataatgtgcagccaggattgaaaatcacaattttatatactttatctcatgtcatcatcaaaacaatctgaccaggtaattatattattccttttttcagataagaaactggaatttcagaaaggttgtgaaatttgccccagggcatagagaaggtatcagagttagaatttaaattcagagttctccgacagcagcgatctttctaacctccactttgtcaaattcaaaacaccagaattattagtgtgaatttagagtagatttctatattttattttactcctggcttcaagaggtggtggagtaaagtatgttttacgttaatttgctagcaaaacacaatattctttattgaactaattaagctgttactcaaaatgaagttgctttgtattttataacataaagtatggaatattttctccctttcaaaatgttcctttttttcataggtacactatttaaaaattattgattttagagtttcttatcagagataagaaggaaaatgcaatgtaaaagtattcaaggaacaaaaagtagattatatttgccaaccattttattttgtcaaccacctttaagggagaaaggtaatttcttataaaatataattatttgttaaacagcagccaaaattaaacagaattctcaattaaaaaaaactttgttttacaaactatatccaatgtataagtattttaaaatataaatacatttcaatattttatttaaactttaaacaagcctatacatattataagttaatttaggaatgttttataacttttacgataagagtaaaatgttagcatgtaatttcaactgtcaagctgaaaataaatatatgaataaccttcattctattacttttcatcttaaaatatatcgttaatgggcttttttttaagtcataccaaaggtgatattaccaactccctaaggacaacgaattctgctaaactagaattcatatttcagagaggagatggataacatctcacaattcaacttcagcaggagtcattaagtcagacacctatgtgagggctgtatttctcattgaattacaaatccaataagagctttgcctttgaattactagcactacaaagattaaatcaatatactgtgaaaaaaggaaaaacccttggatgcttgaagattagaataaaacgcatgaattttttagctcaaatggacaaccatagaagtcattaatcctactttttcattatacaaacccgctacacggcttttgcagaggtccccctttcattcttcacccctccaatcctatagcgactgcactcagtttaatgtcccaaaatgttcatatgagctgtatggcccagcatgacccctaccttgcctacctgcctcccagtctcatctaacactatatgccccctcaatctctgaactgaagccactcagttctttccagaattcacgggcactgagctcttttccccaggaggatgtctgcataaactgttatctttttaggaatgtgttttttcatcttcacctcctacttctcctggataacatctaccttatccttttggcctctaacatagagaggttttctacatcacctctttccctttaaattcaaattgtttcttttttttagcaccctgtatatttctttcatttctactccattcgtaattacgtattaatttagaggactactgtttatgtctatgttaccagtaggctgttggcttcccaagaacaagaagcatgtctctttagttcattaatatatcctcagcaccttttacaatgccaggtgcataacagaagctcaataaatatttatcaaatgaatgaattaactggatactaaggaagagaggtaaagagcagaagctctagagtcaggctgccttggtgccatcattaattcaactacaaagtggttgttaattcttttacctttaaagttagcattttaactagctacttagagaattgttgtaatgattacatgacaataagtaaattatctagtacaggccaaagaaatgttaagttatcattaataattaccaagatataatgtttcattaatgtattatttaaaatatacatgtatatactatgtatatgtgtttgtattaatatatgtgtgtgtgtgtgtgtgtgttgtacattcattcttcttttagttaccaaataatcctattatgtacattgggatatgttgtttattcattttacagatgaaaatacagattgtgttataattgttttatccatgattggcttccatcttctttatcagtactttttttctaagtttttctagcataaagtaaaacttactaagtttggcatcctgcattggtggtataatggttagcatagctgccttccaaagtttgtcatccctaggtcatttgttactgcgttcagaagtgttcccttctcttcaatttttagaagagcttgagaaggattggtattaattcttctttaagtatctagtagaattcaccagagaagctatctgatcttgggcttttctttgttgggaagtttttgattactgattcaatctctatactagttacatataatgatcagattttttatttgttcatgattcattcttggctaagttgtatgtttctagacattcagccatttcttctgggttatccaatttgttagtgtagaattgttcacagtagtcttttaagatcctttctatttctgttgtatcagctgtcatgtctactctgtcatttataattttatttgagtctttttttctcttacttttgctagtggcttcccaattttgtatcttttcaaaaaaaccatctcttagtttcaatgatttttttctattatttttctatgttctcttgtatttatttttgctctaatctttaccatttctttccttctactaactttgggcttaatttgttcttctttttctacttatttgagatgcaaagttagattatttacttaaaatatttcttctttttgaatgtcaacagtcatggaaacttccctcttagtactggttttgctgcattccatgagcttggtgtgctttgttttcaatttcattagtctcaaaatattttcaattgctttagatttattctttaacttgttgtttatgcaagagtatattgtttaatttcaacatacttgtgaattttccagtttttcttctgctactaatatttaatatttagtttcattcaactgtggtcagaaaaaaaaaatacttggtaagatttcaatctccgtaaatttgttgatacttgttttgtaacctaacatgtagtctatcctggataatattctgtgtgcatttgagaagaatgtatattctgttgtttttgatggaatgttctgtccatgtttttttagttgcattaagtctaaagtattgctcaagtctgctgcttccttattgatattttgtctgtatgttctactcatactgaaagtaggatagtaaaatatcctactgttatattgctatctagcttttccttcagttctgttaatatttgctttacatacttaggtgctctgatgttgggtacatatatttatagttgctgtatcttcctaatgaatcaacccttttatcactatataatgtcctcctttctctcttagtacagtttttgacttctgtaaaacatagtactataagtcctagttagagcaattaggcaagaaaaagaaatacatagcatccaaatttaaaaggaagaagttaaattgtctctgaagatgacataatcttacatgaaggaaattataaagactacacacatgcaaacacacacacacacaaatacaccaatgttagaaccaacaaaacgtatcagtaaagttgcagagtacaaaatcaacatacaaataagtatatctgccatgaattaagctcatgtgcaaacatgtgtaattactggtcttgtgtcatctagactactttaaaaaaggtgaaaaaggtcctgtttagttccaaaagggagaaggcagcccctcctgtatgagtggaagctacaaccccttgaaattaataattacaaatcccttaaacccaaggtagaaaaaaggagaacacatatctctgggcatcaataggaaaagactaggtcctacagtaaatatcttagtaaaagaggaggtttgtaaactctctccggaaccagtatttcagactttctatgatgaactaaatgtgccagtaccagagactctaggaaaaaccaggaatttgtttttgcaattagccgcgcatgtagcccagtctctaaatgtcacttcatgttatgtttgtggagaaactgtaataagagatcaatggccataagaagcccaagaattagtgcctacagagccagttcctgatgaattcccagcccaaaaaaatcaccctgatcatctctaggttctaaaagtctcaattattgaacaatattgcatagctagaaaaaggaaagaattcactcattctgtaggaggacttagttgtctggggcaaaaactgtataacagtaccacaaaaaaagcagttatatggtggagttcaaattacatagaaagagatcctttcagtaaatttccaaggttgcagactgtctcggcccacccagaattccaccgggactggactgcccccaccgggttatactgaatatgtagacatagagcctacactaagctgcctgaccagtggacaggtagttgtgttactggcactattaaaccatctttcttcctactgcccataaaaacaggcaaactcctggcttccctgtctatgcttcccgcgaaaaatgaagcatagccataggtaattggaaagatgataaatgacctccaaaaaaaaaattatataatactataggcctggcacttagacacaagatggctcatgggaatactggacccccatttacatgctcaactgaatcatacggttgcaagctgttttagaaatcatcactaataaaaccggtcaagctttgactattctggcctggcaaaaaactcagataagaaatgctatctatcaaaatagatgggctctcgactacttgctagcagctgaaagagaggtctataagaaatttaaccttactaattactgtctacacatagataatcaaaggcaagtagttaaagacatagttaaaaatatgacaaaactgacacatgtgcccgcataagtgtagcacgaattggaccctgaagccatgtttaaaaatcagttcccagcactaggagaacttaaaactcttataataaaagttatgatagtaataagaacctacttactgcttccttgcttgctacctgtacttcttcaaatgataaaaagcttcatcgctatcttagttcaccaaaatgcttcagcacaagtgtactatataaatcactatcaatctattacaaaaaaaaaaagtaacaaaaataaaagtgagaactcctactaataaaaaagtgagagcctcaaaggggggaaaggagggaagagagagaccctctcatattgttttatattgttttatactcagtacctgtttttaaaaaaaacaacaaggaagtaaaaccaaagacaggcagcccagagccacgcctgaaaccaggcctgggcctgcctggcctaaacccagtagttaaaaatcaactcataacttaaaaatcgatgttattcacagattccagacattgtatagaacaacactgtgaaactccctgccctgttctgtttctctctgaccgccagcgcatgcagcccctgtcgtgtaccccttgcttgctcaaatcaatcacaaccctttcatgtgaaatccttagagttgtgagcccttaaaagggacaggaattgctcactcggggagctcggattttaaggcagtagcttgccgatgctcccagctgaataaagcccttccttctataactcagtgtctgagaggttttgtctgcggctcgtcctgctacaaaggaatcatacttctggatttcaaaaaagattacaaagctacactaattaagacagtatggtactaacataaagacagacatacagaccaatggaacagaatagagagcccagaaatgaaaccacatgttatttatcaattaaaaatgaaattaaaaatgttttaaaaatctacatgtgtaaagtcaactaatcttcaacaagggtgtcaagaatacagaatggggaaaaggtagttccttcaacaaatgatgctgggaaaactgaatatccatatacaaaagaattaatttggacctttaccttacaacatatacaaaaatcatctgaaaatggattaaagacttaaacataagacctgaaactgtaaaattcttagaaaaaaataggggaaaaacttcatgacattggattggcaataatttcttgggtatgactccaaaagcatgagcaacaaaagcaaaaatagaaaagaaggattatattaatctaaaaattttctacacatcaaaggcaacaattgagagagaagacacaacctatagaatggaaggaaacatttgcaaatcatacatctatctgataaggagttaatatctaaaacagatcagtaattcaagcagctcaatagcaagaaaacaaataacccaataaaaaaaatggcaaaggacccgaatagacatttctcaagagaaaaaatacagatactcagagtatatgaaaaaatgtgcaacatcactagtcatcaggaaaatgaaatcaaaaccaggagatattaccttacatctgttaggaaagctattatcaataaacaaaaaaagatcacaaatattgaggaggatgtgaaggaaaaggaatgcttgtacactattgatataaatgtaaaatgatgtcacagctatggaaaacagcatggcatttcctcaaaaaaattaaaaataaaaatactatatgatccagcaatcccgcatttgggtttatacatgaagaaaataaaaagtagctggaagagatatatgcactctcatattcatcacatcttttttttttttttttttttttgagacagggtcttgctctgtcccccgggctggagtgcagtgatgtaatcatggctcactgcagcctcgaccacttgggctcaaacaatcctcccacctcagcctccctagagctgggaccacaggggtgtgccaccacacccagttaatttttatattttttgtagaaacggggttttgccatgttccccaggatggtcttaaaccctgggctcgagaggtctccctgcctcagcctctcaaagtgctgggattacaggtgtgagccactgtgctcggcctcacggcatcattatttacaatatccaagatgtttaaacaacctaaatgttcatcaccaggtgaatggataaaaaatatgtggtatatacatacaatgaaatattattctgtattgaaaaacaaggaaatcttgcactgtgacaacatgaatgaattcttgagaacattatgctaagtgaaataagctagtcacagaagaacaaatactgcatcataccacttatatgaggcatatgaaatagtcaaacacagagaagcagagggtagaatggtgggtgctaggggattggggagggagaaatggaaagttgccattcaacaggtataaagtttaagatatgcaaaacaatttagttatagagatatgttgtccaacattgtgcctctagttttcatttgatatattgttcacttaaaaatttgttaagattgtagttctcttattgagtgcttttgtcacaataaataaattaaaataaataaaagtagtaatctctgaagatcaagagagaagaaataacaaaaaagtaaaaatatgaataaaaatacacttctttcttcagttttctaaattatgtttgatagttgaagcaaaaattaaaacagtcttacgtgtttctcaatatacataaaacaaatatttaatatatttatataataaatgagtgagataaaattacataaagggttctacattttcctcaaactggtaaaatgtcaactttattaaattatgataattatgtgtatataatgccatacctcgataaactactaaaatagctatataaagatatatactcaaaaatactatagacacatcaaaaaagaatctaaagtgtattcaagtaactgacaaaaagtcatgaaaaataaattaaaaacagagggaacaaacagaaaacaaattagatggataggtagatagattagacataatccttaccacatcaataattacttaatatacatggtctaaatacaccaattaaaagacagaggttagcagaacagattaaagacctaactcaactacatgctatccttaagaaacttacttcacacatcatgatacaggtatattaaaagtaaaagggtggaaaaagataaaccatgcaaacattaatcaaaagaaagtagctttattaatatccagtaaagaagactgcaaagacagaaaattactcaggagagagggagacattacataatattaagagtcaatccttcaagaagacatagctagcctaaatgcgcatgtacttaacaacagagctataaatatagatgaagcaaaaactgacaaagctgaacggaagagtggacaaattcacagttatagctgtagacttcaacatccttctctcaacaattataagaacaactagacagaaaatcagctaggatatagaaaaattcaacaataccatcaaccaacagattctagtcaacattttatagaacaccttacctaacaacattatttttaagtttttcaagttttcaaatttgttttaaatttttcaacaaattctcaagaccacgagtgggacaaggaaatatcctacaggcagcaaaggacaataagggtaaatacatattatttttaagtgcccattaaactatattaagatagaccatatcctgggccataaaatagcctcaatatatgtaaaaaaaaattagtcacaaagagtgtgttctctgcgcacaatcaaatcaaaatagaaaattgattattgaaagacaacaggaaaatctgcaaaagagaaaacattccagctctcactgggcttgagtttttaaaaaaagaggcagagaaacagaaaatatctcacatcagtaatctaatcatctatctcaaaaatctagaaagaaagcatgaaatacacccaaagtaagcagaaagaagaaaataataaagaacacaaataaaattgaaaatgaaaatcgagaaattcaatgaaataaaaaagcttctctttgaaactatcaagataaaatgttaaaattctagaaaaattaacaaaaataaaagagaagatacaaatttttaagaccaggaatgaaacaaggaaatatcctacaggcatcaaagcacaataagggattatacaaacaactttaacatgtaagtttgacaagttagatgaaataaaccaattccttcaaaagcaaaagctatcacaactaactcaatatgcaacagataatttaaatagctctataattattaaggaagtggaattcataatataaaaactcctggaaaagaaatctccatccccagatggttttcttggagaacactgccaaatatttaaacatatgtaacacctgttctacccaacctttctagaagataaaaaaagagggagtactttccaatcaattttattactaccatgataccaaaaacaaagatattataagaaaactgcaaattaatactcttcattaatagagatgaaaatatttctaataaaatattaacaaatagaattcatccatatgtaaaatgaattgtataccatgaccaagtaagatttattccagggttgcaaggctagtttgatatttgaaaatcaatgtaatctaccatattaacaaactaaacaagaaaaatcatatgattatgtaaattgatgcagaaaaggcatttatctgacaaaattcaacacccatttatcacacaaactctccaaaatctagaaacagagaagaacttctatatcttgatttttaaaaatctatcaaaaagagatctaaagctaacattgtatttaatggcaaaagactgaaggctttccccctaaaataggcaacaaagcaaggatatcagctctcaccacacttacgcaccatatttctggaagttctaatcggtgcagtaaggtatgaaaattaagtaaaagacatacagatttaaaaggaagaaataaaactattcctactatctatacatgacataattttctatgtagaaaatcccaaggaatccaccaaaacgacaataataacaattcctgaactactaagtgatttcaggagggttgcaggatataagataaacatacaaaaatcgattttacttgtatatactaataacaggtgaaaattaaaattaaaaatataataacatttataatacctgaaaaatgaaacaattaggtataagtctaataaaacgtgtacgacttctatactgaaaactgcaaaatgctgatgaaagaaatcaaagatctaattgaatggagagacatcctgtgttcatgaactggaagacaacacagtaaatatgtcaattctcctaaattgatatacaagtttttataattcttataaaacctaagaaaaaaattttagacattaaaaattattgtaaaatatacatggaatgacaaagtagctaggatagctaaaaacaactttgaaataggaaattaataggaataactctaagtgatttcaagacttattatatagctacagtagtcaatgctttgtgatattggccaaggaataaacaaacagcccaataaaatagaatcatgaaactagaaatagccatacacaagtacagcaaattgatttttcacaaatatgcagaagtaatccaatggaggaacaaatagtgctagagcaactggatatcaataggcaaaaagtaggaactttgagaaaagtctcacacttcataaaaagttaactcagaatggatcataaatacaaaatcaaatgtaaaatataaaacgtttaggaaaatagcagaaaagaaattttggacctagaactcgttgaaccattcttagacacaaaaagcatgacacataaaagaaaaaatagataaagcttacttcattagctacaaactgcaagaaaatatttacaaaactaatatctgaaaaggtctcatatatagaatgtataaacaactcttaataattaacagtaaactactatacaaaaaatcctattagaaaataggcaaaaaacatgatgagtcatttcactgaagagtatgtacagacagcaaataaacacatgaaaagatgtttgacatcactggctattagaatgaagatcataatatcactacacactgattagaacatctaaaataaaaaatagtgaaaatatcaaatgttggtcagagtgttgaataactagatacattgctggtgggaatgtaaaattgctctggaaaatagtttggcagtttcctaaaaactatgcatcacataccataacctagcaatcacacttgtgggtgtttctcttagagaaattaaaatttatgactacacaaaaatctgtacccaattgttcatagaagcattatttgtaatagccccaaactggaaaaaacagaatgtcctaccatagtcaaatgtataaacaatggtatatcctaccatggaatactaattagcaataaaaaagaataaactatcaatatatccaacttggatggatctctaaggcattatgctgagtttttaaaaagccaatctcaaaaggtcctacactgtgtaattccatttataaaacactgtataataacaaaattatagaaatggagaatagatttgcatttgccgagggttaggcacggggcaggggcaggtggtaggggtagggaggggcaggtgtgattggaaagtggtagcacaagggagatatttgtagtgatggaatatttctgtatcgtttttgtgttggtgattacacaaacccatatatgtgataaaactatatacataatttatgtcaatatgtcaatgtccttgttttgatatcttgctatatagttacacatgatgcaacctatataggaaactgggcaaagggtacaaagaacctctctgtgctgtctttgctacttcctttgaatctataattatttcaaaattaaaagtttttttaaaaatttagtttctagtctttgagaggtattcctgggacgaaaatgagagaagatggataggctttcccatatagcataaacagctgaactaaaattaaaagcagttatcaagtagattcagtcagttttatttttacaagtgttaggtttaatataaaagtcagaaactaaataaaatgaacagtcaatacttctaaaggagttgtcaaattagaaagagcttgtttctacaaaagacaacataattatcacaaatagtgattatcatatctctgctatgcaccaaacaaaaattatttttctcttcccagttgtaagccaactgccatactaaccgtcttgccaactttgtattttctttgcatattccttttctcctgagcccccagtactgcacttaaaattgccaaggaggaagggagacttagaaactgcaagaggctaaataaacatttgcctgtgactattccacagcataaattatataatcactaggtattcaatgattctaatttaatactgctaaagagggcaggtgatcataacgcacattttagaaatatcaattgtgggtcacctgaaaaagtttcagtcattcttaaatgcaattaccaatatcattataacataaatgcactcagacaaaactaaactcattaaaatggaattctgcaagagtgtaacttacctagctttcttggttttttttcacactggacactagaatctttacccttataattagataaggttcacccacttcagatctctgttataagtgtttaatttatatacactggtttaatttttaacccgagacttaaagaacatgaaagatttgcagggattaactaaatctattctttgtaatagaatccattaataattttctctacatctttctacctactaacatcagttttggattctttctaataaagctgtaactaacaactcttgaccattatggctaaggagacagtctaactcatcctagaataccctctaggctattccctacatttgttgttagggtaattcagatcctttatgttcttctcaaagtaaagtctttgcctaaaaaattgtatagtattatgattatctattattgtgtaagaagccattgcaaaacctaatgtttaaaaagcaacaacttctggccgggcgcggtggctcatgcctgtaatcccagaactctgggaggccgaggcaggtggatcatttgaggtcaggagttcaagaccagcctggccaacatggcaaaaccctgtctctactaaaaatacaaaaattagccgggtgtggtggcacatgcctgtagtcccagctactcaggaggctgaggaaggagaatcacttgaacccaggaggcagaggttgcagtgagccaagatcgtgccatggcactccagcctgggtgacagaacgagactccatctcaaaaaaaagaaaaaaaaaaaggcaacaattttttattctttcttatggttctgaggtttggctgggctcagctgagatttgacacatcaggtctctgagcagctgcagtcaaagtttggctgcagtgggaaccatataaaattttgaataggctagacatacaagataccatatttacagtgctggcagttaatgcgggcttttggctaggaatgcagctctatcaaccagagtgcctacctaattgttatctctctgtgtaggctgggcttcatacagcctagaaattgcattctgaggggaaatgtctcaaagttgagcactccaaaacaatcaggtgaaagctaaaagcctttttataatctagcctcagaagtcctagaatgttacttctgccatatttagttggtcaaccaagttattaagtccagccaagattcaagaagaaaagtattaaactctatctttttgatggaggaaaagcaaagtcatgccagaggagaatttgcaaaatgtgaaatattgttgtagctatcattagagaatacaatctatgacatatagaaaatttcattcctttccaatatacaagtataaaatgccacttgcttattttactggataaccctaggaatgacagcatggtgaggtagctctagatatccctgacctaagtattctctctcctttcttttattaccccaacagtagcatttttaaagttataaaaatatagaggttatcggccgagtatagtggctcacgcctataatcccaacagtttggaaggccaaggcaggtaaatcacctgaggtcaggagttccagaccaccctggccaacatggtgaaaccccatctctacttaaaaaatacaaaaaaattagctgggcattctggctcacacctgcaatcccagctactcaggaggttgaggcaggagaattgcttgaactgggggccagggattgcagtgagccgagatggcgtcactgcacttcagcctaggcaacagagtgagactccatctcaaaataaaaaaaggttatccaacattaaaaacatcatgatgtagccaaattctattaataccagatgtacaaagaagagctggtaccattcctacagagactattccttaaaattcaggaggaggaacttttccccaactcattctacaaggccagcatcatctggataccaaaacctagcagagacacaacaaaaaaagaaaacttcagagctatatccttgatgaatatcaagacaaaagccctcaacaaaatactggcaaaccgaatccagcagcacatcaaaaagataatccaccatgatcaagtagacttcatccccagaatgcaaggttggttcaacatacacaaagcaataaatatcactcatcacataaaaagaacaaaagacaaaaaccactattatctcaatagccacagaaaaggcttttgataaaattcaacacccgttcatgttaaaaacttctaataagctaagtattgaaggaacatacatcaaaataataagagccatctatgacaaacctacagccaacattatactgaaagggcaaaagctgcaagcattcccccttgaaaactggcacaagataagaatgctctcttgccacttctattcaacatcatattagaagtctaagccaaagcaatcacgcaagagaaagaaataaagggcatccaaataggaagagaggaagtcaaactatctctgttagcagatgacatgattctatatgtagaaaaccccatacccatagtcttagctcaaaagctccttcagctaataaacaactttaacaaaattttagtaaacaaaattgacttacaaaaatcactagtattcctacacaccaataacagccaaactgagagaaaaatcataaaggcaatctgattcacaattgccacaaaaagactaaaatgcttatgaacacagcttaccagaaaggagaaagatctctataacaagaattacaaaatgctgctcaaagaaatcagtgaagacgcaaacaaatggaaaaacatccaatgctcatagataggaagaatcagtatcattaaaatggccatactgcccaaagcaatttacagattcattgctatcctatcaaactaccaatgacattctttacagaactagagaaaatgattttaaaattcatttggaaccaaaatgagcctgaatagccaaggcaatcctaagcaaaaaaaaacaaagctggaagcatcacgttacccaacttcaaactatactacagaacacagttaccaaaacagcatggtacaaaaaaagacacgtagaccagtggaacagaagagaggcccagaaataaggccacacatctgcgaccatctgatcttttgacaaagctgacaaaaaataacaattgggaaaagactccctattcaataaatgatgctgggataactggccagccatgcacagacgattgactctggaccccttccttacaccatatacaaaaatcaagtcaagatgaattaaagacttaaatgtaaaaaccaaaactataaaaacactggaagaaaacctaggaaataccatcctggacataggaatgggcaaagatgtcaggacaaagacaccaaaagcaatcacaacaaaagcaaaatttgattaaacctaagagcttccacacagcaaaggaaactatcaacacagtaaacagacaacctacagatgggagaaaatatttgcaaactatgcatctgacaaaggtctgatataagaaacttataagcatctataagagacttaaacaaattgacaaaagaaaaacaaccccattaaaaagcaggtaaaggatatgaacacacttttcaaaagaagacatagatgtggccaactagcacataaagaaaagctcaataacactgatcattagagaaacgcaaatcaaaaccacagtgagataccatctcacaccagtcaaaatggctattactaaaaagtcaaaaaataacagatgctggcaaggttgcagagaaaaggaagcacttatatactgttggtaggagtgtaagttaattcagccattgtggaaagcagtatggtaattcctcaaagaactaaaagcagaactgccattcgacccagtaatcccattactgggtacatacccaaaggaatataaatcattctatcataaagacacatgtacacgaatgttcattgcagcatgattcacagcaaaaacatggaatcaacctaaatgtccatcaatgacagatttgatgaagaaaacaaggcacatattcaccatggaatattatgcagctataaaaaataatgagatcgtgtcttttgtgggaacgtggatggagctggaggctattatccttagtatactaacacagaaacagaaaaccaaataccacatattctcacttataagtgggagctaaatgacaagaacttataaacacaaagaagaaaacagtaaacactggactcttcttgagggtggagggtgggaaaagggagaggagcagaaaagataactactgggtaccaggcttaatacttgggtgattaaataatctgtacaacaaactcccatgccacaagtttacctatgtaataaaccttcacatgtacccctgtatctaaaaaaaggttaaaaaaaccacaaacactatgatggagaaggcaattctgcatagtgctatgctgtctaccatggcagccactggccacatgtcgctattgaacacgaaatatggttagtccagctacactataaatgtaaaatacacatcaaatttcaaggacttataactaaaacagaatgtaagatatctcattatgatgtttatattgattgcatattgaaatgatgatattttgcatacactgacttaactaaaattaatttcacctgttccttttactgtatgtagctactagaaaatttaaaattatctatttggctcacatattattgtagtttgcataatatttccataagatagtgctggctaataaaataaactgaatcatattttccagtatatagtaccacaaaaggtcatggtttttgtaccattaaatggttttcaggcattttaattgcttcttgctaaatcttatgtgagacatataagcatattcaaagtaaatattttggtacttctaggccaggcgcagtggctcacgcccataatcccagcactttgggaggctgagacaggcggttcacctgaggttgggagttcgagaccagcctgaccaacatggagaaaccccgtttctactaaaaatataaaatcagacgggtgtggtggcatatgcctgtaatcccagctactcaggaggctgaggcaggagaattgcttgaacctgggagtcagaggttgcagtgagccgagatcacaccattgcactccagcctgggcaacaacagtgaaactctgtctcaaaaaaaaaaaaagaaaaacaaaatatattgaccaggcctggtagtgcacacccgtagtcccagctattcaggaggctgtagtgggaggatgacttgagcctggaaggtcaaagctgcagtgagctgtgatcacatcactaccctctagcagcctgggtaagagagcaagaccctgccaaaaaataaaaataaaaacaaaataaaaagataaattaatatatttcaatggaaattgatttatgaatataagacagccaagatgatatgagggactcataactgattaacattgaagaaaaataggcaaaaattaaaattcagcttgttttagaaggaaaaaaatattgggagtttatcaaatatttaaaagaaacacatttgcaaactaatggccagtacttagtctcatatccttcctttctttcttccctctacttttcctccaaactgaacttcatatatttcctacaacaaacaacctatgtgattcctgctctgtgcctttgcacaggctcttacccctttctggaattcccaactccctcaactgtctaatgagtacctacttctccttcaaaagccagcttaagagctttctctcctctgaagcctgatccaccccaggggagttaaccacttactacttggtgctcttatagtacttagcattcatcagtattacagtttttatcatgttccatttcacgtacttgtctgtttgattctccttgacaactaagactgcagttgttagtactttgaaaccaccacttcttagcacagtgtttatagaagaattatgtaactagaaatgcagtaacaccaatagcattttaatttaaattttacagtttagctatctgttatagcccatacaaaatctgtcagaaaaatgtgttaaatctctctcaaaatccatcatatgtattcttgtgtttattatatatatacatatgtataatacatacatatatatacacacacacactatagtcatatagtcatatagtttctaggtggccatacctctcagtttgcttgagatgccttttgtagatcaattaaggtctgttgaccattttatgaatctttgtctctcagaagtaacgcagttttggccgggcacggtggcttacgcctgtaatcccagcactttgggaggccgaggcaggcagatcatctgaggtcaggagttcaagaccagcttggccaatgtgatgaaaccctgtctctactaaaaaatacaaaaattagccagctatggtggtgtacacatgtaatcccagctgctcgaaaggctgaggcaggagaaccacttgaacccaggaggcagaggttgcagcgagccaagattatgttactgcactccagcctaggtgacagagccagaccccatctcaggaaaaaaaaaaaaaaatgtatcccggtttggataacaaattacatgtttctcctaataattttctaaacattaccaatagtaaattaaattctctgtgaagccaaatattctgactatagttgctaacacaggataatatttcattgttcaagggctataaaaacaaccttttgatttttgctattaactgttgtagtgaataatgtggtgcttcacccagatttcctttataagggattcccttttcagctggaaataccagctgtgatggctcacatctcttttcctcactgggaacagtcctcagttgcaggaacctgcctcatccaaagttacagagctcctgggatgatatgccatcaatgattgacagttgcaggaattctaagggtccattcccccgtttcaatatgagacaattctgaaaggccatcccagctccaacactccccataggacagctaagatttccattgtaagttggcttctctgccaatctgcctttctttatatgtttccttatatgtttattttctgaaagactgtcccaacaaaacttttttgtactcaaatttactttcaagtctgttctagtgtatatgatctaagacaacaatcactcttcattctaccatcagctcccacctaggaactctactaggctcaggacccttatatttcgtccaagttagaactaatacttcatgccaggattcttgattcttactatattcctgtcatttctaccatttgacctagttttattttatgtaacaaacaactctgagtaaagtttaatgttaaaaaaccatagcaggaacttctaacatatgaggaatgcctaaacactagggagtaaaggaacccacttcttgggaaaggatcagttggaacaatccacaaagtgaatgactgacctgccccacaggtattagaaatcatggctgcctctgctggaaggcaaatgacaaagggctctcaggctttaagctctctggccaagaggatgtaacctttagggactttcacctctgtattgctctctgcttttcacctctgtattgattgctctctgcaagacttaagttttgacactttggaatattctccattactttatagttacttttattttacaaaaattatttcattctcctcctgtgctctggctctatctgattagtttcccttttattaaaaaagataaaaatggctgcctactttttattatttcagcttttcttactagttccgcaatcacatagcttgcatttctgtaggattctcacaattaatttttattattaagagagattagtacattagagcacaaagaagagatatatgagaatagtctgtttcctcaatagaggaacccagatgcctccttttccccaatgagcactgcacaagctcctcttaaaccccaaagtggatattctatgccagatctacgtgacaccaaacttaacttgtcaagaaggatttggaatcattatttaacagtcatctatggaattaaggaacatttagtagaggaataagactaggaacccagagcagctcagaaaaataatagctgaaacaataaagttatttccaaaacaattcacatatgcaaatacctgtgtaatacttagtccttaatttaggcacagaaaagaaatcagagaaaaaaaaagcattttgccaacttaaccagatccccactatttattatttctctcaactcccagcttgttgaatcatcagctcctatattccagcttcaatatctaaatccagcctctttcattgggatgattcctttatatcttcttggactttgactttatgctctaatcaatctgaccttggttgatatctctgtttttggcatatccactcttgcacagacctatataggatactatttatttcttttaagttatccagatatctgtaaactgaaaaacattatctctaaccaaatcaaccactcaaaaatcagttaccactacataataatgaaaacggttaagaatataaaaatgtaaagcatctagtacagtacacttgaggtgataatgacaattctcatatgcagtccatgccaaaaaaaaaaaaaaagaaaggaagggagggaggaagggcaagaaggaagggatggagggaaagggagggagggagggagggagggagggaaagaaggaaaaacataggctgaaaactgcctttacatttttagaattttaattctaacctgtctcttgtattcaaaaagccattgcatattgttcctcccaactgttttaccatatcatcataggaaataaaaataaattaattaattaaggctggaattatttccaaaatgcattttcaggagtgagatggaggtctatacaaaaggaaaaatcccataacatctcttttcgtgtaggctttatatgaattttcagaatttcccaagacatggaatgcattaaactcaagacacacaataaaacaggtttctgaataacaaagccagtccatttgattctttattcactcagcaaatacgtaatgagaaccaacaatgtgcttccacataaaacaccaagagaagaaacaagtgggtggatgagaggtccagaaatgcaaattagttcctgcatggagctcagatctgacttgtttactctagcagcattatctctcactcagttctaataatcccctatagtcatgtatcacctgaatattaactttactaataattatatgtcacctatctaacacatccaacccaactacaacaatatgatttcaacccagtcccagaaaaatatccatgcttggtgttatcttagaactcaaacatgatggctgcctacctacaattctattttcaccaattacagaaagatcaccatgtaaaaataattgatttcctgaagatcattcctttttcacagggcctcgttgctctgccccatttataaaaaaattccttaattatgttatacatcagagaagatgaactaggtctaaccagtcatagagatataacaaaatcagcagaaatatcttagaaatatatatatccctaagttttaaaagacaaaagctatattttttctgatcctaaatgtttcctggagtgtatttttaatgaataaaaatcctgttctagaatagggctggatgtggatccaaatgcagagattaagataaaaaagaatttatttctggatatttacattgatttccagaagagatttaatgctttgcaaaataagaccttttataacaggcagtccattgtataaatgtagtagatgcttgaaactcatttcagttaatgtcagagaggctgtttctccattacatggcatatacaacatgcaatcatttcattcactctttcatccaaaaatacaattcagctttttctaaattctatgcattgtgcctgaggcttgggataaaactaaacaaaacagacatgtgatctgcctgcacagagcttaaagtgtatgagggatgctgtctataatggattcgaaatgaaaggattgataatgattccaccaaagagactagggaagactagtattgatataatgttgtgagtctcccagagatgtccacattcaaattcccagaacctatgaatatgttacctgacatggcaagagggattttgcagatgtaattaaggttaagggccttcagatgggaggattatcctggataatctgggtggctcccactaatcacatgagtcctaaaaagaagagaatctttccaaggtgtggtcagagaaagagatgtgaggttggaagcagggtcagagaaacatgacgttgctggcttagaagatggaggcagagggccatgagccaaggaatgagggtgacctctagaaactggaaaaggcaaaaataatggactcttccctagagactccagaaaataatgcattcctccaacaatttgatttttactccagtgaggcccaggtcagacttttgattacagagctgaaagacagaaatttgtgtggtttaagacactaagtgtgtggtaatttgttacagcagcaatagaaaactaaccaaacatatatacatatgtatccactcatataaatttaacaggacagtatatattagggcaaacatacataatcaatagtgttaagtggttgtctgttttgtccgttatagacccatctcatctcatttcttgctaatttcttcttaatgtgacaagacattgaacttattgaacgttgagattccattttaaaaaatgatcaagacttgctgatctgtttaaggaactgaatttatttagactcagaggagtcatatggttgtgtggactgagcctgagacaaacataagctgcattcatttctcattgcggaactgctctggctggacgcaacagatttgcaaaatttaagccaatctctgaagtccccttcacctaaaagactcacaggttttgatgaattaatcactttcagttttcatgcttatcatcaagcatttgctccatcagcacagctcaattacaaaagctactgactgatctgaaaaacaactgggtccaccaaaggagacacagtattccttaaaatagaaagatgaggacttaagtattagagccatcccaagtctttgagcaaacggtgagcaaggtttgagttcagctagttccagaaaaatgcattccctttcattaaaactgatgcaacagctataaagaagcattatttgtgatagaaacctggagtgacagtaaacctggggatgagatacaataatacactccacagttttccaggttggttcctgctacttaattacacttaattacaatattcattagttcagtccaatttgctcagtttaagaaaaccataaaatcaccattattttgatgtgatatgtgtttattatacacaggggcagcttcagggacctgctactgcacataggatcccaattttagacaggggtcccaggcttgggttttcatgctctgctaccacagtcttgaattttttaacaattttacctgtgaatctgtgtagtccaatgcagcaatgaagcacatgtcttggctcatatgcagtcctgcctccgagtgacttcctgggataggtcctcagccacctgttctcccacccagtgattactgccaccctttattccttgtgggggccttggcacaccctggggtgggtcagggtcatttggtggggccacagatgcctgtgagggtctgcagtcactttataagtacctctatactctagaaatctaacattaaatagcaaataaaaataacctttcataggtcatagtctctcgtgacctatatgtcacgagacatatagtcactttataagtacctctttatatagtcactttataagtacctctttatatagtcactttataagtacctctatactctagaaatctaacattaaatagcaaacaaaaataacctttcataggtcacgagagactgtgtaagaaagctacagttcctttctcctgctttttgaacaagaagcctcacattttcattttgtattaggccccacaaattacgtggccaaccttacctatgtatgtgggtaagtgtgcacatgtatatatatctgaatttgtacctataaagaataaaataactttctattttagataaattgaacttacaattttataatttctaggaaaaataaatgtatatataactttactatattttatctgtaaagaggaaaataataattgtaacagtttgcatatcatgaaagaaggcatttcaataaaatattatcttctaagttttttatgactgatgaattaccttgaaaaatctttaagaatatattatatgctaaaaatggggatattctagcttcaggcattctaggacatgtcatgtctaggacatgacaatactaaaattttcttattaaagaaatctaccttacaactttgatttatcgacaggtgagagatttctggtcaggaaccaaagtcatcaaatattaagagtatgaagatacatcaaatgtgttgaagggtcttcaaaatgcaccaaataattttagtgcatttcaattattcacataattgaacaatctcaaatatcttaaattcatacctgaaaagtcataccctttgtaactaatcattctcaaaacacacctacatgaatcttgaattcttctatttataataatgcagatgaacaaaatattgctattataactttcattttgtttagctctattatttaaggaatcttcataatcaatatataattgaaaatatattcaagatttttctcttcactttataaatattaccaagatttgaggggaacaatagttacagacattccatagatgaagagatatgtatttcatatatatgtataaatacagtgaaacaaaatggactttgaaacaaatatttttgccctaaatttagacatttacaatatttctgatagctaaaacttcaaaaaaaaaaaaaaaaaaaactagacactgtcacatttgaaaaagattaagagctgccaaaactacgtgggtgcctgtaatcccagcactttgggaggccaaggtgggagggtcacttgagcccagtagtttgacaccagtctgggcattatggcaaaaccccatctctacaaaaactacaaaaattagctgggcatggtaacacacctgtagtccaagctacttgggaggctgaggtagaaggatcatatgagcccaggagttcgaggctgccattagctgtgattgcccaactgcacttgagcctgggcaacagatcaagaccctgtctatctccataaaacaacaacaacaaaaaaacataacaacctgcatgggctctttacacgccttcaaacatagctcatgatccctgtaatatcactgttattggatactaacttctaatggcctttcattattcactaacttgatcctgagcaatctgcccctctctttatcttctttatatttcttaaattgatgtgcaactctagtttcctttctccaatcctgattcccttcttcaactaatagtgagatacttccacaaacaaaacaatcacctgtaaatacccttctggttctgatctcatccctagaaattcccagggttgttgttccctgtaaataaccaagcagaactcacttagaaaatcaacctatgtaaaatcacatactcatttgtaatttaccctattttgtatacggaaagtatctcagcctatattcaaagtacaagggaagaggggctagggatgggaaggcaaaccagtcacctacgttgttcatgtactctgaaagcagatcctgaagagcctggcgaatggcgttgcattctgcgataatccgctctcggtgtaagtccctcgtacatgaagaatccgccagcagagcagccccactgataatggcttcaaggcgtttctctagtgatggtcgtatttcctcctcagttactgtgagtggattcaggacaattaaattctaagagaagaacacatttgtatggttagagctccatggcatttcacttttatgaaaaacaaatgttattttgtttttgcatttagaattcagatgtgataataaagagaactgtgttttactgcctcggctggttcacacataatgctatgtagtgattattattctgataaataatgaaagtgatgcaattatgagcttttgttctagcctcagacagacctggattcaaatcttacatttctccctcatgcaggtgtcatacacttgctgagcctcaacctcttgatctataaaagcagaatattaatgttgcgtgtgttgtaaaactgttgtaagaatgatataaatgcttaatacactgactggagcatattaactgttatttacaatagtaacttttatagactgcactgtttatacaatattttcatgtatctcatcctgacagcaccatgaggaagtaggcagcaaagtattaataactacacatttcagctgatgatgagtgaggctgaaaggctgtcttacccaaggtcatagagcaaataaacagtgacgttcagacaagtatccatgtctttcaataccagatttaatattattttcattatgcctcactttaaatcataaactttagttaactttaacactaacatatcaaagtaaattctgaattttaattatttaatttaaaacaaaactgcttcttcctgttgatctattataacttccagctatttccagctattagaacctgacacggtatttttaaggtttccattagacatatcttcaggtaatagaagtcgagataatctacagcctcttaagaaaagatggaaggtatatgctgctctaagggtcttttattaaaatactccaagagaggaagtctttccaagattaggcataatgtgagaattgaagaaagagatagtgtagaataaaagctctctgaagaacccttaacatgaaatgcaatcacataatgatcttcagagtgtgaaattctgagtgtgaatctacacacaaacacactgtgaagatattataagatcttcctagtatataatcttatgtataagattatagatatgtatatgtattttatataggtagaggtgtttaagtatgtaaataagtatatgtgtgtgtgtttatatataaaatcttatacttatcattgtgttacattacattctgataaatatttggggattgaaagtagccaggatacaattttaaaagccacaactgcagagtcaagctaggaagaaaaaattattatagaaaaagatatagttttaaaacattttttttaaaaaaacagcactgtgtaatgttcccttactataaaatgtgaggggttttgagtgagtttcttaatcctgagtcatgagtgaactcccattcacaattgctacaaagagaataaaatacctaggaatccaacttacaagggatgtgaaggacctcttcaaggagaactacaaaccactgctcaatgaaataaaagaggatacaaacaaatggaagaactttccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatcagcaagtcaatcctaagccaaaagaataaagctggaggcatcacgctacctgactttaaactacaccacaaggctacagtaaccaaaacagcatggtactggtaccaaaacagagatatagaccaatggaacagaacagaggcctcagaaataaagccaatctacaaccatctgatctttgacaaacctgagaaaaacaagcaatggggaaaggattccctatttaataaatggtgctgggaaaacgggctagccatatgtagaaagctgaaactggatcccttccttacaccttatacaaaaattaattcaagaaggattaaagacttacatgttagacctaaaaccataaaaaccctagaagaaaacctaggcaataccattcaggacataggcatgggcaaggacttcatgtctaaaacaccaaaagcaatggcaacaaaagtcaaaattgacaaatgggatctaattaaactaaagagcttctgcacagcaaaagaaactaccatcagagtgaacaggcaacctacagaatgggagaaaatttttgcaatctactcatgtaacaaagggctaatatccagaatctacaatgaactccaacacatttacaagaaaaaaacaaacaaccccatcaacaactgggcaaaggatatgaacagacacttctcaaaagaagacatttatgcagccaaaagacacatgaaaaaatgctcatcatcactggccatcagagaaatgcaaatcaaaaccacaatgagatgccatctcacaccagttagaatggcgatcattaaaaattcaagaaacaacaggtgctggagaggatatggagaaacaggaacacttttacactgttggtggaactgtaaactagttcaaccatcatggaagtcagtgtggtgattcctcagggatctagaactacaaataccatttgacccagccatcccattactgggtatatacccaaaggattataaaacatgctgctataaaaacacatgcacatgtatgtttattgcggcactattcacaatagcaaagacgtggaaccaacccaaatgtccaacaattgtagactggattaagaaaatgtggcacatatacaccatggaatactatgcagccataaaaaatgatgagttcatgtcctttgtagggacatggatgaagctggaaaccatcattgtcagcaaactatcgcaaggacaaaaaaccaaacaccgcatgctctcactcataggtgggaattgaacaatgagaacacatggacacaggaaggggaacatcacacactggggcctgttgtggggtgggaggaggggggagggatagcattaggagatatacctaatgttaaatgacgagttaatgggtgcagcacaccaacatggcacatgtatacatatgtaactaacctgcatgttgtacacatataccctaaaacttaaagtataattaaaaaataaataaataaaaaataaaatgtgagggtactccaaaaagttcacgtaaaaagtggagttaaaatataaaaataaaaaatgtaaactttatttctcaacgtaagctccatcaagttcaagaaatttatgcaagtgatgataccagctatttagtctacctctaaagaactgaaggttctgggaattcaactatgtcaatgcagtcttttttacattattaactgaagaaaaataggtgccctttacaatttttttaagattaggaaacaaaaaggagtcagaaggagccaaatcgggactgtaacatggaagcctaataatttcctatgcaaatcttgcaaaattgcccttgtttaataagaggaatgagcacaagtattattgtgatggagaaggactctctggtgaagctttcctaagcatttttctgctaacgctttggccaactttcttaaaacactcttataataagtagttatcattctttggcctcccagcaagttaacagacaaaatgtcttgagaatcccaaacactattaccatgacctttgctcttgactggtccaattttgcttcgactcgattacttccaactcttggtagccattgctttgactgtgctgtgccttagggatcgtagtggtaaagccatgttccatctccttttacatttctttggagagatgcttcaggatcttgatatcaattgtttaaaaaatttctattgaaagctctgctcttatctgcagcttctcccggagcaacatttttgacactcatcaagtagaaagttggctcaactttaatattttagtcagaactgtataagctgaagcaattgagatgtctatggtgttggctattgtttgtgctgttaattgtcagtccttttcaattaagacatgaacaagattaatttttttcccacaaattgatgtggatgttctgccaccttgagcttcatctttgacatcatctcatcccttactaaaatgagttacccacttgtaaactgctgatttctttgaggcattgtccctataaaccttttataaagcatcaatgattttaccattcttttgcccagtcttcaccacatatttgatgtttgttcttgcttcatttttatcagaattcacattgctgatagaggttcttcaaactgatgttttatctttctcagtgcctcaaaataaatcccattctgacatgttacaacaagttagtatgagtttattttggtggaaaaaatgttgaaatccatgcatagttttttataatacacattcttcatgaactttttgaaggccccttatataatgtaaaatgtaaactagaatatagatctgatataaaattggttaaatatcttaaaagcatgcaggagaattcttcctttcctgactgttttcttcctatttttctttttttcttttctttttttgttttttagatggagtctcactctgttgccaggcttgagtgcagtggcgcgatctcggctcactgcaacctctacccccaaattcaagcgactctcttgcctcagcctcccaagtagctgggactacaggtacacgtcaccacatccagctaatttttatatttttagtagagagagggtttcaccatgttggccaggatggtctcgatctcttgaccacatgatccgcctgcctcggcctcccaaagtgctgggattacaggtgtgagccatcacggccggcctttttttcctttttttctatgcctctattgagtctctccatttttctgtcttacatgggcaaaaaaatttttaaaaacatgaaaggaaattaactttacaaaaagcaaatttaacatttctttttctttacccagtagatattatttttgatgaaaccataatccctacaatggggctggccatcagttaaggcttcattcatctaagtcttcctccttatttcatttgccacttttaccacatctttctttggcccactcatttagtacaaactttccactacaatgtttcataacaaaaattaaaccatttaggccaggtgcagtggctcacacctgtaatcccagcattttgggaggttgaggtgggcggatcacaaggttaggagttcaagaccagcctggccaacatggtgaaacactgtctctactaaaaatacaaaaattagctaggcatggtggcatgtgtctgtaatcccagctacttgggagattgaggcaggagaattgcttgaaccgggacccaggaggcagaagttgcagtgagccgagatcacaccagtgtactccagcctagactacagagcaagactccgtctcacaaaaaaaaaaaaaaaaaaattaaaccatttaaaacctttttggaaatgtacttccagtgtggcatcattaagaaaagactatgcaggcaatagaattgctctttaattgctctaatgtaattagaagatgtgatagaaacagtgaatatgtctccagcattgtgacaataggaaaaaactgattacatttcaaatctgtttgctgtaagtactgcaagaaaaaactgccgtgatttttggcagttctggcttttttgccatgttctagctgtgatttcatgttagtaaatagcctatattgtagaattaagttcactctagcttctgctctacaggttcattcctcaaactatctcagcatttggaattttacatgcttgacttttaagacttccgattcttcaagctcatctgaactcaaaccgttgtctgttctgacatctgacacctataggcaggtctcttgattttgcctgaaacaactgtcctactattccaacctactaaagttttcactaaccttgtcactgaatcaataaaaaggcaagaattttttaaagtaaatcaaatgtcctgtgaaatggcactggatttgtttaagaccaactgaaataagtttttacctcttccgatgcacaatagctatgttaaaacagcatttcagtgtgtttcatggcattaatcccatgaaagacaatcaataggatattgttttttcaggatgccactccattgaaatagaaaatatttttccttttttaaggttccactcaatgtatacttacctccttaataatttgattgctgacagaacattattttttaaatataattaagagtcccaactccatattcttctattatattattttgtttaaaagagtaagtatagctagaaatttagaacccaggtcttagaagcagatagcctgggtttgaatcctggcgcatagctataaacaaatatatttgtattgatatcatcctctatatttttatctctctctggagagcttataatttatttgattaataaatttattccttatttttcttcctaccacttcttttcaaaattaaagactttaagtaacttacccaagatcactcagctagtaagtagcagagggaagagtctgtccaaatctgtctacttccagttccatgctataactaccatgcaatgctgcttttgttatcttatttaaccattaccaaccattttgtggggtattatcatcattaatttatacatgtgaaaaccgagagtgagcaagattaagtaagttgtctaataatccccttaaaagagaagatataggattcaaatccaattttatgtaagtaccaaatccatacactttctaccactctggggaaactgagatgagaccacctggcaaacttcttcattcacctgagtctcattatgtttttccactcatttcttctcctccttgtcttcaaggaagacatagtctttctctctcatcattttctttctctctctttatctctctctctttctttctctctctcttatctcccctttgtttctttcttttttgaaaaaaatttgaggaatgtctcactctgtcacccaggctgagtgcagttgtgcaatgatggctcactgcagccttgacctccccaactcaggtgatcttcccaactcagcctccgcagtaactggaatcacaggtgtgtgccaccccacccagctagtttttgtaatttttgtagagatggggtttcaccatgttgcccaggctggtctcaaactcctgagttcaggcaatccacctgccttgacctcccacagtgctggaattataggtgtaagccactgtgcccagtgttcccctttattttcaaggctatcttctcctcatcacaaaccccaagtactcttcaacttttccttccttacattctgagtctcttaaagagcctactctgtgccaggtactgtgctaggaattggtaatagaatggtgagcatccctgccctcctcacagggctcacatctcagaacttaacactattaaccaagaaaatcacaaaaatacgtaactacaatgtggatgtgttgtataaataaaaagagtagttagttaagcacagattgaccagacgtaagtctggacaattaaatgcagaatcaaaatggttaaaggcaaagtagggctaagcacagtggctcacgcctgtaatcccagcactttgggaggcacagatgagccaattgcttgagcccaggagttcaacatcagcctgggcaacatagtgaaacccgtttctacaaaaaatataaaagttagctgggcaaggtggcacatccctgtattcccagctacttgggaggctgaggtaggaggatcatttgagcctggcaaaccagtcattcacagaattcttagggagggatttagatccatagaacatggaattgaaagctacaggtaatcttgatgacaaagatgtagagaaaaggggaatccttgtatgctgctggtagaaatataaattgatacagctatcatgaaaaacagctggaggttccttaaaaaattgaaaatagaactatcatataatcagcaatcccactactgtgtatatatccaagggaaatgaaatcagtatatcaaagagatatatgtactctcatgttcactgcaccattattcataatagccaagatatggaatcaccctaaatgtctaccaatggccaaatggataaagaaaatgtagtatatatgcaatggaatactattcagcctttaaaaagaaaacaatctgcagggtgcaacgagtcatgcctataattgcaacattttgggaggctgaggtgggtggctggtggctggtttgagtccaggagttcaagaccagcctgggcaacatggcaaaatctcatctctacaaaacatacaaaaattagccaggcgtggtggcgcatgcctgtagttccagctactcgggagactgaggtgggagaattgcttgagcccaagaagtcgaggttgtggtgagctgtgagcatgctgctacactccagcctgggtgacagagcgagaccctgtcaaacaaacaaacaaacaacaacaacaacaaaaaaaaaaacagaaaattctgtcatttgcagcaagatggataagcctagaagacattatgttatgtgaaataagccatgcacagaaatacaaataccacatgatctcacttgtatgtaaaatccaaaagaatctaactcggacacagagtggagtggtggttaccaggggctagggggcagggacaggattcaggagatgctggtcaaaagattcaaaattttactttgacaggaggaataaatacaagaaatctattgcataacttggtaactatagttaataataatgtactgtgtacttgaaaattgctgagagtagatattaagtgttcttaccacaaaaaaataagtatgtgaggtagtgcatatgttagtttcatttagccactgcataatgtgtatgtatttcaaaacatcatgttatacaccacaaatatacataatttttattcactaatttaaaaaattttaaatgaactgctaaaaaacagtctggatgtgatcttatccagattttatgttatcaagtcttcctgaacaggcatcagcattataattatacagctagaagcagaaagactgaaacttgaaaacaagtcaaagagaagacaggtactttacatctgagtaaacaaaaaaactgcatcaaaggtagggaagggatctgtgaaaccaggagaatacatatttcattcatctataggagttttaaaaaatctgacactatgacggaatgattaaaattaaaataaattgcaaatatcaatattttaaaatacaaaagatgtataccacccacagaatggaagtatgagaaccaattcaaatagtgatgtggggaatgtcttatattaaatcatttaatggagaatatgtagtttacgtaggcattgctgatcatttttctttttggttgtagcctaaaggctatcttccagaaaataacttataaggattattttaatcaatatgacttacagtgaaagaaaactctatggcctctagaaacagaaataattgctacattttgagaagactgagatcatggctctacatgtatttgagtgaacaatgtgggatgaatctatatataatagcttgaaaaattgccagaatatatgataaaataaaaaacagaagtggcaggatgatatatataatgatatcatatatatttttaaaacgagcacacaacaacactttgtattttctctgagtgcatatgtgtatatgagagcctaggaaaaggtctaaaggaaacataccaataccatagcaattattattttggggggaggatgagacaagaacccaaactggggtagtaaagttttaattttttaataactaggcttcatttcatattacttataaaaatacaaagtaattaaaaattcaaattcttaaattttaaaaaagataattatggaccaaacgtttattactcttttagattcaagtattaatcaactaattattttggaatcaaatagacaaaatgctttctttgtttaccagaatgaatataatattatttttaaattaatcagttgcaagaatttcaattttattatgttaggtttacactgtttaaactattacaaatatgtttggctaatatatgtcttttaaaaaataaagacatcaagagagtgaaaaaacaagacacagactgggagacaatatttgtaaaaggcatatccgataaacgatattatccaaaacatatgaaggattcttaaaactcaactataaataaatagcctcatttttaaaaataggccaatgaccttaacagataattcacttaaacatatatacagatagaaaataagcatatgaaaataagcataagtcataagggagatgcaaagtaaaacagtaatgagataccactacacatctattagaatggccaaattccaggacactgacaacaccaaatgctggcaagaatgtggagtaataaaaactctaattcactgctgataggaatgcaaagtgataaagccactttgaaaaacagtttggcggtttcttacaaaattaaacatattgtcccactctcaccatttccacttaatatattcctggaagtcctagccagagcaattaagcaagaagaagaaataaaaggcatacaaatcaggaaaaaaagaagtaaaattttctctgtttgcagattatataatattatgtatagaaaacccaaagactcaaccaaaaacctattataactagtaaacaaatccaataaagttgcaggatacaaaaccaaagtacaaaaatcagttgcatttctgtatgctaacaacaaactatctgaaaaagaaagaaaacaatgcaatgtatattagcatcaaaaatataaaccacttagaaacaaatttaaccacagatttgaaagatctgtggttacattaaaaattacaaggcattgatgaaaaaaattgaagacacaaacaaatgaaaaagtaccctgatgttcatggattaaaataattagtactgttaaatgtctatattacccaaagtgatctatagagtcaaaacaatctatgtcaaaattctaacagtattcttcaaagaaatagaaaaaacaatcctaacattcatataaaaccacaaaagaccacaaatagccaaagcaatcttaagaacaaaactggagggatcacacttcctgatttcaaagtacattacaaagctatagcaatcaaaacagtatagtactagcataaaaacatacacaaacaccatttgaatagaattaagagcccaggaataaacccacacatatacagtcaactaatattctgtaaaagcacaatggggaaagaatagtctcttcaataaatggtgctgggaaaactgaatatttacagacaaaaataaaataaaattcgacccttatctacaccactcacaaaaattaacttgaaatggataaaagacataactgtaatgcctgaaactgtaaaactcctagaagaaaacatagggtaaaagattcttgacattggtctcaacaatgtctttttagatgacaccaaaagcacatgcaacaaaagcaaaaagatttaagtgggactacttataaaaatcttcttcttctgcaaaaaatcttctgcaaagcaaagcaaacaaccaaaaacatgaaaaggcaacacacagaaagaatgggagaaaatatttgtagaccatgtattcaataaggagttaatatctaaaatatagtaggaagtcataccactcaataacaatataataataataatccaattaaaaataagtaaaggcgctgaatatacatttctgaaaaagaaaacatacaaaaggccaatagtgcattaaaagatcttcaatagcactgatcatcaagggaaatgcaactcaaaaccacagtgagatattacctcacacctgttaggatggatattattaaaaagacaagagataatatttgagacgatgtggagaaaagggaacttttgcacactgctggtgggaatgtaaattgatacagtcataatgaaaaaaagtggggagattcctcaaaaattaaaaatacaactaccaaaagatctagcaattccacttctgaatttatatctgaaggaattaagtagcttgaaaagacatctgcactcccacattcattccatcattatcacaatagccaaaacatggcaactacctaagcatctgcagatgaatgaatgaataaagaaatggtcatatatatgtatatatacaaccacttacaatagaatagtattcagctataagaaatgaagaaaatcttgccatttgtggatgaacctggagggcattttgctaagtgaaataagccaaacacagaaagacaaatacaatatgataccacttatatgtaaaatcaaactgttttgattttacataaatcataaaaacagagtgaagcagcagttgccacagatgagagggtgtgggaaatggggagatgttgaccagtgggggcaaactttcagttataagataaataagttctggggatctaatgtacaacatagatggtaattggtatgttaattaatatgattggggtaatcattacacaatgcacatgtatatcaaatcatcacattgtgtacctttaatatataccttctttgtcaattgaatatttaaaattgttttaattcaaattttaaaaactaaacataattttcctaaaccttttaagtcggagtacctgtgcaggtttgttatataggtaaacttgtgtcatgagggtttgttttacagattattttgtcaccaggtattaagcctaatactcattcattattttcctgaacctctccctcctcccaccctccaccctctattaggcaccagtgcctgttgtttccctttatgtgttctcatcatttagctcccacttataaatgagagaatgcagtatttggttttctgttactgctccagtttgcttagaataatggcctccagctccatccatgttcctgcaaaggacataatctcactctttttatggctgcatagtattccatgatatatatgtatgagattttctttatccagcctatcattggtgggcatttagtttgattctatgtctttgctattgtgaatagtgccgcaatgaacatatgtgtgcatgtgtctttatgacagaacaatttatattcctttgggtcaaaatgaatttctgttttttaggtattgaggaattgacacactactttccacaatggttgaactaatttaggctcccactagctgtgtataagtgttccctttgctccacaacctcgccaacatctgttatttttttactttttaatactagcctttctgactggtgtgagatatctcattgtggttttgatttgcatttctctaagatcagtgatgctgagcttttttaaaactatgtttgttggctacatgtatgccttcttttgaaatgtgtctgttcatgtcctttgcccactttttaatggggttgtttgaaaaacaaactaaacatactttacaatataacccagcaattgcacttcttggtatttgcccaaagtagtcaaaaacatgtccacacaaaaaccttcacatggatgtttatagcagctttattcataattgccaaaacttggacgcaaccaagaggtcctttagtaggtaaatggataaactgtggtacatccagacaatggaatattactcagcactaaaaagaaatgagataccaaaccacaaaaagacatagaggaaacttaaatgcatattactacatgaaagaatccaatatgaaaatgctgcatcctatgtaattccaactacagtatatgacattctgaaaagggaaaaactatggagacagtaagaagtcagtggttgccagtagttagcaaggagggatggaggaacaggcagagaacagaggatttttaaagcagtaaaaatactctacatgatactaatggtggatgaattttattatacatttttccaagcccacagaacgtacaacaccaagagtgaactctaatataaactagggattgtgggtgataacaacgtgtcagtttagttcatcaattgtaacatttgggggatattgataatggggaggccatccatgtgtaggagcaggggatcagaacacaatgaggggaatctctgtaagtttctctcaattttgctgtgaatctaaaactgctctaaaataaagtcttaaaaataagaaaaaaattagtattacagaaaagtcttctagtctttaatactaaaaggctgaaagccttttatttaatactaatattccctataaggaatctgtactccatgaaaggttgctgattttatatcttaggatgggaagaatcaaaatgtgtctggaatatctggtggccactaaccaaaatcacttaaaattagcagggatgatagcaaaagaacaaaggagtccagtccatttaaaggggctcctactatttaattcctgataaattgagtattatttagacatattgagtctggggagccattaattcataatgctactcaaaaggtaaattatgaaaatgtttttactaatgaaataaatatggatacttatctttaagaaaattagaagaaaataaagacatatgatctaaaatagcagggctctcttattcagtggagctctggagtcagaaaaactgaacatgaattttggccccctactcacattgggaaagtggtttaagctgctgaagcctttattccatccctggtagaatgaggaaaataaaatctacacctaccatacaggactttacttaatgtagctttataacatgttttaatatcgggggcggggggcgggtaggctccacctcagtggtctccttgctaatgttattttttgcatttaaatgcactaccatctatacctgatgaataaagccatagacccatatgaaggaagcagcttttcctaaacagaacactccaatataccatacagatgtgtatcgttccaccaatatttattaatcatccaatatatttcagattctgaacaaggctgtgaccatgccttaccaggacatgtagaacttatacacagtcttaaacaagctgaagcacaaaatcaatattttggttggaaaaagttttctgtattttaataacatgatggaataaatgctattcatcattcacatactctatattctctgatgggattgacctgatttacactgaaaatactaaaaatcttacacctattctccaaagtgaaattgcctatcaaatgagatgcagctacaattataatcaagtaccaacattcttcacaaaaacacatgctatgcttcacgttgagagcagcagaaataataagcacacagcataagtaatgtttctcaagcaactatattatcaatcttcagaatgagtgataaaaatggaatgaaatttttccttatgattaccaatagaaaatgctattgagagagctcatagactcccttttgtctagtatatttcctgttttaatgcatttctacttaatctaaagaatagaagctttagatataaaaaaaattttaagaaggcaaaatgtgaacaataaactaaattagcaagatgatcaatacaaattatttatagtactttggtacattagtgtaatctacacatacaaatctaaatacatacttagctatagtaagtcaaagagtacataacttgcattttgttgtgtatcaattagcacaacagaaaaaaagaaaatattttagagatactcaatatacttatcaattaaatataatacatacagactcctttaaaaatcttgtaagtaatgaacatattacatttaaatggccctaatactgtaatgatggttaaaccagaacagtgataaaaatttcactcatctgatttcactcatttcacctaaggtagtaacgtcttctcctaggcatatttctgtcagttaagcaaaccagcctatgcacagcaccacacatcatgaattctttcagttttttatctttttatatcaataatatgataaactttgaaggattctcctactttcacaatctctgtataaaagaatagtaacataagcacctccaggaatctgttgattttgttgtgatattgaatattatattgaattaatcttaccataatattatagactgaggcaatatatattaatgaaagagtccttgtgtgattatctgtttggaaatatgtgtttacatgtttgtgttttacatggtctgtatttaaaatgtgtaaaaaatcctaaaaatatagacgcaatggtgattaacttattctgtctacattgaacttagagaaaatacagatgatttttatacacaataagattgtcattaaaactaaagtatatgccccaatatttttaagtatattaaatcttaatttctcagtaacatcatgtgtgtcccaccttctatgtccatgaggcttatgattccaagcctaaatgacaacaaatctgcaaaatttaaacaaacatttgaatagttcctgtcatttccgaggtttatgtcaattgttattcctgtggagttctcccagaaaacaattcatcgacaaagaagaaaagaaaaggtacacagggggcaagtggaaaaaataagtaatcccaattgtgctctatttctgtttgattctacctttcacttctgtctataatgatgtcctttgggagaaatagcaggttaagtacaagccctggattcatgggtgaattgtgcatagtagagcattaaaaaaaagtagctgatatggtgcagtcttaccttgcaactgtaaaattctcaaagtcatatctgctgtagaattccttaacaatgatgagtgtgaaaatgactgctgggtggtgacagtttctcaataacagcatccttcagatgttcttgatgtggtccctgaggtcttccccatattctctagagcactgctgtttaaggattgtgggtattctgaacattttgaaattacaaccaactaaagatgttcttggtatgaaaagagttaaaaatctgctcttttcctggagtttaatatccagttaaatagaaattaactcaaatgtttctaagtcattttccagttaactagggcttaagaaaaaaaaattgctgtagtcactgtgtttaaaattttactttaggacgtattagcctataagtgccacaaaatcatcattttggagtctacataaagctacattgtcttggtaagaaattgcaaagaaactgtattgactctaaagtacactctggagtactgcccaaaagagcaatctatgttgatgaaaattttctgtatctacaatggtcaacacagtagctactcaacatctgaaatttggatagtacaagtaagaaactgaatttttagtttatttaattatgattaatttaattttaaattgaaaagccacatgtgagtagtggctactatattgaacagcacagctcttaaagttgattttcactgtattttccatatgagattatgtcatgatatgttgtgatatcctttaggtatctaggtggttgatggttgattgattgtgattaaaagcactatttccctaagcaagtgggtatctttggagaaagcactggtggaggataaaagtttaagctgttgccagtcacgaaggtcttactttatcaggtccttttccctaacaactagttgagaatgagttagactaaaaaagaggcagctccagagaatatgagtcacagtgtggaaggacaagaagcaagtcttatgtggctaggatatagagatactgagcatcagtgggaagacagggaaaagatactctgagaaaaaagaattctgagaaggaaaatggaaaggacaatcaaaggcaacattcatctatttcacagtttaattcattctgctctgttttatatccttctctttttattaatgaaggatgttgctggtgctgttctcatagggtgtcgatgcaagactgaaaatgtcagtccctggcttaatatcctttccaaattgagaagacctgtagaaaaaatcaactgttcgtgcattttacactgtttggatctttttgctttgctagttatgtaatgacatacacaaaagttggtcagaaaaatgttaaaccaacatcattccttctgctatgctttgatatttatagtctttaaagtttttaccaaagagccttattttttcccttggtgctttatcaatatgatttacatttttcatcctattaaggaacaagaacatgtgcaatataaggaggagggggagatggaggaggagaaaggaaggagagaaagaggagggagatgtaaaaaaaataaggtaaagggggaagggaaagagaaaaggggatggaaggagagttgagaaggggactgacaggatagaagaggaggaactgggaaaagagagaaagtgacaaaaaaagaaagtgaaagtaaagaaacagtttgctaaacactcttgtgtcattcacactgcaagtaataaaaccaatacgcttctgtgtttcatgattcaagagaacatttaagtgataaagggataactgtggaggtacctgacaactttgccaaataaaaatccagctttcatcactatagaaaattttaaatggctacaagttttttttgtttttcctttttgttgttgttgttgttgtttttccagatggagtttcgctctgttgcccaggctggaatgcagtggcgcattcttggctctctgcaacctccgcctcccgagttcaagcgattcttcttcctgagcctcccaagtagctgggactacaggcgcatgccaccacgcctggctaattttttgtatttttagtagagacagggtttcaccgtgttagccaggatggtctcaatctcctgacctcatattccacccacctcggcctcccaaagtgctgggattacagacgtgaaggtttttgtatttttataaagtgcaggtgttcagcatgtcccttcctgaactttacaatattcacatagctttggcaaatgggatgcaaaacaacattcagaatgaaattaatgttgaaagagtagtatcatctacataactagactatttttcaagtagatattgacgttatgcagtgggatgtgctattaaagagcataaactatatcctttaaatttaacaatacataattccatcaagaaaaatcccatcactgaacaccgctccagacttttcttatcaggatattataaaacactagttaactactacgaataccaagcaaaagtatggtaagaatactttgccccttttctttgcagacaggaaaaagcaattgaatatgaaggccaaaatctctgagaaggagtgctttatctagagagacaagcaggggcacatatcacaatagcgaacaggagagatatattgggtcctgatgaaaactaatataggaagaaattggctgaattttttctgtaccctgtatgagaaatgattaaatttaaagggtttttaaattaacttacttgtgaccttgcctgctattccatatttgaagatctggtggggggaaagtatgtagaaacttcaaaatatgctcaggaatgcatgaataaaaaaatagaaattcttactattgataaaaagagaagagaatccaacttctcaatttaaggggacttttaaaataaagaaaggcagtttaatactccctaaagaaggcataaaattcctatagaaccaagattcttggttgatactgcctctgcatcagcaccaaaaattatccctctaaacatcggtggttccaaggaggctccttggtaaattgtagcctgcctgaatgaggtaaagtgatcccatctccaaatcaacccataccaggaaggccaggaataggagtctgtatcaagtcaaaattctttaatgccttcccatgctcaagccatgacctgcaaagatgcccacaagtcatataccaggtagacaatactgctcagcctactgccctttcctcattaactccctaaagcccaaaagacagtcacgcatgcacttttctttccgtttcacaaaaacaactgtaatgtgaacaccatacacattataccttgttacaaatattttaagccctatatttaagttagaaatattaagacttagaaattcctaagtattagaaaatatcaactaaaacagactattctcactatcttcagtttgatgtgtctcagtatgtgtttcctcctgttttttcatcaaagggtcaattgaccccaacggatgctctctctgtctctgggtcactcatctgtttggctgtatctatttattacattgcttcatccatcaccggagttcctactctgcattgggcctccctccctgtccataagactgactcaacactcacatgactaagatagtaatgtgaggaaaaaaatattgtcagactcattctaggcattgaagaagcaagccactatgcctgttagagacagcatggtttccacgtgaaacaaataggattagtctacctcctataatgcaactacctttttcaaaactcatggatattgtcaggctgcttaacaaatataacctccagcagctgcagagcagatccatgcatctgtacagtacatgtttgcacatactccttttccatctgcaggacatgacatatgccaattgattggcttatagtaggcttggagaggagtcagagtattggcaggcaccttatgtctattcttttttttttattatttttttattattatactttaagttttagggtacatgtgctttccattttttccttttactctgaagcttttagacattgctcttttggatcctgcctaccaaattattcatttaacttcaagtgttcatttgtggctaacgaagctgagatttttgttaacatataacttgcatttagtccaaactgattagatgtcaataatcaacctaaattatcaggctttactttaattgcaattatatcctccatttcacatgtttaaaggtgagttcttatcaggtgatgggaactaagcagagtccaagtcaacctgaaagaaaccaaaagattcatccacgatcagctacgtgatttggaaggctcagtgcaatgtggaagtataaggtaccttgttcaaaatatattcagaattttaatatagcaacctcaggtaattaaaccaaatatgagatccttccatctgtgagacacacccatgaagagagccctggatttgtcaaagaaaacataagacatttttgccatttcttttaaatgttaatcacgcttatgataaaaactaatatgttggcaatattttcttcaaagtcaatagtatcttcatcaaaaatttctttttagaatttacaaagacttctttttccttttcgattggtctcagaaaacaagctttgaggttctattcataacataaagttcaattcagtttcaaaaaataattgcccgatacccttcttgcctttccaaatcttactgtaaatacaaaagtatgaaaataaagcctgtaaattatagatccatggctagatttggaaaaccctaaatcttaaacttagcagtgaacacctgacagtaacaaaagccataagcgctcactctaggaacagcatggccactgaacaatgttctccataataaagccataatcaacaccctacaaagcaaaatactatactatgatccacactactaaccatattttatcaaactgtatcttaaaacaaggaactctacaacttactaccctccatctcttgataaaagtaaaaacagattcctctaaattaaagctggaattcgcaagaccaaactaataaaaactaataaaaattatgttttactaatttttaatgtaagaattaataattctcataggctacttctcttttcttgatttcaccttactctgagaacatgtctaaaataaacatcattccattttgaacgaagtgctttatccaacagaccgatcatgctagacagaaagtttgcaccaggtggtagaaaaaaaagaaaactgtaatatcactttacatagtaaatgtaaccttccaaaacaaatttttattatattattatgatggtacctacagccatataaaaagggaactctggacatatctgctttaaaaaaaagctagataatcttctgaacttggaataattttaaccaacattctttaaggaatacttatggaaataattaattgcttattttagtttacataccatgtatacttgtgttaaaatgatttacctcctaaaactaactccaaaaaaaggtatttgaatactcagaagcttgtatctctttctttttggctgtctcccttgttccatttcctatcttacttctcccaattcagtttatcctctgatatggtttgactgtgtccccacccaaatctcaccttgaattgtaataatccccatgtgtcaaggacagggccaagtgaagataaatgaatcatgggggcagtttcccccatactgttctcctggtagtgaataagtctcacgagatctgatggttttataaaagggagttcccgtgaacacgctctcttgcctggcaccatgtaagaagtaactttgctcctcattcgccttccaccatgattgtgaggcctccctagccatgtggaactgtgaatcaattaaacctctttcctctataaattatccagtctcaggtatgtctttattaacagtgtgagaacagactaatacgccctcctactgaagatatgatgtcaccattcttccaagcatagatccattggatatctaagctatcttgggccacttccagtcactacaactgtcagttcttttttcatacctatccctctcctttccattccaactcctttacattgggtttttattacactttacctgaaatattataaaaatatcttgatttttcttgcttccattaaaccatgcaaaataatctacacatcattactgattaatcttccacaatacctgtttgattgtcccttccatgacaaaatattcctcattaacaaagtccaaatttcttagcttggcattcaatatggttcctcaaaatctggtttccaagccagattatcttctcacctgttgcagatactgtaatacggtattaatgagcttgggctggaaattcccatttcattactacagaaaaggtgtagtgatgttacctgcaggagtaattgagggagttccaagtcttgtgactgctggaatatggctggtaatacagaaaaggagtgatattagccctctctttaaaagaagaaaatatgaacttaggaattcaacttcctaagaaggaaatgggcttttattagaaggaagtgataaagcaaatctcttagacctaaaagtatttttttcccagatatgtactatgaaatgtcttgattcctgctgatatggtttggatacgcacgtccccaccccaaatctcatgtcaaaatgtaaccactaatgttggaggaggggcttggcgggaggtgattagatcatggaggcagagttctcatgaatggtttagcaccatctccccttggtactgtagagtgagtgagttttcatgagatctgcttgtttgaaagtgtatggcacctccccccctctctcttcctcctgctccagccatgtaagacatacctatttccccttcaccttccaccacgattgaaagtttcctgaggctgcccagaagctctcgtgcttcctgtacagcctgcagaactgtaagccaattaaacctgttttctttataaatttcccagtcgcaggtattcatagcagtgcaagaacagactaatacagctactaataagaaagctgaatttatgggatctaaaacaaagtatgttgatctactgattaatcaaactgacatgacagtccggaaacgacccaatgggttcttcctgcccactgcacaaagccaattcactaagaccacagcattgcaataaagattttaatagacacaaggtcagctatgccatgtgagagatggagttattaccaaattaatctccttgaaaattcagaggctagggtttttcaaggatagtttggtgggacaaggagtcagtttgggtggggccacatgacagatgggcaggggtagactgtcctcagaaatgtaaaaacctgaaaagatatctcaaaaggccaatcttaggctcgctctgtaatagtgatgttatctgcaggagtaattgcgggagttgcaaatcttgtgacctccagaataatggctggtaattgtttatgtctacaccttagcagaattcaggatcctcatctcttcgtaacctggtggtcttttattagctttacaaaggcagtttagtttgggggaagggttattaacatttaaactataaactaaatttctcccaaagttagcttggccctggcccagaataattaagggcagtttggaggttaaaggcaagatgggggttggttatatcagatctcttttatgtcataattttctcatgttttattttttgcaaagtcggtttcagtcccaagtaagaccaactttaattctgttctgctattcatccttaatggtgtgttcctgtatgaaggttttctggcagataaggggcctcttactagtaaataattttatttagttcttatttacccaccaaaattgcaaactctcatatatttataggcatcagagttttgtaaacccccttttagataactgtgaaaagtcattaaacattctatcaaaatctcccatccttcaaggcctagctcaatttcctttccataaagacttccctgtttgcttcttgctaggttacaggaggcttgagaacagagtgaagtgtggattcaacaaacatttatagaacaggtactgtgctaacaatttacccctcagttatactcacacttgtatatacagaacaatctctggactaaaacaccaaaaaatggtttaaaatacttgtttctgaggaaaaggtaaggataaatacagatcttaaaagaagcaaaatataattttcctagggaaaaaagggagagacacgttaccatttactttagaaaacttgtcatggtgagtctttctctgccctttgaaacgtatgtaaatcttcttaaaagtgaaataagcttctcgccagcttttcaacccaaggatgaaaagaatcttgggagaatgtctttctcaagaacctggaaaccatctcttttaaatataatcatcaaagaacgtagtgtccctatctcccagtttctgtgggaaggcaggagcctaactttggtgggtgcctggctccaagttacaaacttgtcttctgtcaaaaagatataaaaagttcctttggataaaggcaattagtgaacagagacagttattcaaattaccaggtgagtttaggatgaactatgtatgtaaatggtactgtcaagtcctcttacttgaggaatagttatcatttatcttgagaacatgtatctaatgggttgtgtctcctaagctatataaaacattgagatttctttatgtctctgcatttctttagctgattgcctgtggtatatatcacattctggtttaatgcttatcaattataaaattgttttcctttgtgaagggtatcctgggttggcaggatatattgttttaaattatatttccccaaaactcactggagattactgtatcatttaaatatgtaaatgtgcaaatgttttaacttctcaataaaatgaaaggaaccaattaagaaactaaagaataaggagggaaattgtggaagaagaagggaaaggaagaaaagagggagggaggaagaaaaacaaagaacaggctattagcaaaaactcaacaaaaagcacttccacttagggaagaaaagaccttcaaaaaaaaaaaaattaagagtttccaacaggactctagaatcaggcttctagagcctgcacctgattctagaatctagattctagaatctagaatcaggactctagaattcagtctctactgaacatattgtctgcgaagtaattaaaggggagaacaatcaagccaatatcccataaaaactaaaaccccttctcaaaacaactcacgcctgtaatcccagcactttgggaggctgaggcagatggattacttgaggtcaggcgttcgagaccagctaagccaacatggtgaaaccccgtctctactaaaaatacgaaaattagctgggcgtggtggcaggcgcctgtaataccagctactcaggaggatgaggcaggagaatcactggaactcgggaggcggaggttgcagtgagccgagatcgcaccattgcactccagcctgggtgacaagagtgagagttcatctcataacaaaacaaaacaaaaattgtaatgcataaaaataacagatacaattttaaatggaaatcaattccattgacagatataattttttagtcattatattaacatgaaataataagatctagcagtcagcctaataactctcataattcagacatagtgataagcatacatgacataatgtggtatgaaaatatctgtaatttctataggtgacaaagtcttaggtatcttatgcactgtggtttgtatttaataatattaataactaaagtgataaatttcagatagaactttataaaataaagaactatttatttttctcatccaagtccacagacaccctgaattctacatatgaatccccatgaactgtagcttaagaacctctgtgggaattgtaacagaactcaggatgagttctgctaccagaaaaactaggcaagtctaccacaagagacaagaagcttcttctccaagaagataaactatttgctttccatgttctaaagggccacctacatctccatgttgccctccctccagtatagcgacttgacctagcattcctagaatcagaaccttacaatcttacaaacctgcaagattacccgaatactcagtctaactgaaaaatatacagcagctaataatactgtataatctagattaatggtttggaacatttagtgtgcttaaggatcacctgggaaggctcgtctttgaaaatgattcatgacctcatcatcagagtatgtctaaatttgggaacagaaatcttcacttttaactagcacccaaagtgattcttgtgcaagtggttaatcaccaaacatttgagaaacatcaacagaattagagtccccaaactcaacaaacagaagaacttaaggaaacataattagtataattaatattctaaaagagattcaaatgtttatcatagctataagaacagccaggccaggcgcggtggctcatgcctgtaatcctagcacttttggaggctgaggtgggtggatcacgaggtcaggagtccaagaccagcctggccaagatggtgaaaccacgtctctactaaaaacacacacacaaaaaaaattagctgggcctggtggcaggcgcctgtaatctcagctactcgggaagctgaggcagagacttgcttgaacccaggaggcagaggttgcagtgagccgagatcgtgccactgcactccagcctgggtgacagagcaagactctgtctcaaaaaaaaaaaaaaaaatagccacagaaaacaccactggtattcttggaaatttaaaatggtattgcaaaaataaaaactagacagttgaagacttaaagagcggaatgaaaatagctaacatcaaaatcagtgaccagaaaagaaagccaaaaattctcacagaatgaaaaggatatgcaaagtatgagacaaaaattaaaagccacaagactcatccagacagaccaacattcatcttaataagagttttagaagagaaaagaaaatgtgtctctgcctagaaaagcgtctggaaaatatataccaagtccttaattgcagttatcactggcaataagaattgaattgaggtgaagtgaaaagagacattaacttttttcttaatttccataattgtataattattttacaagaataaattcatgtattccttatgaaattaattaatctagacatgaataaaattattgtcaaagatacaccaggaaaatgctaataaaaaggaagccaagaatatcaatattaataccagacaaattgaatcagagtagacactattaaaataaagaggaacattttataataataaaaggtaccttccaccaggaagtcataggagtcaagaaaacttctaaatctaataatataagggtattgttattttttgttgttgttgttgttgttgttaagacagagtctcactctgtcaccaggctggagtccagtggcacgattttggctcactgcaacctctgcctcctgagttccagagattatcttgcctcagcttcccaagtagctggttttacaggcacacgccaccgtgtccagctaatttttgtatttttagtagagacggggtttcactatgttggccaggctggtctcgacctcctaacctcaggtgatccacccgccttggcctcacaaagtgctgggattataagcatgagccaccgcacgggcctaatataagtttttaaatgtatggaacaaaataccactagaaatacaaggagaaaatggtattttgctgtaatgtgaaagacttcaactaacctctctcaaacaggtgaaacagaaaacagaagtaagaatgaagacactttatttattacaattacgaacttttaaaacttcctcccaaagagagaatacacaattttttcaaatatgtataaatacaactttcaaaacatgaattaagccacaaaaaatttcagtgttcccccaaaaaaattccaaacattttccaaaataaaacctatattttctgaccaaaattcagtaaaactagaaattaattttaaaggatgacaaaaataaacaaaaaacaattttaaaacaccaaaaaccaattttaacatttttaaaacacacttctagtagtataaggcaaagaaaaaaaaactaagttaaaactaacacctattttttaaaatacagataaaagtactgcttattaaacataggtgttcagaggaaaactgacaccatgaatgagtttacaaaagaaaaaaaccaagtaagaaaaacagaaaaagagagactaaaaattaactcaataaatatattcaagatattataaaagatcagcaaattaacctaagaaattagaaaatataagttaataaaaataaaagcaggccaggcacggtggctcaagcctgtaatcccagcactttgggagagcaaagcaggcagatcacaaggtcgggagatcgacaccatcctggctaacatggtaaaaccctgtctctactaaaaatacaaaaaattagccaggcatgatggcatgcacctgtagtcccagctactctggaggctgaggcaggagaattgcttgaacctgggaggcagagattgcagtgagctgagattgtgtcactgcactccaggccaggtgacagactgagactccatctcaaaataaaaataaaaataaaagcagaatctagtaaataattaaatagtagtcttaattgctaaaaagaaaattctttacagagaagaaaataaaaattcagatttttaaaattcaaactaaaaaaaagaagacacatgttcctaatgtcattcatctattgcctcttttttgtacacatctgtggaatacaacctgatgctttgatatatgtatgcactgaggaatgactgaatcaagctaattaacatgtccatcatcccacatacttttttgtggtgactcttttattgaggttttctttgcagcctttgctccatttttgtggatccattttggatccatttttccatagctatttgaaagatatgcgtcctctgttgcatgtgaagttctatacatgaaatcaactttccatactgcatatgggggggggctcaataaaaaataataaataaaaataaaaactgttctattttgaggtcctctataaatttcaatcagtagtcagtgtgaattatccactcctattacacaatcccttcatcagctctcatatttatttttccttcatgccttttctcattttgcagtgctcacaagtatggtccctagttaacgctaaactaaccctaaaactaaacatcatcaaggaatcggcatccaagaaagcccgacctgtgtcatgtgagtgaggatctaaaggaagagttgtgctagcttttattgcttgatttatggtattcttatctcctgaatatgcaatttttaggattggaggctttttatttttacttattttctagctcccattaagcacatgacaatgtggaaatagagaacaagtacctaataaatactgatgattaactgatggtcatgagactcatgatacaaacattttataagaatttgtttttaaaaacttgctgtggattcattttggttttttcaagttttggagaaaaaaaaaaaaacattactataactggctgccagagttttctccaagcttgacatcgggtccatataacagcaaaccttgaacacgatctataatgccatgtacatcatggggtctaagagtcccaagaagccaagagcaaacaaggtctaatactcattactatccatgtgttttatttaatcatcaagataaaggagatgttgtccttcttttattgggtaaatatttattagatgcattaaaacctcacactaggttctgaaatatcaacaattcattgctttttcaataaatatgtttaaagcaattactatgtacctggcaacttgctaggcggtgacaatataaatatgaataaggcattattcctctactcatataattcatccaatagcaaagacagatgcataaacaaataaatgtattaaactcaagacctaattgtattccaacagtctccatcatttgtcacaagagcattatttggaaagagtaattgttgggagggctcacgaaatatgtgttcaagttataactcttctaattcctgtttatttgactttgtacaagttacacaacctcacagaagagtagtttgctcctctataaagtacacaataactcctgacctatgtgctctatgaagcaatttgatactattaataaaatgtgcagataaacaccctaaatagtacaaatgtaagatgctagtaccttaaatttgtattaagccagtacctagcacaagggttcacacagacattaattacacagaaaatagatttaataaatatttgttaaatataaacagtacattgttgtagcacttattctcagatttaccacccattttaacacactttattcaatttcattattaactacctcaaacataagagaatgtatgaataaagaataataatataacacacattcatctaccaacccagcttctgaaaaacaatatgctcagtagctttaaagctcctgatgtgtgtatgcaacctctttctccccactcctccactcctcaatattgcataaatcattctcttccttctctttatatcttaccagacatgtctgtaacactagaaatgtgttgtttagttttgcttgtgtgagcctttatataaaagtaaaaatgctgtatgaattcttatacggcttgctcttttatggtaaagctttttgttttggtatcattcatattgacatgtattactataatttactcatttttattcattatggcctcatgtctaagtttaaagggagtgtttttaattactcaaatttaactatgaagtttactgtagaattttacagaaaccctttatcaagaaaactcacttctgttcctagctttctagaagttttaaataaattatattgaatttttcaaatgttttctgtatctactgagattattatatagtttttctcttctaacttgttaatgaggtgaataccatcagtaaatgttctaatgttgaactaacattacattcctggaataaattcaactttgtcataatgacttttttatctagtgctaaacagtttattcacattttgtttgcaatttttgcatctaatttcataaattagattggcatgtgaatttccttacttatctgacctgtgtagcatcgtttcacacttgcttcaccaatttcatataatggattgagagctactttgtttgtttgtttgtttgctattctcaggacactgctgtagaaatacatttacatattcctggaagggtttatagtattctatcaaactatctgagcctcctatttgctttcagtaaaaactgttaactactaattctatttaattatttcattcagattgtctatacttgagtcaattttgttaatttatattttcttaggaatttttccatttcatccaaattttcatttttatcagtataaatttgtttataatattcttttagtgttttagtatttataatatttagtatttagtcataaccctgtagttatgactcctcttctgactttcactcttacatgctgttttttgtctgctttcagtattcttaatttatctcaccagcagtttgtcaattttattggtctttacaaataatacacttttggctttgttgaacttctctactgtatctttgtttgtgatttaattaatttctattcttatctttattaattttttccttctgggttttttatattgtctgtttcaaactccaagtggaaacttagctccttaacatccagctttcttctttcctaatataagcatgtataggtgagaaatttccttctatgtactccctttagctatatcgctcaagttttgttgttattatacattatcattatttctcagttataagtattttttactttcaattataatttattcatgacccagtagttatacagatatggttttcaaaaaagattccaaatagtagggtaatttcacttatttacctaaatacatttctaggtggcctgtataatactagtgctttgaaaatcatgactcagtatgctgtcaatttttgttaattttccatgtgtcctcgaaaagaatgtgttacaacctcctggtgaatttatcctatcagtagatagtaactgtcattagcatttttactagtattgatatagctataccagctttcttcagttagaatttgttggatatcgttttatcctttgactttcaaactatcttgattcttaagtgttagatgtgtttttataaacagcatatagctagatttcgttttatattctaagctgtcagtcttttgtctttggagagtttaggtttcctttttacatttattatgattccaagattatttggatttattttattatgttttctactgtgtgtacatccttctttttccacagtgttttttcctccatttttttcttcttttggacaaactgagtttcttattttctcattgcatttctccttttccatatttggcaattatacagtctatgactacacatttttagtagttactatagacattttaacatgcttattaagataaatgcctaatataagtcaatatttttatccttccccaaaaaatatataaagaccctagaacatttaactatgattctatccatcctaattatacactgtgtttccagacacaatcattctacaattttaattatacaaagtatacatagttattaatcatttataaaaagtaatatgtaagcagtaataaatccttatgtttaccatttcctctgcttacaaattcttgcatttgcacccttaagataggataatttttttatttttctttaacaatttcttcagtgaaaagttgttgacaataaactattcatgtttgggactgggtaaaaatatatttatcttttttcttgaaaaacagctgtatcatgtattgaactcaaggttaacagttattttctctgagaatgatttactatcttgtaacattcatgtttaagaactcggctatcattcacagataatcagtcatcattcataggtaactcttttttttcctattttcttttaaaaatattcttttggtctttggcgttcttcagtttcactatgatacgtgtaaatataggtttctttaaagacaccttgcttgggatttactgggcttcttagctatagagaatggtgacttccatcagttctaggaaattctcattatctgttttatacttctctctcttctgaattgtatattataatattttagaacttgtcatggcatgtatcttaactgcttttcaaaaaatactttttacttctgtgtctttctgtgggaaactcaaagtaacctcttcaaatatctttcagatcaccaattctctaacctaatcacctgttttgcctaaccattgaatttttcatcattatatttttcattttagatagctctgcctggtcaattttgacagtcttttgtttcttcaacatattcattagggaataatgtatattaaaatacttttttcagtaccttataatttcaatatctacagtgtttgcagacctgattctgtagtttgttcattctatgaagttactcaagatggcttatttgtgtgtcttgtgaaaaccatcttccttggaaccgtatgagaattttttgaaagctgtgtataaagtgcagaaagaatctgagtttccttctggcagatctctggaggtattgccaggataaggcaattttaaactagatttttggatggggttttagaggctacacagataatatgaatgctgacccaaagtccagataaggacaggcctatggctagaaaattccaacatggattctgttccttttttctgagcttcccagagccaaggctatgctagtcaaaagttctcccaacatctcctgctattcgggttagtgttattttcatttctccaacaaggtggtcaaattttaaagattcccagtaacatgcaaatgtatcttacgggactttccagttggcaggatacagaatttatcttttgtcttcagttcacagtctttcaagattcaagctccaggccataattgaaaagcagctaccccatcccccagcataatgctggtgttggctcactagtttggattttgtgctttttgtatcagcctcaaataatttccataattcagttatcagattatttatgtatataaaaatattttcttcatctcttttagttcttatagttcactatatatctagaaaccaaaccattttttaaaatcatattaatgtgcttctagataacagtgatatctatttcttctttagcttctaaatgctaatctgactaacagagatcctgttttctcctaacaggtgaaaatgtaagaacatgaggagtatcttccccaaaattattacccttagtaaaagacagagtatcttggaagtaacagggaactctgactaaggctggacagctgctgagagaagagaatatatataaagttttttctctttgtgctgccttaccacagaaaggattctgagcagtgtatcacttacatgtgcttctggtagtttccatcactataaattcatggcctggttaaaagttaaagtagagccatatacccccaaatacatccactttcagtcggaggaaggagaaaaaaataagggtaaggaaaaaatgcttttcactgcaaaatcacaaaatggcatgccgtattattgcattcattcattcatgcattcattgatatttacctagcacttactacatttagggcattattctaggtgctggagatataacagtaaacaatgactgtatgaatgatgatacatgaatatgtaaaaaagttaaaaaaagtgaatatgacagctctctaaaaataagaaaatatacatacatatcatttgttatcatctttattgcatgggaattcagattagttcttgtgtaccacaatgacaacagctgctttttccctcctcacaggagacaatatgtcttaatggacttggaattttcaaagcaatttttattggtgaagtttcttgcttcataacattttcaaaattctcttaatctacaattcagcacttctcagctctcattcagccacaaatacagaagaaaacccctataattcacactggcctttccaataaatcaattgatttagccagtatagtgttccaattcaacttctattttctccactcataaatttcaggtttcatactcacacccagccaagggccagaatgaaaaatttaacaaaagcttcagcatggttgttgagtaagcactctgatacattccacactataaacatttaatgagacttactcccaacagagtatttactacatcaatttacttcatagtattatatttgcaggagcaaaatagagcaaaggttattttggatcctttaccaatacagcttcctgtaaataatgaaaagtgcaaccatttaatttaccaaatcattaaaaaaggttaaatgctcaataaattctgctttatctagttcagtcagccacagcagctatttgtaacttggatataaaaaatatagaaaacttaggcattttttactagtttgtgcatctgtacctttgactagaactaaatttcaaaggttgttcagacagtttagaatcctcattaggatctcagagaaatatcttttggaccccttcccgcctcatgaagaacaactgagtctgcctttcttaagagaacactgttgccctgcctatgcccactcccactgaagttacacacataacacgcacactttctcctcctctccaaccactgccattttgtgcctgtggcagtcactttcaactaaaaagagaaaagagaagaggtctcagaaggaggaacaatttggaaatgtcttcttctttaatcctaaaatacagaatgcattgtctgagataaactggagctcttatgggagcattctctgacacaattgtgttttagtactgtgaaaaatgtgctatacaggttgagcgttgctaatctaaaaatctgaaatccaaaatgctccaaaatctaaaactttctgaatgccaatgtgatggcactagggaaaaattcagcatctaacttcatgtgacaggtcgcagttaaaatgcagtcaaaacatcatttcatgcacaaaatttttaaaatgttgtataaaattaccttcaggctatgtgtatagggtatatatgaaatataaatgaatttcatgtttacacatcaatcccattcccaagataattcattaggtatatgcaaatattccaaaatccaaaaaattccaaaatccaaaccacttctggtcccaagcatttcagataagggatgctcaacccgtatgatcctatctatctactctaacaaatttcaatgtatcacactcggcactccccagatacagactacagatggtccctgacttgatttaacaatggttcaacttataattttttccagctttatcatggtgcaaaagtaatacatattcagtgtgtatatagagtgtttcaggcccctaaaggtcatacccttcccagggtagagtaacctgcatccagtgactgaaagagacatacaggcctggccatttctgcctgacaaggtacactctggagggcaatgctctcaccagagctccctgctgattggcctaggctttgcgggtctagctgtcaggtagacttcttcctctatccagtcccgctccttccctctttccttcccaaatgtaacaccttgttttccaaactccattctgtgtgtgattctggaggacccagcctacaacactagccatgactccttcctttcattcatgtcccacatccattctatcaaaattcagttgactctatttacaaaatttagcactgatgtccaccaacaccactctagtctaaactaaaacatgaggtggttcatgtaaagtgtataaatggaacctgggttactacaatagcctccagcctggtttttcagttcctctcattgttctccttcagtctatgttccttatgcaactatcatagtccttttaagacacgagtcgcagcatgtcacacctttgcttaaaacctttcagtgtattcccatttaacttggagtaaaagccaaagtccttaaaggcatacacactcctaaatggttggttctccaaccttagctcctgctactcatcactttgctgtcttcacctagacaccctggtttttatgttgtcacttaaacacagggcacataccttcaagcctttgctctagatcttcatctgcccgattcctgaactctttcaaggctttggcattatctcaccttctcagtgtaacatctatacaattttgttctctacagtgtttattggttttattttttgcctataatcacctgctaaaatgtaaaaatttgtcaagggaagtgatcagatatgtcccaagcacatagaacagtaatgccaataagtatttgtggagtgaataaatcttatgcttcataagtagatctacataaaacaaagtcatcatttcgatctaattaacaatcccacttcaaattcattggattccttggcagagatgtacaggagtcagaagtttactaacagagtactttcctgttaatcaattctttggaagactcaagaaggtgatagagactaatctggattttttattttctcatgctctaaacgccaacatgtggatcttcttctgttttattattattattactgtattaggacatcagatcacactttatctttctcccgacttacctccagctcatcaagggcacttcccagggttgctgcctgaggttctggtggggttgtcatattctggatcccttgtgaagcatttgaaattacattgagagcattctgaatttcttcacaaactgtgtccttgcttgctttgagggaagcaacatcagaatgctccaaacaagctgaacaaattgaatgcaagaggggagagttctccttcagtgaagctcgggctcctgcaatttcatctctctgatttggagattttaagtcctgagaaggtaaataaaaagagtggtatcttacaatgggttatgggagaaagacttaaattaaaaagcttctttttttgtaagtataaatgaaaagataatagacatgaagaagtcagctataagttataatcaagggcatctattatttctacattctttcagtttctgttaaaaattctgcagtataaacaatgacacagttaataagtaaaggtccccgtagagcagatgtgtaaagatccattactattcagtcaagtccttgtcagtcaaatccttataagtagctaaaatactctggcattcacattattaagtgcattacatgggagcttgaattacaaggatgctgattacctcattccatagatgttgataattgcatttaacctctccgttaaaattagaccaattgagttaagaacactaatgaaacctcccaccattcagctatttttctttttcagaaatactaataaattaatcctatatcattctttctttgatatttattcaacaattagttactgagcacttagcatattctagcccttgtgctggactccagtgtacagatatgaaaaaatcctacaaggaccttgttcttctttcttttggggggaaagggcctacagacaaacaatgaactagatgaacaaatatacgagatgatttcaggtgacaataaatgctatgaagaaaacacaaaagtgaagtgtcatagagattgacttgaaaggaaaagctgctttaggctgaatggtccgagaaggtatttcttcagagatgacaatttgcagtaaatgtaaatgaatagcattacatcagagagaagagaggaaagagaatgccctgtctaagtgataggcgatcagaactagctcaatatacaagaaaaaaatctggcaagccctaccttaaccaagtgatgaaatttaacataatcagtgatatcacatggatatcatgtaccccttgatatactgtgacaggaaaagtatgccatttctgtggtattccctccaggaacccataattccagtctaatcatgagaaaagcaacaaacaaaatgagattggtgaacatcctaaatgacacctgggcagtattcctcaagaccattaacatcatggaaaacaggagatggactgacaagctgtcacagaacagagaagattggggagacataactaaatgcagtgtggtactgaggattagatcctggaacagaaaaaacattcatgaaaaactgctgaaatccaaataaccattattaatagttaatagcaatgcatcagtatccatttctttgtagtggcaaatgtaagatacagcattaacaatggagaaaactggaaaaaaggtaaatgggaactctctgtaccacctttgcaacttttctgtaaatctaaaattactcccaaataaaagcttaagttaaaaaaaactaattcaagggacatttacaatagttcattcacttcatatacaacatttcatataatctttataaaaactcatgagagatgtgattattcccattttaaaactcaaaacactaaggtttcaagagactaagtttcttagccaagtggcagagctagatggtggtatttcttgtattgtaacccacgtcagtataacttccaagcccttatcctaaaaactatgtgacattatttcctacataggaaaaatttttttcttttttctttttttatgacagagtcgcgctctgtcgccgaggctggagtacagtggcgcgatctaggctcactgcaagctccgcctcctgggtttatgcagttctcctgcctcggcctcctgagtagctgagactacaggcacccaccaccacacccagctaattttttgtatttttaatagggacggggtttcatcatgctagccaggatggtctcgatcttctgaccttgtgatccgcccgcctcggcctcccaaagtggaaaaatttcttatttgctacacagaatgaggacttgtatttgtataatatcatgtagcttataaagtgcttctatacagtatcttactgatcatgacaatagtctttgagggaatgaggctgctattattagtcctattttaactaaacaggtgtttggtgcaaggagatagaaactagtaaaggaacagagatctaaacctaagtctactgattgctaaccttatgccttttcacaagactctgctactctgggaataatgttgcatgaggttaataaatggcttgtgctactatatttttagttccttcccttctgaaaataaacactgtctgctacttcactcaggctttggagagattaacttcgttacaaaatgtagggaggacagttagaagtagctatcaacccactgttcatagtcactaatcacccaagaaaagacactatggttttcttggcttgctacgatttcccccttgtatatgtggtctgggttttagttttagttctgtcattagcactgtgagctaggtaactcatctctttcggtgtctgtctttctatctgtaaaaatgggataatgatacttctgccgaccctctcacaagattgagtacatagcacatcagaaatggaatataagtggaaaatagagaaaaggtgtagaaagaatacggaattgttttattccttacatctgtcaaacttggtgtactgtttctgtactgataatcttagtgatttttgtatttcccacaacgttgtacaagctctacctacagtcatcagtgtaacttagaggataaatagtttaatgtttagaaaggatgcacagctcctcagatgagtaataattaaaagtataaatatttagaaaaaggtaaggcaaattctctgatattactgtacaatcacaacttaatacataattctctctgaagtgacctatacattatgcttctttatttagaaggacagtgtcaaggtttagtttgtttctgaaaggtgaaaaacttgaacatagattataatcaagaagctaaagttaaaattatttcttttgctctaatggtagcaatgtgtaatctgatggtaaattgtagtaactttaatgccatggggactttgaaatgttaaaaatacaaatgtattttgaatttggagcctatgctttgtcatctctgcccaaggcaattacagaatccatgagcccaaatagcaagtccttgacgcctgcgaaaaaggactagatcagtgaacataacaaatataacgttacagcagtggacaggggcaaaggggcaggtggcagagtttatgtaaggaaaactgacaaggcatgaccatttctcccaaaggacatcaagcatgataaacttaatgtagtaaataggcacacagataaaagagaaattaatgactgtcacctcctaaatgtatgttgtggtagtggtgtttgtagttgttttattttaactgatgataccataggttcaaaggttcttgtttgtccatttaccctaaaattttacataaagtcaaaataggcattaaacagtaaagttaatcagggatttctttggatggagaagtataaagaattcagctcctcaaggattgatacttatttataatctttttttaaatgctccagaagaaagctcacaggagatttccaagttaagaagacattaaatgtttccagctgacgaagaaacacacagatgggatttaaaaagaccttaaagtctgtgcaagtgggtagagaagtaacatatgagttttaaccctggcaagagaacaaaatatatttaggaatattattttaaaaaatacaagtggagggctttaagctatcagttaattaattcaaccattccttcaacctgtactatgttgagcctctcctatgctgagcctcgactttgcatcaaggcagtgtgctaaatgttggaaatgcaaagataaagatcaggaggggagacaaataaacacatttacatgggaactaaaatagagttacccacagcatagaggacagtctctcagtttgaagggattaaataaaatttctcagagaatgtgaatcttttttccagctttattgaggtacaattaacaaataaaaattgtgtagattcaaggtgtactatatgatgctttcatatacatatacattgtgtaatgattactacaatcatattaatcaatatatccatcaccacacagttaccctttgcgtttgtgtgtatgtgctgtgagaacatgtaagatctattctcttagcaaatttcaagtaagcaatacattattattaactgtcttcaccatgctgtgagttaggtccctagaacttactcatcttataattgaaagtgtataccctttgaccaatatgtccccgtttcccccacatgccaacccctggcaactatggtaaaactgcttctatgagtttgacttgtttagattccacatataaatacaatcatacaatatttatctttctgtgccgggcttatttgacttagcataatgtccttcaggttcatccaagttgtcataagtggtgggatttcagagaaggtgaatcttaaacagtgagtagaagttatccctatgagggaggacccacagaccctttgaaggaagcggactgctcctgcaaaatctgggagacaccacaaatactgtgagtgccccaactgcggaagtgggaaagggagagcctcctctcctgaatacacaaccccactggggcaaatgaaggtctgtttgcgggagaagtttctgaccttacctggagctgagtcaatttaaagagccaagcaaaaaaaaatatagagaggaagcagcagaaagtccctaggagctcgctgggtccccagtcaggccattcctgcctggcatcacagggatccactgggagggcagccagagaagcaggggttgggggagggggaagcaccacagggagaaggaaaattccagctgaacttcgtaacaatttgaacagggtgagaagcctcatggccagaacttgagggagggtgtgaatccagcatgcagactccacagcgtgggggaagaaccaggccgttttcatttgaaggtggcaggcaggtagcctggggcaagttctcaagcccagcttgcccaccacctggaaacagacttggggctgtttgggggcacggtgggagtgagaccagccctttggtttgcctgggagctgggtgaggcctgtgatggccagctttcccccacttccctgacaacctggatgactcaggagaggcagccataatcttcttaggtgcacaactccattgacctgggaatctcactcccaccccctacagcagccacagcaagacccacccaaggacagtctcagctcagacacgcctagctctgtccctatttgatggtccttccctatccaccctggtagctgaagacaaagggcatataatcttggtagttctaggacctgcacgctgccagttcctctccatactaccacagctgatgctctctacaaaaccccatctcctggcaggaggccaaccagcacaaaaatagagcattaaaccaccaaagctaagaaccctcacggagtccactgcaccccgctgccacctccaccagaacaggaactggtatccacagctgagagagccatatatggttcacatcacaggactctgtgcagataacccacagtaccaacccagagcagggtagacttgctgggtggctagacccagaagagagacaacagtcattgcagttcggctcacaggaagccacacccataggaaaagcgggagagtactacatcaagggaacaccccttgggacaaaagaatctgaaaaacagccttcagccctagaccttccctctaacagagcctacacaaataagaaggaaccagaaaaaaaaatctggtaatatgacaaaacaaggctctttagcacccccaaaaagcacactacctcaccagcaatggatccaaaccaagaagaaatccctgttttacctgaaaaagaattcaggaggttagttattaagctaatcagggagggaccagagaaaggtgaaacctaatgcaaggaaatccaaaaaacaatacaagaagtgaagggagaaatattcaaggagatagatagcttaaagaaaaaacaaccacaaattcaggaaacattggacacactttagtaatgcaagaagctctggaaagtctcaggaatagaactgaacaagtagaagaaagaaatccagagctcaaagacaggtcttcaaattaacccaatccaacaaagacaaagaaaaaagaataagaaaatatgaacaaagcctccaagaagtctaggattatgttaaacgaccaaacctaagaataattgatgttctggaggaaggggagaatcctaaaaccttggaaaacatatttaggggaataatcaaggaaaacttccccagccttgctagagacctagacatccaattacaagaaacacaaagaacacctggaaaattcagcctgaacagatcgtctcctagacacattgtcatcaggttatccgaagttaagatgaaggaaagaatcttaagagctgtgagacagaagcaccaggtaacctacaaaggaaaacctgtcatattaacagcagatttctcaccagaaaccctacaagtaagaagcaattgggaccctatcttcagccttgtcaaacaaaacaattatcagccaagaattttgtatccagtgaaactaagcatcatatatgaaggaaagatacagtctttttcagacaaacaaatgctaagagaatttaccattaccaagccaccactacaacaactgctaataagaagctctaaaccttgaaacaaatcctagaaacacatcaaaacagaacctctttaaagcagaaatcatacaggacctataaaacaaaactacaagttaaaaagcaaaaacaaaaaaccaaagtacatagacaacaaagagcatgatgaatgcaatggtacctcacatctcaatactaacacagaatgtaaatggcttaaatgctcgacttaaaagatacagaaccacagaatgcagaagaactcaccaaccaaccatctgctgccttcagaagactcacctaacatgtaaagactcacataaacttaaaggggtggaaaaaggtatttcatgcaaatggacaccaaaagcaagcaaaggtagctttttttttcttttttttttttttgagatggagttttgctcttgttgcccaggatggagtgcaatggcgcaatctcagctcaccacaacctctgcctcccagtttcaagcgattctcctgcctcagcctcccaagtagctaggattacatgcctgcaccaccatgcccggctaattttgtatttttagtagagccagggtttctccatgttggtcaggttggtcttgaactcccaacctcaggtgatctgcccgccttggcctcccaaagtgctgggattaaaggcctgagccaccatgcctggccaaaggggtagctattcttatatcagacaaaacaaacttaaagcaacagcagccaaaagagacaaagagggacattatataatgataaaaggccttgtccaacaggacaatatcacaatcctaaacatatatgcaacactggagctcccaaatttataaaacaattactaatagatctacgcaatgagatagcaacacaataatagtgggggacttcaatactctactgacagcactagacaagtcatcaagacaaaaagtcaacaaaggaacaattgatttaaattataccttggaacaaatgaacttaacagatatatacagaacatttcatccaacaaccacaaaatacacattttattcaacagcacatggaactttctccaagacagactatatgataggccataaaatgagcctcaataaatttaagaaaattgaaattatatcaagcactctctcagaccacagtgggaaaaaaactggaaatcaactccaaaaggaaccttcaaaaccatgcaaacacatggaaattaaataacgtgctcctgaattagcattgggtcaaaaatgaaatcaagatggaaatttaaaaattcttcgaactgaacaaaaacctctgggatacagcaaaggcggtgctaagaggaaagttcacagccctaaacacctacaccaaaaagactgaaaaagcacaaactgacactctacggctatacctcaaggaactagagaaacaagaacaaaccaaacccaaacccagcagaagaaaggaaataaccaagatcagagcagaactaaatgaaatcgaaacaaaatgaaaacagatgataaatgaaacaaaaagttagtttttttgaaaagataaataaaattggttagcaagactaaccaagaaaagacaagcgaaaatccaaataacctcattaagaaacaggagataggccaagcacagtggctcacgccggtaatcccagcactttgggagactgaggcgggcagattacaaggtcaggagtttgagaccagtttggccaacatggtaaaaccccatctctaccaaaaatacaaaaattagcagggcgtggtggcaggcacctgtaatcccagctacttgggaggctgaggcaggagaatcgcttgaaaccggaaggtggaagttgcagtgggctgagatcgtgccactgcactccagcctgggcaacaagagtgaaactccatctcaaaaaaaaaatagaaagaaacaggagatattacaactgataccactgaaatacaaaagatcattcaaggctactgtgaacacctttatgcagataaactagaaacctagaaaagatggataaattcctggaaaaatacaaccctcctagcttaaatcggtaagaattagataccctgaacagaccaataacaagcagcgagattgaaatagtaattaataaattaccaacaaaaaaatccaggaccagatggactcacagcagaattcttccagacattcaaagaattagtaccaacccttttgacactattccacaagatagagaaagaaggaaccctccctaattcactctatgaagccagcatcaccctagcaccagaaccaggaaaggacataaacaaaaaagaaaattatggaccgagatccctgatgaatatagatgctaaaatccttaacaaaatactggctaactgaaaccaaaaacatatcaaaaagataatccaccatgctcaagtgggtttcataccagggatgcagggatggtttaacatatgcaagtcaataaatgtgatacaccacataaacagaattaaaaacaaaaatcacatgatcatctcaatagatgcagaaaaagcatttgacaaaatccaggatccatttataattaaaatatcaggaaaatcggcatacaagggacatacctcaatggaataaaagccatctatgataaacccacagtcaacattatactgaatggggaaaagttgaaagcattccctctgagaactggaacaagacaaggatggccattctcaccactcctctgcaacatagtactggaagtcctagccagagcaatcagacaagagaaagaaataaagggcatccaaattggtaaagaggaagtcaagctgtcactatttactgatgatatgatcgtttaccttgaaaaccctaaatactcctccagaaaggtcctagaacgatacaagaattcagcaaattttccagataaaagattaatatacacaaatcagtagctcttctatacaccaacagtgaccaagtggagaatcaaatcaagaactcaacaccttttacaattgctgcaaaaaataaaataaaataaaatacctaggaatatacctaacaaaggagtcgaaagacctctacaaggaaaactacaaaacactgctgaaagaaatcacagacaaaacaaatggaaacacatcccatgctcatggatgggtagaatcaatattgtgaaaataaccatgctgccaaaagcaatctacaaatttaatgcaatccccatcaaaatactaccatcattcttcacaggattagaaaaagcaattctaaaattcatatggaaccaaaaaagaacctgcatagccaaagcaagactaagcaaaaagaacaaatctggaggtatcacaccacctgatttcaaactatactataaggccatagacatgaaaacagagtggtactggtataaaaataggcacatagaccaatggaacagaatagagaacccagaaataaacccaaatacttaaagccaactcatctttcacaaagcaaacaaaaacacaaagtgaggaaaggacacccttttcaacaaatggtgctgggataactgactagccacatgcaggagaatgaaactgaatcctcatctctcaccttatacaaaaatcaactcaagatggattaaggacttaaatctaagacctgaaattataaaaactctatacgataacattggcttaggcaaagatttcatcaccaagaacccaaaagcaaatacaaagataaacagttgggacttaattaaactaaagagcttttgcatggcaaaaggaacagtgagcagaataaacagacaatccacagaatgggagaaaatcttcacaatccgtaatctgacaaaggactaatatccagaatctacaatgaactcaaacaaatcaataagaaaaaaacaaaaatcccatcaaaaagtgggctaaggacatgaatagacaatgctcaaaagaagatatacagagaagccaagatagctgaataggaacagctcggtctacagctcccagcttgagcgacgcagaagacaggtgatttctgcatttccatctgaggtacagggttcatctcactagggaataccagacactgggcgcaggtcagtgtgtgcacacaccgtgcgcgagccgaagcagggtgaggcattgcctcactcgggaagcgcagggggtcagggagttccctttcctagtcaaagagaggggtgacagaccgcacctggaagatcgggtcactcccacccgaatactgcgcttttccgacgggcttaaaaaacggcgcaccaggagactgtgtcccgcacctggctgggagggtcctacgcccaccgagtctcgctgattgctagcacagcagtctgagatcaaactgcaaggcggcagcgaggctgggggaggggcgcccgccattgcccaggcctgcttaggtaaacaaagcagctgggaagctcaaactgggtggagcccaccacagctcaaggaggcctgcctgcctctgtaggctccacctctgggggcagcgcacagacaaacagaaagacagcagtaacctctgcagacttaaatgtccctgtctgacagctttgaagagagcagtggttctcccagcacgcagctggagatctgagaaccagcagactgcctcctcaagtgggtccctcacccttgaccccagagcagcctaactgggaggcaacccctagcaggggcagactgacacctcacagggccgggtactccaacagacctgcagctgagggtcctgtctgttagaaggaaaactaacaaacagaaaggacatccacaccaaaaacccatctgtacatgaccatcatcaaagaccagaagtagataaaaccacaaagatgtggaaaaaacagagcagaaaaattggaaactctaaaaagcagagcacctctcctcctccaaaggaacacagttcctcaccagcaacagaacaaagctggacggagaatgagagaagaaggcttcagacgatcaacttactccgagctacaggaggacattcaaaccaaaggcaaagaagttgaaaactttgaaaaaaatttagaagaatgtataaccacaagaaccaatacagagaagtgcttaaaggagttgatggagctgaaaaccaaggctcaagaactacgtgaagaatgcagaagcctcaggagccgatgcgatcaactggaagaaagggtatcagcaatggaagatgaaatgaatgaaatgaagtgagaagggaagtttagacaaaaaagaataaaaagaaacgagcaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagacactcctcgagaagagcaactccaagacacataattgtcagattcaccaaagttaaaatgaaggaaaaaatgttaagggcagccagagacaaagcttgggttaccctcaaagggaagcccatcagactaacagcggatctctcagcagaaactctacaagccagaagagagtgggggccaatattcaacattcttaaagaaaagaattttcaacccagaatttcatatccagccaaactaagcttcataagtgaaggagaaataaaatactttacagagaagcaaatcctgagagattttgtcaccaccagacctgccctaaaagagctcctgaaggaagcactaaacatggaaggaacaactggtaccagccactgcaaaatcatgccaaaatgtaaagaccatcgagactaggaaaaaactgcatcaactaacgagcaaaataaccagctaacatcataatgacaggatcaaattcacacataacaatattaactttaaatgtaaatggactaaatgctccaattaaaagacacagactggcaaattggataaagaatcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataacggtaaagggatcaattcaacaagaagagctaactatcctaaatatatatgcacccaatacaggagcacccagattcgtaaagcaagtcctgagtgacctacaaagagacttagactcccacacaataataatgcgagactttaacaccccactgtcaacattagacagatcaatgagacagaaagtcaacaaagatatccaggaattgaactcagctccgcaccaagcggacctaatagacatctacagaactctccaccccaaatcgacagaatatacatttttttcagcaccacaccacacctattccaaaattgaccacatacttggaagtaaagctctcctcagcaaatgtaaaagaacagaaattataacaaactatctctcagaccacagtgcaagcaaactagaactcaggattaagaatctcactcaaaaccactcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagacacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcatcactgatcccacagaaatagaaactaccatcagagaatactacaaacacctctacgctaataaactagaaaatctagaagaaacggataaattcctcgacacatacaccctcccaagactaaaccaggaagaagttgaatctctgaataggaccaataacaggagctgaaattgtggcaataatcaatagcttaccaaccaaaaagagtccaggaccagctggattcacagccgaattctacaagaggtacaaggaggaactggtaccattccttctgaaactattccaatcaatagaaaaagagggaatcctccctaactcattttatgaggccagcatcatcctgataccaaagccgggcagagacacaaccaaaagagagaattttagaccaatatccttgatgaacattgatgcaaaaatcctgaataaaatactgggaaaccaaatccagcagcacatcaaaaagcttatccaccatgatcaagtgggcttcatccctgggatgcaaagctggttcaatatacgcaaatcaataaatgtaatccagcatttaaacagaagcaaagacaaaaaccacatgattatctcaacagatgcagaaaaggcctttgacaaaattcaacaaccttcatgctaaaaactctcaataaattaggtattgatggggcgtatttcaaaataataagcactatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaagaaaagaggaagtcaaattgtccctgtttgcagatgacatgattgtatatctagaaaaccccattgtctcagcccagaatctccttaagctgataagcaacttcagcaaaatctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctactaatgactttcttcacagaattggaaaaaactattttaaagttcaaatggaaccaaaaaagagcccgcatcgccaaggcaatcctaagccaaaagaacaaagctggaggcatcacactacctgacttcaaactatactacaaggctacagtaaccaaaacagcatggtactggtaccaaaacagagatatagatcaatggaacagaacagaaccctcagaaataatgccacatatctacaactatctgatctttgacaaacctgagaaaaacaaacaatggggaaagtattccctatttaataaatgctgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtttaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaatctactcatctgacaaagggctaatatccagaatctacaatgaactcaaacacatttacaagaaaaaaacaaccccatcaaaaagtgggcgaaggacatgaacagactcttctcaaaagaagacatttatgcagccaaaaaacacatgaaaaaatgctcaccatcactggccatcagagaaatgcaaatcaaaaccacaatgagatatcatctcacaccagttagaatggcagtcattaaaaagtcaggaaacaacaggtgctggagaggatgtggagaaataggaacacttttacactgttggtgggactgtaaactagttcaaccattgtggaagtcactgtggcgattcctcagggatctagaactagaaataccatttgacccagccatcccattactgggtatatacccaaaggactataaatcatgctgctataaagacacatgcacaggtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagcaaactatcgcaagaagaaaaaacaaaacaccgcatattctcactcataggtgggaattgaacaatgagaacacatggacacaggaaggggaacatcacactctggggactgttgtggggtggggggggtggggagggatagcattgggagatatacctaatgctagatgacaagttagtgggtgtggcgcgccaacatggcacatgtatacatatgtaactaacctgcacattgtgcacatgtaccctaaaccttaaagtataataataataaataaaaaataaaaaaataaaaaaagaagatatacaaatggccaacaaacatatgaaaaaatgcacatcactaatgatcagggaaatgcaaatcaaaactacaaggcaataccaccttactcctgcaagaatagccataatcaaaaaataaataaaaaacagtagatgttggcatggatgcagtgatcagggaacatttctacactgctgatgggaatgtaaactagtacagccactatggaaaacagggtggatcttacttaaagagctaaaggtagaactaccatttgatccagcaatcccactactaggtatctaccccagaggaaaagaagtcattacatgaaaaagatacttacacacatatgtttacagcaggacaattcacaattggaaaattgtggaaccaacccaaatgcccatcaatcaatgagtggataaagaaactatggtgtatgtatatatatatatatatatatatatatatatatatatatatatatatacacacacaatggaatactactcagtcataaaaagaaatgaattaatagcatttgcagcgacctggatgagattggatactattattctaagtgaagtaactcaggaatggaaaaccaaacatcatgtgttctcactgatatgtgggagctaagctatgaggacacaaaggcataagaatgatataatggactttggggacttggggtggggaggtgtggaattgggggaagggataaaagactataaatatggcgcagtgtataccgctcagatgatgggtgcaccaaaattttacaagtcaccaccaaagaacttactctagtaaccaaataccacctattccccaataacttatggaaatttttttaaaaaattaaaattaaaaaattcaaacattgcctaagtataatagaaaaaaaaagaagctatccctatgagcaatgcagaacaaaagagcatgtggaaaggtctgaagcatgaaaaggcgaggaaggtgcaggtcactgcaggtgatatgacaaatacaggaaacctaagcatgaatggtgatgaatccagcagaaaaaggtaggcaagagacatttcacgtgctctgctaaagaactctgaaagcaacaagctcagatgtgtatttacaaagattgctctggcaatgggtttttgagtggattggagagaatgaaattgcagtcagagagaccaggcaataacccaggtctgggaaagagacaataagtgcctgaacactattgctaggctatagtgggagagatccaggaaatttttaggaggtacaaatggtaggattttggtatatctagatgggagtagggaagagaagatatttgaaagcatctagagaattgtttcagcaatcgtggaagtggtgatgcattcaccacaatgagaatacagagagaagaatgtacttggaagaaaaaggtgaacacattttgtaatctgccaaatgtaatatatcagcacaagatccaaatgaaaatacaatacacatgaatctagacttcagaggagagtctgggccagaaatagagatatgtgaaacaccagctcacagttgggagctaaagccatgtgtgtgaaggctacaggacctgcatccagggtgaatattacaataaggagaagaatctaggagtcatcgtaaattgttccttgagtatatcaacccagtaattttatgtgctagcccaaaaggccaaatatatatttatattagcaagaagggtatcagcaaatactaaactaaaaaaaaaaaaattcaattaaaaatatttttaaataggccagaaaacgcatgcaggctacagagttagaatctaaactactgtgggtaatcatggtcatcataccttaagataacaaatgatttttctttaaaagcaattttgaacagaatgacttctgtttctggaaagcttaaaaatatgaggtctgttcaccttggaaaggggaaatttttattggaaaacgcatgataaaaacatctgtaaatcatgaacgaacttgataacttgttaatgggcttctttacttaaatctggagatactaggtcatagaagtagctttttagatttgagtaaaataaattatatctgttcatacttctgtcttcactacttcattataattctcttgaatgcaagtactatggcttacttattttatacctcattatctagtagtatacagcacatattaggagtttaatacatttttgttaaggaaacagacaaatgaataagaattaagccagaggaagtcaatatgctcaaaaggagatagaaactccagatatgattactccaagaaataaaacatggggaaaatataccttaatccagagagtttgaataaatttatgcatggcaatgccacagaaagctgaagagcaaaattaaactataactatcttcacattaaatggtagtgaggccgttggtacgactactttggaaaatgatttgatagtatttactgaagctgagtatatgcatgccctgttacccagctatttcattcctaggagaggatacacacatatggaaatatgttcctatgtccatctaaagacacaggcaaaaatgttccataccagcactgtctgtaatagtcccgacctggacacaacccagagtaatgaaaaagaaaaaaagacagctacacgtgataaaaaaaaaaaaaaagcaagacataaaagagtatgtatggtttaattccatctatgtgaagttcatactcaggcaaaagtaacctatcattttaaaaatcaaaatagtggttattctttggggggtgattagagactaaacagggaggaggaatctttcagtttctggtaattttctatttcttgtcctgggtgctagttacaccaatgtgtttagtttggaaaaattcattgaactgtttatttcacactatgcatttttctgaatgtatgttatactttaattaaaaaagcttcacataaaatcaaggaaatgaaaaacaaaaagtaaagccaatatctacagtgtgagccttcttttggcaaaggacactggtataaactagctatggactggctatgttgtcatattacccatgtcattaagggaagaatgagaaaattagatattctgtccatctgtaagaatcctgtatccactttgagggctcatatttttaaaaaagaaaaaaaagtctgaaatataaaaataagaagagaaagctcctgtagcctgaccatcagaaaaagcaaacctaagaggttttcacagcaactgattccatgaaccgttggacaaacctgcatttctgagaatcaaagaaaacttccttacgaagctacattcctgcccacatggaatagctcagcatatactctgctcaacaaagcagagctacatacaaattactgagtttctcttccaggtgtttaaatgaggtttctgaagctgacaaaaccactctggtaagggaaggaaagggagcttataaaaagaggttttgtttgtttgagattaagatgtgcagcagaaaagcccatgtatactttgctatttggattccattatgggttggcttctgtctccagtcttctctctgccaagatgctgcataccaattgcttcactggtcattgggcagcttcatgttctattaggaaacaaaataacacaaacacctgctaatttaatgttcttggccaacttaaattaggaaatggaaacttagtcttaactgagctgaaggatataagatggtgaaacaacagtaggcttcaggtaaaagaaagttttgagaagaaaaattaaaattaaaaaaatgcaagattttacaataaaagcatcattaaggagcagagagaggcctttactacttttctatccttatttcccatttgtcatttcatagaaataggacagattcaataaaagagaaaataaaagaattcttcaaattcaaataggaaactgagaaaccatatcataatagtattaagatatctcccaaggtgtgcattctgggccattaatgcataccttgggtaactgaaatacaccaaggtgaatattaactccaaagaaacctatgaggaaaacattatcacttaattctaatgcggactactgtgtcagtcaagaaaatgtaggggggtgtgtgtgcacatgtgtgtgtgtgtaaagttcaaaaatgcactatgttcatttcctgttcatctgaagcaaatacaatatgtattacatttgtctattgtttgcttagaatttatatctcaaaataaatggtatctgaagccatctgccgcatgattaaaaagtaaaaggaatacacagaaaaacaaaaaagttatgggctattttagcaaaattcagtggctgtacttaatgcatcctttccattggtgcatatgtttcatcatttaatctatcaagaagagtcaaatatccataggtcagggccaggggtgatggctcatgcctacaatcccagcactttggaaggccgaggcaggtggatcacctgaggtcaggagttcaagaccagcctggccaacatggtgaaaccccatctctactaaaaaaatacaaaaattagttgggcatggtggtgtgcaccagtaatcccagctactcgggaggctgaggcataagaatcacttgaaccttggagacagaggttgcagtgagccaagatcatgccactgccctctagcctaggtgacagagtgagactgtttcaaaaaaaaaaaaatccataggtcagaaaatttttcctctaaagcataattaacaattataaaagtaaagttgaattttttaatttagtcaaaaatcaataaatatttttatccttgcaattccttcctatttaagttttcttgtgagaaacagaccacttgtttcctgaacattatggtgcatctcaaagagcaaacagaatcacttagatcaaatagggtccaaagcccagggatgttgacccaacttcctagttaataattcattacatttgtgtagtgatttattctgttcaacatatttccagccattcttccacaaggagttctatgagaaatcataaaaagcggtatcccttgttgtcaaaagaagaaatggacatttgtcaaaaggcacacacatattaataaaaagtggtgatggtgatttttttcagaaagccaacatttaccaagcagctatgatgcttcctatattcaagtactctctaatcactttctcatttaatggccccactaggaataggatccaagactggctcctgtctcaacactctttctactcgacactatttctatttgttgtcagtagctcccacatctgctcttaaagcctgtcaaaaaactctcctttaactctgcccatctgcggtgacccaatagagaatatatatttcaggcatatcttcctgacaaagaactgttgtaactaatacaactaagttagaaacattttcctgaattcagttttagaacaaggctgatacaaaaacctcaggtcaaaactacaagattaaaaattaaagtgtggtccataaggtcatttagaatgctcaaaaatataagtcagatatgtggagaaagaatgaaactaataagtataatcttgaatatttcaatctaactttgataaaggaaacattctaaatatggcatatttgtagactaatggttgattttcccacaggaaaaaagtgttttgctttttagtttaattcaaatagcttgaaatgcctgctataaggtgtgactttaaagctaagactacaaactcaaatgtttaagcaggaagcgtgaatagggcagatgaaagtaaatagggagtggtgaggccttggcacactatactgtatctgccccgatttaaacacattcagatccaattgaccaaaccaaaagaatccctgaatctaatatactagcacagatgtttctgtgagccttattaattcagtcaccatgctgtgcattcatgcaatatatgtgcctgaccttggaagacctcggaaagataggaaatgcatgtctccgggcctgatgagcctacaataagccaaaaggactgaatgaggagcaactccaaggcaggaagtctgcctcattttaatggaaatagcataagctttgaggttagaatcccagtgcaaaaacactccaatagcaggagatttcaggcagaataattaacctcacttcagctacaaaatgtgaacaattcctaccttttagggtattaatgaagttaaatgatttaatgtcaaagacttttccagcattttcttatttgatgtctctccatgcaacaaactattagccatattccctctttacaatatttctcccctgttttcttagatgacagcaacctaaatttaaactgagaggtgtttacctctcctctaagttccagctgcatatctcaagttgagtctcaaacatgtccgaagttgagcccattgtgtttcctacactcccactccccatgtttctctccagcattccatctgcatggccctaatattcagctgatcaaaaagaaacgtgaggaatatccgtgacttttccaacccccccaacccccaccattaggtaaggtctattattacactcattaactatttctccaatatacacccttgctctgttcctcactagtagcactagtctagaggagaaataattagggataaaattaaggaagtgcacgtgaacacaagggagatgagagactacagaaatatttagtaagacagaactttttgaccaatcttttctctgtcataccatcagaggaaactctttaaaacttaaatctggtcatcactcctccaatgtaaaattttctaatgatggttaatccacaaataagaaaactcatattttttgttatagacaagcatgcttctctggcttctctctctagtcttacttcctactactcctgtcacggtcactcttttctccagatacatagaatccatgaggttccactggtgcctttgcatgagctatgttccagtctcccctgcacctcctaggaaatgactattcatcttttaagtcatcgtggattcttacattctatcacacacagacttcactcatgtgccccctttatatggcactagtctagcagatattttaaactattactctttgctgtaactatttgttgacacgtctgtgtctctcaccaaatcatgagttcctcctgaggccaaaatgatgtcttcattcctccatccactaggccttgcataggaactagctgagagtaaccaatgaattgataacacctctcaccactttaaagtaatgagaaaaccttgagggtcactgccataaaataatttacttttccatgaaataaaaattgcacttttgtaaaaggaaatcacaactgcaaaaaagctcagatatgctcagtctagaatggaaatgttttttaatcttccctgactaggctaagtagatttgtttatgaactagtcttcaaagttttctggtctaagcctcttttaaaaaaccagtgatgatggtttttaatcacttataagaaggtgtgtctttcagaacctattgctttgactctcaggatgttctaaaatatacctaatttctaacacattccccaacagaaacaagactgagaagaatgcagataaagatgtctcacacttgacatgcttttcagaaagttaaattagtgctccctatgttaaccaataactagattcatctgatcgaggaaaacagaggtaacttaggttgataatcttgctaaatttcaggtattctgaaaaactgatttcaacaagtatttatatagtggaattgtgcttagagctgtgagaaaatagaaataccaagtaaaatcaagtacccagctctgcagtcctctgttcttcagaaattgttagataatgatatgctaaaataataaatttggctaaaattagtgaaatagataataattaccataggaattataaggaaagcatgaaaagcttaagaaatgcttcagagagaggaagatgcacatttctaaatgtaccacgtaaaagctagtccagaaaaccggtatgaaagtcagttggcttgctagtaggcatctcagacattctgtatcaaaatttgagctcctgatagtgcccctcagcccactattcttacggtatttaacagttcagttaacagcaattcttctaattgccagtgccaaacactttgttgtcatctttaagcttctccccttctctcatatcccacatccagtctgtcagaaaatcccatcagttttaccttcatttatgaaaaatgtgacctcttattacctctacaacttaccatgtcactgcttggctcagaccatcctatgtatctctgtgaccccactcccagtactctccttgcttaccctgaccagctccatggacctccttgctgcttatccaagaagccaggcacatccctacattaggccttcccacggccggcatgctcttctagatccatgactccctaacttctttcaagtctttcctcaaaaataaacttttcagtgagacctcccctggtcaccctgtctaaaagttcaatcaacaattccaacctcaatatgccatatttcccttccttgctttattttctctgtactatttgtcactaatatatactacatttatttatcatgtttgttttctgtcttctccagtggaacgtaagctccatgaaggtacataagaggtgataaatatttacttcatgaatgaatgaacagcaacccaaatcaagaattttcaattaatttgacatattttactgatcacacatgcaaaaagttatcctatcatatggcaataaaataccagagaattggccaggtgctagtggctcacgcctgtaatcccagtgctttgggaggccgaggcgggcggatcacgaagtcaagagattgagaccatcctggccaacattgtgaaaccccgtctctactaaaaatacaaaaattagctgggcatggtggcatgtacctgtagtcccagctactcaagaggctgaggcagaatttcttgaacctgggaagtggaggttgcagtgagccgagattgcaccactgcactccagcctgggtgacagtgcgagactctgtctccaaaaaaaaaaaaaaaaaaaccagagaattatctagttacaacagggaagacagataaagggcatacaaatagcataaacttcctgctcccttttggctctcattctagaggcaaatattagaacattcacctgcatatcttaggatttggttttgtattctacttaggtcatctttcatgtttgcgagaattcatatagaaagcttctgaacccaaaacacaatggctgctgttgaaaggtcaactgcgtatgactgccaattagatggcaagttgtatttaaaatccagatccctaattaataacgattttgccttactcaagaactgtacgcagagcatgaatcatctatatgcagagtattcactgtttagttgttgccaatttaaatattcatgtctctaggaatggcttcaatccaccctggtgcataaaataaattagcattcttgcactctagagagaagtatgtgtttagcaccaaatggaatcagcagatgactaaatactctttttttcctctcttgtttctatcataaatacaacagatgcaagatgctggaatgtggacaaccccagaaggttggtgtttgcctctaatgcagaaataaaccattcaaaaattcattccatatagcataccagagttagcaagagcccttgggttcctttattgccatcaagttgactttatgactaaacatatcacagcgacccccatagtacaaatgaagcataaggctacctttgctactaaacatcacggaatatcttataaatttacagcaatgataactgattcagagttactacagttcaacagtaaattttgagcattacccaaattcatgggacacttaaaggtatgagacatggatctttaaatgataagttactggagtacaactgttcctatattaaatagggaaaaattcctttctaggaagactcagctctcttcaatcacacctcttttacaagcagaatgcgcaaggaaaatggcaggacctcaacagttgtctaattgtccggcttatgttcctcaaggttctctagcttttgctatctcaatgtgagtggtactttcattctcatttttattcactatttgatgtgtaaggaatgcatactcagagacagtcaatttcagtaaaaaatacataaataaatcttcaaccacagctaaaatcataattaatagtgaaaaactgaatgccttcctccttaaaataaaaaactaaacaaggatgtcccctttcactagttctatccaacattgcactagttctagtcaaataatttaagaaagccaaagaaataaaaggcatacagattagaaaaggagaaataaaactacctctctttgcagatgccataatcttatgtgttaaaaatcctaaggagtacactccccgctgaaaacagtagagctaataaataagattgatacagttcgcaaaaggcaagatcaataggcaaaaatcagttgtacttatagacacttgctgtgaaaaatctcaaactgaaattaagaaaacaattccacttaaaatagcatcaaaacataaaaaacttagtaaaaaaatttaacaagagaaatacaagatgagtatattgaaaactacaaaacatcattgaaatgaattaggcaagacataaataaatttaaagacgttccatgtcatggattagaaaacagtatttttatgatgacattattccccaatttgaactataaatttaatgtaatttctatcaaaattccaactgtgtttttgcagatcctaaatgcaaaaatgaattttgtaatcctaaaattcatatgaaaatgtaagggactcagaatagccaaaattatcttgaaacaaagagcaatgttggaagaattcccctcatttgatcattacacattatatgcttgtatcaaaataccacctgaaccccaaaaatatgtacaactattatacaaacatatcaattaaacattaataattcttttaaaaagaattcccagtttcaaaacctactacaaaactataagacagtgtgttacaatcataaagacagacatatagatcaatgtaatagacatcagagtccaaaattaaatatttctatttattgtcaattgattttcaacaagggtatcatgacaattcaatacagaaaggatactcttttcaggcctcgtgcagtggctcacgcctgtaatcccaacactttgggaagctcacggcaggtggatcacttgagtccaggagttcaaaaccagcctgggcaacatggcaaaaccgtatcttaattaaaaatacaaagattagctgggtgtggtggcacgtgcctgtagtcctaactacttggggatgaaggtgggtgtggtatgcggcaggaggaccacctaagcttctgggtgttgaaactgcagtgagccctgattgtgtcactgcactccagcataggcaagagtgagaccctgtgtcaaagaaaaaaagaacaatcttttcaacaaatggtgctagggcaactggattcttttttcgtgttttttgtttttgtttttgttttgtttgtttgttttgagacaggatctcgcttagtcactaggctggagtgcaggtggcacaattttggctcactgtagcctggacctcctgggctcaggtgattctcccacctcagccccccaaagagctgggactacaggcatacaccaccacacttggctggtttttgcttttgtttttattttggtagagagacggggtttcaccatgcttcctaggctggtcgcaaactcctgggctcaagcgatctgccagcctcagcctcctgaaagtgctggaattacaggcatgagccaccacacctgagcaacaattggatatatacatgcaaaagaaaaaagctggactcctacctcacaccatacagaaaattaacaaaatggatcacagaccatttatgcctgtctcaacctatttatgcctagtgttccattattggaatgctaaggatgtgggagttatttatatcctactgctcaaggtcattgccaaggtctgattgcaaaaattcaaaaaattgcaacctcaggcataaatgggttttaatataagagctaaaactataaaacacttagaagaaaacataggagtaaatctttgtgattttggtttagatggcaatttattagatatgacaacaaaagcacaaacagcaaaagaaaagatagataaatcacatttcatgaaaactaaaaaattttgcttatcaaagagtactataaagtaaaaagacaatatacagaataatagaaaatttttgcaaattatatatatgatgtgtcatatatctggaatatataaagagctataaaaactcaataataaaacaattactcattaaaaaatgggcaaagagtctgcatagacattactccaaagacaatacagtcatcccacagtaccacagggtgttggttccaggaccctcatggaaaccaaaatctatgatcttcaagttcttaacataaaatggcataatatttacatacatcacatcctatcatacgctttaaatcatctctagattatagtaaatcctcatttaacatttttgattggttcttgggaactgtgactttaagcaaaacaatgtaacaaaatcaatttactataggctaattgatataaacaagggttaactttctaccgtatgtattaccgagcttgtaaataaagaccaaaacatttctaatattaaacattgaaataaatgtgagccacacatacatttaagaaagactaaggtaagtatttacccaattattatcattaaaggtggcaggtgacagagcctatcatggcagctccaggtgcaaggcaggaaccaaccctggacaggataccattccattgtacacagggctcagtcacacacatacccacactcattcatactgtgacaatttagattcaccagtttacctaacatgcacatctttaggatgtgggagaaaactggagacccagaaaaaacccacacagacatgggtagaacacgcatacttcacacagttagtggtcccagctaggtaccaacattggatgaaacaacattattggaggacctgctgtacttacaatacttaatacagtgtaaatgccatgtaaatagttgttatactgtatttttaatttgtattatctctattgttgcatttttattttttattcagattcagttgacccttgaacagcatgggtttgagctgcacaggtccacttacacagatttttttcaaccaaacatggatccaaaagacaggatttgtgggatatgaaatctaagtatacagagggccaacttttttttttttgagatggagtctcactctgtcacccaggctggagggcagtggcacggtctcagctcactgccacctccacctcccaggttcacgtcattctcctgcctcagcctcctgagtagctgggactacaggtgcctgccaccacgtctggctaattttttgtatttttagtagaaatggggtttcactgtgttagccaggatggtctcaatctcttgacctcatgatctgctcacctcggcctcccaaagtgctgggattacaggcatgagccaccgcgcccggccacagagggccaactttttatacacatgggttccgcagggcagatttcaagactcgagtacctgggtatacctgagggtcctggaactcatccctcatgtatacagagggatgcctgtatatttcagccactgttggttgaatctgtgaatgtggaaccagcgcatatggagggccatctctatacaaatagatcacatatgcatgaaagatattcaacatagtagccatcagagaaatgcaaataaaaccacagtgagttatcacttcacgcccactaagatggctatgataaaaatgcccataatcaataacacttgttggcaaggatgtggaggaaataaaactttcactcatttctaggctgactgtaaaatggtacagccactttggaaaatagcctggcagttcctcaaaatgttagtcatacatagaattatcataccacccagtaattcctctcttcagtatgaaatcaagagaaatgaaaacatatgtccacataaaaacttgtacatgaatgtttatggcagcattcttcataataaccaaaaagtagaaacaacctcaatgtccatcaactgatgaacaggtaagcaaaatagagtatatccacaaaacaaaatattatttgtcaatgaaaggggatatagtactgatacatgcaacaacgtggatgaatcttgaaaacattatgctaagtaaaagaagccaatcacaaaaggccacatggtatgagttagtttctatgaaatgtctctagaataggcaaatctatagagacaaaaagcagattagtggttatctgggggttgggggcaggagtgactgctaatgggtacagggttgcttttggaggtaaggaaaatgctctaaaattaggttatatattgattgtcatacatctctgtaactatactaaaaactattgaattgtataatttaaatagggaatgttatgatatgtgaattatgccttaatagagtggttagaaataaagacaaagacatacccatacatatgtcatcagaaagaggagtgaagaggcagcctgtcctaatagtaaaactcagacttgaaggatgctaatactttggcagctcagaaccaatgaggaagaagaggaagtcaagatcaagggacgggggttggaaaactgctggtttaaagcacttaaagaggccaggtcacgtttgtcaacagaaaataatctcaatataaattacagatagagccccttctagaatttgccatcgtatggtcaggtcacaacagtaaggaattcaagatttgaggaagagagggaggggcagtattaacgtaaacacagagagacatggtatccagcatcaggaaactattttccacaagatcatcactagtggcctcagatgtttagaaagagaatcaagacctgaggaggtggtggctcacacctgtaatcccagcactttgggaggccaaggcaggtgaatcacttgaggtcaggtgtttgagaccagcctggccaacacggtgaaactctgtctctaccaagaaacacaaaaattaaccgggcatggtggtgtgtgcccgaagtcccagctacttgggaggctgaggtgggagaatcgtttgaacccaggaggtggaggttgcagtgagcagagattgtgccactgccctctaacttgggcaacagagcaacagagtgaaacactgtctcaaaaaaaaaaaaaaaaaagacctaaggactaaggagtaaggtagctattacgtggagaattagaagctcatctactgtctgaggttgaaggaggcagtacagtcatcccccttatctgcaaaagatatgctccaagaccctcagtggatgcctaaaaccctggataataacaaaccctatatgtactgttttttcctatacatacatacctatgataaattttaatttataaattaggcacagtagaaatcagcaacaataactaataacaaaatagaacaagtataacaatgcactgtaataaaacttatgtgaatgtgttctctaactctttctgtctcaaaataccttatcatactgtactcacccttcttcttgtaatgatttgagtttatacgatgcccacaggatgacatgaagtgaggtgaattacataggcattgtgacataccgttaggctactattgccgtgtattcctgaatcatgtgtaaccatcccttacttgaaataaatggcttggtgtcacttgtttcaggagactccttgctgaaattctcaaataaactcaatgttttctggtgcaacatgctgtcaatcagaacacattttctgtttatgtctttcaccaacaaatttaatgcattttccatctaattaatcacttattatgcactgtatctgtaaagtttgcagtttgaggtatgacaaccaaactagaatttctttctccttcttcacaatttaatggatagaagattcattcttaccatagagcaacctcagcatacaattatttttttccttactaattcaagaaatttcaattttgcacttaaaggaataactttatgggttctctttggcatatcccaaccaccagcatcactactcttgtgctttggggccatgttaagcaaaataaggattacttacacacaaatgctgcaatactgtgatagtcaacctgataaccgagagggctactaagtgactaacgggcaagtagtatacagcatagatgtgctagaggaaaagatcattcacatctcagcaggactgagcaagagagcacaagatttcaaaatgttatgcagaacaatgtttaattcaaaactcacaaattatttatttctagatttttcatttaatattttcagatcacagttgactgtgggtaactgaaacctcagataaagggaaattactatatttttagaccatgcaagtagaaagatacaaggaaaatgtggagagttaaatagggctacaaggggttaatctatagttcaaagactaggatgtgggagatgagcgagatgatttaaatgttctctctctctctttccctctcctacacttaagtcaagtcctgggaatggcataagtatataatggaggccatcaggggattcaactgttgggagtagagaatgcagagtcaggaggtaaccggcaatgccaataccatgggagattgtagctgttccctgcagtttcctccaatgcagcaacaccaaaggaaatcataaatgaaaaacgatggtgatgatgaaccatgactggcagaacaaagcacaataccaaggccaaattctgggttttatgggcccaggaggcccagaaggtaatgcaatatgagggccactcaaatacccatagttccttcctgactggctattcagactcaggatccagtataccaggaatgaactacgaaaaatatgtactgtgtgtccactatataaacggcagtattctaggtgctttcccttccttctatgattcatgcatagagagagagattatttaaactgcaatacagttttcctttcttaccaatttattttcaactatatgctctaaatatttacaagttcctctgttgtccttttcaggatttaccatcttgctacctttcatatggaaaatactggcagaaaaaagaagacattcaaagttgggctcataaaagaaatgccccaaagtggcccccgagactcactttagttcaaactatgcagtgacttataaattaattagaaacatgaacaaattgcagctaagaaaagccccctaaaaaaagaaaagaggaagaagtaagagagagggataaataaaaactaacatgtatcaagtgtctgctatatagatggtaaggttcaaggtattttcccttccctgtgaagtgggaatcattatcaccattcttattgacaataacagaaacacagaaggatcataactcatccaaggtaataggattgctactacagatggcactggaacctaggtctttctgatctaaatctatactctgagcccaatgtaatgctacttctattaacaggtctctcaagctcactattctaatatcatcatgtacaacaaaataacattttagtcaacgacaaaccacatatacaatggtggtcctgtaagatcgtaatgtcgtatatttttaccttttctatgtttagatatgcttaagtaaataaacaccattgtgttacaatcccctgtagtatttagtaagtaacatgctgtacaggtttgtagcctagtagcaacaggctgtatcatgtaacgtaggtgggtagtaggctataccttctaggtttgtataagtacactctatgctgttttacaatgaaatcgcctaatgatgcatttctcacaagtatctacattggtaaatgatgcatgactgtttatcaaatgaaaggcctaaattttgaagtgtcactctaaaatttttgtgtgattgtttctatgctataaaaccacaataatttctggccgggcatggtggctcacgactgtaatcccagcactttgggaggctgaggcaggtggatcacctgagatcaggagttcaagaccagcctgaccaacagggagaaaccatgtctctactaaaaatacaaaattagccaggcatggcggtgtgcacctgtaatcccagctactcagggggctgaggcaggagaatcacttgaaccagggaggcagaggttgcagtgagctgagataatgccattgcactccagcctgggcaacaagagcaaaactccatctcaaaaataaataaataaataaataaattaattaattaatttaaaaaactacaataatttctaaaatctattacaactccaaaattctctaattgtatcttagtcaaataatatgcagaaggaaaattacacaacttaagattccaacaatcctgagacctatgtttcttctatgtattacataagcacagacgctaattggctctgtgtatagtgcttattactggtgcttactgctatacccgctttatagctattaaatactttaatccttctaataaccctatgaagcaaattattgtcttcattttataaagaaactgacatgcaaacatattaactgttcaagttaaaacactgataagcagtgaaggtgagatttaatccaaagtattttagctccagagcccatgtgtgtaactgctaggctgtcggactttccagtaagaactgaaaaccttctcctagaggttcacagtgttttagttttgtatacattttctcatttgatcccattatattgtgctcattacataaattaataatctaagaaaacaatggcttatttaatgtcattcagctatcaaccagcagaaaacactcttctaattcttgcaatacaccatgagatttttttcttagtgaattcttaccactgaaaaccagcaccaccagagaaataatcacttaaatataatagatatagagtatatataacagataaaagagacaataagaacagcagcaaaaaaaaaaggatttctctcctttaaaattcttagacccttaaattatattattttctctatcaccaaactggactagattacactaagacctttgaagcttagagatttaagacaattagctaaaccattaggaaaatattatttgccacacctttctcttgccttgctctttctttaatttggcataaatgcattttttctaactgcattgattgttcaccaaactaggaagcttgctcttgatgctagtgaagcaatgtcttattatcttgattgtataccaagattatgcttcagtctgaattgtttacttaataatttcactgccttaccgaatgccttcttttgatctgtcttgatgtccaaaaatattagggcattaaatttattttcattattaaaagaacaatatagactataaaaaccacatcgcttcagctcctttttgcataatatgatgggacacatgaatttgatcattaccagatggtttatctgaaagattacccaataaaaatgactgctttttccctaaagtctctttatccttacattcgattaaatgacataagatgggatgatctagattttcttagagtgaattatctgggaatttaacattgctttgaaaagtctctgagtgatgttagacatttatttcccaccaggaaggataaacagaacacaacataaaatattcaccctaagctttaattaaaatcatttaagatcaaaaagggaggtagcacagcaatacagggaggaaaactgcaaaaacttcagtatcatggacattaaaaatacccagtggtactttttttagtgaaatttttagaacaaaatcaatttaaatagttaagaaaaagtttagttaaataaaaaaaattaaaattgcaaaatgcaaactctgtttatgaatgtcttcctttaaataaaaaaatgcatctttgctaagattttatgcttatagaaacacttgcttactcataattcaaacatttcacgagtttccagctataaacatgtttataattttagaattctgatagcagataatcattttataactataaaacaatatcaaacaatagttatctaaatagtttcttgaatcatcatgtgatgtttacacagctgggcatttaagaccaatgtgtgagagataattgcatagctataattccgagcctgttgttttaagaacaagcaggctcttggggagataaagacagggtttgtgattttctaactcaaaaagtaatctggagaataaagtatgtaaagactcctagagtgcaatgctgaaagcacaaatttcagtttaaactaggaaaggcaaaagctaatgttttcattgccacattaattttctcacattatacctgagcagtgttcttgtttctaattatattcctacatgaatgccttattacatataatgtgggaaatattacagtgtgatatcttgtgtttcttggcttgtgcttcttttatatttataactttaatgttctacttagtgagattttgtatataataattatgctccagtacactgactctgctccacaaaacgcaagtacaaagttctcttaaacagcgggtggactagtgtttcgtgcatgtttttttggtcttgttttgtcttgcgtcatttttgttttggtttttttgacaagttggataagaaaaaccaaattttttctttaattaaaaacaataatggaaaataatattacagataatataaaatagaataaagaattgaggttttgtgtaaatttttgtgaatatatctgaaaggttttctgaaaaacatgaagtgttcaggtgtgacttccagaagctgaaaagcaatagctgtttagactctccttacatcatcacaaagtttaacaaaactgacttcttgcccaagagttcatgaaatcatttatactcccaacatttattaagggcctaatgtgtgtgtcagacaatctgccagtcacctgggtttcagattaacaaggataagtcctttccttgttccttctacatatgcaatccctcttcaaaaatctgcatttccttgctcatttcaacaatggttatcctttgtttgtttgtttgtttgtttgagatggagtctcactctgttgcccaggctggagagcagtggcttgattttggttcattgcaacctccgcctcccaggttccagcaattctcctgcctcagcctcccgagtagctgggactacaggtgcacaccaccacacctggctaatttttgtaattttagtagagatggagtttcaccatattggtcaggctggtcttgaattcctgacctcaggtaatccactcgccatgacctcccaaagtgctgcgattacaggtgtgagccacagtgcccggccacaatgatttttcttaaaagtacttgtcataatacccaaattttcttaaagtaacaatttatagttttccaaaagcgaacacctagagaactttcatggcactttgtttagccgacaactttgaaaattttattttattgtagtaagaacacaaaataagatctatctttcaactgtgattttttttacccttaagtgatgtctgctttattctatccctttccatgaaaactgaagccccaaaggttgaatgaatcttaaaaattagtcactttctcagtgtaaaaacattcattgtatcaatatgtaatttaaatatgctatttttcaagccaagtattgtttcagaattaaaggtgttcaaatattccctcaagaatatgtttgtccttcgtaccagagggcattggttctaggatccccactgataccagaattctcagatgctcaagtctcttatataaaatagcatagtatttgtagcaaacctacacacctcctctcatatcctttaaatcatctctagattacacataatacctaatataatgtaactactatgtaaataattgttgtactatattttttctttttattatttttattgttgcgttgtgctctttttccccacatattttcaacccacagttgattgaatctgcagataggaaaccagtggattcagagggacaactatattctccaaaacataatcttaaatgctcacattttagcttttaactacttactactacaacacaagttcccagtctgcagaacctaaacccattctgcggagtgaaacccaagataatcactctttaagtgtatctcttagttgtctctccatatttttatagattggagacatatctttacaacatcttttttatcagccttaaagctctgaacataaatctaaaacatcaaatctcaacactgaccctgaagttatataatgcaaaaacaaacaataaaaaaaaaagcatttagcattaaaagagctgaatacaatcttggctcacctactccccagtaagttaacaagacctgagctaatcatttacgcagaagcttggatcactttacagagtgaataatacttatcacaaggagagtttggaaagatgataataagataatatgcatgtgagagcacttacactgtaaaatatacgtccctgaggttgctgcctgctgcctacttcatgactatttttgcgccactttatgttcccgcttccttgcttctaactcccatgaccctctatgtttttgcctaattggcaaacatattctcagtttctcagctgcaggataccaggtgaccttgctctctgattctgcctcttttctactattagtcaaatgaagtagcttcataagtagcacaggcagtttcctgtaaagtgtaattgggatagtgttggaagggcccctttcccaaacacacctcctctactgttctgcctagggcatgtagtttcatcatcaaaatataattatcataccatatatactatatgttagtataatccattaccttggattaaagcacaatttcttcagcagtcctttactagatgccagtaccctaaagaataaactaatcaagtaacatgtatttgctcagcttattttatatacattagcgctgcgctaaataacaaatgaacccaataacggcatcgtttcctaaataagagccatcatctggagggagtgggaccacagaggttaggtgtttctcattcagcatgataatggagaaggaaagagtgggcaagaacctagcttctgaggaacagaaactcagaagatgctacactcggaagaggacccaaagtagccacagtgcagaatggaagtcttatgtatgaaaaggattcaaaacactatgacatttgctgttcctttataattagccttctctttgtaagtagtcctaatgaagaaatttggcaacaaatataaaatagtttctccacaaaataattttagggactcccttaaacacagaaaaaaatgtagtagctgttatttaagtgcccaggaagtctcctcactccaaaatatctctcacattcaacacctagaaattcattcttctatagatccaaaccattaggcaagaagtgtcctaccaataatgccgtccttgaaatgcaagcattgcaggtataaataacattgaatcataacatgctacgtgactttcactgttttgttttgtttttttgttttttttttgtttttttgaggtggagtttcactcttgttgcccagcctggagtgcagtggctcaatctcggctcactgcaacctctgcctcctgggttcaagcgattctctcgcctcagcctcctgagtagctgggattacaggcatgtgccaccacacccggctaatttttttatttttagtagagatggggtttctccatgttggtcaggctggcctcgaactcctgacctcaggtgatccacccaccttggcctcccaaagtgctaggattacaggcgtgagccaccacgcccagcgactttcactgctaaatccatttctttgacaaaagaaagtgaagttatcaagtgctctgatagaaagcctcagtggtcattcatgtggtcagcctgtctataagtcatcttggggactggtttttaataagcagagggtttcctgtgctccaaaatttgcttagggctgaccctgacaactctatttatttatttatgcatacaaacacagtttaaattagcaaacagatgagttaaaataatgagattaccaaatgaacacaaaaggtatcctgaatcttcccaaacccaattcaaagccaagccttaaaatcaagagggacagaagtgctcagcaaaccacctgcaatttaactgagttcaaggagttaaaaggtcttaaaattaaccatgaaatgtgaaaaatatatgaatggtcttcaaaaacaacatttgggaaactttatgtcagaaataccaacactgtggttgccaagagtgaggcattttgcgatgactaacaaattaaggcatcttaatgtgaaaactgattatataatgcataatcaagcagagtaaggaggaaacagaggtatgctttctcattaattctggcttagaactacattgcgtaacatcaccagatttatgaatatagagcaactttaaaaatccacggatgttccctgaatcaaatcatttttatagctcaaagaggctgtcatttcaaatacacacatttattcaaaatatttttattgtctctatttactataaaatctcaaaactatagtagtcaggatggtcagcaaggggtaattggtccagaaaaacaattcagaaaagagaaatcagagaaaaatggctcattttcagtgatgctgcctctagttcatgttggggatttttttctttatgtatgtagctacacagggttctgctatacaaataagttggatatgttttttaaaatcaactaatactaacacaaatgtagcactgactatgtgttgagaactgttctatgtatactatctcatttaaatataatactcaatacactttaatgatgcatggtataatattgtacaataatattaaatataaattgctcaatctcattcaatatttcaatgatctgatactttttagactaaaaataaatgggaaaagagaaagagagaagagaaaaggcataattattattataagccacaagttttcacgtataataggatgaatactatattggcattcaagtaatttagttcccacaataaataataagatacatcatccaacctattatctgctatatcataaaaataattttatatgcaggatcaaaaggggtgattttcttgacttttctgtgactattttcaaaagtcatgaagcagaacatccacgcaagaggataaactggctctgcagctgacccctggaggtactaatgcagagtttgaaaggggaggaaagcttattactagtgaccatgagattccccaacttatattagtcagaaatagcaccccaggatggaatactaaatcataagggtatcctacaaaggcagtctagaatgtgagaggtctaggatctgtggatgtcagagaagtctgtattttcacaaatcataaaaaccgaaaccgctttaaacagtttttttaaaaaacagctcatactccctctgtgatttcacaaaaggctgtccgtggatctttggcggggaaaaatccctgctagagacaaaaaggggaacaaattaaacaacaatataaaacccaaattgatttaaaacttgtcaggaaaaaaattatttcacaaaagcaaagaaataatgttaaaaatgagaatgcaaaataacacaaaggggaagtgaaaaatagcaccgctaatcagcaaaggcaagagttccaataaattacggctcattctgaaatgacagactccagggtgttttcaatcagtcttcagtgagaaaatatttaaaaaggaagaactgtataagttcaagtaattaacatcttacttgtataggaactagttagtagggagaaggggataaaacttgatgccataacacagcacttggagaaaactaagtctctacaggttagcaggtccagatggcaagaaacccaaggtaatataacaagcagtggtggagtatttattcaaactagtcaatcatcactgcaaggccctggtacctttcttttacaaatgagttcttgtttcagccatcaacttcatcatccccagaagcccaaaacaacactccagtttataacctgattgaattgcagtgatttcagacctagtactattgtgatctgggatctttttattacggcatcataaacatcactttcaacaactttcctgtatgtctttgccccgttctgagagatataagtcagaggtggagaaaaggctacaaatgcgttgatttgtggcatgaagaattgtgcagaatcttttcctttgatatgacagtccaaggggtatattaacaagggcagatggttgccatcatttgttacaagcacctattcattataaaaaaggaaaaacaactcatccctcaagaaaggatttaaagtgataccagaagacctcgatcttccactctccagcctccctgcttcatcttggtaaggatgttgttcctaacccttccttctatgccagggaaaggatatgcaaactaaaaaagaagaagtaccagatgtgaaattctataaaatgccaactgattcacaccctacactctgaggatttacacacacttccacttctggcaggaccaagggtaatgagaattctgctgtcgctggtgaagaagtagcaaatcacagccaaaaaggacacctacccctgggaacgagaacttcaattccaataaatgaggcaatgctgatgagataaaatttacatttaagtcacaaagctactggaactgaattgtaataaaaaaaagtgtcagacaataaagcagtttgataacgtcagcttttttactgttgtgtgtgtatctgaaagaaagtttctttaaaaaaaaaagggtaacatttgaactagcattgaagttatattattttacaatattttatattaaggaaatatcaaaaatgaataatatactatagtttattaaggacacatgatgggttagggacttgacatgttttatctcatttagtatacttgatccagatagacccatttttaagcagcagcagctcagaaagggtgagtaactagtccaaagccctggcggtaggaaggaccagaagtgggattcaaactaaagcctgccagactcctaagtcattgttgtttgtgcctcagattccctttgcaaaattcactattaaattttttcaaagttataataataactattaagggcttactatgttccaggtatactgtctcactatatctccaaacagctatatgaggtactatttcacctatttacagttaggaaactaagactcaaaggaggtaagtaacatgcccagttagaaagtaggataaacatgattcacattcaaatcactgcctccaaagcctcagcacatttccaaaattcataagagctacaaaattggaacagacattaaatgcctggtctttggggaattcctctattctgcaaattttagatttagattcccacctgtctagcttcatcttttatgtgtttgttttctcctctcttcttctcattatagataccataacttcctagattcatgaaatgttagagatagaggttcaccctccgaaaaattgacctactgaggactaaaagtaacttaataacaaagtacaatatacatcccaaattgctcaacagttggataaactttccactgcatgatgccgtaattcaccatttccaaaataagtaaatatgaaggcatcgagaaaagactatgaaaaatccaattctagtgttttgaaggtaacaattagatataatgacttcgtatcaagggtaaatttttgaaatcagtcactactttaataggattttcttatgctataaaaacatcaaaatatgcaacctagctttgaaagctctctaagttgtgttcccaacctggcaaaccctgtacaccagctcatctgttctacttgccatacctagtataagtccttgtctgtcctatttctggaactgtgacaactttctccacatttccatcttttaaaataatcaaactcaaccattcatccttatagcttctatcacaaagtcccagccatgatcagttgaaggctcatattccgttactttgaaattctatcaacagatttatgatgacttgattatactttttttatatcttctctttccccaagacttccctaaaatggtgaaagagcaatagacacatacaaaacaaataaaaggcctaactgaatgagattttcagcatatttgcaaggagggtgctaacaaaagatggataacttacttagcagggaggggaagctataactttaaaaggggaataaagataagagagttgattcacttcacagaacccttaaggaggtttggggtttaaagtctgtttctatggggtacaaaatgcccacacacacctccctcctactccctgcactagatacaagcaccaagagaataccgcattttccatgggataaatttaactggagtagctcaacactcagagacatcaggtactgtgaagagcaaggaaaaaaagtggattaattaaacatccatgtgttgagttaagagatgcctcctcctcagcctctatctcttcatgtgcaaaaacctggaaaccaggcatcttccacacacataaggaatcaaagattacttccttggaaaaactgacctgccgcagagaaaaatatctttattctcagcttgaggttctccagcaaagtgctaggtcctaacaccccggagattccaaaatgaaacagatcaatcgacaaggcctagaaacagatctgcaaatcagccttttaatgcttcattcaaacctagactgacacccaagaaacaccaaacatttcatgaaagatttcaataaaaagagagaccaaaataaacagagaaaaaaattaaaactggaagaagctgatatacgctagaaagagaaaaaagtcatcaaaaaattttatcagtatcctcagaaaggtaaatgattaagattacaatcttaaaataaggacaggatactacagaaaatgaaaaagcaaaagacaagaaagaacactaaacaattcaacttacacttcatcttatgcatgcagtgaactgtatttttgttcaaaaaaaatatatatgttctacccctctcagaggggaggctatcctcccctgtcccctccatggctggctatttgctattgatttcctttgggcaatgaaatgtgtttgaatgtgatgtttcaccgaaaccttagagcgagcatgcggttggcatttttccccctctggcacaagactggcaatattctagatagcagttagaatattgatataatctagaatatgatataatctagactattgatatcatctaatattgaatattagattccagcattttgaatcctcaaaggaagatgatgtggacacatctgtagctgacccacagtgagtaactatcatgataaggaattaactttgtggagatgagtaactcagaaatgaggagttgcttttcaaagggtacaaagtttcagctagataggaagaatacactttaagatctatgtcacagcagggtgactacagtcaaaaacaacatattgcatagttcaaaataactaagagagtaaacttcaaatgtatcaccacaagaaaaaagttaaatagtgaggtaatggatatgttaattaatttgatttaatcattccacactgtatacatacatccaaaacatcaaattctatgctataaatgtaatacaattatgatttatcaattaaaaataatattaactttaatagaattaaacttttgttgttgaaagcttttgaaattctgggcatgcttttttacttcagataatctggtctatcctgacaattacaataggtttgatcacattgacagggctttggattttattttaaaagactgacccaaattagtaggcacatagaaaacgaagaaattaaaacacaaacaattcttaactctggataaaacgaaaagaaatataagaacaaactgtagccattttacactatgtgattcagagtaaaaaatatttacatagtaataatagcataatcacttcatactggctgaaataaaaacacgaaattactgaaaggataggaagaagttctgtgtgtgtgtgtgcatgtaaaagcgatatgaaaattaaattataatcttctttttttgtttttgagatggagtctcgctctgttgcccaggctggagtgcagtggcacgatcttggctcactgcaagctctgcctcccaggttcatgccatcctcctgcctcagcctcccaagtagctgagactacaggtgcctgccaccatgcctggctaatttttttgtattttttagtagagatggggtttcaccgtgttagccaggattgtctcgatcttctgacctcgtgatccacccacctcggcctcccaaaaattataatcttcttcaaaaggaaatctataaagatctaaccttgaaacatcaagaaaaacagtatactgtgtgatatttagaaatatgaatataaatactagaagaaacaattaaaagatttaaaatagttgcctctgaggcatgagaactgggagacaggctggaacatgggacagctattttttattatagcattatttgatttattatatgtactattttggtaaaagtgaaaattaaatgaaaacagtagtttactcttatcttttacaaatactgagttaaatatcagaagaaagagccaagaatttaaaaatagttgtctctggaaaataattgggaagtgaagaggggttaagcacataataatttgataaaatttaaaaaattaaaattttctaagagaaaatgagtaatctgaaataactgaaatttgtgaataagtggaatttggttttggcatagtgggtcaaatcatcagaaaacaaactcatatgagaaataaactactcaatactggtttatctcctggtagaatcaatcatttaacagtggccaagcatggtggctcatgcttgtaaagtcagtattttgggaggcgaaggcaggaggattgattgacgccaggagtttgataccagactaggtaacatagaaagactcccatctctacaaaaataaattaaattaaattaaattaaattaaattaaattaaattaaattaaataaataaataaaaaatcagccgttagcggcggctcatgcctgtagtgccagctacttggccactaaggcaggaggattgcatgagcccaggagttcaaggctgcagggagctatgatcacaccacttcactgggcaacaaagggagacccagcctctgaacaaacaaacaaaaaagctttgggtccctctacggccttttttgtttttcaaaatgagactttttaataaggtcacattgggtgctttaagaacttcaattattataaagcgtaaattacttttaatatgcagttccatacttagactgcacaatgcacatctcagaggcattctcaacaaccattaaacattttgaattcaattttcagttaaaccagtattttattaacaacagattccagttaaatacaacaaatattaaacagctattgtatatgcaaatgacattgccctaggctttgttggggataaaagttaaaatatctcaatctttaattgagtttataatcttccaaggaatataagccatgcaataataactactaaaaataaaaaaaatgtccaaaagagatggttaaaggaaaatccttatcattcagagaaccgtggtcattggaaataggatttgaacatctgaatccagacagagaattatctaagagtaaaatagtatcataaagcatgagagaaggacagtatggcacatgtgagtgcagaaaatcattcattttggctggaacataaggtggattcaggggagtagtaaaaaataaataaagtaaatagtctgggagaagatcatggggctccttgagagtcaagttaacctttttataattcatataacagaaaggttggagtcattaaagattttttatgaacaagtggcttatctagatttattgtttaaaaaattagtccagaaatgtatatgagaaggattaaaagggaaaggatgaaagctatgttttattttatattaatagataataatgagaaaatcttattctctgaataaatagctagacatacattttgaggattattattctcaagcactgtgtacatttcaaatgtgcttcaatattttgtgaacattcaatattttgtgaaggtgttttagagaagtcataagcaagcaacacatgcattgagctctgtaaactctgtttatgttattaatcagaatagctcctgtccatctaaaggaggaatagatgtctttaagaagaaatgaaaaaataaagtaaatgtgaaaatttcccttacttatttccaaacaagtgctcctccaaaaaaatgcaaataattaagtttctgaaatggtgaacatatcagattagtagacatatggcaggagcagcaaatgagcagatcaagttgaagtcctagtattaccaatctgttaatgttgacaggaagactcattttgactgttccttttatatcaataaatgagtggatttcaactactctaaataggaatgctaaaagcagcactgctaaaagtgcatatcaaaccaataattttctgatgctgttttggtatatcctacaaacatttgtaggacaacaactcagaagggaaaaaaatatcttatgcctttgaggtctgtactgaatgctaatgcatttgtatatgatgggtttaatacagaactgagaataaattactttcagcagctgcactctagacctataaatcgctctgagtactacaaaatccatacaaaggaagaacagctggataatttacaccaccagtatttgtcaaaaaaaaaaaaaaaagctgaaaatacagaacctgatttgtccctttttcgagtatacacgtctacaaaaattaaacattatctttctagagaatctattaggataggcacatctattcgcatcttgacatgttgctcttttaaaataaacataattcctcttattttaaaagcactttttaaaaggataaaagcagcaaagaaaaaaacttttccttataaccaaacgcaagcacaaagaaaagtctgttaatgtttattttgtgttccaattgctatgctctggtaaaattctacaaaaggaaacacgttaaccagatgacttgcagagcacagtgataccaaaaatagtacttaagttaatacactaattgcaaagttgcagagattaagttcaccattctagttcttggataaacttttggagagggagtatttaaagtttaatataagggctgtcttaagcttcctaaagaataatacaagcagtaaaaatgtgctccgtataagtgaactccagaaatagaaagctgcagtcactaaaggaatattagcttttgtgtaagcaacaaaattacccttttgcaacttctattaaagtcaatacaagagagtggctaatggctaattttgctcacaaatctaccattgttttgagtttttatatgtgacgctaattcgtaaagaagccatactaccttgataataacaacaaagaaaaattcttaagtccccacatggtaattactgtgatctatatgtagaaatttgacaatatgtcaaaatttgaacctattttcaaatgaacctatatcagtttcagaaatctaagcgttcctaaaacaatgattaacaaaaaccaattggtgttactctccaaatcatgcaatctagtggactgtaattccaatattataaaaatgctgtgataggaatatgcatgagtgaacaaacaggcggctttatctgcctgccaatttcacatccactggaaacaaaaggaataggtgaggttattcttaattgatgcctgtcaatctttcttttcctacactactaatatggttaggctttgcgttcccacccaaatctcattttgaattgtaatcccaataatcctcatgtgtcaagggagagaccaggtggagtaatcgaatcatgggggtggttcccccatgctgttcttgtgatagtgagttcgttctcaggagatctaatggttttataaggggctcttccccactttcgcagcactcaactctgtcctgccgccctgtgaagaagttgcctgcctcccctttgtgttctgccatgattgtaagtttcctgaggcctctccagcaatgtggaactgtgagtcaattaaacctctttcctttacaaattacccagtcccaggtatttcttcatagcaatgtgagaacggactaatacaactacactcttctaatcactttattttaaaatcagatagcttggagcccaaacaaggcctcctctctgtcaattgtccttaatctgaactcagttttagaacactcacaaccacataggatataaactcatttagcaaaatgccagggaaaaaaataataggcatccagtagtagaagtaagcaaagattgacaaagaatccaagccctaaagtgtccataaggttgaagagtttaaaaatgacacactagtttatgtgaagtaagagtcatgcagataactggaggacttatctacttatctgtatttctctcaagttatgctgcttactagttcacagcataaaccaccaaccagatggcttaattgcacagcagacattcttacattgccttaaactaggaatagagggctactagtaaatatacaaaaataaaacaagtaacattgtttatggcccactaaactgtatacatttatgtgattctcttccctatacctctgtcacaactttgtatcttttctggattctctcttaggagttcatggactgaactgagctaactttaaatgcactactatacttaactattctataattctgaagttgccgtaatttctcaagttaaaataccctgtggttccaaactcaacccaacttatttcaagactggtagcacccaatttttttaaatgtccattaaggctgggcacggttgttcatgcttgtaatcctagcactttgggaggctgaggcagatggatcacttgagcctaggagttcaagaccagcctgggcaatatcgagaaaccttgtctctacaaaaaaatacaaaaattagctgggagtggtggtgcatgcctgtagtcccggttacttgggaggctgagatgggaggatcgcttgaacccaatagttggaggctgtagtcagctatcattgtaccactgcactccagcctgagcgatagggtaagaccctgtctcaaaaaataataataaataaataaaatgcccattaaataaaaatcttaagcaaagttaatactttattaattcattgttgtggaaaccaaaccattttagcagaagagaatacaaaataatgttcaaagaatagggaagaaagttttagttctcataatttgcaatgcactaaagcatcttgataattacttgttaaagttcctggcctcaaataatcttataattttgaggacattttctgattgatctctctattattactccatgtaggtgcatgactatcttttgcatggaggtatttttacaaacctctatatcccacaacacaataccactacttgataaataattatttatcactcatctgtcactcatcaaaatctatcatttccacttattttctttaatcatctcagctcacatgggttccctctctcacataaagtcccatactacttattatttgtagcataatgtagtagttacaattacacagttttcatcctagccatcctgtatcagagttctatcatttattactcatgagactatggagaagtcacataaccatcataactcctattcctcatacctaaaatggaaataattatatctatttcccaaggtttttgtgagaaatgactaaaaccatatatgaaagtgcttacaactcaatagaaagcgggaaaagataaaaataaataaaaatacaactcaataataagacaaacaacccaatttaaaaatgggaaaactatgttaacagacacttacaaagaaagacatataaatggccattaatcacatgagaagatactcaaaattatattcattaggggaatgcaaattaaaccaccattagatgccaatacacatctggcaaaagctgaagttccagcaaccagaactcttatacattagtcagtcagagggtaaaatgataaaactccttcaggaaagagtgtgaccatttcttataaaactgaaaatatgtctatcctatgaccaaataatttcattcttatttatttaagagaaataaaagtatgttccacagaaagccttgtgcatggatgtaaatagcacctttatttataataaccaaaacttagaaatgcccaggtgtcaaaaaatagagaaatgtataaacaattgtggtatattactactttcccataaaaagaaacaaactactggtatatataatgacatagataaatattaaaaatgtcacaacaagtgaaagaagacttacacaaaacagaatgcactgtgtgattccattaatgtaaagtaatgagaacaggcaaaactaatgaagggtggaaaaggtgagaatagtggttgtctagtgtgggaggcactcctggctcacaagagggataaaggaacttgaaactatctgaggtgatgggttacaaggatgtttgtattcatcaaaatgcagaatatgtacgcttaagatttaggcatttaaatgaaagttttgccataaatttactataaaacaaaaacattggaaaataactataaattaaaagcagaaaacaaatcaatctattgataagcataaattagagtaaaataattaaactgaacaaagagattctcacaactgttcttagttcagcttcatgctgtttcaagagaaaactatagaaagattcaaacaaaagaaatggaagaagagttacaaagcagatattaaataaaagaatgttgaataagttaagaataaaggaaatactgtttttataccagaccaaaaaagatgtttaggccaataagagttactagtatacaagggtcattggataaagacaataggaatatttactaggaaataattacaattcttgatttccacgacctcaatagcataatcacaaatatttgaaacaataattgactgaattatgaagacattggcaaatttacaatcgccatgagagattataccacatctcttttggtagttaaaaattaaggagatggcctggcgcagtggctcacacctgtaatcatagcactttaggaggctgaggccagcggattgcttgagcccaggaattcaagaccagcctgggcaatacagcaaaactccatttctacaaaaatacaaaaaaattagctgagcacagtggtgtgtgcctgtgtccccagctactcagaggctgagataagaggattccttgagcccaggaggtcaaagccacagtgagccatgatcatgtcatggcactccaggctgagggacagagatagactctgtctcaataaaataaaaattttactgacaaaatatcagtaagaatcagatttgaacaacatgattattatttaatttaatgaacaaatatagaatcattagatatattcaatagaaaatatattctgattaaagcattcatgagacatttacactattgaccacccactaagccagaaagcaaagcaaatctcaatttgaagaatcaagattatacaacccacattttctgaccatcatgataatacattagaagtcagtaaaaatgttccagagaaataatagtagcaacgcatatggtccttgctaagtggtgggcactcttctgagtattttaaatacgttagcacttttaatccttgtaacaactatataaggtaggtactgctattatcatcccagtttcatagatgagcaaattgaggcagaaagagaataaataaggtgctaaataaccacacgtgcacacataagtggtggagctcagctgtggtccttggcagcatggctttggaggtagaactcttagccaaaataacattaggatcaaagaaaatgtctttatgtaaattagataatagatgagaaactttgatcaaactacaacagctacatattacctggaggaaaataaagagccttaaatatttgtgttagaaattatttttaaaaaatgactgacaatgaatgtgctaagcgtataaaaaaccgaagaaattgaaaaaagaataacagtaaaccctaaaagaaagaagaaaatgataaggataaaatcagaaattaatgaaatggaaaaaatcaagattaataaattcaaaagggtacctctaaattcaaaaaaagtggaaccaaactggaattttcccattggtgtttacattgcttaggaggcatgtatcacattataaactgtcctaagaactatcttctgtaattcacatatattcctgagctctctccttttcaggttaaatcaacacaatttctttagccgtctttactgatcctgctttctagcccttcactaatttccatttattatcttctgattttttccacttcttcttagtcttcttaatttatggatcagaaaactagctcagaaccttaataagaatccgaatggcactgagcatagttggaaaatcacttctgggttttacattataaatatttagaatgatcatataaaatgaactgcaatatgtttcaggaaactttaaaaatgttcagataatactaacggggcttcataagaatatcaccaaaatacagacttaccaagactggccattcattgtcactagttgcaaattaaatctgcaaacatcatcctcaaaattttacaattaattttaatggattatggaagaatttaggacagcctatccattataacaaattcctgaaacaatgtttttgtctgattggagagtataaaaattaccttgttgagtttgcctgtttacttttcaaaccaggtattgaaaattgaaatatagtcaccagtcagaagttgttgcagtaggcttcaaataagtttaatatacttattgctgcctttctaaaattctatgcaaagaaagcaatcagatactgaaataagtatttatgggcaaagattctcagtgcagtattgttggtattattaaaattcagaaacaaaccatccaaaagtacagctattgttaaataaattatagtatatccacacaagacaatattatgcatccattgtatttgtattttttaattaattctatggggcaatgtgtgatatataaaatacaaagagaaagtaaactatataaaattatatatggttgatacatttgccgatgaaatgacataatgattgccatttgcttcaaaataatatgtgaggggaatgaagtgggtgtgacagagatgaaacaagatggatcgtgaattgataattactgaagttgggtgttagggacacaaaggttcattacattattttttctacttttgataatgttacaaatattctataataaaggtttaagaagcctatatatacattgtggttctaattataaatctatatatacacatatatatattataatataactagtgttttataacatatgttcatcttgaagaagacatcaccaaaatgttaaggctggcccaaagtggttgatcattccttattcattaatacttttctaatcaaacttctaagtttataggcatcccaggtcttccaagatactactttaaaatgttaccttttttctaattcatgctttcaagtggcaattcatataattaagaagaatatgctgatcatcactctactttattgtttcaaattatcttgaactcttaaactcataatcctacataagatgactatttctaccatggcaatccctgtggttatttgttcaatgcccactgccttctgatgcaactggctcccagtacaccagaaaggtcctttattggctgagcacattgatgggtggttgtatgcagtttgaataaagataggagattattaggtaaaatagagggaaaagaaacctaaagttggataatgataacctagaggaaaggtagtcagaagctggggaaggtgaatgcttcttagtcctgagaagactaaagtgtaaagaatctccttggcagcatggtagtgtcagaggcctttgaaccagagcaacttcatcttaaataggggctgggtaaaataaggctgagacctactaggctgcattcccaggagattaggcattcctagtcacaggatgagatgggaagtcggcacaagatacaggtcacaaagactttgctgataaaacagattggggtaaagaagccggccaaaacctaccaaaatgaagatggcatcaaaagtgacctctggttgtcctcacttttcattaaaggctaattataatgcattagcatgctaaaagacactcccaccagtgtcatgacagtttacaaatgccatagtaatgtcaggaagttacactgtctggtttaaaaagagaaggaaccctcagttctgggaattgcccacccctttcccagaaaacttatgaataatccaccccttgtttggcatataatcaagaaataactataagtattatcaatagagcagtccaagatgctgccctgcctatggactgccattcttttattcctttgctttcccagtaaacttgctttcactgtactttatggactcgccctgaattctttcttgcacaaggtccaagaatcctctcttggggtctggattgggacccctttccaggaacaggagaacaaagatgatttctggagaacgtacaggtataacaaagatttttacagtaatttgttatggaatgtgcaaggtaaaagctttcctttgatgatgaaaagagtcaaactctgtaaaatattttaagagatttattctgaaccaaatatgagtgaccatggcctgtgacacagcccttgggaggtccagagaacatgtgcccaaggtggtcagggtacagcttggttttatatattttggggaggcatgaggcatcaatcaaatacatttaagaaacacattggtttggttcagaaaggcgggacaactcaaagcaggggcttccaggccataggtgaatttaaacattttctggttgaaaattagttgagtttatctgaagactggggatcagtggaagggaaatgttcaggttaagataaaggattgtggagaccaagttttattgtgcagaggactctctcagatagcagacttcagagagagagcagattgtacaatgtttcttatcagacctaaaaacttacctgcctttcagttgactgcctcctggatctagaaagaaaggaaggaaaacgaagggggaaggagattctctgtagaatgtggatttttcccacaagagtctttgcaggtcaatttcaaggtatggcaaggaaatatattttggggtaaaacattttgattttttcccttcttatcctatagtcagattggaaagtaagccacgatacacagggttaaataaaacccatctgatgagaatttatggtttgtagggcatgattccccagaccccttagaaaggaatttgggcaagataaaatcagatctcagtcctcacctccaaaataacattcagcacaatcaccattacttactgatgctttaggcgtgggtaaattttttctggagaatgcaaaggtggtgttgagtcctgagttgtttacctatggagcagtaatcagaaaaactgacatatgggatccatactaaataagtgacatttactgcaccccaaatacatcgagtcagtcataaaacctagagtctaagcaacaccaagccctcaaaagactaaggacacataacaattaacccatcattagtctattagtatacatacattaacaataacattttgaacctggagagagccataaaatcattcatttgtaaaccaaagtgtatctgagacaggtctcaatcaatttggaagtttattttgccagggttaaggacatacccttattaagaaataaacataaaatcaccgaaacagtctgtggtctgtctttctccgaagatgaacttgagggcttcaatatgtaaagggggaaagcgggctggaggggaaggagggagagtatggaaatacacacactgcaagaggaaaggggcagatagggtaatagtcaattaggtatttgtcttgtgcttggtaaattggcactttacataagttaaggtgaacactatgtagctacggggagatatttaaccttttatctgtagctatctgcttaggaacaaaaggaaaggcggctgactcagccttcagcttaactttttccttttggcatggtgaattggggtcccgagtttctactttcctttcacaaaatctaacctcctaaagccacccagctagttccagtcacagccagatataaaatcaaggcttttgactcagtgctctttcaactactccaaactgataaggtttactaggggaggtggaagagaaaaaactgagaaaatgaaagaaacggacagagaaaatttcattcattgataaaaacagatgacatctatcattacttcataaaagataccaaaaatcatatctattacacaattatagaaaaatatattaaataataggccttaccatagaaattgtaggagtccagagaacaataccccaaagtatggtgctttggcatgctgagttcttttaaattaaaggatatcaaaaggcctcataagcagccccagaaccaaggactttttgatctcctgtttctcactccaagcacagagtggaaccctctctctcaaattcctttatctgagctttccaaaaggcacagaattgtcttttgtcccccgccctgaaatttaattatctatggcaggaaagaagactaaggaatgtaaccaaaactggatggactttgtcagaaaatagtgtctgtctctaaagctcattcaaatgccaaagagaaccatttacaagctaatttctgtctcctggtgatgcaggatttttttcctccttagttcgggtaaaatccaggttcttgtctcacaaccaggaaaaattaggcacacagatccattgaaaggtaaggagagcagagttcattgggcaaaaagaaaactctcagcaaacaggtgagggagtcctgccaaccggctcccacttcacagactgaataccaggtcaccacacacaagctgaagacgcccgactcctgcccctgcataaggtgtcaattcctggtgactccaccccattctcccagtgtgcacataggcccccagtgcattgcaggcatgcccaggcaagaagaccctgtgcaggttcccttatctgcctcctgcatttatcactgggaccatttaatttccctaaaaatcatttacaatccctcaaaattgcctatatttcctccatttccctcccccaatgaagagggtatataagcttcaactgtctgtctgtttctttgagtcttatatctgtgggactctcatacccatgtatgtgcacaataataaacttttgtgtctttttctcctgttaatctgtctgtctattgtcagtttattttggcaaaatgtgtcaatcatcaaaacatcagagggaaagtaggcttccccacaaaacacagcaattctacacatttttacgtttgacattttcatcattatcctccctccaccattctgtctttattttttctcctattactgattttaggtcatgatctttacacttttgaaaaaaaaaatgagaggacagtcaaatatttttcacctcaaaaatgatttaatcaaatagcaagatttaactaaataagaccaatagtagcaataaagacctgtttagcattttcaaagttattttctaacaaaaatgttcacttaaacatactctggtcaatagtttatttattgcctgatctatgtaatccactacatttcatcactttgattcagttgcaagtccttttgttttccttctgcagcaccttcactaaatataaaatatatcagcacgctgagtgctctttatttacacttctgagtgactagagaaatttatttgattgcaaagcttaaaaggagcccaataagtcaggaaaaaaatgcacagcactgcttctctactcagactaatttttttctaatatatatgatggtttataatttgcagatatctttaaatatttataattcagcagggactccttattagttaagtttatttggaataaaaattaattttccaagatacttcaatttcatagattgttactgtcctttatgtcatatagcatgaaaaaatgtctaatgggacaatcacttgtattatattattaatcatgaataattgatatgtaatcaattcactttagttctgaatataaatatcccaccagccaaatgaatcaaattcaatttatcttactttttagaggacattttcaatgtaacaagaatgataatgatttctaaggaaaagatccttggattatgcttccataagatgcattcattcattcactgattcttcaaataaatattgactactctctacatagaaaacctcatgataggtccatatgacaacgcagagagagttgccaatcattgtggccaatagaaaactgtgaagtttcattttaatgataataccagtatgtcctattacacaaataatgatttcacattatcatttaaagtaaattaaacagaaaataagactatcataataaatattattttttaacttatactttctattagaagtaattctaccctattccttacgcaacttggtccaaaatttattttaaaattttataactctatattgaatccctactatatgtcagacactgctagtcttgaacatacaaaaatgttcctaagcctagctgtggagagagattcaaaggcactaatataaacaatataacatcatgatgaatgttttcctgtaggtatactcccatgggaacacaaatttgagtaggatgcagagaatgcaattcataggaaaaggcttctcaagggaagtaatatttatccaagcataaataagaaaaggaaaaggagaaggaagcggatcttcatatctaaaaacaattgcttaacccatggtaacctaagtctacttttatgttttcttttctcacattttatgttttgctcttacattatttgatacaaattacatctttaaacattataaagcaataaacgcagttttacaatttatgaaattgtctcaggggtatggagcttttgaggcagctccaaatccattcttcttttttcagtggctgctcagctgtgggtttcacagctaccatggttgtgtgactactgactttcaagattggggctcagaaaacaatgcctcaaaatgaaggccttagcagtagctcaaaagcaaacatttttatttgaccttctcctgcatgcctgtctctcagtcccattctcccgcaaggctagccatgaaaactagaatctctcttccccaaggtgggtcatagaaagcaggaccccttttcccaaaagccagccttagaaacctaaaaatagtctatgtaaaaacaggccataaagaaattatctaatctattttgtttgacattccagagggggccccatcccacacccagaaggaaggactgctgcacagagaggacaagaagaatctagacagacaggacttgctgggtttccccactcagttttttaacactagatcatattgttatagaaggtagttagtgagacacaagcatggtaggagagggtccactgcttcttcaccaggaatgtcaggcaaccatcaggtgatggtaaggtggttgttatacagtcttgctaaaataataattggtcgcagccagtgccaggaaaaggcagtctcccaatagacagataacatctgaaactggtaatcagcagcttcccaataagatctcaggagttgggtgagtgggctcaagcacgcaccctaagaggcaaaatggcagatgaccttcctctaggaacactcagttggtaaggaaaaaacatctcaagtgactatgtgtacaacttcagtaaacacactgtgcattcaacccctccaaagtcctagtaggtcactgtgcatctggatggcccaccgcaaggaagaatcaggatataagagatgcagagatgcagaccccagaagcatgctaatgaaatgtataaaatcctaagtcaaaggtcaaatcacatacttgatctctcaagtcacccacttggccctcttctaaatgtactttacttcctgtcattcctgctctaaaactttttaataaactttcactcctcctccaaaacttgtctgggtctctcactctgccttatgcccctcggtcaaattctttcttcagaggaggcaagaattgaaggttgctgcggacctgtttggactcgccaccactaacaatatccttttgaacaatcatatttctacaggtatgtccatacttcattgaatctcagcctaaaaatggataatgtatctttgtcttcattctgaaggccactgtgtatacacattgaataaatgtgtatgccttttctcctattaatcaatctgcctcacgttagtgatttttcagcaaaccttcagagggctggggtggggaaagtggggaagctctccctttgcccccaaacaaggctactgtgatcctagagagagggagatggaaatagggtaaattaaaacaccacaaaaatcattgttcttgtatcaattctgccatttttcttgttgcaagccttaatttccagagttctgaaaaagttattttgaccatttttgccagtgttctcattgcttttaaggagtgaattttcagatgtccccactctgccatttcaaaagtactcccctggggctatgcttttgaattacatttaggagtgaattgatttaacggagaacaaagaagcatctttaaagtaattgacttttcaatgaagacaaaagaattcatgcaaccaaattagtattattttgttcaaaagcaacatcttagaaagaagtaacactaattccatggtagttcacatacttaaatatattttgaatatttttatctgtacttacagcgagtaagtaaaaaaaaattaatgttttaataatggcaaatgtaccctttgggagaaatttaattgaacaaagtctaattaaaaaggtatttgatcaggctgaatgtatcatcatttttttatctaagccaattgatggctataaagtaatcagggtaatatttgcacttggatcataacctaactacaaaaccctcattccaaaagagtaactttccttaaaatgttataaccaatggagaaaacattggaataagcttatagcattcccagtggacatatttggcttaacaagttctatagtgagtgttaaaaatattgaaaaaagaaaaatagctcagagaagtctaagctatgtgaggaatacaaaatttatcaagcctggagagacataagacttcagtcatcccctcaccccctgggggtggcacctatgcccaggggtaattgtttaaaagcgtttttgctcctgactagctgcctcacccattatcttcatgttcctggaatttgtgacttcttcaagacttactccaaatagatatttactcatttctctgagctatcatgtatatagaaagtacacgttattaaacttctgtttgctgttctcatgttaatgtcttttagacattagaagttttagaagacactgttctcatgttaatgtcttttaaacattagaaattagacatttagaagtcccaactaataactaatgaaaggtagaggagaaaattgtttttcctcctttacagcattgcagagctagctatgggcccctagaaatcatccgtaaacttcacatatttaaaataaggaaatagacggctagagaactgcccaaagtcacttagctagcagagattttacaaaacatcaatgggcatctaagaagtgcctacaatacatcaggcactgggctagacactacccttcacaaaataaaactataagttgggccaatgacattcagtctactgctctttgcacaacttcacactgcataaatgaataaattctcaaatagccatcaaaaatgaaatatccagaggaggcagtctaaagaattacaatgaatttttaaagtaacacttgttttgtaaacaggaaagtacatagaaaggaaaagagaaaatccattctatataaaatagaaaaatatgtttgtactgactcaattatttaaaattaatattgtgtggcctaggaatatgtttttatataattaatgtttgttttttacaaaggttcctacaggcaggaaatgtgtttgatttttgtgtatacttcagatttcatcacaacagcaatataatgcaggactcaatgcaaagtaagaaaaaacaccaggcaatcagttttggttgctttttcactaacaaagcttgttaagaaaagaagagcatttttattttttataaatagaggattttagtgcctattttggaatagcaggtagtattccagctgtttggggctgctttgggctctaggcattttaaaattaatgggctgggccaaacaaagagtgtattttcattccacatcaaatgtgtatgctggtttctagaaatacaatatgtttgtgcaagtgtggcaacatttatccttccaggtagtaaatgaagacatctgccttctcctagagacttagctctccaagtcaatttaaagaaaccagcaaataacccttagtgactcttaccctcacacagaacaagctgatttctcatgacagctatattcaatctatgactaaataatgccattttaaatgaccatgtgtgggaagtaaaactataaagtgaacatgtgctttagagcctggagctcttagttcaaatcccagttctgtcatttactagttgtaggacatttttaaaatctgttaatttctctggatggtcagtttcctcctatgtaaaatggagacaatattacctacctcacagggttaatgtgaagattacattatatagctcatgtaaagcacttagctaaatagctggcacagagttgacacttgatgaatggtgccttttatctgccccctctgcaattacttacttaaagttatctattatttaagcatctttccattcttaccaaacttaaaattggtacccaaaaaaatcacctaatttttctcctgttgtactaagtagcaaaagaaaaacattcaagaaatgggaaggccttcatgatacaagttttcatgtctgtaaaattaactctgcattaactcctgacttaaaattctacaacacagaactacaaaattttaaaagaacagaatattaatctagagttgatataaaaatactagctgtctcaacttaaggcatttcacaagcctgagaattatttctgctttgactttgcagctctactgaaagaaacccttaccctagctgcaaacctggacagattcttgaacacaatttcttggcgcttcctctgaaatccccctagaagcaagagcttctgctgagcgactccatggtgactggaacatgaaaaaacatgctgggcccgagcgcggtggctcgtgcttataatcccagcactttgggaggcggaggcaggtggatcatgaggtcaggagttcgagaccagcctggacaataaggcaaaaccccatctctactaaaaatacaaaaattagccgggcatggtggtacacgcctgtagtcccagctacttgggaagctgaggcagaagaatcacttgaacccaggagacggaggttgcagtgagcccagatcccaccactgcactccagcctgggcaacagagtgagactccatcttgtaaaaaaaaagaaaagaaaaaacattcttacagattgtctttgtgatagccaaacccattccagactagtcaatggttttgccatcactttcgtgcaaatattttctaaatatctttgcatatagtatgatgtattataaagacaatcctctggaactattgtgtatgttcaccataaaaggtactccttatgcacatatttctcacactgactgcatacaaatgacttgaatttatagaaggatttttcttcttgtagccattcatacccagctcacagcccaagccaatgtgcgtcctccaaatgcaatcagatgatgtgaccagccttgaaacgctcatcagacatgttttctaacatatattcttggtccagtctaaacttggatatttggaaacagactacttagaacaccagcatttgatattgtgttcaaagattgcagaaaaacatgtagttataatcactctagtactctccctgattatataattaggggtgtagttttagtcttaaaagagtaccaaatagactttgagtcagtaaaaagaacaacttttactgagagtagaagagcatctttgccatcaaatatgagcttttgcagtcaatttagccccttctctaattgacactgttcataaaagacatttaaaaccatttcatgtattgttaatatgcacagtttcaacaccattacataacccatcaatgtgaagatcagaggtttataatcactgaaattgattagtccaatcctcaaaacaaatagcttactattctgtaaaattttttccctggtgcaagtggaagtagtattgtaaaatgtctttgaaatccaacaggaatacagatttctcctgtaggacacagttttgcaaaaattgctttaatcattaagtaaagttaagcttgatgaaaaatctttctactacacgtctttgagtcccaacaacagaagcacagatgatggctgtgtgaacttctatcagtttgcttcaaaattaaagaaaatcttcttagcatacaaatcccaacaagtagcctagcaccacttttcatttattaccaatgcaaccaatttaaacagaacttattcagtttataagatggatatcttgtcaactgctaatcataatataaacaatgaatttgtactgcatattatctgtgcattttttctcttcaaataagattgcaaccttaacagaaaatgtggaacaaaccagcttccgcaacatagttctttctttaacaataacaacaataaaactatgctaaaactacactgaagctacactacaataaactgcaaaaaatcaaaagatccaagcactaacactgagtcacattgtactctggcacctgtaataagattacctccttgtgacctgctcaaattctggacccaaagaaagttttcagaaagtttttccaaaatcctctgtctgtcacccataaagcttcattcaggtactaaatgataggtaagtttagtagtgtagtcctagctacatgaaaggccagggcaggaggattgcatgaacccaggagttcaaggttatagtgagctatgattgcaccactgcactccatcctggcaagagagcgagatcctgtctctaaataaataaataacagataaatgatttacaaattttttatcaagcactctttagaaaaacttcagcattcacacataatatatgtatttatacattatatacaagttctaatctcagcctttatgttaaataattactaaactttgttttttacttagataaaaagtaattatccgtagaatttctaatatttttcagatgttccactggatcattgtgcatgccttctgggtattcaactttggagagtactgtactatatgagtcaggattattagacagaaaaccaattaaaaaccttagatgtaaaaagagaagagagaggagagaaagaaagcaccagttgcaaatagcctaagttttaaagtacatcaaacatcgttatatgccagagcttcacataaattatcttagtaaatcctcaaaaaaggcattaaaagaggtatcatttttgctcttgtacagatgaggaaactaggatcagggtaattacatccaaggtctaagtgtcaaaacaaatgattgtcagaggacaggaagaaaataaaagggaagccgttaatcaaacatttggccctctcatatcccaaaattctaaagatctcttaccacaaagaaggcaaatctaggaataatcatctaaaacatgttcagtacatgtatttcaaggctctagagacaaagggcaaaacatactaaattattattagtgcttgagaaactaatcaattatcttttgattgcctgtcatttcttaagcaggtaacatggatccaacaaaggaaggatggatgaatggatggatggatggatggacggatggatggatggttgatggatggatttatttatttatttattttaaagacagtgtctcaatctgtctcccatgatggagtggagtggctcactgaagcctcaaactcctgggttcaagggatcttcccacctcagcctcccaactacctaggactgcaggcatataccacatgccaggctaatttaaaaaaaaaaaaacatttgtagagacagggtctcactgtgttgcccaaactggcctcaaattcctggcctcaagtaatcctcctgccttggcctcccaaagtactgggattacagatgtgagctaccatgcctcaccaaagtctttagaatctctattagcagtctttagaactgtggtatccttcatacaatgtataaatgctagcagctccagtgattccctgcttacagtgttaagggatggagtaatacctgctttttttattttattttggtttattggagacctgcacaacttgtgtggcatgtagcaccacaaatcctagtctgttatgtaaagagaatttaaacaaattaatcacaaacattcatgagcacatatgcttatttgcatgactgtcttgtattatagcctaaaagttattcatgtcttaaaggtgtagaaatactgtgtctttcatcaacatagcctgagacaattgagaatttaataagatatgcaaaaccataaaaatcatggctaatatttatgcaacttttctatgtgccaggatgtgttctaagcattttatgtgtattatcactttgaatcttcacaaacacctcataaagtagatgctatatgtgtccccatttccaaccaggaaaactgaggcaacaagaggtaagaaatgtgaccaaggttacatcactagcaggataaccagatctttgactcaaagatgtctgactccagagcttcctccaagaactatgacagacatacagtaagagagttcaaaatacagcaaattgttaacaaatatgtagagcaaatggctaacaatatcaattaagcactctgatatatctccaagactagttctgcaacccctcgcagctatacatcctaaaatattctgcctcttacatgtctcagaaattaaaagaagattctgctaatccatgttcagtctgtcacacataattgatgtgtgggtgatgttgagtttgcttatttgttcaccctttcttatgtaatataataggtgatgttacagatgatagaaaaacataaggttgaaaggatggactccggagtcagatgcacaaggattcacattgctctctggctgtttttggctatataataaattgatccctccaagtctcagtctccccttctataaatggagatattgacacctgcctcattaaatagctgtaaggagaaaatgaaataacatatgtaaaagaaaataatacatgtacaatgcttgggacgtggtgagctcccaaactatgctagctatggtaaataaaaataaccccactaatagtgacacagctggtgttaacagtgtgatctatggtacatggacacagaagagatagttaacctattgagtggctaaaattgtgagcttggtgtgaaagatgaatgatctatcctggtccactgattttctataggtctccacagcacttgctcacccacctctttacaaagcatttctcctctctctagcatttctcattgttatctctaacaagtgatttattttaagttcatcttttctcatttcctgtgacctgttcagaagctcatgtacatctaccattgtgagcacccaaatagtttgttatctcctcacacaatacttcatagtcagctgattcactggggttcgttttactatgtaaccatctaccataaatacctagattgtttaaaaggccacaccgccactcacacacaaaaagaaagctttgcatattactgtaacctcttcacatgatttactagtgttaacacagctttctatgaaaaatgaaagataaaagttgtagagaccaagggaaaactccttcagcctctaaaggttcatggaaaaatcaactcacaaaaggcaaattaattacagaaacggcatacaaatgtatttaatgtgtacatgagagccttcagaatgaaaacccaaagatgcaggggaaattgtccatttatatgcttcagttcaacaaagtatgaacagccatactcaaataagattggacaaaaagtttactacctaatgctaataggttgagtggggaaggtctgtctagactcttcttggcctctctgagcatgcctttcttccttccgggtatggggcaggactctctcttgaatggcgggtgggggtcttaagacctacagtaaaacaatgtcagttagataatttctttatggccagtttttacacagcagggcagagagaaagtttgagtaatatttttaggtgttatggggggctttagggaaaagaagttctagtttctacgacatgccctggggaagagggattctcatttctatggctggatgtaggtgaatggggctgagagacaggagggcaggagaaagtcaaagaagctttcacttctgagaccttcattttgaggtatttttttttccgagtcccaacaaagtaaagtgggaatccagacaattctccacaatttcatgtaaaacaataagcgcaatgattgtaatatactgatctacttctcaaatttaaatgtcaaatgataccacatcattttactttttcagattccataattagtccccctcccatttttatatctataaactcctacttggctattttctttgaactgctacaatgaaaccatactctaagggatagaacaattttatcaacgtttgtaataatgaaaactttgaaagctttagttttacttaataatcagttaataaaaagccataaagctgttaatacattttagattcaagtaaaaatagtaatgactttcaaagagcaacatttctgattggcaatattaaataggaacaaatcattgtggtttgagatgtgtttaatgcagaaagtcctgtgtgctcaccatgtatcacaattaatgttttctggtaactctaatgggctcacagggatttggaagtttggtaactatcagcacttgaaactttttcctctttgtccaatactagataaataaaccattctagtttaggatattgaatcatataaattcctaaagagaattagtagattaagaagagtcaataaagcagaaccatcagaagttctctaaatggaaagaagttataaatactacctatttccttgttaatatcaggttacataaaaaaattattcctgaaaataaagttgctaagcttgatcaagtagactttcttttttataagtagattagacttttcaacctaatgttttgaggaaaacatctccaaaggtcctcttagaaggtagttggaaggagccctagtaaaagaaaaatctataaagcttacagataaaaatcagcttaaattgtgtccatccatgaatgtcaatttctattacagggcagaatttaattaattttgtttcatttaataaatattctcctatggtatacaattccttactagacactatatcagatttctaagtagttcaaagtattaaggattacttatgactggaacatgttatcaatgtacatattaaattttctcctccttctaaattacacattttattttttttattatactttaagttttagggtacacgtgcacaacgtgcaggttagctacatatgtatacatgtgccatgttggtgtgctgcacccattaactcgtcatttaacattaggtatatctcctaatgctatccctccccctccccccaccccacaacaggccccagtgtgtgatgtcccccttcctgtgtccatgtgttctcattgttcaattcccacctatgagtgagagcatgcggtgtttggttttttgtccttgcgatagtttgctgagaatgatggtttccagcttcatccatgtccctacaaaggacatgaactcatcattttttatggctttatagtattccatggtgtatatttgctacattttcttaatccagtctctcactgttggacatttggcttggttccaagtctttgctattgtgaatagtgctgcaataaacatacgataaattacacattttaagtgctctaggttcaattggctctgagcatggtaaacaaactgcagtcactaaagaatctccaaaggcttatctaataccagtcaaagttatagattctatttggaaggctttttcatcctacaaagaggatgaggtcttattcgttgtccccaacacctcgctttttgagtgttcgcacagtgtttggcactcagtggcactcaataactgtttgctgaaaaaaataaatcaatgagtatttagagacccaaatatatataaggaaatctaatactcgagtaaatataccaatagacacaagatataggtggggaaaaagactatgtgttgctacaatttcagggtaattacatacatacaatcattcaagaatttcaaacttaaaatgtattcaactacaccaagttaaccttctcaataatatgttcccttctgttccacaaattattcttaatttgattttttttaaaaatcacactatcaattcaggtaacatttttacaaataaaatgttttgatttttaagaagaagaataatgactacaaagctatgtatattgtcaaatcaaataaatttatcatgcacctgaaacttgcaccaaggaaaggaattctaaaaaagtgactccccagttctcccactgagacaggagttaaaaagatttaagacactgacagttaaatcaatctcagtgatctcttttactgggggaaagtactgatttgatttataaaagtttaatttcaaattaaaacagctgttaatatcctttaccaaccattattttgttatacgtggcaggaaaataagcagatgaggtcatctgcctagactgaggtgttgtgattatttacagccctaatttttgttcagtaattggtaggtacagttctaattcttgctaatgactacgatatattgctcaggcaaattagaggaatagaatgttctgttactttagcagtattggtaaaaagtgacacaataaaaatgagtactcgttgaattaaatgccttcaacaacatcataattcaccccaaagatgctaatactaaaaacacatcctgcccccatgaagtggacttcagtagaatggaatttctgtatttatttagcattggcttctatcactaattaccccttctttaatgtaattttggggcataacgtagtaagtggttcatgatcactaattaaatgcctactatctgtgagaaaacatattttaaattgttctcttgaaataaaaatgaaaatactcaaaagaaaattctttcttaaaggtctcagaaagaaagcaggattttttaaaagttaattcatgacaacagatagatcataaattgtaaaattataaagccatttttactggaatagaagaggattagcagctaaggaaatacagtcacgggcatggtaagatatacaggtactttctaagttgcttcatttgagtcacgtgggaattccaaattgaatcatatgggaagttaggtcagagaacattcttactccaggagtttttcaaggataatagctgagacctgcttatatataggccataatgcagctatttaaagtaaataaagtcttcaattcctaaagtggcagattccataccaagttctaatgtacccagccactcacagctaaagccacaaacaaatgaaatcaataaaatcaggcagtaaagccaacatctggggttgctgttcattgcctaaaagtgtcaatgtgggttttaattagctggagtaagaagaataagagttgaataaaatcaacttaaattagaagacacacacctgtgatgcaaatattttattctgttaaatcttgtttattatactacttatcacatttatctcagatgctgatacaaaatgctatgcaacaggctttgaaaactgtaatgtaccatacacatgcagggccactacctacggatgctcaggatgcgcagttcattgcagtgccacatctaagggagggtccatagtagacactgtagatatcatgaatttttcagggtgatcaaagttaaatgtctcagtctaacaagaatttctgacaaaggtgaagtgtgagtaagcaatgaccctgtaagatattatttttaacccaaaatttatattatctcagcaaagaggtttctggaggaagcaaacacagttgaaattatagcattttttttcttttctctctaaaatattattagatgctcatttaaggcaaacaccacaatgcagtacagcatcatagcctaacagagcattatcgcctacctagctctatggctaagcatttaagaggtcagaccatcattctacaaagctagctgtttctgaattatatacatacagtaaacccagtaaattctgtgggcttgaaatcactaatgccataaaaaggtctgttaattgaaggtgattttatgggtataccatggagatggataaaatattttataagtccaaaaatggcagcgattttagaagcactgtaagaaaaggcaaatcaatatttggactttgcgtctttctttgtgaggacaaagcatggcatcctccaggttgaaaggggtttaatgcaatccagttgtcacttggtagttggatgaccaatgatgctgtatcaagggttcagtgctgggccgggcgtggcagctcacgcctgtaatcccagcactttgggaggccgaggcaggaagaacacctgaggtcaggagttcaagaccagcctggccaatgtggtgaaaccccgtctttactaaaaatacaaaaagtagccaggcatagtggcaggtgcctgtaatcccagctacttgggaggctgaggcaggagaatcgcttcaacccgggaggcagaggttgcagtgagccaagactgcaccattgcactccagcctgggcaacaagaatgaaacgctgtctcaaaaaaaaaaaaaaaaaaaaaaaaaaaagagttcagtgctggtccctgatcctagcaaattaaatagtcagcaacttgttgaagtcagatcagctttgtagaggaaaaacccatattgttgagctttgtatgacctctagtcagtcaccacagccacattgtacgtggactctctgaccaagcaacagggtagctggaaaaagttgactgacattcacagaatgagtcatttgaccacctgaaaactgagtgtcccatttactgtgaatctctttggtaggcattaatgtgagacaggaatatcctcacactccatgacagttccaagaggtgtcctccagatcctctttgtcaccaacttcacaaatattttctttccaactccctgaccagccaatcagtttgctagggaccatccatgaattactgcatattgataccttaggacatctttacttctataggaaattaacaactagatgtagtgctcagagttcagcccactggaaggatttcccttcccactgtctttcacggtcctccctgcataggttacacctatcccctatagctggtttcagtatactatgcaatccatccataaatggaccacatattttccttctctgttaacatatcataggaaattccccacgaagccatagatatggactgaagaagaggcagagaaatagtagaatcaagtaccatgggagtgtaaatcacctgcttgtgcagtttacttggtgggcattctgggtctctcaggctgctcttaatatgccacatctgattactactggaatgctcttaggcacatcctattttaaggttcactggattcgataacaccttgttcattatggacaggtcaggtcacatactttgcatcctgcggtcatgtagggtccagaagcaagccagaaaaactgctttttaaatggaaaatagttgttggcagataagaaatctggccatgattctcctttgaggtttcttccagaaactccaaatagtaattctgtctatcgcatacatttctagtacattgagcctgctgggccataaaattaatgaggcataacagtcattggaatggtaagatgtacaagtactttttaagttggcttcatctgagtcacatgggaatcccaaactgaatcatatcggaagttaagtcaaagatgatttttactccaggagtttttcaaggataacagctgagaccatcttatagataggctgtaatgcagacaggacctaaggacctaatgcagagaccttcctttctcctggattcactcaaactgccagccttagcatttatccagtaaatggtcagcagtagcccatccgaaggtaatatgtattgcattcaaaatccgaagtgtctcaccaagcattgtgcttgatggtggatggggttcaaggttcaggtttaataatctgtttttcactttagaataacctgctttagtgtcactctaatcctagaaacttcactgatgtggttagcccttcaaattttacaggatttatctcccacactccaacatgcatatatctaaagttactatagtacttgcttcttcctgcctgttaggccgaattagcataacgctaacaatttaatagtatatttgatgttctattgggtataaaagaaaccaaagtccctctagattatgagtgatcagctaggtgttacttatggtaaacctgtaaagatatactgttgtccctgccatgtaaatgcaaactacttctgattttttcatatcaatgttaatggaaaataaaacaacttctaaagggctgtgctagttagttcccataaatgttgcacaactggaactatatgtgcaaatagcatcacaacctacttaagtctgcaaaaatatactctcatgctccatgacccacatgttttgcatcagccaaacagtcaaattaaacaaatatgtagtaggaatagtcactcttcatatgttgcattttttttttttagacgaagtcttgctctgttgccaggctggagtgcagtagtgcgatctcctgggttcaagtgattttcctgtctcagcctcccaagtagctgggactacaagcacgcaccaccacacccagctaatttttgtatttttagtagagatggagtttcaccatgttggccaggatggtctcgatctcttgacctcatgatccactcgccttagttatatcttttatggtggtactaatctctgacattccctcaggaatgtgatgttacttttggtttactacctcagctaggtgaaaaatgtcattccaggagcttctgcttggccctttcttatcataatagccttcattacatggatcaagaaaccaacgtgttgattccaccagttactaattatatctattctcattatatattctgagactaagaaatgctgttagatttagaatatgatcaagatctacgtaaatctctactctgacttttaaatactatggtggcatttagagtctctggggatcagaatgaatttaaagccagaatcgaataactcagaagttctgagtattatttccttttctcccgtgtaaagtcaccctggtagaaggctgtaggattctttatattgtgaagatttctctttcccactggctttcagggtcatccccatatggggttttagtgcagcacctatccaattacagctggtctcagtatgccataaagattcatccataaatcaggaccacacagtttcctcctctattattatagaaatatgtttagagatggcttggaaaaaatgcaaaatatacagccattgctacattgcaaggcccttttacaaagagacctgaccttttcctcaattgaaaggacctaatatataaattggcatacatctgaaaacactaagttaaattgtttctgcccacaagacttgacataaggcagaatttttctgcctatatatgtaagacagtacattggaaggctgcacatgtatttcattcttagaactacatcatcagttagctattgctttagattaatggttctcgaagtgtcatgtccaggccagcagcatcagcattacctaggaatttgttagaaataaaaatttttagactccacttcagacctattgaattagaaattctggaggtggggcccagcaacctgggttttagcaagcccccaacataagtctgacacacagtgaggttaaaaaaccgctccccccacaaaaaatacagaaaagaaaatcattcccatagatgcttacaggtcaaaactccatccctgtggcttgttgtaatttcaaacacctcgtttgtaatgattaagggccaccagctggtctccatcactgtcaaaccatcatgaatcctactggatcaggaaactcagttccattatggcataacctacagtcatctccttcctacagaggacagcaaccacagagctatttaacaatgctgttatccccctcaccaatgcatattatagtgctttcatcaaaacagcatcctctggccttcctagggagtacggttaggagttggctgatccattctagcatttccgtttccccaagcctgtgaattccttcctctagagtaggtcaggtaatctcaaacatttctaccttattgactataggtcatcattgagttcaggcttcaattaatatattcatagactattaatgcctctcccaagtgctcagaccaacatattaaaccctaaattccaggtgagtacaccaatgtcaacaatttagcctgatgaacattagcattcactccccatgtatgccaatacagactggtggggtcttgaccttcttgacctctttcagtgtataaactgtttctcctggaccaggccttgtaccttcccatctgggctatgttgagtcaataagaggtggcaaagattggtcctgaggttaatcagcatctgcctgtgagacaggtaagaatttttttatgtacaatattttttatttaagttttaaaataaattttattgtataaatttaaggtatacaacatgatgttatggtatgttttgtagcaaaagtaaaatacttttatacactgagtagccaaatcccttagtgagccaggaggagttagatttagggccagaggctcctcagccatacctggtctgaatctggaagagatgggaaactctttcaagtctgcagtggagagcttcgtttgtccacacatgtccttaattgtatgtgcctagtttttaaattactccttttttctatttaacttcctgagagacataagaagaagccagggactccacaatctttacaattattaaaaaccacaatgagacatctcacctcatacctgttagaatggtttttatcaaaaagatggaagataagtataggagagaatgtggagaaaaggcaacccttgtacactgtggtgggaaggtcaattagtacagccattatagaaaacagcatggagagtcctcaaaaaactaaaaatagagctatcatatcatccagcaatcccactactgggtatgtattcaaaagaaatgaaatcagcatgtcaaagaaatatctgcactcccatgttcatagcagcattattcacaatagccaagatatagaatcaacctaagtgtccatcaacagataaatgaagaaaaagtggtatatatatatataaggaatgcaattttgcctttaaacataagaaaatcctggctgggcatggtggctcacgcctgtaatcccagcactttgggaggccaaggcgggtggatcacgaggtcaggagatggagaccatcctggctaacacggtgaaaccccgtctctactaaaaatacacaaaaattagctgggggtggtggtgggcgcctgtagtcccagctaatcgggaggctgaggcaggagaatggcgtgaacccgggaggcggagcttgcagtgagcggagatcgcgccactgcaccccagcctgggcgacagagcgagactcgtcaagaaagaaaaaagaaagaaagaaagaacgaaagaacgaaagaaagaaagaaagaaagaaagaaagaaagaaagaaagaaagaaagaaagaaagaaagaaagaaagaaagaaagaaagaaagaaagaaagaaaatcctttcatttgcaacaatagggtgaacctggaggacattatgttaggtgaaataagccagggcacagaaagacaaataccaaatgatctcatttatatgtggaatctaaaaaagttgaactcacagaagcagagagtacaatgagagtacgatggtagttacgaggggctggaggaatgggggattggggagatgttggttaaacaattcaaaatttcagttcaataggaagaataagtcaagagatctattgtacaatatggtgactacaattaataagaatgtattgtattatgtaaatcaataagaaaatagattttaagtgttctcaccacaaaaatgataagtatgtgaggtaatgcatgtatcaattcgcttgactgagccattctgcaatgtatacatatttaaaaatgtaatgtttatacaataaatataaacaattgttgtcaattaaaataaaataaaatggtaaataagttatcactgacatacaattaagaaccacagccacttgacctccaataatctatcttccatgtacacttcatccccatgttaccaccagtgataatctgagtaattatgccacctcctgccataaactgcccatgtcccattttcttccgctgtacactttgaatacatgacaaaactaattccggaatttcatttttggttctgttgactaggaacatttttggtaaagtgggaaagagtactaggcagggtgccagcattaaacagatggtataaccaaattagaataattgaaaaaggattgaataaaaggacaatttaataaagctataggcaagggacaaggaaaacataggctctttaaatgtggtctctgaaccagcagcaccaacatcacctgggaacctgtcagaaatgcaaattttggacctcacccgagacctattaaattagaaatcctgggagtgaggcctaaccatctgtattgtaataaactcatccaggtgattctaatgtgcaccaatgtttgagaaccactgacataaggtataatgcagtaaccaagtgctaatagctgtgaagctgttaccaatcctaggtccaaagagacaagagaacagatccgtatttgaaaccagagaaagccatagagacaaccaccttgagagaatcagtgacctttggtcaagagacccaggctaccctaggaaacccaataacaaggggataatataataaataacaaagtctcattttctcccttcttccagttgtcaacctggactcccaagtggccaaattcaaccagaatctagaaggcgagggaaccagataattttgtacattacagccttccaggctgaagaagaaagatgtatctgaaggaacaaatagaggagatccggcatgcaggcctaatttgcttttgttaacacacccaagttttgataaaactccaaaacatgtatttaaggaagctagaaatttaaaatattttgcaatttccatggcaagaatggtttctcaggaatggtcatttactatttaagctaataactagattccaataagaaagttcttttatggttagtgaccaaccccttttcttgttccctataatacagtatattgtagatattaaagaaatgtcagggattgttactattattcattttataatcacctcctttcccctatttagatatttaagtctctccttgtttccatgccgcatctgctaagtgaggatctaacctgtcactgaattctcctaggatttctgttcatatcagaacccttccctcttctgaatgccataatctaagctccattcacccacaagctacaacctactgacttacttaattcctttctcttttataagctatatttctttatttgcatttaatcctatgtaccgttttgggcttactcttgctttcagctagacaaactgctctagcctcctccttgttcttagttctatactacactttaacattcgcattgccttgatgcttgagatgtaaacatatataatgtggagttgggcaaaattaagggtctgcatccccattattgacttttagacagcaccacttcaccgtgcccctatctccatctatttctattatacaatgcttgtatccatctattcagaatttgtctgaatgtgaagtctcagccatccttgtcaaacccatctctccataggcacttcactatataggacaagtacatacacaagaataagaagccttgtttataattatagactgctttaccacacacattctcatcaatgtttcatctttcacgacactgataacttgaattagaaaggattctggacagtcagcagaaacttgttttaaactgagctttgttagaaaataaaagtaagactgaaataaatattatctgattattatgaatgtgtccctcaaatgtgtcctgcaaatttacctcttggctttctctgaaatgaaagaaatctatttacaactatttttggttttttttctactaaataaaataaaaggtgtatcttttgaggtgttggaaggatcagctaaccaatctcacccaatcattacttggtatctgctacgtgtctgacgttatgctagttgctattgactcaaaggaaaaaggaaaattgtcctctgccttcaaagggaaacaaaaaataagcaggtagttatagttattagtatttcatcaaggtacaaagcaggttatgtactctagactctgtgatcagagaaaggctttctggaggagacatcccagaactatgacctaaagagtatagtaagtcaagcagaaggagtgaggataagggaagaggaggaggtacaaagaagaagctatatataaaaaggtataaaggcattagaaaatgtgaggtattaggctgggtgcggtggctcatgcctgtaatcccagcactttgggaggccgaggtgggcggatcacgaagtcaggagatcaagaccatccttgctaacacagtgaaaccccgtctctactaaaaatacaaaaaattagcagggagtggtggggggcgcccgtagtcccagctacgtgggaggctgaggcaggagaatggtgtgaacccgggaggtggagcttgcagtgagccgagatcgcgccactgcactccagcctgggtgacagagcgagactccacgttagtgggtgcagcgcaccagcatggcacatgtatacatatgtaactaacctgcgcaatgtgcacatgtaccctaaaacttagagtataataaaaaaaaaaaattaaaaaaaaaaaaaagagagagagacaatgggaggtattaaagtaaaaagtgaaaagtgaagaggaaaagtctagataggtatgtaggggagaaataaagaagggtcttgtaccctatgctaactatgctaaaatctatagagaatcatggaagaattttaaatcagggagttgaagagtaatattttcctttttaaaaggtcacaatgtgaattgtaaaaaaataaataaataaataaagctagattggaggggcaagactagaagtggggagataagttaggataccattacagttaaaaaaagaaaaaaggatgaacctgcactagagtggtagatgtgaaagtggagggaagtagcttcatttgagagattagggaagcagactcaataggacctggtgactatctggttgagtagctagaagagatatcagtggatgctaatacaggactgagctcagaaagaaaaataagcaaaggtgaccaaaacagaatgatcagaaaacacaagaaaaactattatggcatttcacacccaaaacaagcgtttgaggagatattggtctatggtataggttgagtaaatgaggtctgaaaaagaatcagtgtgcttgacaagtaggaagtcagtgaaatttgccagaggagtttcagaagtggggtggaactagaagtcaaataagcaaagtgaggagaaaataggaggtgaagaaacagataaagcaggtgcaaatttctcttttaaaaaagcttaacagtcagggatagaaagaactgatagcaaaaaaaaaattatagagcccagggaaagtggtggccttttaatttttttagatgggaggaactggaaccttcatcagaacgagctaataaaagataaagtttgggaaaaataggattgtattcttcttataccagacattggggtatattgagtaagagacactactgacacaaaatgtcttttaaataatatgttggaataaactcccaaaagcatgaacaatattccaataaagttatgcaagttgcaagataggtgattgaagaagagctctttattaatcaaagaaaactctcaggtacacactgcctgacatccttaaatggtaacatgtagctaaagatgacatccaggaaccttaattaataaaaccaggaccataaacctcaggaacaagagttggaaagaagttttacagaggaagtttcaaaaatggcaatgagtggccggaaaaagaggaaaaatcagcatgcgtgtgctgatgatattttaccagctaatagctcctcagaatttcttctccatcagtctcccacaaccccagatcatcacactgcattggaccattttcttgatagctttggctctgagcctctctagagccctctgctggtggatttttttaaaaaaaaatacaaggattaaggattttacctgacttctagatcccatccatccaaggtaaaacccttcacatatctggctttcctgggaagagtattccagaggaaacactatttccactttaatgtaagtgttcatgggaagtgaaagtaaacattttgcacacagagaaaacctatcaaagactcagagcaggagataaaaaggaaggaagatacaaaaaaatgtaaaaatcaagaagggaaagttatgcattgtgggtgactgcaggttctggaaacaatctacctgaattcaaactctggcattatgctttaacagacacatggctgttaacaagttgcttagtatttttggacttcattttcctcatcaggaaagtatggaaaaaaatatcttttattatgttgattaaataattaataaatgcaaaaaaatgcaaatggattctattgctacattttcggttctctcttcagtgtcttatagaaaagtaaaggaaatcaacttgtcaactagcagaaagcagtatctaataactgatcaaattatacgggcagtaatgctaattgattaaaagtcatagcatatcgtcatatactgagttccaacagatggcatgaaaagcctttgcagtcctgaatctctgccttctatacaacatgctactgattaattgtttgtttgtttgtttgtttggttggttggttgtttttacctcagcaactaaatatcccattcatataaaccacagcactagtatcagagacccattcagtgcttgtctagtctaatttcatgaaggaaaacatcatgcttatttgaagactatccttgaaaagctacagtggttaatttcagtattctagatatgtcagtatcagatattgagtcctgctttgcctatcacctctttctaagactgagtgtacaacctatacccccaaacctcagactgtgctccaagcatctcaaagtggccattaggtgaccagtacattaattctcgtgtacattaaattctgtacaatgggtggaagtggtaagtggctaggtaaatcagatttcatcactcgggacctataaaggaaaaatatggatgaaattaaccagtggaattaggaattaacacacaaaaagaaagagtcttattaatggtagagtgctagagtcaagatccatgaaactaccactaagaggaataacattatctggtccccattctcagaaggtcctgtgggattctgctactctaccctacatgtgttctcataaaactccaatcattcatgttctccatgacaggaaattgccaaactagcacattatagcatttaattatcattccttcccctcttttggcctacatacttactggatcatcctttcaacattcaagagactaaattacagaattacattgatatggcttagctgtgtccccacccaaatctcgagttgtagctcccataatacccatgtgtcatcggagggacccgggggggaagtaattgaatcatgggagtgagttttttccttgctgttcttgtgatagtgaataagtctaatgagatctgatagtttcataaagggcagtttccctgcacatgctctcttgcctgccaccatgtaagacatgactttgctcctccttcaccttctgccatgattgtaagacttccccagccatgtggaactgtgagtccattaaatctctctttctttataaattaccccatcttgggcatttcttcatagcagtatgaaaatagactaatacatacatctttgagacattttttttctagcctaaatgttaagtggtatatgcataatgagtatggaaagacttcattaattaaacattccatttaagaggactgagcataatattcaaaggaaagaaagaattctaggattcaatcaaactatttaagtactaaagttcacttagagacccagttaatcaatccctcatttgaaagttaaggacattgggagccaggaagtaagtcactaggaactgagagacctgtcaaaaatgacacagctatttagaggcaaaggcaaaaccagaatcagaggtacaaattcctacttcaaaactttttttttcctattagtgaattttaattctcaaaaagtttacttctactcttggtctgaagtgactttttaacctcttaaccttaattccaacatctttgaaaggtgctcatataattgtgactgctgagaggatgttacttcattttgtgaaaaactttgaagataaatagcaccattacaattatgactcatctcaaaaagtttaacatttcaacctttgcttcttattgtctttttatgcaacatgattaatgcactctatttttttgtggctgtcacaagagccacaaaatctctcacttcctttattgtgactcagtttgaaaaaaatatgcacaaactttttcttgagtgcttgcttacataaatttaccaagtaaaaaaattatactactcactcaccatcatcaagtgaaatactatgtcatcttacagcagcatctcctggctgatgtttgtggcaagtctaaagagcttcataaacctttcctacatttcactctgtaggaaaaggtatgggaggtggaagtatgattgtaagataaaagagaattaaggagaaaaaatgatgtggacatggatgagaagcctgggagacaatagaagaggcacaaagagagaaatgaagggagctaataagaataagtgtgtgtatacaggtgtgtgtgttgatgtgtacatgtgtgtttgtgtgcagctggtcacagaaatacagtcagaaagaagtcgttattatgttgttttgactgatctgttgcagaacaggaactgtgatgaaaacagcagcaaacagggtcaacttactattgatcaatataccacaattataataagtagttctaaattaatccaaggctatttcagaaatcccaaatagaacaaaaaaatgaaattctacccttattaatcataccattgccggccaaaaggagcagaattatactcctgagagtattctgaaaatgtcagtgcaacattgttctgtaccaagaactgttagcctgcaaatgtatccttcctttaaaaaaaattgccaccaaaagtagatattaaaggagcaactaaatagatgtttctatttacccaaacaagctccagaggaacttacgtgaagtgtcttaggcagaataaagctatacgttactcagaataaataaataaccaagaatgttatttcttgcacagttcagagtgatagaagggttaaataagtaggtggagataagggaaggcaaagcttaaaggctcacaccttggaagatatttaagtaggaaagcatattgcaaagttcataagattgttctcctagtctattttaccactgtaaaccctctatttaagtatctagctgtatgcatcttccgacatctaaacccaattaaatgccaactgaaatagccttaaattactacccctaagtaattccctcctacttccataaataaaacaaggaaagtaaacagcactaaaaccagctgtgatgtccttcacacacacacacaaaaaaacttctttttaaaagcaaagttttctgagatattaaatttgtaagaggaaaaaatcaacacagactcattcattccccaaatgtgctcacaatttttaaagttttaatattaccatattagtccgttctcatgctgctataaggacatacctgagactgggcaatttataaaggaaagaaattaaattgactcacagtttcacatggctgggaaggcctcaggaaacttacaatcatggcagaaggcaaagcaaacacatccttcttcacatggtgacaggagagagaagtgaaagcaaagcaggggaaaagccccttataaaaccatcaatcttgtaagaagtcacggactggcacaagaacagcatgagggtaactgcccccatgattcaatacctcccaccgggtccctcccaccacacatggggattatggaaactataattcaagatgagacttgtgtggggacacaggggacatagccaaaacatatcaaccactttattcttactcctagttattataaattactgtattttataataaagataatttgtgaaaatgagcttaactgtcatcttttgttttacttttccccagtttcatacacaatatccaggtgccacagaaaaggtaactagtataaaggaatttacaaaattataatttatgaggtttattctgtaccttctgcgccttaaaagaggtgatactattgaaatttggaggtgaaaagattttgactctggaaaaaactgaagccttttagggaaccacttgtggccaaagtctacagtagacttatatagcagaaaatgaattaataatggtatttgaagaggaagaatgaagcaagaggagtgaggggtattggaaaaagaagcaaaaaagtgagacagataaaggaagaatgagagcagcttccaagctctataaaggatcatggaaggaggggggttgggaatctaataggtaactttaaacaagaaaaatggtattaaaaccaaatacctgaaaaactaattgatagtgaccaaaagcagatctgtggttgcctgtggctggggattgagaagggagcttgcctataaaaaggcagacagaaatttctagagtgatagaaatcttatatttcaattatggttgtggttacctgaatggctacatttctcaaaactcaatcaaccattaaaatgggtgcattttattgtattcaaatcatacctcaataaagttgattttaaaaattgaatgtttagtaaagcacactcacagacatatatttaagtgtatagaagaaagagaacaccaaaaaggctgctaaaaagaaacttgcacgaataaataaagcaaggaaagcataaaactatcccataatctttaggaacaatgtgttctagaagagtaaattttattgaatactgaagcttatgtttttaaagcctcccattttttcaattcatttcccctagtatcccaaccccaacattctttctaccacattggatcaccaaatccatcaattatatcaactttttagtcacacacacacacaaacacacacacacgcacacgtaccacctcacctcactacaatcacaccacaccgagctgattttttaaagtgttaagtctgcaaggcttgtgaaaaaatatatacatttaaattactttttttttttttttgagacagagtctcgctctgtcacccaggctggagtgcagtggcacaatctcggctcactgcagcctctgcctccggggttcaagcaattctcctgccttagatttgcaagtagctgggattacaggcacgcaccaccgtgcccagctaatttttgactttttggtagagacggggtatcaccatgttggccaggctggtcttgaactcctgacctcatgatctgcctgccttggcctcccaaagtgctgagattataggcatgagccactgcacctggccttaaattacatttaaaagaaatttggctttaagtgtatcttggctttcagtggaggtcccattcagaaacaaggaacagagaagtgacagtaaagctgagtgatcaccatattgagaaaattctacacagagggaggaaaataagccaacaaaaacaaaatagttcagtgcatcaagggaatcataaatagtcaatctcgctggaaataataagggggagaagaggagactggacatgcacatagcaaagaccagccttagaagtctgaggacgatagccattgattctgtgacaatgaaacctgtgttttgttcattagcatgtccctggaccgtaacaattttctaggatgtactgggtgctcaacaaatatttgacaaatagatggacagatgggtggatatatgaataaataaatgactggcctgaatcatggagggttttgtttgtggtaaaaagtctggactttgatctaaaacccagcttttgctaaccataataatagacaatcatttatgaagtatgtcacaagtaatttgttagaaattaaagtcaaagtaccataatttgtgaataatttactttttaaatttaaattagagtctgttcaagattacccctacattactaccttcatgttcattccttactttactgagtggtaaagtaaggaattttagccaattcaccaataaatgcacatctattataagctgttattgatagtaaattaccacggctaaactactaataactgtggccattataaattattgaagtctgtacttcctaaaaaataaactttaggtaatcctagcactttgggaggccaaggcaggcggatcacgaggtcaggagatcaagaccatcctggctaacacggtgaaatcccgtctctactaaaaataaaaaaaaataaggcatggtggaggggcctgtagtcccagctactcaggaggctgaggcaggagaatggcatgaacccgggaggcggagtttgcagcaagctgagatcgcgccactgcactccagcctgggcgacagagcgagaatccgtctcaaaaaaaaaaaaaataataataataataaaataaactttagcatttctcaaagttgggcaaatcactgaagtatacaaggcatgtgaaatcaccagtcatgtgactctaatgaaggcaacagagagtcattgaataattttaagaataggattgatattatgtaatttgtgctagagaaaaatcacttttgtggcaatgccaattagtggagcgtatgagacctgaggcaggagactgctacaaaagtataggtgagaggtggagaaagtctgaaccaagatagtagcaacaaatatgtagaaaagaaaaggacaagagaagtaaataagcaataaaattaagacttatgcatcaattagattcactaccttaggcaaaatggctttgcttaaacaacaaggtcaaacagcatataaaagaagagggtcatactaggtaggaaagataagaagttctatattagacatgctgacttggatacaaggatgccaaactgagaaaaagaggtctggaatagaggtactgattcaggattcctgaaacagaggtgtaaaagcctagagagagtgcatagagttagcaaaagagaatgtcacacagacagaacctggaataatatcacttttaagataaacagcaagtatttgggcttctactgaaccccaaaaagaagatgcacataatttgaatcatagaccgttagttcctccaagtagagttcctcttagtgtaatttcatgcatagtataggcatttaataattaaaatgaataattagaaagccaaaactaaaaagaaagaaatcatctatactacggctaggaaatcagtttcaagactaactgcagtcattttcgcatgactatctataaaactgtgtcaatagactctgaggtcaagtatggaattcaaaggaaagactcccataactctcaggtaacattaaagccatgggctcaggacaagagaagcaatcattcgtgtgtcacatattgccactattgatattttctgtttattacatagtttattttttattttagtatataatttaactatgaaaataatacaagtaaattgtaatatcaaacaatacagagataaatgcagaaaatataaataatattccccaacctgctctgaagtcttattccccgaaggcaacaaatactcaacaagagtaaaatgttctgcatttatgctctcactcctttctcctgctcataaaagggttttgttttggtttcatttgttcataaaattattatcaaaggaagacattatgacataggaagcattatggcatatggataaaattgctaatgtccaaatttattgttagagttgactatcatttattattgtttaaaaagtattttctataattatatgtaagattatatttttcttctctaagaaggtttatcagtagtttgcctgctacattgatttttatcagcgacccaaatgacttctaagtggcccattccaatgttcaagtttcagtcttcttggcagcatttgacacagctggtcactttgtccttgagatttcaagtagtgttcttaccagcttaatgaagttccttctcagattcccttgctattcctcctcattcttctgacatctaactgctggagtacacacacagtgcccagtcctcagaccttttcttttctccatctgtactatcatccaattccatgtcataattgccatctttattctgtctacctcaagtatgtatcttcagcccaacctctctatcactcagcatcttcattttattgcctaacaggcattcaaaattcatacccaaagtaaactccccatcttttccttaccccaaaatattaccattgatcattaaattgggtgagttggttattcagcaaattgattgacaacttagcagatatttacctccacccctctcattaatctatccactgaagaactgaccataataatatctaaagtatctcagtaacggggagggggaactaagaattttatattcagcaaagttgtcctttaactataaactaaactgataggccatctcaaatatattaagaacttagtaaaattaagcactttgtaagtgcttagtaaaaagcacttacaagtgcttccttaacaaattcccagaccacaaaatctaaccattcaaacaaacaaactcagtaatatcgaaataatagtaatagggctggtgttgagcacaaactctatttttaaatggaacaaggaacatgttattaaatagctttaataactacagttacagaacaaacaaaaaatgtactaaatcaatgtataaagaataagatatcaaaaatcagaggagggggaggggatctgttaaaaagtatgtttgttattttttcatcttttatagaaaatcactagtgattgcactgctttaatatgttaactttgtgctctacaagcctctacataactttcaaacatgctctgttcctatgaccatcactacattagaatagaaaacaattgaaattgactcctaataaatagtcgtacttgaaagaaaaaatatgttaatttcaaactcttagactgagtttattctttttgaatagtgataatgggatttgtaaatcggctatatcatttatggtaatgaaatatttatctgagtggaatcaacagctcctccagttttatttcaatctctctttcttatgttaaattcaagtaaaagtaaattaatacttggtatttaaaatgccatgtatactgtgatcccattttcctaaaattacatctagctatattttgctcaatatagacacactgagaaatgtctggaaagatgttcaaatgctgagaatggttatttctggaaagtggaatttggagtgtttttctgcgttcttatttttctgagttgtttaaattttataataatcacatcattttataacaaaagctattaaattttttgtcaagggccttagtacaaacagaaatattctaatagttaaatctagtaactcccaccaccaccaccatcaacaaaagcaaggccttttgcagttcaaaatacatggaagggatcaaagctcagagggaaagacctcaagatcttgcttttttgggtatgacattgatctcatctcttcaacagtaatagataattttggttttatgtcatctagccatgacagagccattcattgcatcattggttgagataatatagcataaagtatttaacagcaaccaccctaaagatgacaatatggaaatactgcttaatggacagaaatttttttatctgtaaaatagcataagccatgttttacctcctcacattcagaggaggtgattaatgattttcccccttgaaaatataaagtattttttaaatgcctatacttccaaatccatataataattaagtagctctgaacttaacctttcaaaatttattctaaagggtttcttttactttttattctggctttcaaaatagtaaaaggcattattaaattcctttccgtagctgtcacccaaattgtacctttagcacacatataccaccgatctatttgcatctaacatttcatttctttatgcttaaaagcagtaaatgtttcaaaaactgtagatcttcttttcagcataattttcttttgaaagaaaaaattagatagcaattatctgttgatttcataagcagcacatatcatcgggttttgttttgttttgtttttttctttttgtttttttctttttttgcttcttttttaaattttattattattatactttaagttttagggtacatgtgcacaacatgcaggtttgttacatatgtatacatgtgccatactggtgtgctgcacccattaactcttcatttagcattaggtatatctcctaatgctatccctcccccgtccccccaccccacaacagtcccccgtgtgtgatgttccccttcctgtgtccatgtgttctcattgttctttttttttttttgagattgagtctctccctgtcgccaggctgcagtgcagtggcacaatcttggctcactgcaacctccgccttccgggttcaaacgattctcctgcctcagcctcccaagtagctgggactacaggcacccatcaccatgcccggctaattttttgtatttttagtagagacagggtttcaccatgttagccaggatggtgtcgatctcctgacctcctgatccacctgactcggcctcccaaagggctgggattacaggctgagccaccgcgcctggccatcatcgggggttttaaggtcaaacatactactttctggatctgtgttcagtaggtatgctttggccatgtttcacccttttcaactagaccttcttggtgtgactgttgcagagttgccaatgagagaagttaactttaaagtcagctttagtttatttttatagcccttgtgaaaaaccacagttgaatctctttaaaatcaggagacagcttaataaactttttctttgtttgcatataatcataatgggggcaaaagagggatggcttaacaggcaatgaaaaccatttttttttttttacataaggagggatagatgtgaggtgtaaagacatttaattgaattatcagacattctaatatgtaggagaaaatgcctattaggtatttactacttgttttaccccctacttactcaggattaggcaccccagtccccttctattctaaaccaaaagaaataattgaacacattctgcctgaactatcctgaagcagtgtggcatccatttattatcaactacattaataattaggattctcctaatcttgatggaaagattgaaacattaatgttctacattttatcccccattctcccactgaagatcatgtgaccttaagcaagctacctgtcatcacttagggcttagttttccacctgtaaaatgatggaagttaccctagatctgcagttagtggatgttgggggctcacagaatcaaaagaaatgaaaactaatggatctttccccagtaaaatgcacacatgcataaaccaaagaacaaacaatgttctacaaggtcccatatggtatagccagcagtcctctccccaaaccctaattttccaccttcatctccatgttcactctgctccagctacattggcctccttgctctttctcaaacatgacaagcagactatcaacttagggtaattgcattgactgttctcctcacctggaatattcctttttacctccaagcctttgctcaaatgttgccttctcagtgaagcttactctgatcaccttatttaaaattgcagaccacgttgctttccagctttactagcccttgctccttgctgtaaaattattttccccaatgcacttgtcataatctagctgttcacaaaaaacttaacatagcagacctaactgctacccttcaaaaggaaggcttaaaaggttggtccttggctggcatctagaaacttgggtttcaggagggtttccacatgcctagaactggtaagagtagctcactatacctaagtgtttgtgcaaacaatgtagtttatgctgaccatctgctttcctttggccagtatacaaatttggtatgtgctaggcagagggagggtgctgtgtgatcagcccccaataaaaaccctgagcactgagtctccaataaactgtactggtagacaacatttcatatatgttgtcacaactcattgctggaaaattaagtgtatcctgtgtgacttcactaaaagaagtgtgtaacttagtctttcccagactttgcttcttttcccttttctctttgtggatctcgcccaatatctcttcactgtgataaatcatagctgtgagtaaaaccatatacaagtcctgtgagtcctcctagcaagtcatagggaccaggggtaatctccggtaaccccaacccggtagcacactaaaatttactcatgaattatgcctagcacataaaaggtgcttgattaatatttattaaataagtacatgcaaaattttgcaattaatttaagaaagttaatggagctccctaaaaaaagtgctaatcattgatactggtaaggactcctttccaagatgctctccttataatttgaagattcaaaattctaagcaatggccaggtgcagtggctcacacctgtaatcgcaacactttgggaagcctaggcagatggatcacttgaggtcaggagtttaagaccagcctggccaacaaagtaaaactccatctctaatgaaaatacaaaaaatagccaggcatggtggcgggtgcctgtaatcccagctactttggaggctaaggcaggagaatcacttgaacctgggaggtggaggttccagtgagctgagactgctccactgcactccagcctgggtgacaagagcgagactcagtctcaaaaaaaaaaaaaaaaaaaaattctaagcaagaagatctgtctctgaactagtttctcttcctgaaaatgcttacatttatggaaaagtagaaggaactgtatatgttttagttggccaaactaggcacatgtcctcagaattaagtgtgacggcatgttgtaaacttggtaaaaaccctggctacacatgagcccttgatggaaatatgaggtttccatttttcttggataccatagcttcaaaattagatttgggaaagcctcttaaagccagacttttgaagctcagtaatcttctgagccaagttaatctagagggagtctcacggcctcctttaaaaatgaaaaacatggaaagttaaagaaattttaaagaggaaattagaaaaagccaactctgagaacagagccaatctttgagtatgtgcagaacatatgagggaggggagaggaagaaaaagttgttattactgttaactgaatcctgtcagaatcaaaaaacaatgtgcaaagccctctcatgtcagcaatactacaatagagataaccagcagcttgggtgcaagcctacattttaaaatatttaatcttttctggtagcaagaaatattggccaatatatttattttggcaagaaagatgcccacttgtagacaaaatgctcacagaactaaatttcatgctgggtactcaaagggagcatatgagtaggttctgttatgggggcatagtaggagttcaataaatgctagtgaaattaataagcatgcctggtaggtattcaataaatgttagtgaaatgaataaatgtgtgcaagacactgggctacacgttgattatagccttagtgcaaatcatacaggtcttaattactttctatagtaagtctgggcatattacagaatttgggggagattacaaaagcagacccttagtcagtgaattaaaagaagagaattgagattggaaggaaacatttctgctgtttttaattaacaaatcctaaagtagttattttagctgttaaaatagattctaagtctttattcaatttttgcaaattttatcactaaattacttagcaatagcttcttctctaaaccatcctccctcctgctccaccccacacaacgcttttggttccattaaaacctgtaagaatcttgatttctttgcagaaaaagttctttgtggcccaacactaactgcacttaacatatgatcttatcatgatattgttaaaaactgtaaaacctcaaaggtagccaatttcaaagagagaagataagcactaattattcaatcaccaatccccatgtttatagttgcaaagtgcaatcaagaattaatttttaagctagtctcaaagcacctaagagaagatagattaaagatgcagaaagaaacattctaacttctttacacactgaattctatgtatctctagaaggagcctctggaattcccatgtcatcagttctttgatggaagcatttatgtgattctactcttcattcctacttatgacttaaacagcccgtatcttcagtcaggattctgcatgattaagtgccatcctagaccaatgggacgggtctcaacaggcagatcagcggcacccagagggaaagaaatccacatcagatcccaacacagaccataatcttttgaccataccatgtagatttcttattacattcatgagactggtttcagagccctcttcttaccttatcctaaactttctctctagatgatctcaaatgctgccataactttaaatatcatctctaagctgaaactccaaattttaaatctcgagtccacacctctcctcttaaattcaaactcacatatacaacttgatttctgtttttggatgtctcacaggcattgcaaacttgtatgcaaaattgaactgtttcaccctaccacacaccttggatctgcttctcttcaacttcttccatccctataagcagcccctccacctactcatttgctcaggtggaatatttgtgtcatattaatatttatttttcacctccctccatacacaccccacattgaatccatcagccaggcctagtgtgtgcgccacacagatcacaaacctgtcaaaccttttcttatacactgacaaggtcctagtccaagatactgtgtcatttttcacttgggtttcagcatggggagaaaagtccatgcttatacttgaaaaaaaaagaccttttataaaattataacattacaaattttaaacaggcatttaagaagtctcatacgtgtgttcaatggaacacacttgtgtttctttttcttttttatttataacttttattttaagttcagggtacatgtgcaggtttgttatataggtaaacttgtatcatgagggtttgttgtagagattatttcatcacccaggtattaagttcagtacccagtggttatttttccggatcctctccctcctctcaccacccacctttcaataggcccaatgtgtattgttcctttctgtgtgtccatgtgttctcatcatttagctcccacttataagtgagaacatgtggtatttggtttgctgtttctgctttagtttgctaagaataatggcctccagctctatccatgttcctgcataggacatgatcacattttttatagatgcatagtattccatagtgtatatgtaccacattttctttatccagtctaccattcataggcatttaggtttattccatgtctttgctattgtgattagtgctgcaattagcacacaagtgcatgcatctttataatagaataatttatattcctttcagtatatacccagtatttgaattgctggatcaaatgatatttctgtctttaggtctttgagaaatcaccacaccatcttccacaatggtcaaactaatttatcccacaaacagtgtataaacattcctttttctctacaatctcaccaacatctattatatttggactttttaacaatagccattctgactggtgtgagatgatacctcattgtggttttgatttgcatttctttaatgatcagtgattttaagctttttttcatatgattcttggccacatgtatgtcttattttgcaaaatgtctgttcatgtcatttgcccactttttaatggggttgtttttttcttgtaaatttgtttaagctccttataaatgttggatgttagacctttgacagatgcatagtttgctaaaattgcctcccattctttaggttgtctgttgactcttttgatagcttccttttctgtgcagaagctctttaatttaattaggtcccatttgtcaatttttgcttttgttgcaattgcttttggtgtctttgtcattaaatcattgcccatgcctatgtacagaatggtattgactattttctcttcagggtttttatagtttttggttttgcatctaaatctttaatccatcttgagttgatttttgtatacggtgtaaggaaggggtccggtttcaatcttagcatatggctagccagttatctcagcaccacttattgaatagggaatcctttctctattgcttgtttttgtcagctttgttgaagatcagatagttgaggtgtgtggccttatttctgggttctctattctgttccactggtctatgtgtctgttcttgtaccagtaccatgctgttttggttattgcagccttgtagtataatttgaagtcagggagcgtgatgcttccagctttgttctttctgcttaggatggtcttggctatctaggctcttttttggccccataagaattttaaaatagttctgtgaagtgtttcaatggtagtttaatagaaatagcatcaaatctctaaatcactttgggaagtatggccattttaacaacattgattcttcctgtccatgagcatagaatgtttttcgatttgtttgtgtaatctctgatttctttgagcagtgttttatagttttccttgtagagaacttttacctccctggttagctgtattctgtggtgttttattttaccttttttgtgtgtgacacctgtgaatgagattatgttcctgatttgattctcagcttgattgttgttggtacatagaaacattagtaatttttgcacattgattttgcatcctgagactctgttgcaaaactgttgaagtcgcttatcaggttaagaagcttttgggctgagatgatgaagttttctagttataggatgatgtcatctgcaaaaaagggatagtttgacttcctctctttttatttggatgctcttattttctttctcttgcctgattgccctggccaggacttccaatactatgttgaataggattggtgagagaaggcatccttgtcttgtgctggttttcaatgggaaatactagaaatgcttctagcttttgcccatcagtatgatgttgactgaatgagtttgtcatagatggctcttattaatttaaggtatgttccttcaatacctagtttattgagtgtttttaacatgaaggaatgttgaatttatcaaaaagccttttctgcatctattaagataatcatgtggcttttgtttttacttctgttatgtgatgaatcacatttattgatttgcatacattgaaccaaccttgcattctagggataaagcctaatcgattatggtggataatatttttgatgtgctgctggattcagtttaccagtattttgttgaggatttttgcatcaatgttcttcaaggatattagtctgaaattttctcctttttttttttttgtcttgccagattttggtatcaggatgatgctggcctcatagatgaggtagaaagaagaccctccttctcacttttgtttggaatagtttcagcagtaatggtaccagctcttccttgtacatgtggtagaattcagctatgaatccacctggttcttggcttttttgattgataggctatttattacggctcaatttcagaactcattattgatcaattcagagattcagttcttcctggttcagtcttgggaggttgtatgtgtctaggaatttatctgtttcttccagattttctagtttatgtgcttagaggtcttcataatactctctgattgttatttgtatttctgtggggtcaatggtaatgtgtccttgttgtttctgattatgtttatttgaatcttctctctttccttctttattagtctagctagtggtctattttattaattttttcaaagaaatggttcctggattcattgatctttaaatgctttctcgtgtctcaatctccttcagttcagctctgattttggttatttcttatcttctgctagctttgggatttgtttgctcctggttctctagttcttttagttgtggtgttaggttgttaacttgacatctttctaactttttgatgtgggcatttagtgctataaatttcccttttaacactgccttagctgtgtctcaaagattctggtatgttgtatctttgttctcactggtttcaaagaacttcttagtttctaccttaatttcactgtttactcaaaagtcatttaggaggttattcaattcccatgaaattatgtggctttgagtgaatttgttagtcttgatttctcattttattacactatagtccatgacatggtatgttatgatttcagttcttttgcattttgtagagaattgttttacttctgattatgtgatcaattttacaatgtgtgccatgtggtcatgagaagaatgtataatctgttgttttggggtggagagttctgtatatatttagcaggtacatttgatccagagctgagttcaggtcctgaatatctttgttattttctgtcttgatgatctggctaatattgttagtggggtgttaaagtctccccctattatattgtgggaatgtaagattctttgaaggtctctaagaacttagtttatgaatctgggtgctcctgggttgggcacataggtatttaggatcttcttgttgacttgacccctttactattatgtaatgcccttctttgcattttttgatctttgttggctggcttaacatctgttttgtcagacactaggattgcaacccctgcttttatctgttttccatttgcttggtatatttttctctatccctttattttgaatttatgtgtgtctctgcatgtgagatgggtctcttgaagacagcatactatgatttttggttctttatctaacttgccactctgtgccttttaattggggcatttaagccatttacactcaaggttagtaatgatatgtgtggatttgatcctgtcatcatgacgttacctggttgttttgcagacttgtttatgtagttgctttatagtgtcacttgtctgtgtacttcagtatgtttttgtagtggctgacaacagtctttcctttccatatttagtgctacctttaagagttcttgtaaagtagttgatggtaacaatttccctcagcatttgcctgtctgaaaaggatcttatttctccttcatttatgcagcttagtttggccggataagaatttctgggttgaaatttcttttctttaagaatgttgaatattggcccccaatttcctctggcttgtatggtttctgctgaaagctccactgttagtctgatgggcttccctttgtaggtcacctgacctttctctctagctgcctttaacactttttctttcatttcaaccatggagagaatctgattattataggtcttgagaatgatcttcttgtgaagtatcttaggggttctctgcatttcctgaatttgaatgttggcctctttagctaggctggggaagttctggatgatatcctgaaatatattttccaagttggttccattttccccatctctttcagggacaaaaatgagtcacagatttggtctctttacataatcccatatttcttggaggttttgtttgttccttttcattcttttttctctattcttgtctgaatgtcttatttcagacagccagttttcaagctctgggattctttcctccacttgttctattctgctattaatacttgtgattgcactatgaaactcttgtagtgtgtttttcagctctatcaggtcaattagattcttttctaggctggctattttgactgtcagctcctgcatcattttatcatgatttttagcttccttggattgggtttcaaaatacttctgtagctcaatgatctttattcctatccatattctgaattctatttctgtcatttcagccatctcaatccagttcagaacccttgctggagaggtgatgtggtcatttggagcaaagaaggtactctggctttttgagttatcagggttcttgtgctgattccttctcatctttgtggacttaccttccttcaatctttaaaactgctgacctttggatggggtttttttccttttatcctatttgatgaccttgaagtttgattgtggtataaagtgaattcagctaactgccttcatttctggaagattttacagggccaatgcttagctcccaactcctggactgcatgctgtaactctgggggacttgtattgagccccaactttgttctctggctccttgaggttaggaatccacttcactggggaggtgggggagaatgaggtgctcccagaccactggtcagtacactccaacgggtggtgtcagccaaagtgtttcagagtgcgatgacagtgggacccattcttgctcacaagtgccagtagcagcagtagcaacagctgtggcatagtgggtggcaggtgccaggatgcctgcctccctgcaagtgttcaccacagtggcaaagtcaacgcagctggggggcctccgctggtgactgtgtgtgtggtcaccctgaaggtggtgttttggctcaggagtggggcactgatgggtgcaggtctgggtgtataggtctctgtgcctcgcaagcaggaatgattgctcaggcatgggaggatccaccattctctgcagagtgttaccataagggcagagcactggcgggggcagggctggctgactctgtgcccaccaagactctgtctgcaacagaggtcagtggggagaggaagggtagactgcacacccaaatgctgatggtcaagaaaagcaaaacccacctccacagacacatgccagcaaagcaatgtggggagttgccttaggcctaaagaaagctgcagtatgggagggagcatgggggttggtgcatggctgtaggggccatcctgctggagctctctaccagtcaggcacaatctgccagtgcagaagctatggtgtgggaccccagggcacccgaggctgctctgcaagcaggtgtagccaggctggggctctgggaaaggacagcagaccaaggggttctcaggtcagactggcctcgtctgatgggcaagaccaccctgcagagttcaggactgacagttcccctagtcctgcaccaaactcttcgggctccacatcagctggctgctgcccctaacccttctctaagcagctctccatgccatcttgagtgtccatagtggtcaaggggtctccccctgccagggttccagaggcctgtggcaaaagcagtttgctccttgccagtgcaactcacctgttccctcagagccactgggggccaggaatgagtgtgggtatactgtagccccatgtagcgtttccagctttctcacccttcagcccagcttctgcgtcttccctctgtccattcttagtgcctttatctctgaagatgtgttaggagtgtgtcagtcatctgagtcccttcatgagagccgttccacctgcctgcgtctagttggtcatcttgtcccccaccaattctttttctttttttatgattaataggatattataggacttatttggttttgaaactttttcaatataaacatacataaacacatgtactttttcattgtaccataaatgtagcataatattaaatatcagaattctgatttgtaacatccagataaacccataagtgatttttccagtaatcactctttctaattgatttatccattgatcctaccccactgatctaatgtttaatataaaatggcaaatgggctgggtgcaagggctcatgcctataatcctagcattttgggagaccaaggtgggtggaccgcttgagctcaggagttcaagaccagcccggacaacatgggaaaacccatgtgtactaaaaatacaaaaattagctgggcatagtgatgcatgcctgtagtcccagctacttggagtgctgaggcaggaggatcgcttcaacccaggaggtcaaggctgcagtcagctgagatgatgccactgcactttagcctgggtgacaaagtgagaccctgtctcaaaaataaaatcaaataaaagtcaaatggtaataaatagtaacatacttaaagtacatttggtttgctacatggatgtggcaagggagttttaccttgatacttgtaagttgtattctaatatttggatcttcctcattactttaagaaaaaaggaaaaccactcaggccctgttgcccaattattttacatttacagcatgattttgaatgtagaatatacatacatattgtcactgttcttataaagtaactcaaatagatgattctaaatattaaaatgggaagagataaaaaactcaaatcaacaaatatttacggagggcttactatgcacaaatagtgaagctacttacaatccacattgttaagtaggtatgaaatgagcaattagctgcaagttaaagacactcaaaatcacagtgcttcaaatgagacagaagtttactttgctttcacaaaaaaagtctggaggtaaagtgctcctgagctgatgtagtggttctgctttataaaatacctaggaacccaggcgtcttccaacttctcactccgccaccttaggtgtggccttatcctcatagtccaagatgccagctagagttccaaccatgacatccacattccaggcagcaggatagagccaaagtgtgcaggtagactaacttttatggaagtttgcaaaagttacccaataaaaatttcacttatatgtcattaatcttacttgcatctcaaagcataattacagctgcaagggaaactgggaggtatagctgctattactgttggtcattaatttagcaggattctgtttttagaagacaaggacaattcatattggaggcaacatctcactgtcacatctctctcctgcatgtttcccaaaactcaaatttctgaatgttctgtgtctattctgcccagccatgctgtaggaggcagcatgaagcagctcttaaatatttctatatttaaactgcctggatttgaatacagtctccaatgggtcctcatctgtgaaatggagataacagtaagatctactcctaggagctgtaaagattaatcagttcgtacatataaagcgattggcacagtgactgacacactgaaagataagcgcagcatatattactatcattatatcaatttagtcaagaggaaatggaagtaacttaactacaggcttaatagcttcctacacaggatcatgggaggcagtcagaagaacagagttaccactacagttttcatggtgagtcctgctgccaccccagtaccgtccataaagaaaatagagaggaactgacttgtataaagtgtcattttctaaaaaaaaaagctccttattcataccacattaataaagttaggcagaaaatctaaacatacagatcactccccaaaccttcctcagacgatacctgggataaactggtatttcaccctgccaaagagaagtaaaatacggataaaggaaaagcaattacggcaatttgttaaaggcatccagcaccaaagctaagatctgaattcaaaatccctccccactaatcctgtggacaaaatggtggaattcatacttgctgaaaccacctttacttataaatattatgaaaatactttaaaccacaaatcaagcaataaaaatcaggtttagggggaaattttctgggtatttttttcccacacacattcaaaattgcttttaagtctttactgacaaaagtgacattgttttttaaaaataaattgggaatacagaaactgccagattactgtgttggagtagtgttgctgggatatcacctctcttccatatttcccagtcttctaatgttaaatttaggctcctgttggcaaactgtttttcttcttttatggcacaaaatgattatcttacttcaactgccaaagtccaagcttgagacatgcaggataaagaaaagtgaataaactgctgtgtttccattttccaacatcacttgcaggcagcaggaagtcacaagcataaagtcacagggaattatcacaaagacaaaacaattcatttaaggctatttagaagcatatttttttatttttgctcccaaatgttgtctagtcatagtattgtgagaatcaacaaaggattctcctccaactgggggagggccgggggagggacagaatgggctagttcagatttggaacagtgacctagaaggcagttctatcactcagctattcaagtgatgtggccatctgaacatctttcccttccttggtagcagagtgagatgaatatatatgtgttaacattcttgagatgagatatagtatctttcctagccaaacataacttctccaaagccaactttttccacatgctttagagtaagaaagataatatttttagagatgttgagaacttttaggctttatcactaaaactgaattcacccagtgaagaggaaccctaaggaaaatttcaaacataatgtcttcccagtgaatttcatctttactcctgaatctgaggcaataggctactttctcccttattaaacataaagaaaaataattacttaatgagagaatatatagccattctcaataaaagcaactgggattccacaaacattactatgtcatgactgaatgaatgaagtgctaagataaagagtttagaaagaatgaaaaacctaattacttataggaatctgtgtgattaagtctagaaaaataaaaggaagaaaagtgcattagtctaatgagatgtagacaaaatatttaaaattggctcaaagtgtttggttgaattatcttgaataataaaagattaaatttcctagaaaatctttgttccaaagtaaaatgattttctgattcatgcttttgaaactttataaagtgaaacaaaagggcattttcctattctttttagtgttgaaaaatggtaactgggcctcagcagaactgaatttgggaacctaaatggcaaacctaaaaattcacttaaagaaggtgaattaggaaactttgttcctcataacagagctccagtgcttgagaactaaagcataaaactactttctgtgaactgtagagatagatttctgtaagatgtctgactcctccattaggaactagtgatccacatttttaaataagcaggaggttcatggatacagatcccattttttgagaaatgttgacctaaacaacacttacctgttctgttgatgcagaatgaaatcaggtaaactgccctaagcttcctcaagatctactcaagctcagtttatcctgttagcctatatctatctctttttctttacacattttttaaaagcaattttccctaatttcatatcccatgatttggagtcgattgtccactctcaataagaaggtatttctcctacagctctaactctggaactgttttatgaaagcttgcaaacagttagtaagcattacactcacctctgaaagatttttcctacctgtaatttaatttagctccaagctatagcacgtgaatgcccctgcattctttatatgactctttacgtcaagtctctacacactggattatatgaagatcccctatgattcacacagtcaataaataaatcaacaaaaatgtagaaaggaaggaggaggatccagttttagatagtaaagatcagaaagaatagtctacatactttatcaaagcgtactgcaatgaaaagtgtaagcatgactactttcaaatgcagattcctagcatgttcatttcctttgttcttcaagtattcatggaattaaagaaacaggaaacaatcagttatgtatattagtgcttccttcactgcactaggtcatcataagcttctgatgaccaaacagaactaagactaaaatggctgatgttcctaaaaacctcccagttgacccagataataagctaggatcaaaaataacaacaagccaatgcagcttttttctctaagaaattctgttattgctgttattagatttacagttacattgggatgctaagatttcttgctgtatttttatggtaattgcagttttatatacataatatcatcaacagctcatatattctgtgggctggttttatgctgggttggatttaaatgctcttcaaggaactgtacttttttgtccccatttaaaaagactgtagacaggtcagataataatagcaataactcagaaacctgaagattagaaaattgaataaggctgattctaaaaaggcatggaaatttcatacccatgctattttgttggctcactgagtacatgatggagtaaaaagaacattgaaactaaaatctgggaacatcagctctaatttcagctatcacactgtcctttaaggtcactggcctccttgggcctcagttgcctcatgtgaaaaatgagaggtctactagattatacatggcacttactttcatctctcacatcaattacaatcaactgataatggctggctgaagcactgtgttaagaaggattatgaggctgattctggacaaaagtagagtgtcatgggtgatttgctaagtcttccataaggacattgaggaaatagctgtacatatgcaatatattttccttatttgacccaaaggaccactaggatttcctttagttacagtctataaagcatattttacaataaaatatcataagatcctttatacaaaatgtttggtcttgttgcttcctccagccacccaagctgctgaaaggaaagaaggccaaggcagagaaggtggttctagtcccttatcataaagaagcagaaggccaacaaggtggtgaatcccctgtttgagaaaaggtctaagaattttggcattggacagcacatccatctcaaaaggaacctcacttgttttgtcaaagggccccactgcatctggctgcatcagcaaaaagctatcctctatgaatggctgaaagtgcctcctgcaattaaccagttcatctaggctttggactgccaaacagctactcaaatgctgaaactgacccacaagtacagagcagagacaaagcaagagaagaagaaagctgctggcaaagaagatgttcccactaagataacacctgtcctttgagcaagggttaacactgtcaccaccttggtagaaaacaagaaggctcagatggtagtgactgcacgtgatgtgggttccatcaagctgattgctgagggctcgccctgtatcctaagatgggagttccttactgcactatcaagagaaggcaagcctaaaagacatccagtccccaggaatacttgtgccactgtggccttcacacatgttaactcagaagacaaaggagttctggctgagctggtggaagctatcagtactaactacaaggttagatataatgagatctgtcagcactgaggaggcaacatcctgggtccaaaatctgtggcttgcattgccaagctagaaaaggcaaagactaaagaacttgccactaacctgggttaatgtacactgttgagttttctgtgcacaaaaacaatccaaattctttaaaaaacagcttggttgtatagattatctataaaatgatttctatattgaaaatcacttaacttcatgacactgtttcctcaatagtatacacacacacacacacatatacacacacacattgatgagaaaaaaaaatctactgccagccagagccactgtcagtatggggtttccacattctccccatctgtttgagttttctcgtgggacaccagtttcctcccgtatcccaaagatgtccacattagattaattattgtatctacaatgtccaagttggagtgagtgtgggagtgtgtgtatgagtgaggctgcaatggaatggagtcctgtcaagggctggttcctgccttgcaccctgacctgccaggataggcaccagccacccacaaccctgaacaggaataagcaggttggaaaatgaatgaatataaattattgtaaaataaatttattttgacaccaaacagtggggtccaaaagtgctcagcaagcctgccatatttattgtttgtttttgaactgtgtggtgataggaggtgctccttataattctcactttgcaaacatttattccttgattcaacccatcaccactacaaccactatcactcactgattcaccaaaacttgggtaaataattatcttacttgtttttattaatctttcttgaatgtatgtttggctcacatttatttcaatgtttaatattaaaagtgttttgagtctttacttagaagtttgatatttctatgacaaacatgctgtaggagcttactgcttgtttatgtaaattagcctaaggtaaagttagttttattacatatcattttgcttaaagttgtagtctccaagaacctatcgacaacgttgagaacttactgtgtgtaaatgtgtgtatataaccttgttttattgtgcctcactttatggcacctcacaaatagtgtttttttttttttttacaaattgaaggtttgtggcaaatcggtgtcaactgctatttttccaacaccatgtgctcacttcctgtctctgtgtcacattttggtaatttccacaatatttcaaacttcttcattattattatatctgttacaatgatctgtgatctatgttaccatcgtaattgttgtggggcaccatgaacagcacccataaaagaaagtgaacttaattactcaatgttttatgtgttctggctgctccaataaccagttgtccccatctcctccatctctccttctcctagggcttttttattccttgagatacaatgttgaaattaggccaattaataatcctaaaatgactctaagtgttcaaatgaaagaaactgtagcaggtctgtcactttccaccaaaagctaaacatttccttaagccaaaacctaacccagagcaagacctacctcttttcaattctatgaaggctcagagaagtaaggaagcttcagaagaaaagttggaagctcgcagaggttggtttataagatttagggaaagaagtttccttcataacataaaagttcaaggtgaagcagcaggtgctgagggagaagctgcagcatattatccaggagattagcccagataattgatgaaagtggctacactaaacaacagattttcagtgtagacaaaacacccttttagtagaagaagattccatctaggactttcagagctagagaggaaaagtcaatgcttggtttcaaagcttcaaaagacaggtggactctcttgctggggctaatgcagctgatgactcttaaagtcatcaacttaattgaagccaatgttcatttaccatctgaaaatcctagggcccttaagaactgtgataaatctactctgcctgtgctttataaatgtaacaaagcctagatgacagcacatttgtttatggcatggtatactgaatattttaagctcactgtggagacctactgctcagaaaaaagattcctttcaaaatattacagttctttgacaatgcacctggtcacccaagagctctgatagagatatacaaggaaataaatggatttttcatgcttgctaacacaacatccattctgtagcccatggatcaaggagtaaattcaactttcaagccttattatttaataaatacatttcataggctatacctgtcatagatagtaattcctatgatggacctgagcaaagtaaattaaaaaccttctagaaagaattcaccattctagatgccattaagagcattcacgattcatgggaggaggtcaaaatcagcattaacaggagtttggaagaagtcaattccaacctgcttgaaaaactgtgagggcttcaagacttcaatggcagaagtaacagtaaatgtaagagaaatagcaagagaactggaattagaagtgaagcctgaagatatgggtaattgctgcaatctcatgataaaacttgaatggaggagtagttgcttctactgggtgtgccaagaaagtagtttcttgagatggaatctactcctggtgaagatgcagtgaacactgtttaaatgacaacaaaggatttggaatattacataaacttagttgataaagcagtagccgggtttgaaaggattgaccacaattttgaaagaagttatattatgggtaaaatgctatcaaacaacatcacatgctatagagaaatttttcattaaagtaacagccaattaataggtctaacttcattgtggccttatttttaagaaattgccacagccacccaacatacggcaactattaccctgatcaatcaacagccatcaacattgaggtaagacccttcactagcagaaagatcatgatccactgaaggctcaaatgatcattagcatttagcaataaagtatttttaaattaacatatgcacagtgtttttggatataatgcaattgcacacttaatgggctacagtatagtataaacataacttttatatgcactgggaaatcaaaaaatttgagcgacactttattgcaatatttgctttattgcagtagtctgaaataaaacacacaatatctccaaggtatgcctctatatataaagagagggagacctaggaaaatacttgaaatgtattaattaatttgtttcatcttcaggagccagattgtgttaggctattcttgtactgctgtaaagaaatacccaaggctgggtaatttataaagaaaacaggtttaattggttcacagttctgcagactgtacaggaaacatggagctggcatttgcttcttgtgagggcttcagtgagcttacagtcatggcagaaggaaagggaagctggcttgtcacatggtgacagcatgagcaaggtgtggggggaggtgccatatacttttaaacaatcagatctcatatgaactcaaagcaagaactccctcatcactaaggggagtacaccaagccatttatgagggaccgagggacctgcccccatgatccaaacacctcccaccaggccacagtttcaacactgggaattacatttcaacatgaaatgtggaggggacaaacatccacaccatatcagagaccaattcttctctttattatacaaatgccaataaagcccaggagagaaaataacagaaaaaaaaattgtagctaatggcaatcactgataaggaatcataaatgagactcagaatatcttaaaatagttgtgcaaatgacaggaaaatcaaaacaaccttcttccagtaaatgtctcatgaagcaattgtgtataagcaaactgcagtagcttgcctacaatagctaacaacatcatctcacttaagatggatgaggtaaaagacatttctgccaatcttgctgtagccaccaaaaagcaaaaaatatgtaacagtcttttcgatgtcaacatttctttgatgatatctgtaaacatttgtttccatgtaacaagcaacctattcttcaaccaatgaatacagcatgagataagagtcataagacttgaagtttgctcccctctttcatggaatcattggggtcttcataacccacctaacctcagctgcctcaataaattatgaaagttgaccaatatttctcttctagctcataagaaaatgaattgaagtcttgtagaatggagaagtggctgagttgcaaaaatccttggagaggctctagaccaggtactggttgtcacctttacatggccatggtgggcttcttgcaatcactcattcttcaggataaattctatccctgagcaaagaaagcaaaatcttgtccttattaagactatatttttattgtcttttttttccaaagtggacataaatcctagcttacctattagtaatgcacacataatcacatcaagtttgggcaaagctaatgacttatccaatatcacatggtggttcaataaagaaattaaatatcacaattcccagatcttgttccaactaaataatggcaatactgaagcaaaattaggatatacacgatatatcctaaggattataggcaaactcaaaagcctacaatgtttagttgttggagttagagtgacaatcagaaatgttaatgtttatccaactccggtattccataaaatatcccagtttcatgtcaaataagttatacctacaatactttttactacggagaactagaaaaatctaaaatgaaaagagaactaaatacaacatgttctgatatattatgctctaggcaatgatcatgttcctaatttacaaagtccatgaaaagaatactcttatgttgaaatagctgttattaaaagtgagtgctcttacagtgaaaatagatcagatgtaacatatctctaagaaattattgttgttctagccattactttgtgaagatgtgctttgttttgattgatttagaaaattgtaataaataagaactgttcagttggaatatgatgtttattccttatgccaatatacgaccaaaaatattttctcacttcagcctagaaagtgagatgtgtattatttatctccaaataaatgtgtaaaaagatgtgtgctttcagtttttcttctttatcccaaaatatttaaatgcctaataaaataatattgttcattaatatattaattgtcctgcttatattttcagtatccaattagtcatttcaagtatgagatatagaaaagaatgcttggaatgtttgctatggctttgtacaaataaaatataatacctaacaagggcaggaggaaggaggagggatttataagtttgcttattgtatttttaaaagtcaaatttcatttaaaattatgtttaaataatattaccagaatattccaaaataaaagtcaaaggtaagaaaaataatgttaaaatcttctcaaatttatgaagaaaaaatgaagtaaaaaataaaaaatcttgtgaaatttatctggtctttcctgaagctctttggtatctccatagacatggtttgaatgcaaaaaactgcccatgcagtgtctatgataagattgcctttaacacactcagcatgctaatatatcaggttcaaaaaatgatttcataattgttttacttaagactaacaggcaaagattgtcctgaatttgctgctctgctgtgtttttgtaggaccaaatcccaggtgcagtttggcctctaagaggcataatctgctccaggaaagccaatcaggaagtcttccttttaactatggcacaaccgttcagattcacctgctactgctgtttccccagaacttctactctaattgaatgtatcaagttgttaagcaattttacataagatgtggcttaaaataagtagctttttatatagaatgaaatgttctgatgaatatagtattacactttgaaaaggaagaaaaacatctagtggatattgtcatgtttgatatttctttttggtgtcaatggaaactgaatagtacatttttttcaacttttactacatattaaagggatggaggaagtagaagcgtaaacagagtaaacagggatggcaagacaaaggagtgttaagtcctcgaggattttacaatctagttattgaaataagacatataggtttttatttattttttcaatttttaatttttgtgggtacatagtaggtataaatatttatagggtacataaggcattttgatacaggcatggaaagcataataatcacatcatggaggatggggtatcaattgtctcaagcatttatcctttgtgttacaatcaaattacacttttagttatttcagaatgtataattaaattattattgactatagtcactctgttgtgctgtcaaatagtaggtcttattcattctttctactttttttttgtacccatttaccatttccatctctgcgtcacctccccacaactacacttcccagcctctggtaaccacattctactctccatctacatgagttcaattgttttgatttttagatcccacaaataagtgagaacatgcaatgtttgtctttctgtgccttgcttatttcacttaacttaatgatctccagttccatccatgtggttccaaatgacaggatcttattcttttttatggccaaatactactccattgtgtatatgtaccacattttctttatccattcatctgttgatggacacttaagttgcttccaaattttgtctattgtgaacagtattgcaacaaacatgggagtccagatatctcttcaatatattgatttcctttctttggggcatatacctagcaatgggattgctgcatcatttggtagctctatttttagtttttgagaaacctcaaaactgttctctataatggttgtactaatttataatcccaccaagagtgtacaatgactcccttttctccatatcctcattagcatttgttattgcctgtcttttgggtataagccattttaactacggtgagatgatgtataattatagtcttgctttgcatttttctgatgagcaatgatatttagcaccttccatatgcctttttgccatttatgtgtcttttttttgcctcaaactccatctattctacatagctattccagttttcttttgattcgtagtttcccagtatatattttttattcttttaatttatttatttttcttctttttttttttttttttttttagacagagtctcactctgtcgcccaggctggagtgcaaaggcgcggtctcggctcacggcaagctccgcctcccgggttcatgccattctcctgcctcagcctcccgaatagctgggactacaggcgcccaccaccatgcccggctaattttttgtatttttagtagagacagggtttcaccgtgttaagccaggatggtctcaatctcctgaccttgtgatccacccacctcggcctcccaaagtgctgggattacaggcgtgagccaccgcacccggcctgttggttgtatctttagctgagtgaatgatttgcaacttgacgtgatcccatttgtcctgttttgttttaggtgcctgtgcttgtggggtgttactcaaggaatctttgcccactccaatgtcctggagattttctccaacgttttctgtagtagtttcatagtttgagatcttagatttaaatattcaatccattttgatttgatttttgtatatggaagagataggggtctagtttcattcttctgtacatggatatccagttttcccagcagcatttattgaagagactgtcttttttcgccaatgtatgttcttggcacctttgtcgaaaatgagttcactgcaggtgtgtgaattagtttctggattctttattctgttccattggcctgtgtgtctgtttttatgccagtaccatgcagtattggttactatagctctgtagtaaatttgaagttaggtaatataatttctccagttttgttttgttttgtttttttctttttttggatggctttggctgttctggctctttcgtggttccacataattttccttttcttttgagtctgactcttgctctatcacccaggctagagtacagtggcacgatcttggctcactgcaacctctgcctcccacgttcaagcaattcttgtgcctcaggcttctgagtagctgggattacaggtgcaccaccatacccagctaatttttgtatttttagtagagacagtgtttcaccatgttggccaggctggtctcgaactcctgacctcaagtgatctgcccgccttggcctcccaaagtgctgggattacaggtgtgaggcaccgcgcccagcccatataaattttaggatagtttttttctatttctgtgaagaatgtcattggtgttttaatagggattgcattaaatatatagattactttaggttgtatggacattttaacaatattgactttttccaatccatgaacatggaatatctttccattttttggtgtcttcttctatttctttcatgagtgttttatagtttccattataaagatctttcacttctttggttaagttaatttctaggtatttaattttatttgtggctattgtaaatgggattccattttaatattttttcatattgttcactgttggcatatagaaatgctactgatttttgtatgttgattttgcatcctacagctttactgaatttgtttatcagttctaacagttttttggcagaatatttagatttttccaaatataagatgatataatctgcaaacaagcataatttcacttcttcctttccaattggatgctctttattttttctcttgtctgattgctctatctaggacttccagtactatgttgaataacagtggtggaagtgagcatctttgtgtgttccagatcttagtggaaaggctttcaattttttctccattctatatgacagatccccagctagtataacactacagcttttattatattatatattttatattttattatattatattaattatactttattttattatagtataatactatagcttttattatgttgaagtatgctcattctatacccaggttttttagggtttttatcatgaaaggatgttaaattttatgaaatgctttttcagcatcaatttcaattgaaatgaatgtatgatttttgtccttcattctgttgatatgatatatcacattgattgtttcatgtatgttgaaccatccttgcatcccagggataaaatccacttgttcatgatgaatgacctttttaattaattgttgaatttggtttgctagtattttgttgaggatttttgcatcaatattcatcagagatattggcctgtagttttctttctctttttttttctgatgtgtctttgtctggtttttgacatcagggtaccactggcctcaaagagagagtttggaatttttccctcctcctctattttttggaatatttttactagcattggtattagttcttctttaaatgtttactaggattcagcagtaaagccactgggtctgggcttttctttactaggagacttttactacagcttcaatcttgtcacttggtattgatctgttcaggttttttatttcttcatggttcaatcttgataggttgtatgtgtctacgaatttttccatttcttctagattgtttcaccttattagcttatagttgctcatagtagccactaatgatcctttgaatttctgtggtatcagttgtatgtccccctttttcatatgtgattttatttatttggatcttctctcctttttcttactctgcctaaaggtttgtcaattttgtttagctttttaaaacaccaactttttgtttcattgatcttttatattgttttcatttcaatttcatttatttctgctctaatctttatttatagtttcttctactaatgtggggtttgcattttctctcacttttccagttctttaaaattcctcattatgttatttatttgaagtttttttttcttttttgatatagacatttatagatataaacttccctcctggtactgattttactgcattccacaggttttggtatgttgtgtttccattatcatttgtttcaaaaaatttttcaatttccttcttaatttcttcattgacccagtggtcattctagagcaggttgtttaatttccttttatttgtatagtttccaaaattcctcctgttattggtttgtagttttatttcttgtggtcagagaagatgcttgatatttcaattcttttgaatgttttaagacttgttttgtgacctaacacatggtctatccttgagaataatccacgtgctgaaggaaagaatgtgtattcattggatgacatgttctgtaaatatctactagatccatttggttcatagtgcagattaagtccaatgtttctttgttgattttctgtctggtagatctgttcaatgctgaaagtggggtgttgaagtctccagctattattaggggcctctctctttagctctaataatatttgctttatatatctgggcgcttcagtgttgggtgcatatatatttaaaattgttatatcctcttgctggattgatgcctttatcattatatagtgactttctttgtctcttcttattgttttcgccttgaaatctattttgtctgatataaatgtatctacttctgctcttttttagtttccatttgcatggaatatcttttcccatccctttatttttagtctatctgtgtctttataggtgaagtgtgttttttgtaaggcacagatcaatgggtcttatttttttatccattcagccactcaatgtctttcgattggagagtttagtccatttacattcaatgttattattgttaaaaaaggacttactcctgccattttgttgtttgttttctagttgttttgtggtcttctcttccttctttcttcccttcatgtctccctttgaatgaaggtgttttctctggtaatgtttagtttcttgttttttttattttctgattgtatccattgtatatttttggtttgaggcttccatgaggcttgcaaatactatcttataacctattattttagcctgataactacttaagttgtttgtagaaagaaagaaacaaacaaaaagaaaactaataaaaactctatactttgttccctcactttttaacttttttgtttctatttataccttattgtactatctaggtctttaaaagctttgtagttattatttttattggctcatcctgtagtctttccacttaagagtagtttatgcaccacaattacagtgttataatattatgtgtatttctgtgtacttactattatcaatgagttttgtaccttcaggtgatttcttattgctcattaatatacttttctttctaattgaagtactctcttttccatttcttgcaggacaggtctggtgttggtgaaatccctcagcttttgtttgtctgggaatgtttttatttctctttcatctttgacggatgttttcaccagatatactattctagagtaaaagtttttttttccttaagtgctttaaattaaattaatgaataaatggaccttattagaacagacgaggcttggaccttaaagggcacactgtatatggacaagtagaaaatatggagagagaaacttctagttataagtgagtttctgcaggccttcctaatctcgtggcgatagatgagagttcattaatagaaataatccaaatttcttccctcaactatctaatgtcaggtctccttcctgaagaatttctgtgaagccttaaagagtgtcaagatcattccctcatgaacttacatttagaaaccctttcccactgatatcaatgccacatcattgtccctcctgcttgtgccctcagcttgagacagcagatgtgatactcaaagagctgcctgcctccaagggaccacagaggcattctatttcctgcagtcctccctgagtcagaatcactctaatgagttaaaattatgagaatttttttattattggaggaagttattttatctaattcttgatctacttataataagtaatcctagaatttttttttttttttgagacagggtctcattctgtctcccaggctagagatctcagctcactgcaacttctgcttcccaggctcaagcgattctctagcctcagcctcccaagtagctgggactatgggcatgagccaccaatgcccagctaatttgggttttgttttgttttgttttttgtagagatggggtttcaccatgttgcccaggctggtctggaactcctgagctcaaagccattttcccacctcagcctcccaaagtgctgggattacaggcatgagacactgtacccagccagtaatcccagaatttttacaaaagctcctattgttgcataatgaaacagtattctcttgccattatttaaagtcacttttttcactttctggtaaaaaaattcgttcaatcattgacaaatatttgctgaacacccactctgtgccgtgtactactatgttaggtgctggatatatgttgatgaatgaaacaaactgtatccttgtagaatttgagtctgctgaactcagaagtaaattctttgaaagttaggatggatagtaaagttgagtactcttagtttcaatatttaacatgttgctcttatcaattttttagtaaatgttagtgtacaaaggtaatttaggttttgaggtgtatccagaaaaatctggtttttttaatcaagagaatccactcaagagactactcatagaaaagaatttatatgatgcatcagatagaaagtaaaatttagtgttttcctgaaaaaaaaaaaaaaaacacaaaaaccaaatacaatggaggcttctcttccacattctgtggcatttgttttttcaactaaacaccaacactacactcatgaaaacaactccttcagcactacctgtactctgcttcaccaaaccagaaacgtcaatataaaaaacaagcagcatgccaaaggtcaactgatcttcaacaagggtgccaaaaatacacaatggggaaaggatagtctcttcaacaaatggtgtaaaaactcatatccatatgcaaaaacatgaaattgaacccttacaccatacataacattcaactcaaagtagattaaagacaaacataagacctgaaactataaaacttctagaagaaaacatagtggaaaatcttcatgaccttggtcttggcagtgatttcatgaatatctcatcaaaaacacaagcaacaaaagcaaaaataaacaaatgagcccacatcaaaggagaaagcttctgcacagcaaaggaaacaattgacagggtgaaaacgcaacctacagaataggaaaaaatgtttacaaaccatatgtattagtccattctgcattgccataaaggaatacctgagacagggtaatttataaagaaaagaggcttattttggcccactgttctgcaggctgtacacaaagcgtggcaccagcatctgctcccagtgagggcctcaagaagcttccaacaatggtggaagggaaagggggagcctgcgtttcacatgataagagagagagcaagagacagagggaggaggtgcccggcacttttaaacaaccagatcgcacatgaattcacagaatgagaacccacttgttactgcaaggacagcaccaagattttcataagggatctttccccatgacccaaacacctcccattaggctcacctccaacattggaggtcacatttcaacgtgagatttggaggggacaaaacatccaaaccatatcaccatatatctgataaggagataattcctaaaatatataaggaactcccacaactcaacagcaaaaagactaataacccaattttttaaatggggcaaaaaaacttgaacagactatgtcacagtatctatgtgaaaatatacgcaacatcattaatcatcaaggaaatacaaatcacaaccacaatgagatatcatctcacacctgttagaatggctattatcaaaaagatgaaagataagtgttgtcaaggatatggagaaactggaacctttgcacactgtcagtggaaatgcaaaatggtatggccgctatggaaaacaacatgaagtttttttaaaaattaaaaatagaactaccatatgattcagcagtcccactctgggtatttatccaaaagaactgagatcaggacttcaaagagcaattagcattcccaggttcattgcagcactatctacaatagctaaaatgtggaaacaatctaaatgtccatcaacaaatgaatgaataaagaaaatgttgtatctatatacaatggaatattattcagcctttaaaaagaaggaaattctgcaatatatgacaccagagatgactgaggaaattgtgctaagtgaaaaaagccagtcatcaaaggacaaatactgcatgattccacctatatgaagtatcgaaaatagttaaattcatagactcaaagaatggaatggtgattgccagggactcaagggagaagaaaaagggaagttgataatcaaggggagtaaagtttcaattaatcaagataaataagttctagagatctgctgtacaacattgtacctatagttatcaatactatattgcacacttaaaaaatttgttgaaagtagatctcatattaaatgttttacaacaataaaataacataaaaaataaaatgacaaagaagcatgctgtaatggctattccaggttatcttccagtaggctttgctaattgatttcctccaacctcagcctagagctcccaggcaaagcaactccttatgacctacacagttgttcaacactcatactcagacatggattaatcacacttaagtgggaacccctacacaggaggattaaggtaaggtatcagggcactcagtatatcagcttaattatgtcagaagatttgtgatgatgaactgtgacagacaaggctagtcaaataagatgagtcctgttgcagatggtaatttaattaccaatttcgggcatgtattgagccctgaccacttgtgcaaaatgttttatttaggtcttatcatgacctatttgaaaatgacaaactgaggtttagctatattaatctgtcaaggtcactcagctagcgtgtggcagagctgagaataaaaccatgcctagtgaatgtcagagtctctgcccttaactactagaccataccatggttgtgagagaatcagtaaagggtcatgaacaaatgttggtatgaagaaagcaccattatagaaagactggattgctggggacaatgtataggagagaaagatagttggaggaggggaaacttgttgctttcatttaatgttaattagtaaaagttcagtcctaatccacaataatatttatactttctcatagcactagtgtgtttccttaataaatggactaaagcagtagcttggaataccagcactaaacttaagtttttaagattataaccataaagatctgtgtgaatgatgaccaaatggttagtaaaaaaaaaaaaaaaaaattatgtaataaaaaacccaccaccaacaacaaagaaaattacccaaagatgactgagaaacatctttacaccactatttgcctaatagaatgactaaataaaacaaacaatgccagatgctggtgaggatgtaaagcaactggagctctcataggttgctgatgagaatagaaaatggcatagccctgtgaaaaacagttttccagtttcttataaagttaaacatatatttagcatattacccaaaaatcctacttctaggtatttacccaagtgaaaacctctattcatacaaaaaaaaaaatctgtatgtgaaaaaagtatgtgtatatatatatatatatatatgcattattcataattaccaaaagctgtaaataacctgcattcccctcaaatagacatgtgtttttaaaaatggtgatacgcccatagtgtgaaatagtatccaacaataaagataaataaactattgatacatgcaacaaagggatgaatctcaaatgctttatgctaagtgaaagaagtcagactcaaaaggctatagtatgattccactcattcatataacattctggaataggcaaaacagatgagtgggtgtcaggtgttaaaggtatggggaagatttgacttcaaagggagaagataagagaatattagaggaggtatattgaaattgttctttatcttaactgtggtaatgggttacataactctacctattttccaaaactcatagaaatatacaccaaaaaagtcaattttactgtatatgaattaaaactacactttcaaataaaaaatctcttctacaagaaagcatacagcaaaagtttcacatattctaaatgttataaaccacgaaacatttcacaaagcaccatctacaaaaaagataatgtaactgagtatttaaacaaaaaaccaagctataattttttaaaaattatatacaaggcataaaacatgcctattaaaagcataagtagttggccagcgtgttgtttaccacctctgaatagctgtaaaatgtttatagatttttatacctttcatgaataaagcagagtaaattaatgcaaagttatttttctgagagaagctgtcaaactcctttctggccaaaagggaatttgtgacttcctgttatgttaaatttggtactaaagcctgaatgaaccacctcaaatgggctatttactatgataaatactgtttcctaacaagaggaaaagtggtggcctgggaagataactgctgggattttaatgcactctctgaaacactctgacatactctgttagagaaaataatttaatattaaccagaagtcaggcttaacattccatttcctgaaaatgatcatcaaaagacaaatgcaatttaattcaccaaacatgtattaagcatttaatatatgccaagcactgtgctaggcattaggtaaacaaactgaaaataacacaatatttgcctttaaagattgcacaaactagcaggggatagagacaagtaataagcaaatatacttccatacaataatctaagtgtgatgatagaagtgtgatcgggtacggggacaaccaggggaaaaagtgattgtctgagttctaacaaaaagcacatcaaccagatcctaggactccctaaatctgccttcagatgattaaaatgctaacaggaacaaatagaaagctgcatgatttgaagaggccattccttttatatttaccaccaccatcttccatgacagttttgaaaacactgagcaaggcatacctgtgctgatgtatttattccttgacttgaaataatcctccaggtgatgaaattcccacaggacaaaggaataataatctaaagtctccctttccagaaagtggaaaagttccaagtagtattattccttactgaaacctaagatccctttatgcaaaagaataaaaaaaaaaggtctcatgcctcatgctaattcactgtggctaactacactacttaaaattaagatagaaaggtatgaatgttccatttttcctgtatgttagcagtgatcatatctaacacataattccaattcactgttactacgaaatgtaactattgctccagtactctcacaacggattaaacaagtaaaagtaagcattccgaaataatggaactcctactatctcctgtgtcttcaagcccttccctgaaactactagccctaacagagaagaacccagtagcactttctttcctctcttctttctatcctttccattctatccgtcacagaaagtagcatcttttttccttcatcctttttattctatccatcacagatattaattccaggtatgtacacaatggccaactagcagaaaataaatcattagaaaatgttaaaagcaaaacagtgggaaggaaaacctaagtgtcacatctttgagggccagcactacgtttccaaaatgggaaaggttttatagctagaagatctgggctcagatcctgcttccgccacttactagctctgtagctttagacaacatattcacctgtctgaatgtcagtgttcacttccacaaaatgtagatgataggaactgctactttgcataattattcttgagattaggtgccatacaagactgattctcaatcccactgcatgctaaaattcgggggcaccactctgagactctgttttcattggtctactgtggggcatgaactacaaaaagagagagagaagaagcagcacatctccaaggtattcaactttacagctgggcaacaacctctgcattatagtaactgcaagaactccctaaactttaattcagtgcagcatttcacaatttattattgtattttaaaagtaccattgaactcatcctgttatgcacgttacatagtcttaaagattgctagtaattcaatagttaaatttgatgtttacttagaatgcctcccttgacaagcaaatcatcattttcaacaactgagaattgttacaaggagctgagaaaacaagatatatacattaaatgattaaagtcacttcttaggtgccaaaaatgaaaggagtatgatgatgggataagctttatgatgcttgaggtcaggtaccatgatttttaaaaatagtttcagcatcaaggacagtgcacagaactcaataaatatttgttaaataagtagatgaatgtgtgagtgaacggatgaatgtaaagatttccacaggaatttaccaagagtcatcactaaagactggaatgaagaggaaggtattttcattggaaaaataagtctcagccactgccaccaatgaagctgcaatgtctctaatgaagagaccgaacttcaggtttgaaaggtaaattgcagtccttgcattttcagttaaatctttcaaacagcagcccactccgcctccattcttggtcccaattctgactctcctccaaacttctaacattaacaattggcacaaggctagctttctaaaacaaacatttctcattactaggaacattacaaaagtcttgctttctgagcattggatacctgctttaagagctagttaatgcacagtataaaacaaggaagacaaaagacatgatctacccagctgggttagccaaggggcctgggagataaattgaccaactgcctgtgtagcatcttacattctccaaaataaccctacaaggttgctgcagatctcagattaagaaaaatttattgctgagtttattatttttaacatcctttgtctgagcacctagcaactaaagtgataagtaccttcaacttgcaaggataaatgctgcaaatatcttggctgaattacccatttgtatgtatgtttgtaacttgaattattcatttacattttttattttttaaagaggagaataaaactagaaagagaagagatactaaaaaatctcattgctgtagatttaaaggttttccggtggtaggaagccaaaaggccccttcagcaataaacaatagatttattctacaatctaattaatactcacaaactatgttacttatgaaacaaacaatatatctagggaatgcaattgcatccaagcaaaagtatccatattaataaggaaaaatcttacaaaagtaggcttggaaaagtatgtgcagcaaaaaagttatggtttttctttaaaactgtatttgaatactaacaacaatgggtaggtcccatttaattgctggtcttacaataaagcaaacattttaaatttgggtgacgatatgagctttccctgaaaactttgctaataacaacctagggtatctatttcttatttgaaaaggaatgaagggtttcctacacctatgtgtaggtgataatgcaagaccatgaaaattctagacccataaacctaccatagaaaaaaatttaatcccttccaaattaatactttgctattgtccaaatgatagtttaagattaacattgatttatttatttgttttcttattaacaataacaccaccactttgtcaatggttgtcaaagtggggtatgtcattgtgatgtgagaagaaaatatcagaacttctacttgtacttatttttatcaaaaacagaaagaaattaaactttattgatattttaaaaagaaattacactgaccccattccctgtccctatatcaaatgtaaacaagacaggcagatttcatgagataggcagaaggaagtagttgttggtgaaacactcactcatctcctagctttcatcaggttgcaaagtaccatactgtgtgtagccacgagtagtggatttactgaatacattacctagttttatttaaactaaccctacaaaacaaaaaagaaagaaaaaaattcttgcaaagaatcatggaatttatgattacacaaataattgatgattgataataattggtggctatacaaataatgtaagcacaaaaaaaaaggtggagctgtaacttctgctcctgcggtgagttcttcatcattcctgagtaaatcagcctgacaagaagtcaagcaaaaaaaaaaaccttttcataatattaaaatatgaacattcatccaccatcattaaaagtcaaggtagctttaagtatatagaatgccttgagatattatgcaatgataatacaaagctatcatcgttttcaaaccgtttaaaaatgttgattacttcacctttatcccattcttccctttatatattgcactgtgtacaatctgtattaggtcagtagtacatatgcataattcatagtgaagagggaatcccagaccttattctccaagtcacactgcccttctcccagcctccacaccatcatctacaggagttagagagtatcaaagttctatatctgtctccacaacactcatagccttacaactttaaagaccatcaagagaaattccatcaacctctttatcaccacaggaaacccaaagttcctgggttttccctcactactaggtctctggtctatgcatccttaatttcaccctgtcttcccaagttcagagcccattacactatgtcctctggagaacataaagtccctcatgttctatctcctcctgaatactgcctccacctctttgctgtaaataaaagccagttattccccaaggactctcttcccctgtagggtccacaaatgatggctattttctctctcatattccaactatcactgtcctacttcctcatcattgtagaaaactgtgtcccttctacctccctccaaaaatccagccttgcaactcatgccatcaaattagacaacttttactactactggctgcagttaacttcagtttctataactgctacaagattttgattatgattttatcatttgcatctgtcatttccacataactgaatctcccagtaccctcaatcctcagatccttaaattgtaaacttcaatgagcttgtcctcagccatttcatggtgatctggacctcttttttattatcaataacagcagccctccatgacctcaactccaagtatccagttccaaaatattacttcccatttttccagctcacgccctctcattctttgataacaatccttaatcaactttttgctgtattttacctccttctgttctagttacattgcctccttacttagcttagattccatggtccatcattacaatcagctccctggtggccctctcttcccttgtttaatcaacctggtaaaacttatactttgactaaatacagctttccacccacttgaacccaaatatctaaacatgggctgagaggattacacaccatccttactggtttcactttaaattcataatgataatcttcaatggggcttcagttcctcccagtgatcttttatgcatttctgcagtcaattcattctcctacacaaccgtttaacgtctctttcctcaaacctccaacattttctctaccatcctcactataatagatgaaacatattcacagatatacaccaccatatctagcagcctagcattcatacacccactagtgtaaactatccaagctcttatctaagaaaacctctccacatgtatcctaacttttaactctcctcactgtctgaaatgcattactctcttcctcttctctctcattgtatcaacactattttctcaattgtggatcatttaatttacatcaaacatgatgttatatctcccagaagataaaatatatctggaaaacccaagagaatcaactgaaaaaaatactataaacaatatgagaatttactacaatatcatgatgcatattaatacagagaaagcacaaggcttcatatattcaataaaatatgccatttacgatagcagaaaagacactagagtaaacttaatagaaagtatgtaagatctataggaagaaaacctaacaacacaactgaaaacacaaaagaagacttcagaaaatgaaattacatcagctagaaaaacacaacatcataaatatgtcaattcttcttaagataatttataaatataaaaccatcataataaaaatacaacagttggtttgggggacttttgatgttattcttttatttttgaacaaagtagctgaccccaaagttcttataaatagtaagcatgcaagaatagcaagggaagctattacaaagaacaataaaggggtgagggtatgagcaccaccatacattaaatgagaaaaaaagaagagccaaaacaatgctaaaaaattaattttaaaagtccaagaacttgaactgtctgacttcagaattcaacataaagcctcagtaatcaccgcaacacatttttgggttgaatatagacatataaattaatggagcaaaatacagagtccagaaataaacctggatatatatgaataattaattttcaacaaaagagcaaagcaatttgatgagaaaaggataatattttcaataagccatgctggaagaatgactaaccatatgcaaaaaaaaatctccacacttacctcatgatacacaaaaattaattcaaaatgggtcacagacctgttaaattttagagttaatactttaactcctagaagaaaacatagaagaaaatcttagtgatgttgggtctggcaaagatattttaagcagggcacgaaactataaaagaaaactgaactggacttcatcaacactaaaacattttgcttctcaaaagacactattacaaaaatgaaaaggggatcttggaccagatggccaactagacacagccaggaaacatctgtctcaccaaggaaaaaacaaaatatggggtaaaccatcacactttgcacagatcttttgagagaaaacattaaaagttgacaaaaaagaaccacagacacccagtttgaagaaggaggaagctaggaagcctacatagagtccctgagtgccagaacaagctcctagtcctgcaaaggccctaaagaaggggtgagttaaggaattctggggacctcaggagtcctagctacaaggataccctgcccaggtatcttctacacttgacctactacatcaacagaccacccatagacataccccacaacccattctgactcttgccaggcacagaggaccagtgggtcgtcagagagttgtaagtctccttacaactgaccttcagctcaggcttcccccaaaagagaaggaggtgcagcccaccagggacccccttggggctaaggaaatgcaggcactgcaacagtgattaaagaggtctcccccaaggccccagaatggatttggtaagggggtcatcacttgcacccaccccctcgtcttctcctccccagaacactgctgtgaacagaatgaaatataagagacatgcatggctgagcaagatcctatctgctagcccttactcttaagcaccatctaatagaatgcagcctagatgacaccacgaaaacataaataaattccataaatatgcatcacctgtgaaacccaatgcagcaaaactaatcacaacgaaggaacccatacagagccttggttctctgaaagcacctagaaaaaggaccaattgactatatacagtcaaaccctcaagtgaaaaaagtacaaaaacaaaaaggcccattcaaatgacataactttaaaaaaaaaaaaaaagaaagaaacaaagaaacactagccctctcaggtgagaagaaatcagtacaatgactctggtaattaaaaaagtcagagtgtttccttaccttcaaaagatcacactacctacccagcaatacaccctaactagattaaaatgtggaaatgacagacatagaattcagaatctggatgggtaggaagctcgatgagattcaagaaaaagttgaaagccaatccaaggaagcaagtaaaacgatctaagagttgaaagatgacatagtcattttaagaaagaaccaaactgaacttatagaattgaaaattttactgcagaaatttcaaaatacagttggaagcttcaataacagactagaccaacctgaggaaagaatttcagagcttagtcagacaaaaataaagaaaaaaattttttgatgaaccttttaaagcctcaaagaaatatgggattatgtagagaccaaatctatgactcattggctttcttgagagaggagagtaagaaactttgaaacatatttgagtacctagtccaggaaaatttcccaagtctcactagagaagtcaacatgcaatcccaagaaactcagagaaccctcatgaaatgctaaacaagaagatcattctgaaggcattttgtaatcagacttttctaagtcaacaaagaaggaaaaatcaaaaaggtagctagaaaaaagggtcagattacttcaaaaggcaaccccagcaggctaacagcagacttctcagtaggtttctacttttcaagcaagaaaaaattgggagcctatttttggcatccctaaagaaatgaaattccaatcaagaatttcaaaccccaccaaactaagcttcatagtacaggagaaataaaatcttttctggacaagcaaacactaagggaatttattaccactagcccggctataaatgagatctttaagggagccctaaacataaaaaagaaagaacaacacctgctaccataaaaacatatgtaagtacagagcccacagaccctataaagaaacaatgcaattgagaatacaaagctacaagctaataatatcatgactggatcaaaacctcacatatcaatattaatcttgaatgtaaatgatatagatgccccatctaaaaggcatagagagcaagcaggaaaaaaaaaaaaaaaaaacaagaaccaaatgtcttctctcttcaagagaccaatcacacataacagccataggggcaaagtaaagggatggagaagcatctatgtattagtcagttttcacattgctataaagaatacctgagactgggtaatttataaataaaagaggtttaattgacttacagttctacagactatacgggaagcatagcagcttctgcttctggggaggtctcagggagcttccaatcatggtggaaggcaaagagggagcaggcatcttatatggcaggagcaagagcagagagggggaggtgctacatacttttaaacaatcgatctcatgataactcactcactattgcaaagacagtaccaagggaatggtactaaaccattcatgagaaatccacccccatgatccagtctccactcaccaggccacacctccaacactgaggattacaattcgacatgagatttggataggaacacatatccaaactatatcagtctatcacataaatggaaaacaaaaaagagcagtgattgatattctttcataagataaaacagactttaaaccatctacagtaaaaaaaaaaaagaacaaagaagggtattacataatgataaagtgttcaattcaacaagaagacttaactatctaaaatatctctgcacccaacatcagagcacccagattcagaacacaactgcctatagacctacaaaaagacttagatagtcacataatagaggaggacttcaacacaccactgacagcattagacagatcactgaggcagaactctaacaaagaaattatggacttatatttgacacttgaccaactggatctaataaacatctacagaatactccactcatcaaccacagaatatacattcttctcatctgcacacagaacatactgcaagactgatcacatgctcagccataaagcaagtctcaaataactttaaagaatgaaacataccaaccatactcttggaccacaatgcaataaaaacaaatcaataccaattaaacatcccaaaaccacacaattacattaaaattagacaacttgttcctggaagacttttgggtaaacagcaaaatcaaggcaaaaaatagaaaattatttgaaattaatgaaaacagagatacaacataccaaaatctgtgggatgcagcaaaagcagcattaagaggaaagtttagagtgcaatatgcctacatcaaaaagtcagaaagatctcaaattaacaatctaacattgcaactatgggaactagaaaaaacaagaagaaactaattcaaagctaacagaaaatataaatatctaaaatcagagcaaaactgaatggaattgaaaagtgaaaatccacaaaaagcagcaacaaaaccaaaagttggtctttgaaacaataaacaagatccatacactgctagtcagaaacaaagaaaaaaggaagaagatccaataaacacaataaaaaaatgacaatggtgacattataaccaatttcatagaaatacaaaagatcctcagaaactattatgaacactatctatgcatacaaactagaaaatctagaggaaatgaatacattcctggaaacacacaacttcccaagattgaaacaggaagaaattaaaactctgacctgatcaataacaagttccaaagttgaatcaataataaaaattctaccaaccaataaaagccctgaaccagatggatttacagctgaattctaccagggatacaaaaaagagctgctaccaatcctgctgaaactgctcgaaaaaacagaggaggagaaacttctccctaactcattgttcaaagccagcaacatcatcataataccaaaacctgacaaagacaggatgaaaaaagaaaactacaggccaacatccctaatgaacatggatgcaaaaatccccagcaaaatactagcaaaccgaattcagcagcacatcaaaaagttatttcaccatgatcaagtgagcttcactccaataatgcaacagtgattcaatatatgcaaatcaataaatgtgatttaccatataaacagaattaaaaacaaaaccatatatcatcttaatagatgcaaaagaagattttgccaaaatccaaaatcccttcatgttaaaaaacctaacgagcatatctcaaaataataatagccatctatgacaaacccacagccaacatcatactgaatgagcaaaagctggaagcattcccccttaagaactggaacaagaaaaagatgcccactctcactactcattttcaacacagtactggaagttctagctagaacattcaggcaagaaaaagaaataaaaggcattcaaatagaaaaaaaaaaaaatcaaactctctctcttcagagatgatatgattctatacttagaaaaccctgaagtctctgccaaaaggtttctagaacagataaacaacttcagcaaagtttcagaatacaaaatcaacgtattaaaatcaataacatttctatacaccaataacactcaagctgacatccaaatcaagaacacaatcctatttattaatacaatatccacacacaaaaataaaagacctaagaattcatctaaccaaggaggtaaaagatctctacaaggagatctacaaaacactgtttcaaagaaaccagagatgacacaaaataaaaataaaaataattccctgcttattgacagaaagaatcaatatcactaaaatggccatattgcccaaagcaatctacacattcaatgctattcctatcaaactaccaccgtttttcacagaattagaaaaaaaatttctgaaactcatataaaaccaaaaaagagcccaaatagccaaagcaatcctaagcaaaaagaacaaaaccagaggcatcacactacataaattcaaactatactacaaggctacagtaaacaaacaacatagtaccagtataaaaatagacaaattcaaaagctagcagaaggcaagaaataactaagatcagagcagaactgaaaaagaaagagacacacacacacacaaaaaaactcttcaaaaaatcaatgaatccaggagctggttttttcaaaaagatcaacaaaatagatagactgctagcaagactaataaagaagaaaagagagaagaacaaatagatgcaataaaaataatataataataaagggaatatcaccaccaatcccacagaaatagaaactaccatcagagaataccataaacacttctacgcaaataaactagaaaatctagaaaaaatggataaattcctggacacatacactctcccaagactaaaccaggaagaagttgaatctctgactacaccaataacaggttctgaaattgaggcaataattaatagcctaccaatcaagaacagtccaggaccagacatattcacagccaaactcttccagaggtacaaagaagagttggtaccattccttctgaaacaatttccaaccaatagaaaaaagagggaatcctcccaaactcattttatgaggcagcatcatcctgataccaaagcctggcagagacacaacaaaagaagagaattttaggccaatatgcctgatgaacatcaatgcaaaagtcctcaataaaatactgacaaacccaatccagcagcacatcaaaaagcttatccaccatgatcaagtcggcttcatctctgggatgcaaggctggttcaacatatgcaaatcaataaacgtaatccatcacataaacagtaccaatgacaaaaaccacatgattatctcaatagatgcagaaaaggccttcaacaaaattcaacagccttttatgtcaaaaactctcaataaactaggtattgatggaatgtatctcataataagagctatttatgacaaacccacagccaatatcatactgaatggcaaaaactggaagcattccctttgaaaattggcacaagacaaggatgccctctctcaccactcctattcaatgtagtgttggaagtcctggccagggcaattaggcaggagaaagaaataaagggtattcaattaggatacttcagcaaagtctcaggatacaaaaccaatgtacaaaaatcacaagcattcctatacaccaatagcagacaaacagagagccaaatcatgagtgaactcccattcacaattactacaaagagaataaaatctaggaatccaacttaaaagtgatgtgaaggccctcttcaaggagaactacaaaccactgcccaacaaaataaaagaggacacaagcaaatggaaaaacattccatgctcatggataggaagaatcaaaatcatgaaaatggccatactgcccaaggtaatttatacattcaatgccatacccatcaagctaccactgactttcttcatagaattggaaaaacctactttaaaattcatatggaaccaaaaaagagcccacatagccaagacaatcctaagcaaaaagaacaaagttggaggcatcacactacctgacatcaaactatactacaaggctacagtaaccaaaacagcatggtactggtaccaaaacagaagcatagaccaatgcaacagaacagaggcctcagaaataataccacacatctacaactatctaatctttgacaaacctgacaaaaacaagaaatggggaaaggatttcctatttaataaatggtgctgggaaaactggcgaaccatatgtagaaagctgaaacaggatcccttccttatatcttatacaaaaaataactcaagatggagcacagacttaaatgtaagacctaacaccataaaaaccctagaagaaaacctaggcaataccattcaggacataggcatgggcaaagccttcatgactaaaacaccaaaagcaatgacaacaaaagccaaaatagacaaatgggatctaattaaactaaagagcttctgcacagcaaaagaaaataccatcagagtgaacaggcaacccacataaagggagaaacattttgcaatctacccatgtgacaaagggctaatatccagaatctaaaaagaacttaaacaaatttacaagaaaaaaacaaacaaccccatcaaaaagtgggcaaaggatatgaacagacttttctcaaaagaagacatttatgcagccaacagacacatgaaaaaatgctcatcatcactggtcatcagagaaatgcaaatcaaaactatgatgagataccatctcacgccagttagaatggcaatcattaaaaagtcaggaaacaacagatgctggagaggatgtgaagaaataggaacgcttttacactgttgatgggagtgtaaattagttcaactattgtggaagacagtgtggcaattcctcaaggacctagaactagaaataccatttgacccagccatcccattactgggtatatacccaaaggattataaatcatgctactataaagatgcatgcgcacgtatgtttattgcggcactattcacaatagcaaagacttggacccaacccaaatgtccaacaatgatagactggattaagaaaatgtggcacatatacaccatggaatactaagttcatgtcctttgcagggacatggatgaagctggaaaccatcattctaagtcaactatcacaaggacagaaaaccaaacacttcatgttctcactcatagatgggtgttgaacaatgagaacacatggacacaaggcagggaacatcacacacaccagggcctgtcgggggttggggggctgagggaaggacagcattaggagaaatgcctaatgtaaatgacaagttgatgggtgcagcaaaccaacatggcacatgtatacctatgtaacaaatctgcatcttgtgcacatgtatcctagaacttaaagtataaaaaataaaataaaataaagaaaagaaattcactgacattcagaaaaaaaaatagacacatagtcacctgaggtcaggagttcgaggccagcctggccaacatggtgaaaccccgtctctactaaaaatacaaaaatcagccaggagtggtggcacatgcctccaatcccagctacttgggagggtgaggcaggagaattgcttgaacctgggaggcggaggttgcagtgagcaggaatcctgccactgcactccagcctgggtgacaagagcaaaacttcgtccaaaggaaaaaaaaaaagacacatagattaatgggacagaatagagaacagaaataaggccacacacctacaaccatctgctctttgacaaagttgatgaaaacatacaatggggaaagaactctctactccctattcaataaatgatgctgagataactggctatccatatgcagaagaataaaactggacccctacctctaactacatacaaacattaactcaagatggattaaactatcctctaaaactgtgagaaataaatttgttgtttaggttaaaaattttcaaaaagtttaaaaaaaaaggtggattgcagacttaaatgcaaaacctaaaactaaaaatattctagaagaaaagctaggaaatgcctttttagacatcagccttggaaaagaatttatggctaagtcctgcaattgcaacaaaaatgaaaaagtgggacctaattaaactaaagtgcttctgcaaagcaaaagaaactatcaacagaataaaaagacaacctacagagttggtgataatattcacaaactaggtatccaacaatggtctaaaatccagactctataaggaacttagaaaattcaacaagcgaaaaacaaataaccccattaaaaagtggacaaagaacattaacagacatttctcaaaagaagacatacaagtggccaccaaacatacgaaaaaaatattcaacatcattaatcaaaactatgagatcccatcttacacaagtcagaatgtctattaataaaaagtcaaaaaaaaaacagatgttggtgaaggctacagagaaaagtaaatgcctataaactgtttgtgggaatgtcaattagtttagccactgtgaaacacagtttggagatttatcaaagtactaaaaatagaattaccatgcgaacagcaatcccaatactagggatatatccaaaggacaattattcattcaaccaaaaagacacacacacccagatcttcatcacagcactattcacaatagcaaagacatggaatcaacctaggtgcccgtcaaaagtgaactggataaagaaaatgtcgaatacagtatgcccataaaaaataacgaagtcttgttttttgcaccaatatggctgcagctggaagccaatatcctaagtgaactaatgcagaaacagaaaaccacatactgtatgttcttgcttataagtgggagctaaacattggatgcacatgggcataaaaatggtgacaacaagagtgcggaaaaagggagaaaggaaagtgttgaaaaactaatcattgggtactatgctcagtatgtgggtgataggtttaattgtatcccaaatctcagcatcacacaacacacccttgtaaaaaacctgcgcatgtaccccttgaatctaaaacagaagctggtgggaaaagggcttacagagctccaaaaaaaatgaatgaaaaagtacaccacggaatgggagaaaatattcgaaaaataaatgtcccacaaaggacttatacctagaatatttaaagaagttttacaacttgatagaaggacaaacaaaagattgaacctaacaggcatctcaccaaagaagatgtagagatggcaaataagcacgtgagatgtttaacatcattagttattaaggaaatagaagttaaaaccaaattgagatagttctacatgctcactagaatggctgaaatttaaaaggctgaccataaaaagactattggcaaggatgtggaccactgaaactctcatacacagatagtgggaatgtaaaatggcacaactcctttggaaaacagtttgatgatttcttaaaagtgtaaaaatacatctaccatgtgactaagccactgcactcctagatatttgctcaagataaatcaaaatgtctctttacacaaaaacttaaatacatgaatgttcatgacagttgtactcgtaatagcctaaaactggaaacaacccaagcatctatcagcagctaaataaataaacgaataatggtatccatacaatggaatactatttcacaatatttaaaactactgataaacacaacatgatggatgaatctcaaaataattatgctgagtgaaaaaaagctacataaaaagagcacatgttatataattccatgtctataaaattccagaaatgtgaattaatctacagtgacataaagcagatcagtggttacctgtggagaggaggaagagagacacaggaggcagaaaagggaaacattgcagacgggcaagagaaaactttagggagagattggtacatttactatcttgactatggtgatggtttcaccatcgacatatttcaaaactcatcaaattgtacacttaaaatgtatgcactctactttaggggctgaagcagggggatcttttgagcctaaaagctagaaggtagcctgggcaacacagcaaaaccctgtcactaaaatatgtatgtataatgcattacatatattaaacctcaataaatctatttttaaagccttggtaattaaaatactgatgctgtaagatgaataggaagaattaaaaatccaaaaatagattcaaatacataaacgaatgcattctgtgaaaaaagtgatatctcaaacaagttaggagacttgctggtcaagacttgctcttggaaaaactggataaacatccagaaaaaattaaataagattgaatccatacctcacattatatcattatattccagatgcatatattctaaatagatcaaagatttgcttgtagaaagtgcaaccatgtgataattccttttcaaccttgggcctgcgagctaactatgactgagtcaataaaagaaaaaaatgtataaatctgacaacaattaaaatcttctccatggcgaaaatacaccataagcaaattcaaaagacaacaatctggaaaaagtgtaattgcaagtcatattacaaagagttaatctactcaatattttaaaagctcctaaaaatcagtaagcaaaagaagtccagtaactcaaaagaaaatgggtaaagaatgtgaacaaatatgcatatgtacagataaagatgcttaacctttctaataaaaaatgcaaattaaaataacactagataatatcttttgcctatcagcttagaaaaataaccaaagttaaagacactgttagttaggcttcagcatgcaggtattctcatacaccatgagaatgtaaattagtaccaccattttggaggacactttggcaatatctgtacaaattacaaatgcatatgccctttaaccccaaactttcacttctgagaatttatcctacaaataacacttgcatgcctatgaagttgtatatatgcatgtgtaggtgtgtctacatacttaagtgtatgtatgtatatatgtatgtatgtgtgtatatatatagttattacttacattattctgtgtaatggcaaaagattgaaaatcattaaaatgtccatcaataaaggactggtcaaacaaattttggtatgtctatataattgaatactataaagctgttacaaaaaataaggcagatctctatatgctgatgtggaaagatctccacttgatttttttttattcaggtttcatcattttacttttttcacaaaatttgtgtatgtgactcacatcaattcattttgatatataatttatttctgatattttgtttatttgaagtgacaggtaactgggtaattatctatactctgcttttaccatgtattttatttctaggtaaatttgaaaaatctgaagtatttttctaaatttgatcatggtttatttgacagtttacaagtacttgcaggcatgtgtttgcatgcgaataacgacaaatagctaagaaatcttacaatagtatagtttcataatttgggggtcctggttatacattttacatctgtaggttaggaatgcatattgttaatttcccttcatggttccttataactaaactctgtttagtaagattttctacttatcaaaggcataataactcactatttggtatatttgctctttaatgtgacatatgacatattttctgtggataaggagaactctgtatttgtgtgtatatgtacatataatgttttcaactaatcactatttcagagaaaaaacagatgaaaagaaacttgtttgcattacattaaatataatcctatacatgttaagaggaagttttttttgtttttttttttttttgagacagagtctcgctctgtcgcccaggctggagtgcagtggcgggatctcggctcactgcaagctgcgcctcccgggttcacgccattctcctgcctcagcctcccaagtagctgggactacaggcgcccgccgctacgcccggctaattttttgtatttttagtagagacggggtttcaccgttttagcctggatggtctcgatctcctgacctcttgatccgcccgcctcggcctcccaaagtgctgggattacaggcgtgagccaccgcgcccggccaagaggaagttttacagcaagaaattgttcctttttttcttcccatttttctttttatatatacatattttttttctattatactttaagttctagggtacatgtgcataatgtgcaggtttgttacatatgtatacatgtgccatgttggtgtgctgcacccattaactcgtcatttacattaggtatatctcctaatgctatccctcccccctccccccatcccacaacaggccccagtgtgtgatgttccccttcctgtgtccatgtgttctcattgttcaattcccaccaatgagtgagaacatgtggtgtttggttttttgtccttgcaatagtttgctgagaatgatagtttccagcatcatcgatgtccctgcaaaggacatgaactcatctttcttatggtgtcatagtattccatggtgtatatgtgccacattttcttaatccagtctatcattgatggacatctgggttggttccaagtctttgctattgtgaatagtgctgcaataaacatatgtgtgcatgtgtctttatagcagcatgatttataatcctttgggtatatacccagtaatgggatggctgggtcaaatggtatttctagttctagatccctgaagaatcaccacactgtcttccacaatggttcaactagtttacagtctgacctacagtataaaagtgttcctatttctccacatcctctccagcacctgctgtttcctgactttttaatgattgccattctaactggtgtgagatggtatctcattgtggttttgatttgcatttgtctgatggccagtgatgatgagcattttttcatctgtctgttggctgcataaatgtcttcttttgagaagtgtctgttcatatctttcgcccacttgctgatgggttgttttttttttcttgtaaatttgtttgagttctttgtagattctggatattagccctttgtcagatgagtagattgcaaaaattttctcccattctgtaggttgcctattcactctgatggtattttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctggggtttttatggttttaggtctaacatttaagtctttaatccatattgaattatgaaatgaagcgtgaagagaagtttagagaaaaaagaataaaaagaaacgaataaagcctccaagaaatatgggactatgtgaaaagaccaaatctacgtctgattggtgtacctgaaagtgatagggagaatggaaccaagttggaaaacactctgcaggatattatccaggagaacttccccaacctagcaaggcaggccaacattcaaattcaggatatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcagatctctcggcagaaactctacaagccagaagagactgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagacctcctgaaggaagtactaaacatggaaaggaacaaccggtaccagccactgcaaaaacatgccaaattgtaaagaccatcgaggctaggaagaaactgcatcaactaacgtgcaaaatcaccagctaacataataatgacaggatgattcacacataacaatattaaccttaaatgtaaatgggctaaatgctccaattaaaagacacagactggcaaattggataaagagtcaagacccatcagagtgctgtattcaggaaacccatctcacatgcagagacatgcatagctcaaaataaagggatggaggaagatctaccaagcaaatggaaaacaaaaaaaaggcagggattgcaatcttagtctctgataaaacagactttaaatcaataaagatcaaaagagacaaagaaggccattacataattgtagagggataaattcaacaagaagagctaactatcctaaatatatatgcacccaatacaggagcacccagattcataaagcaagtccttggagacgtacaaagagacttagactcccacacaacaataatgggagactttaacacccaactgtcaacattagacagatccatgagacagaaagttaacaaagatatccaggaattgaactcagctctgcaccaagatctccacttgttaagtgaaaaagatctcccacaatgttaagtgaaaaaaagcaagctacagaggagttgtatagttgttacttttctgtaaaatgatggggtaataagaatctatatttatgttttcttatatatataaagagtctctggaaagatacataagaaacacataattttgattaccctgatggatgggtggggttgtatagatgagggcagagaagtcaagggaaacttcactgtacatttcatatataatttttctgatctgtttatatatctgtctctcccctgaaaacaacatgctatgccccatggggtcaggcacttagttgtaatgtttaatgtaatgtttatgtttatctccagtgcctcaaatggttcctagcaaatggtagaacttttgtaaaacttattttttgatagaagtgcacattttaaaaactttcagaccactgtagtaaattatgtctagatttccttacagctctagagtaggtttcagcaaaatttttctataaagagccagatactaaatattttaaggtttgttggccatatggtctctgtcacgattactcaactctgcttttatggtacaaaagcagccacagacaataagtaaacaagtgggtgtgactgtgttctaataaaatattatttataacaacaggtagccagccagatttggtccaagggctgtagtttgcccaactctgttctggaattttgtttctctgattatccatcagttgaaccttgaaaggtatgtaagatttccatctttcaaaataaaaaaattggataacgaatgaacgaataaataaataaataaatattaaccaacttttccataaggaagagttattcatattcttattcatccgatcttattcatcagatttacttcttttatattgggctatatgatactgtatctctaatgagacttttttgctttaaatccactgcattttattttattaatttataatttttattggtacatattaggtgtatatatttatggagtacatgagatattttgttacaggtaaataatgtctagtgaggtgacttttgaacagggacttgaaggaagtaaagcagcaatctatatggttagctaagggaagagggcctcagggagaagaaacagtcaacataagctacttgaagagaaaatttgcttggcttgtcttaaaactatttttaataatttcattaaagcaaaaaattctacattatagaacaccaaatatacaacttatttagtttaatatacaaatatatatctcttaagaacacaactccaaaatgaaaatatttagatattaagttaggacataaatagactaatcatttaatgatacaactccaggaggcacatagccctaagacatgtttgacaccgacatactaaaagttgaagatgctatttattatcctgcccaaattatttaaattattttagtgtatgcttggtcttgccatgattgtgagaagagcacagagacatcagaggatctagtttcttatcctaactctaccactaactagccatgtgacaagtttttaatggtaaacacaggagttgaactagataatgcctactcttcctatataacattcagcaatatctggataaattattgggtatcacaatgagtcaaggtcagggatgctcttaaaaacctgcaatgggccgggtgcagtggctcatgcctgtaatcccaggactttgggaagccgaggtggacagatcacctgaggtcaggagttcacaaccagcctagccaacatggcgaaaccctgtctctgctaaaaatacaaaaaaattagcctagctgggcgtgatggcatgttactgtaatcccagctactcgggaagctgaggcaagagaatcgcttcaactcgggaggcagaagttgcagtgagccaagagcactccaccctgggcaatagagcaagactctgtctcaaaaaaaaaacaaaaacctgcaatgcagaggacatctcacacaataattattcaacactaaatgtcaatagtgccaaggttaagaaaccctgtcctaatgaaaaggattcttctctacttcattgaaggtggtcaatgactatcatatattaattaggaatccttctggctaacaaaacctgaaataaatggtagtttaattttctgaaaacaaattcataagggtggctgccaacaacagaacagcttcaagaactcataggctaacccccaaagtgatgatattagaaggtgggaccttttgggaggtgattagttcaggaaggcggaacccttatgaataggatcagtgctcttataaaagaggccaaaaggaacccatttaccttctaccttgagagaacagagcaggaaggcactgtctatgagaaagtgggccctcaccagctgccaaatataccagtgccttgatcttaaacttcccaaactccagaactgtgaaaaataaactccagttgtttataagctacctagtttgtggcattttgttacagcagaccaaatggactaagacagggagaaagcagtagtactagccacatctatgtcttttatcaggaaagcaaaatctaacaccttaggggacagaactaccttcaagggaggtcaggaaagtcacttaaccctcactgcctgcaagggaggctggactagtaaacacttagcttccttagacttcatagtggagtctggcaaaagagaagaggattggaaattggtcttaggttaatcagttaatagagcctaccttatagtcaatatcctctcacatgaattaagatgaatactaaataataaataagtcctcatcaaacagttgatttctgggatttcctccttggtagagatgaaagaataggtgcgtaaggactacaaatctaattcatatagctcaccgatgctctgtggacaatgtcatttaaaaagtggtgctttcttctttaattgacccactgttcacacattcagctttatgttatgctatggttagatattaagttaggacgtagacaaaagaaactagtaagccaagtatccctctttcatagcagagtaagagacaaactaaaaagctatcaaccagagactaacatcgtgaaaaatcttggaaaccctcttaagggaactcttggaaaagtagtttaattacagagaacaatctcaattgctgcaggaaaagccattcctaactaacctgccagggcacttcagagatattacagccttgatacgagaaagtcaatacacatcaaagctcaaagatatatgttagagcccatagctatgatgccttttgaatctgctcagcgccatccaagcaagtggtataaattcaagattatttggcttatatttaaaatgaaaaaggcatgtttgcattccagtgcacagataaaagtgctctcttcctctagggatgaatatatcctaaccagtttaacatactttagtttggatttctgtttggtacagtaacaatgtagaccctgctaaactttatgtaatccacagtagatgtaatatattcagattttcaaacagacctaaaaagatttaacctctgagattgctgttaaaaagaaaaccttctgtactagaaagtagaatgtgtatgtagcagcatcagggagaagaaagaagatgtatattaaggaaagaatgagaagtcaccaataggaaaatttgtcagaataagttaagagtagggactagttgaaatctcctaggtcttttcagtttagcatttccttctctagagggaaattctatgaagtacttttctattataaacttgaatttctcatcctaatactttccaaataaaattattttacactaacattcaacgactgatttaaagtacagggtctggaaatttggggataaattgttttaaattttttgcaggttgctgaattctgagatgtttttgctctaactattctttctctataaaaagagcttattttaaaaaaaattttcattgacatataataattatatacatttatggagtacatagtgatgtttcaatgcctataatgtatggtgatcagagcagggtaattagcatatctaccatctaaaacatttgtcatttctttgtgttgggaacattcagtttcttccttctaggagtttgaaactacataatatattattgttaattatagtcatcctacagtgctagagaacaccagaacttattcctcctatcttgctgtaactttttttttaagagacagtcttgctctgtcacccaggctggagtagtagcacaatcatagctcactgcagccttgaactcctgggttcaagccacccccacacttcagcctcccaagtaactgggactacaggcgcatgccacaaaacaaggcttctagctttaattttgtaccctttaacaaatctctatcaccttcttccccctacccttctcagaccctagtgtcctatgttctactttttacttttttttatgttttaatgttttgtataattacagtgatatttgttccaaacctcaaactgggacacttaatataacaaaagattttaaacattttgagaatttttaaaattttaacttgttattttgaaataactttagacttacaaaagagttgtcataatgatacagagagtttctgtatatctattgcccagctttctcaaatgttaacatcactaatgttaacatcctacataaccaggtatggttatcaaaactaagaaacgaatatttgtgtagaacactattaacaaatgccagactttattagagttctaccattcttttttaatggatgtccttattctgtttcagggtccaatcaaagatgttatgaaacattttgtggtcatcttcttttgtctcctcagatctgtgagaattctgtgagaaagacagtctccatctttcctgttctttcataaccttgacatgtttggaaagtccctcatccacgtatgacttagaacatgcagtttttaactgtctgttcctgacttatttcacttaacagtgtcctccagttccaaccatgttgctgtgaatgacaggatttcattctttttatggctgaatagtgttaatggaatatatacacaatggtgtatatataccacattttttatttaatagatcattttatgccctttagaatttatttagttgctatcataataagtaacatataagggcaattccattgaagcattctggactttggctaggtaactgaacaattatgagatacatgtcaaataatgggcacttgatacatttctgttgccatttgtcattttcaattgtcgtttgtctacattgacaaatgcagagcttcttcactgtgtttgtgtacctaactgcatcaaccatttaaaaggtatctaaaaatctatgtctaggaattctaaatacaagatttgaccttttgtggaaaatactacatatgtcttaaaatatttctctgtttaaaacataatattacattattataaagttgccatgagcataattctgtcttttattttttaatactcatccaaagaccacattgtatagtgaaaatagcatagaagtaggagtcaggatgcctgtgtttcagctctagccccccgcttggacaagtctcttaaaatcctcaagcctcagattcatcttctacaaaacgaaggtgatataacttccttgcctagttcacagggcaactatgatcattatatgctatgatccttatgaaagtgtttataaattgaaaggcattatacaaagatattaatatagttaaatataaacaagaatatggcatataacccttggtggggaaaatggactaaaaatatatttagaaagtatcatgcgaatatgaacatcacattgcttttcccaaaggtaaagcaaacaagtttatactttaaaggctcttggtaattttttaaataggatcaataggtgacaggtccacacttaatacaagccatctgatctagaataggaaatccaagactttagagtacaatgaggtgaaaatcctaaaccatgagtagagcatagaattagtctggagaggccgggcgcggtggctcacgcctgtaatcccagcactttgggaggccgaggcgggcggatcacgaggtcaggagatcgagagcatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagtgagactccgtctcaaaaaaaaaaaaaaaaaaaaaaagaattagtctggagagcaaacagaacacttacagtaggggcattatgcctgttatcaaactaatctaatttctatgtaaggcaatgttcttttgtattttgctgaagaagaaataagaggaatctgagaggtcttagaaactaatttttgaaagattatattttcattcaaaatggatcagataaagttctaaagtctaagaaaatctaaggtacgatgtgagcaacatgaaatttttcattccacttagaaattctgaaaaaagagaacatactataaccagtgaaatgggaatgaaaattcaagtaaaaccttttcatgaaagattattcaataaataaaagaatattcctggagattaactgtaatcttccaagaggcataggtgcataggtggctcctttcatgggttgtgtataaaagttaattcaacaaatatgcattgagttagtacctaaaatatcataggtaatagggaggaaacagtatgtggcatgacctgtacttatgaaagactaaaggatcaatatcttttacaactaagagaaagtttgatatactcaactgtctaaatgaatggtacatattctatatgcacagatgcttccacatttgttaatgagtactaagggcaaatagggaagacgaaaacagtaggaatacaaaagaagggtttcatgaagaagtggaggccagagactggtcttacagaactgatatgatttgagtaagggagagagcaactactataaatggagcaaattccttatttgcaatcttggaaggaaatctttaagaagttactttagtcttcatttttctatttcactttgtactttttagtgactaaaataggttagcagagagcactaagagaaatataataccaagaattagaatcctaaaacctcaagggcttcaggtaccatataacaaatctattgccctgaactcaagctccattaccacagtcctgatgactgtctctctgctgattgagtatctccttgaaccaagagctcaccattttatgaaacaattcccttccttgtttcagaatagtctacagatatgaactgaagatcattaaagtattttaagtacacaaatcaatattcccatttgctagccataaaaacactgaaaagtcaaggggaaacatctgcataataaaattaaagactttcatataacttttaggtttcaaaatgaaactacgtgtaaggagactaaaacccagactttcctaaggccacaaagcaatttagtggtaaaaacattctctataaattcaatcttcttaacatctttccagtatgtgttactgtcccacatattctaatccaaaagactctattttgtgtttcatatcaagaactacatgctctgctccacagccttctgaaaatgaaaaaaaagaagtttaatgatctattcagatgtgtttcccttccttcgtgcactgtaattatttccaataaaaatttaaggaggttaactggaagatctgacacaaagcttgagctaaatgtaccaccctctcctcataccaccaccctcccctgaccctctttcatataaaaaatagtacattttaacttcaaagaagttcctgttatctgtgtactctctgcccatggaaattacatatacaacatacatacagtctccagatactccatttctatataggcactttcaaaggaggaactcaggcattaagttctttctagaattgaaaacgctcactcagaaatagcacctccagccctttctgacaggtgaagccctgtctatcaatcattgccctgctgccttgttttctttctttttttttccagtccagtgtgatcaactgaaacaatatcactatccagctctgagcatattcattttacttacatgtacattggaagttctttggtgactaatacttaaaattatatcagtttacttaaaccatgttcaatgaaaaatagataatcaaaaagatttttttccacagaagctgtttgactaacagtttatgagaattcaatgttagtttctttcattctaactttttaattatttttaactaaacatagttaagaaatggaggtttctgtcagcaatccaagtctctcaagttttccaggatgttttatctactgaattcttgaaatgtctactaagaacagtgcaataatttccataagcaaaggatgcctaccagtacagaacccaaagcactaagccctgctaaggcacagcattcacatggcacactaaacaaaaattttaacaaaattgtattcatttttatcaatttataatttatcctatcaattttcaaaaaactttaaaacagtgtaggataaatacatgtataaaataagcagaattaaaataaaaatcaactaaaaatcaactaacaaaggttcatgtgatagaaattatattagaaaaatataatatgtatttgtaggaactactaaaattaaggtttcattaattgttatgatcttcttgacaacatggctctcatcatctgctataagtggacccatctgtttcttactatacatacatttatacatgtatgtgtatatgcctccctgtgttggtccatttgcattgttataaaggaaataacctgaggctgggtgatttataaagaaaagaggtttatttgactcatggtttatttggctcattctgcagggcttctggtgaggcccaggaagcttttactcatagcagaaggtaaagggggagccagcatatctcatgatgaaagcgggaacaagagagaggagggggtgccaggctttcttaaacagtcagatttcatgtgaactcatacagtaagaattcattcattatcacaaagactgtatcaagccattcatgagtgatcagtccccaagacccaaaccctaccactaggcccacctccaacattggaggtcacatttcaacacaggattttgaaggggcaaaacatccaaactacatcactccataagttgttaatgcagtgtttatcaaaggcatgacttaatgtaagtcttggaactgtattcattgcttagttttaatgttacatattatacatattatataatctctattaataaattctcattaaaaattaagaacaattaattgttaatgtactaggtgatttgtttaaaataaatttctaaacaggaagtataatgttctcattcatctatttattcatttattcaacaggaagatgaaaaagccatggtacctaccccgtggcaagcaccgtgaacaaggcattacatgcgtaatgctatttaatcttcacaacagtcgtggtaagaaagtattgccatacccatcttacagctgaggaaactaaagctcagaaagattagaatataccagtaagtagtggagttgggacttgaactcatttgcctagctgcatattaagattctcaccactacataatgtagtctcacaacaagtactaacttaccatttatgtagtaccaaagaccaacttaaaatgtagtgtagactcagaatcacaactagaatgtggtccttgatttttaaggtgtttacagtccactttacctcactaacctaactagagctatgctaggcatatcttggagttcaatgattagttaacaataaatttaaatatagaatgagtcagtagatataatattgagtttctattatatggcagctgcatgcaaaacattgtatatgatgaataaggtgaaaataacccacttctaacattaaacagtgacgtttactagaatctttgatgtaggtaacagagaagtaaaaataatctgtagttgctttttaactttttccttcagactactgaggaaattatgttccacttaatatcaaaccagctttcttgatttattttctaagccaaggttaatgctcttatactaagggtcactaacagattccttaccatttacaccattagattgtatagcattaagataaatctacactagcgtgagaaacattactgttttgctccttatcattacttatatatgtatatatcaccttgtgccagaaaggatataaagtgttttataaggatacataaaacacaaattagcataaatttaaagttggttaaaaaaaaataaaggtaaagacaaagtaaggtcgctatacatcactgtggtggctgcaaatttggctcctttctttctagcaacctacctgaaataagaaaacttatcacttattgaatttacaattccaaaggtatttttctcattgcttaaggaatatatgatatccttggaattaagatgttttaatttctccaaacctcttttaaaaatatgtgacctaataaacaactattttcatgcttcatccactaaatatatgcattatcttcatagacatggtttttcttgttccaggaataaaagaaaaggtactgagttacatgtttgcattcttctagattcccactacttacacacacaccacccactaaaataacagattcttgtttgtttgataaattcccaggtcttcttccattgtgcaggctcaaagttccaggggagcccaaaactgaaacagctccctaaggctaggcagaactgtttaataaaactctgagccagtgaagaaagggaacaaatacaggaagctcgtatgactcagtttagagaaaaagctttctgagagcttagaaatagagcatggaatgagaggaagaaattaggcagctgctacatatagaagattgtaaaaatgagagaataaggaaaaaatatttaagaaagccttactgagtattatgcaattattcccctttgcctatttgataagaaaaagtggtaaagatttgaatttcttttcaattatttttgatgctactttgttgcttctttcaatgtgaatgccaccaaaaaggcctattttgataagaaaaagtggtaaagatttgaatttcttttcggttattttacatgctactttgttgcttctttcaatgtgaatgctaccaaaaaagggcctattttgataagaaaaagtagtaaagatttgaatttcttttcaattattttatatgctactttgttgcttctttcaatgtgaatgctaccaaaaaagggaaagagatggcttgctttatgcagcttatagtctaatgacctcagtatagaataatggcatcccagggcctcctgtggctccagccatctgcacacttgtggttgacaagggacttctccttctgtccagaattcacttatgcaagaatgggactttttaattttttcaaacctcagaagttttctttcagaaactagaaaaagcataataaggaaacttgaaccaaaaagaacacttctacctaatatagtttttgaggtgcccctaatctctattgagacccagaatctttcagtgatcacacattcatcaaagtaatggttttcagccttcttcacaaactctaatagaataaagtttgcaccactgttacctttgattgtacaaatatctatatgtgtatagttaaaaacactagtttaaaggaagaaggaatcatatataggagaattacccaactcttcacccttttttttctcttccccacttcattctcctaaaccaaggctgcatgtgaaacttgagcattctgagcgcaaagcaacagcaccatcagagcaagacagctgtgtccaggaactacattcctacagagggtttggcagccagtgtggtcccacagtgcctggtggggatataccctgaaggatctcaaaaaaaaaaaaaaaaacctggggagtgttggaggacagcagaagtttcacagtcatgcaagtggaagctaccagcctgtgcacgggagctttaatattaatgtgacctcctggtcacatacagtgcagtaaagggacatttaaataatatacaaaatggaaataccatcaccttatctgcttatgtctctacattgtttcgagcatctaaaaatgaaatgcataaaaaggcactcagaaactataatgtacaatataagtatatgccaatattctaacttccaaataaaacttactcataaattaggtatagggttagacctgattctgaattctttacattgccatgcaccatagggaatgtgcttctaaaaatatgcaataagttatttggacagtctgacgaaagcataaggagttcttactttttataattacacattgaatttcatctcatttatttacgttcggtcctgttttcaactacttggaattcttctgagcagaaatttttctttatacagacattacataactcacaggtctcaggctactcaccccctccatgtccatctccttctgcccctctaacataccacataccacccttcttaccctctcttcagatggtaaaatgggcgtttctcacattcttttacctaagatctgacttcaacacttgtttgaactgagttgaaagccttcattaaacatcagcagaaaaaaagactgacaatagatcctagggggaagtgaacaaaaaggaaagaaaaacaaagcactgaggaagatcatcttaaaggaaaaagatagaaaaagtcttatactttaatcccaatggcctttgtatatgttttaagaatagtgccagaacacgaaaaatgaggggtttcatttacttatgactgaaatactgagaatgataaaggtaggaaatagtgtctgtcacttaatgattacatgactgataattaccttaagaaagttggccatgcacattaacatgagttccacataatgttaataacaaagcaaaccacaagttcctttttggttaattcaagtctgatcaaaagcaagtgaaagcacatacaattctcacaaaagttaagtatttgttaagacctcattccaaaacctccgtcctaccttcctatccttctttaaatcatctgaagttctgatctgtaacaagaagcccgttagttgagggaggacccaagacggccgaataggaacggctctggtctacagctcccagcgtgagcgacgcagaagacgggtgatttctgcatttccaactgaggtaccaggttcatctcactagggagtgccagacagtgggcgcaggtcagtgggtgcgcgcaccgtgcaccagccgaagcagggtgaggcattgcctcactggggaagcgcaaggggtcagggagttccctttccgagtcaaagaaaggggtgacggacggcacctgaaaaatcgggtcactcccacccgaatactgcgcttttcctaggggcttaaaaaacggcgcaccacgagagtatatcccgcacctggctcggagggtcctacgccccacggagtctcgctgattgctagcacggcagtctgagatcaaactgcaaggcagcagcgaggctgggggaggggcgcccaccatagcccaggcttgattaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaaccagcagactgcctcctcaagtgggtccctgacccctgacctctgagcagcctaactgggaggcaccctccagcaggagcacactgacacctcacatggcagggtattccaacagacctgcagctgagggtcctgtctgttagaaggaaaacttacaaacagaaaggacacccacaccaaaaacccatctgtacatcaccatcatcaaagaccaaaagtagataaaaccacaaagatggggaaaaaacagaacagaaaaactggaaactctaaaaagcagagggcctctcctcctccaaaggaacacagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgacgtgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactccttgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaaaccagaagagagtgagggccaatattcaacattcttaaagaaaagaattttcaacccagaatttcatatccagccaaactaagcttcataagtgaaggagaaataaaatactttatagacaagcaaatgctgagagattttgtcaccaccaggccggccttacaagagctcctgaaggaagcgctaaacatggaaaggaacaaccagtaccagccgctgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacagactggcaaattggataaagaatcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaacagacaaagaaggccattacataatggtaaagggatcaattcaacaagaagagctaactatcctaaatatatatgcacccaatacaggagcacccagattcataaagcaagtcctgagtgacctacaaagagacttagactcccacacattaaaaatgggagactttaacaccccactgtcaacattagacagatcaatgagacaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataagaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacactcaaaagctagcagaaggcaagaaataactaaaatcagagcagaacggaaggaaataaagacataaaaaacccttcaaaaaattaatgaatccaggagctggttttttgaaaggatcaacaaaattgatagaccactagcatgactaataaagaaaaagagaagaatcaaatagatgcaataaaaaatgataagggggatatcaccaccgatcccacagaaatacaaactaccatcagagaatactacaaacacctctatgcaaataaactagaaaatctagaagaaatggataaattcctcgacacatacactctcccaagactaaaccaggaagaaactgaatctctgaatagaccaacaacaggatctgaaattgtggcaataatcaacagcttaccaaccaaaaagagtccaggaccagatgtattcacagccgaattctacaagaggtacaaggaggaactggtaccattcctactgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaaccagaagcattgcctttgaaaactggcacaagacagggatgccctctcttaccactcctattcaacatagtgttggaagttctggccagggcaattaggcaggagaaggaaataaagggtattcaattaggaaaagaggaagtcaaattgtccctgtttgcagacgacatgattgtatatctagaaaccccattgtctcagcccaaaatctccttaagctgataagcaacttcagcaaagtctcaggatacaaaatcaatgtacaaaaatcacaagcattcttatacaccaacaacagacaaacagagacccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccacgctcatgggtaggaaaatcaatatcgtgaaaatggccatactgcccaaggtaatttacagattcaatgccatccccatcaagctaccaatgcctttcttcacagaattggaaaaaactactttaaagttcatatggaaccaaaaaagagcccacatcgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctgtttaataaatggtgctgggaaaactggctacccatttgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactcaagagcttctgcacagcaaaacaaactaccatcagagtgaacaggcaacctacaaaatgggagaaaattttcacaacctactcatctgacaaagggctaatatccagaatctacagtgaactcaaataaatttacaagaaaaaaacaaacaaccccatcaaaaagtgggcaaaggacaagaacagacacttctcaaaagaagacatttattcagccaacagacacgtgaaaaaatgctcatcatcactggccatcagagaaatgcaaatcaaaaccacaatgagataccatctcacaccagttagaatggcgatcattaaaaagtcaggaaacaacaggtgctggagaagatgtggagaaataggaacacttttacactgttggtgggactgtaaactacttcaaccattgtggaagtcagtgtggtgattcctcagggatctagaactacaaataccatttgacccagccatcccattactgggtatatacccaaaggactataaatcatgctgctataaagacgcatgcacacgtatgtttattgcggcactcttcacaagagcaaagacttggaaccaacccaaatgtccatcaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtggggggaagcaggagggatagcattgggagatatacctaatgctagatgatgagttagtgggtgcagcgcaccagcatggcacatgtatacatatgtaactagcctgcacaatgtacacatgtaccctaaaacttaaagtataataataaaaaaaaaataaataaaaataaaaataaaaagaatgtggccatgatgacagggaggaagatttacctcagacctgcagtatggacttctactcatcaatatttactggtcacagaaactgctgaattcaaaatctgccaacaataccatctgtgtgctacagaataccttattcaggatcatattattactcataccatcattgttgaccaaggaatttattttacagcaaataaaatgtggcaaagggcccttgctcatgaaattaactaatcttgccatgattttcttcatagcatggataatagtatggtggaatggctttttgaagactcatttatgatgtcagccatatggcaacacttttcagagctgaagtaatatccccagtatattctgcatggtcagcatacatgtgtggtgccatatcgcttacagtccaaatgtatgggtcaaggaatcaaaaggagggaaaaaaaattagaatgtactatcactatttcttcaggtgatatactagcaaacttttgccgctcattgccattattttaggccctgtgagtttagagatcttaatttcaaaggaagtaatgcttctatcaagtgataatgcaataatgattgcattgaactagacattgagacttgacccagccaaattagggccttcaattaacaggcaacaaatggggtttctgtactagttggagtgattcttctagctatcaaggtaaaattaggtttctactaaaaaataaaaagatatatatacctgaaatggaggagatcttccagagtgcttattagtattctcatttcttgtgattgaaatcagtggaaaactagcacagctcaattcaggatggactgataatcacccagatccttcagcaataatgatttaggtaacttcatcaggcaagaaattaaacaaactgaagttcttgctgggggcaaaggatataaaaatggtagtggaagaagctgtttaaacataccagctataacgatgagaccagttgcggatatatggactaacttaattatgagtatttcttatctttatataaatatgactcttttgtgtgtgtgatatcacatacacaatgtttactttattttctttcttccctcattccctaatcatgtaaaataagatgtgttaataatgcttaactttatatctcagtatttaaggtacaccgtatcaataatggagcatgaatagaagaatgaatatcaaaaaaaaaaaaagaagcccgttagttaaatcagtatgggaagtgggcaatgctgtaaaacagcagctgacatcagtattgtaaaatacataaaatctttcataaaatgaaagatagcacagacagctataagaggcatgtttgctttgaaataccccttaagaatcttagcactacacagtacctgccacagagttacctttttacaaagaaagagtaattctccaaaatcttacaacatttctgcacaatactggctaaggtcattctgatccagtatgacccagccagatattgcattataatacctgtattagaatgacaattctcacctccaggatgttagtaaaataccaatctgattactaattcaaacaaaaatacagggagggagcatcaaatatccataaaaattatttacagcaactgtagttattcaggtcatttttacagaaagcctatcccctgggccaatgtatttgtggcatttttttttattactacatagctcaaaagtgcctttcatgctcagcaggcacatcataggcaaagaactgacaaattgaaaagctatcataagaatataaatcaaaaattctataaaatttggcttatatgcccaaagatgtcaaaaacatgatatactacatcagttattcaccatcaacaaaaagaaacattgaaagcatctattttaatcctgatttttacacttgcagattttcccccaccaaatttatcttaaataattcttaagtacactttctcctcatatatattttattggctttcccttaaacatgaaaaattatagcagtttctctacacatctaatcaactcatttcagtaaaaaccataaccaattaaaatttattctcaaaaaaaggaatctaattcttaaccataggctaatgatgcttaaaagaattgctttgcagcttgaccagcagatgggacatcactttagactgcaacacaaggagaaattgatgagaaaaaactaagagactttctgttaggagaaaaactgtaagggacaccacaggaaggagccatttataatcattttctcctccacataatttaaagctgtgggccaggagccaaatgatggcaaggaacacacctcccaccaagcaagaattaagataaccagctctaatataagcaacacaaaactaattattctcataaattcccttcatagtgttaacacaaaacatcaacactatggtgctgacagcagcaggcagggaagtggtagaaaatttagatccagcactttcctttaaacttagattagtacatcatagcaatatctatattggaaaagtacaaacagaactaacagaagcataatggaacaaatttcagaatgtgaatagtaggaaacattttcagattataacaacatatattctaaatgatgacattacataacaacaatagttaagattttttaacatttccattaatcccactatccaatttaatcccccaacaacctatgtggatagaattatttccctactttacaaacaagaaagtagaggatttcagggtgacctcaaggcaataattagtttaatggcaaagccacaagtcttggtttccatttcagagctctttccaatatattaagctgcctatctatgtatattttttagtattattaacagtaaatattaaattaacatttaaaaacatcactttaaatgtatgtttgtaaaataaaagcagagtatatttttaaagaaagatcattgaaaattttaaatgacataaaaatttctttagatgattactgtaaccaaaaagaaataatcacaaaactatctgaaagcaaataacaacatcaacttgtaaacatcaattattcagaaaggaaacagaatatatcctaggaagacacaaagttgaaactcaatatgaatctagaaaaataggattatatgtttaaacttataatttatttgatgatgacactataaaaaagaacattcaaataaaatattaaataagatgcttctgacatttgactaaattcaatagatattatcattattaatatggtatcatcatcaaaattatcatattggtaaaattatcattccagctatgtaatttgatcatgttttattataagcatcaaaatcaatgtacagatgaccactgaataacatgggagttaggagtgtcaaaccccacacagattttcagctgcatataactttcaacttccccaaaatttaacaggaatgtctactgttgatcagaagccttaccaataacataaacaattaacaaacattttgtatgttataaagcaagctaaagaaaagaaaatgttgttaaaacaatcataaaaaagagaaaatatatttattatttgatatggtttggctctgtccccacccaaatctcatcttgaattgtagtttccataatccccatgtgtcatgggagggacacggtgggaggtaattgaatcgtgggggcagttaccccatgctgctgttattgtgatagtgagtgagttctcacaagagctgatggttttataaggggctttcccccgttttgattggacttctccttcctggcaccatatgtttgcttccccttcgccatgttgtaagtttcctgaggcctccccagccattctgaaccgtgagtcaattaaacctctttcctttataaattacccagtcttacatatgtctttattaccagcatgagaatggactaatacagtatattggtaccacagagagtggggtgctgctgtaaagacacccaaaaatatggaagcaactttggaactgggtcacaagcagaggttggaacagtttagagggctcagaagaaaacatgaaaatgtggggaagtttggaacatcctagagactaggagagctcagaagacaggaaggtgtgggaaagtttggaacttcctagagatttgttgaacagctttgaccaaaatgctgatagtgatatggacaataaagtccaggctgaggtgatctcagatggagaggaggaactttttgggaactggagcaaaggtgactcttgtcattctgtaacaaagaaactggcagcattttgcccctgccctagagacttgtggaactttgaacttgagagagataatttagggtatctggcagaataaatttctaagtgacaaagcattcaagaggaagcagagcataaaagttcggaaaatttgcagcctgaggatgcaatagaatagaaaagcccattttctggggagaaattcaagcctgctgcagaaacttgcataagtaacaaggccaaatgtaatcaccaagacaatggctaaaatgtctccaggccatgtcagagaccatcacagcagcccctcccattacaggcatagaggcctaggagaaaataatgatttcatgggcagagcccagggcccccctgctgtatgcagacttgggacttggtgccctgcatcccagctgctccagacatggctaaaaggggtcaaggtacagctcaggctatggcttcagagggtgcaagccccaagccttggcagcttccacatggtgttgagcctgtgggtgcacagaagtcaaaaactgaggtttaggaacctctgcctagatttcagaggatgtatggaaatgcttggatgtctaggcagaagtttgttgcagaggcagagccctcatggagaacctctgctaggaagtgtggaagggaaatgtggtgtgggagcccccacacagagtctccactggggcactgtcaaatggagttgtgagaagagggccactgtcctccagaccccagaatggtagatctgctaagagcttgtggctggaaaagcagcagacactcaatgccagccagtgaaagtagccaggagggttgctataccctgaaaagccacatgggcagagctgcccaaggccatgggagcccacctcttgtgtcagtgtaccctagatgtgagacatgaagtcaaagagcattttggaactttaaggtttaatgactgccctattggatcttggacttgcatggggcctgtagcccctttgttttgaccaattttgcccacttggaacaggtgtatttactcaacacctgtacccccattttacctaggaagtaactaacttgcttttgattttataggctcataggtggaagggacttgccttatctcagatgagactttggacttgtacttttgggttaatgctggaatgagttaagactttgggggactgttaggaaggcatgattgtgttttaaaatgtgatgacacaagatttgggaggagccaggggtggaatgatatggtttggctgtgtccctacccaaatcttatcttgaatttagttcccataatccccacgtgtcatgggagggtacctggtgggaggtaattgaatcatctgggtggttacctctacactgttgctttcatgatagtgagtgagttctcatgagatctgatggttttataaggggcttttcccccttttgcttggcactcctccttcctgtctccacgtgaagaaggacatgtttacttccccttctgccatgattgtaagtttcctgaggccttccagccatgttgaactgtgagtcaattaagcctctttccttcataaattacccagtctcagatatgtctttattagcagcatgagaacagaacgaatacactattcattaagtggaagtggattatcatgaaggccttcatccttgttgtcttcacactgagtaggatgaggaggaggagaaagagaaagggtgggtcttgctgtctcagtgggggcagaggcagaagagatggaggaggcagaaagggaggcaagagagacaggcaccctccatgtagcttttattttttaaaatctacatataaatgcacctgcacagttcaaatccttgttgttcaagggtcaactataaacgaatttgttagagtgacagacaagtaccacctttgctcaaattgtaaaaccaatattattaattttatagcattttatcagcattttttcattaaatgaatatacaattgtcacattaaatcccctagactctcatcaaaattgtaaatcatttcattagtaatcaaataaaatttgcagtttttggctaagtcattgacaacactccatgctctgtcccatcctaactctttcaacaccattttctaccatgtaatccaaatatactgggcattttatgctttctcacttttacaacatctcccaaggttttttccaggtagaacaccctccatttctccttgttaaaataatacctgatcttcaccacccaactcacatcctatgtccttagttcagacttccctgatcctgtcaactgttggagatcttttcctccattaaggtacttaccaaagtttgtcttatgtttctgataattttcataagtctcaaataactataagcattatggtaaccaagactgttttaaacttttgtatctcccaaaatacttcagtaccatagatcaagtacacattcatgaattctgcatctactacatagtcagaaaagtggaagaatttctatagttatattttaattacaatttttttttattatactttaagttttagggtacatgtgcacaacatgcaggtttgttacatatgtatacatgggccatgttggtgtgctgcacccattaactcatcatttagcattaggtatatctcctaatgctattccctcccacctccccccaccccacaacagtccccggtgtgtgatgttccccttcctatgtccatgtgttctcattgttcaatttaattacaatctttaaaatcacagaaactcttgaatacatataccaaaaccttcaagatgccaataagaattttactctgttgtgagtgcttgtcatttgtaactatattgttcccacatctaacaatctatcacccataaacatgtcaaagtactgtgacaaagtataacaaatgattctccaatattttgaatagatttacttttaaataaatgttacagatgtattatgaaataagaaataagcttacaaatacatttattttaacatcttgtgttgattatgagaacaataaaaatgagcaattcacgggaaaataatttcagatagattttgtctccctacaaatgggcatcctgatattcactctggaataaatactttaggaagaagatgatattgagatcatatccctttgtttggtaatcaaaggcttatttttcatgtggaaaattttaagtgctaataaataatccactgcaaaccacataatttttgaaaataacccccaaattatatacacaaacaagtaaattttagtgaatgtatgcaattgctattggcagttattagatcctaattacttttcaaaagtggaattaataatatgtaatttaatgtcttacaggatattataaagatgtaattttattggactttgcttctaatacactgaaccataaggctaaatttaaaaccacttagaaaagaatattagaattaaattacagagaaatttacaactaaattaagaaactctatcaattaaaaaactttgctgtcatcctcaaatgtgagtgcttatctaataatatgatcctggactaagtgttgtgtatacttcagatataaaattttcatataggctattcctaggcaaatacaaaaagtaaacaaaaacaaaacaaaaaatactgatgactagtgatcacattaaaataaatgacatcataaaagtgacccttttccccttccacctcccaccacattaggacagcaacagagcatcagcttggaagcaaaagcagccctcacaagatcacacctgtcagtgccttgatcttgaactcctgagcctccagaactatgagaaataaatttctgctctttaaaaaccacccagtttcagcatatactgaaaattcaaaacttgccatacttttaaaatatagattgggactagatacagtcagaaattgccactcccacagaaagagacccaatttaatatacaccaacataatttgaacaaatcttcagagagaaactaccaaacatggattgagaaaagatgcagtcccagagactgaagaagaaggaagttaggcacccaatgtggggtgcctgaatgctaaggctgatttccaaactggaaaggtacctggggaaggggattggtccagtaaggatatgggttatttccataccagacctctccctaagggagccccgtggccccaaagacctaataaaaacaacaacaaaatcgaaggtacagtgctagtgattggatgtggctcccccaagcagacctgatgagggggtcatctatttcccccttgcactgcagaacacagctgcaaatgttaacatagacaaaggaaccacaaggctgagtagaagcctatctactgcccattgctctcaaggaccatctactagattgtagcccaaactacaacaccaaaatcactttactaatcctgcccttgcaaaaccaagagtaagaattctgcaacgaagacaccatacagagccttagttctctaaaaactttcagaaacaaagccaacaaagtacactcaatttacaccacaattaaaagaataccatccctcccagatgagaaagaatcagcataagaactctggcaattcaaaaagccacactgcccccttacctccaaatgagcccactagctccccagaaatgtttcctaaccagtctgaattatctgaaatgacagacatagaattcaaaatatggatggcaaagaagctcattgagatcaagaagaaagttgaaactcaatccaaggaagccaagcaatccagtaaaatgattcaagggctgaaaggtgaaattctcacttaaagagagacaaaaacttaatttcttgagctgaaaaattcactacaaaaattacataatataattggaagtattaacagcagaatagaccaagctgaggaaagaatctgagagctcaaagagcaattctttcaattaacacagtcagacaaaaatacagaaaagagaattgagaaagatgaagagcagagagtgggccgagacctccaattagaagtagctatggtgcatggcactcataaagaggaagaaaagcagtgagtaaatacagcaccttcaactgaaatatccaggttttcgcactgggactgatcagggaaataaccaatccacagaaaacagagaaaagtagggcaggatgatagcccacctggaagtgacgcaaagccaagggaacccccaccccagccaaggaagtggtaagtgaatgtgccaccctgggaaaccacatttctcccatggatctttgcaaccctcagatcaggagatcccctcataaacccactccaccaggaccttgggtcagatacacagagctgtgtggagtctcagcagggcagccactcaggtatgcacagagacccaggagatttacataccccagccacaggatccctggcaaaggtgactacaactcagtcaaggcgggaggtccatacatacccctaggaagggggccgaatccagggagctgaacagcgtccatctgtgggccccatttccaaggcacctcacaaaataagacccactggcttggaacttcagccagccaccagcaacagggtagtgcctgcctgagatggaatggagctgccagggaaaggggtgggctgtcacctttgttatttggacaactcagctgttcaagtctgtgggctttggagagtccaaacagtctggacaagtaagggacccccagcacagcacagcacagctgctctatgaaaatgtggccagactacttctttaagtgggaccccaatccattccaccccactgggcaggacttcccaatagggacctccagccacccctgcccatattctaggaaagaactctgatctctcccttggctggagtgcccagtggggagggatgagctgccaatgttgctttgagcccattccagcctgtaggctttgcagaatccaagccaatacaggcagagatggatccccagcaacgcatggctgttttgtcaaggtgtggccagactgcttctttaaatagaaccccaatccattcctccttgctgggcaggtcctcccaaccagtgcttccaaccaccctcacccatgttctatggctgacaaagttctaatttctccctgtgatggagtgcccagggggccaggtgggctgccacctgtgctgtttgggcatctcacccagtccaacctgtgggccttggaaagtgcaaaactatatgggggtgaagggaagccaaacacagcacagctgctctacaaaaacgcaggaaggctgcttctttaaggaggtccctgatcccattcctcctgactaggtgagacctccaaaacagggtttccagccacatcctatgggtgcattcaggctggcaacaggtcagtacttctctgggacagagctctgagaggaaggggcaggctgccatctttgctgttttgcagccttcaccggtaatacctacaggtactgaaaaaactgaggtgactagggtctgaagcagccgcccagcaaatcatagcagccctacagaaaagtggtcagactgttcaaagaaaaaacgagcaaaacaacaagaacaacaacaacaaaaacccatccaaaggtcaacaacctcaaagatcaaaggtagataagccaacaaagatgagaaagaatcagcacaaaaacacagaaaactcaaaaatccagtgtgctccctttcctctaaatgaccacaacacctctccagcagggatttagaactggactgaggctgagatggctgagatgatagaaataggattccaaatgtggatctaaaaaatgaacttcactgagctaaaggagcactttgcaactcaatgcaaggaagctaagaatcatgataaaacaatgcaggagctgacagccaaaatagccagtatagagaggaatataaccaacctgatagagctgaaaaaaacacaacaagaacttcacgatgcaatcacaagtattaatagcagaataggccaagcagaagaaagaatctcagagcttgaagaatgtcattctgaaataacacaggcagacaaaaatagagaaaaacaatgaaaaggaataaacaaaacctccaagaaatatgggattatgtaaagagactgaatctatgactgattggggtacctgaaaaagatgaggagaatgggaccattttggataacataattcaggatatcatccaggagaacttccctgacctacctacagaagccaacattcaaattcagaaaatgcagagaaccccagtaagatacttactccacaagaagatcgtccccaaaacatgtaatcatcagatcctccaaggtcaaaatgaaataaaaaatgtcaaaggccactggaaagaaaggcgaggccacctacaaagggaagcccattggactaacagtggacctctcagcagaaaccatgcaagccagaagagattgggggacaatattcaacatttttaaagaaaagaaattccaatgcagaattacatatctagccaaactaagcttcataagagaagaaataagatccttttcagacaagcaaattctgagggaatttgttaccaccagacctgctttataaaagctcctgaaggaagcactaaatataaaaagggaaaactgttgccagcctctacaaaaatacactgaagtatacagaccagtgacattataaagcaactacataaacaagtctgcaaaataaccagctagcatcatgatcacaggatcaaatccatacataacagtattaaccttaaatgctccaattaaaagacacagagtaaaaagctggataaagaaccaagacccactggtaagctgtcttcaagagacccatctcacacgcaaaaacatacacaggctaaaaataaagggatggaggaaaatttaccaaccaaatagaaaacagaaaaaagcagggattgcaatcctagcatctaacaaaaaaagactttaaaccaaaaaatatcaaaaaagacaaagaagagtattacataatgataaagggttcaattcaacaagaatagctaactgtcctaaatatatgtgcacccaaaacaggaacacccagattcataaagcaagttcttagagaccttcaaagagacttagactcccacacaataatagtgggagactttaaaaccccattgacaatattttctaatatctctatcatcaagacagaaaattaacaaaaatattcaggacctgaactcaactctggatcaagtggaactgacagatatctatagaactctacaccccagaacaacagaatatacattcttctcattgccacacatcacttactctaaaattggtcacataatcagaagtaaaacactcctcagcaaatgtaaaagaactgaaatcataatgaacaatctctcagaccacagtgcaatcaaattagaaatcaagattaagaaatgcattcaaacccacataatatggtttggctgtgctcccaccaaaatctcctcttgaattgtacttcccaaaatctccacctctcatgggaggaacctggtgggaagtaatcagaacatgggggcagtttcctccatgctgttctcataatagtgagtgagttctcaggagagctgatggttttataagaatctgacatttcccctgctggtacttctctctcctgccaccttgtgaaaaagaacatgcttgcttccccttctgccatgactataagtttcctgaggcctccccagccatgtggaactgtgagtcaattaaacctcttttctctacaaattacccagcctggggtatttcatcatagcagcatgaaaacaaattaataccccacaaaattacatggaaattgaataacctgttcctgaacaactgttggataaataataaaattaaggcagaaatcttgaaattaatgagaacaaaaatacaacataccaaaatctctggaacccagttaatgcagtgttaagagggaaacttacagcactaaattcccacatcaaaatgttaaaaagatctgaaattaacaacctaacatcacaactaaaagaactaggaaaccaagagtgaacaaataacaaagctagctgaagacaataaataaccaaaagcagagctaaactaaaggagatagaaacatgaaaaacctttcaaaagatcaaaaatccagaagctaattttctgaaaaaaagttaataaaatagactgctaactagactaataaaaaagaaaagagagaaaattcaaataaacacaatcagaaatgacatggaggatattaccactgacccacagaaataaaaacgaccatgagagaatgttatgaacacctctatgcacacaaattgaaaatctagaagaaatggacaaatccctggacacatacaccctcccaagactgaaccagaaagaaactgagtccctgaacagatcaacaacaagctctgaaatcaaatcagtaatgaatagcctatcaaccaaaaaaagcccataaccagatggattcaccgcttaactctaccagaggtacaaagaagagctggtaccattcctattgaaactattccaaacaattgaaaagcagggactcccccataacccattctatgaggccagcatcatcctgatactaacacctggcagagatataacaaaaaagaaaacttcgggccaatatccttgataaacattgataccaaaaatcctcaacaaaatactggcaaactgaatctagcagcacatcaaaaagcttatctaccatgattaagtagtcttcatccctggaatgcaagtttcgttcaacacacacagatctataaatgtgatttatcacataaacagaactaaaaacaaaaaacacatgattatctcaacagatgcaggaaaggcctttggtaaaaattagcatcctttcatgtaaaaagctctcaataaactcggttttgaaggaacatacctctaaataataagagccatatatgagaaacccacagccaatatactgaatgggcaaaagctggaagcattccccttaaaaactggcacaagacaaggatgccctctcttaccactcctagtcaacatagtattggaagttctgaccagggaaatcaggcaagaaaaagaaataatgtgtattcaaataggaaaggaagaagtcaaactctcttcgtttgcaggtgacataattgcgtatctagaaaaccccactgactcaccccaaaagcttcttaaggtgataagcaacttcagcaaagtcttaggatacaaaaatcaatgtgcgaaaatcactaccattcctgtggaacaacagcaggcaagtagagagccaaatcataaatgaactcccattcacaattgccacaatgagaataaagtacctaggaatacagctaacagggaagtgaaggacctctttgagaagaactacaaaccactgctcaaagaaatcagagatgacacaaacaaatgggaaatcattcaacaacaggcaagtagagaaacaaatcataaatgaactcccattcacagttgccacaatgagaataaaatacctaggaatagagctaacacggaagtgaaggacctcttcaaggagaactacaaaccactgttcaaagaaatcagagatgacacaaacaaatggaaaatcattccatgctaatgaataggaagaatcaatgttttgaaaatggccatactgtccaaagtaatttatagattcaatgctattcccatcaagctaccattaacattctttacagaaatagaataaaatattttaaaatcaatacggaaccaaaatagaactcgtatagccaatcctaagcaaaaagaacaaagctagaggtaccacattccctgacttcaaactctactacagggctacagtaacccaaacagcacagtactggtacacgaacagacacatagaccaatggaacagaatacagaacccagaaataagactgcacacctacaaccatctgatattcaacaaacctgacaaaaatgaggaatggggaaaggattccctatttaataaatggttctgggagaactggctagccctatgtagaaaattaaaactggaccccttccttacactatatataaaaatcaactcaagatgaattaaagacttaaatgtaaaacccaaaattataaaaaccctagaagaaaacctaggcagtactattcaggacataggcacaggcaaagatttcatgatgaagatgccaaaaacaactgcaacaaaagcaaaaattgacaaatgagatctaattaaactaaagagcttctgcacagcaaaagaaactatcatcaagtgaacagataacctacagagtgggagaaaatttttggaaactatgtatctgacaaaggtctaatatccagcatttaaaaggaacttaaatttacaaaaaaaaaaaaaaaaaagccattataaagtaggcaaaggactgaacagacacttctcaaaagaagacatacatgcatgtggccaacaaacatgtgaaaaaaagctcaacatcactgatcagtagagaaatgcaaatcaaaaccacaatgaaataccatctcatgccaatcataatggcaactattaaaaagtccagaaacaacagatgctggcaaggttgcagagaaataggaacacttttacactgttggtgggagtgtaagttagtttaaccattgtggaagacagtgtggtgattcctcagagatctagaggcagaactaccatttgacccagcaatcccattactggttatatacccaaaggattataaatcatgctactataaagacgcatgcacacgtatgtttattgcggcactattcataatagcaaagacatggaattaacccaaatgcccatcaatgatagactggataaagaaaatatagtacacatacactatggaatactatgcagccataaaaaggaacaagatcgtgtcctttgcaggaacatggatggagttggaagctgttatcctcagcaaactaatgcaggaacagaaaacgaaacaccatatgctctcacttataagtgggaggtgaatgatgagaacacatgaacacattgaggggaataacacacactggaggctgttaggggtggaggtggggtagggggagggaaagcatcaggaagaatagctaagggattctgggcttaatacctaagtgttgggttgattgtgcagcaaactatcaaggcaaatgtttacctatgtaacaaacctgcaaatcttgcacatgtactctggaacttaaaataaaagttgaaggacaaatattttttaaaaagaaatgcaaatcaaagccacaatgagataccatctcacaccagtcagaatggctactgttaaaaagtcaaaaaataacagatgctggagaggtcgtggagaaagaggaacacttacacactgttggtgaagagtggaaattagttcaaccattgtggaagacagtgtggcaattcctcaaagacctaaagacaaaaataccactggacccagcaatcccattactgagtatatacccaaaggaatacaaatcattctgtaataagactcatgcacacatatgtttactgcagcactattcacaatagaaaagatatagaatcaacataaatgcccatcaaagatagactggattaaaaaatgtggctcatatacacaatggaatactatgcagccataaaaaggaatgagatcatgtcacttgcagggacatggatagagttggaggccattatccttagcaaaccaacacaggaactgaaaaccaaacaccaagttttcacttacaagtgggagctaaatgataataacacatagacacatggggggaacaacacacactgggtcctgtcaaagggcaaggggtgagaggagggagaggatgaggaagaatagctagtggatgctgggcttaatacctgggtggtggaatgatctgtggagcaaaccaccatggcacacatttacctatgtaataaatctgcacaacctgtacatgtacccctgaacttaaaataaaagttggaaatataaaaaatagtgttggcaagagtacagagaaaagggaactcttccacactattggtcagaatgtaaattagtacagccttatggatgatgcttccccccacccaaaaaaaaaaaaaaacccacagaaataaagctaccatatgatccagcaatcccaatatgtaataaagtatgtcccactactaggtatatacccaaagtaaatgaatcagtatttcaaagagatttctgctcccctatgttcactgcagccaagacacaaaatcaacctaagtgtccatccacagatgagtagataaagaaaatgtgttatatatacacagggggaacctgttcagccttaaaaacaaaggaaagcttttgatttgccacaacattgatgagtctggagaacattatgttacataaaattagccaagcacagaaagacaaatactgcatgatcaaacttgtgtgtggaatccagaaaagtcaaactcatagaagcagagtaaaaatagtggttaacagaggctgggagtgaggagatgggttacccagaaaaatgctggtgaaaggatacaaaatttcagttagacatgaagaataagttcgagaaatgtacaacatgaggaccacagttaatggcaatgagttgtgtaccttaaatttccaaagacagcagattttaagtgttctcattacaaaaaaatgaaaagtatatgaggtcatgtgtatgctaattagcttgatataatcattccacaatgtctacatatttcaaaacatcatgttgtatgccataaatatatacaatttttgtcaagtaaaaatttttaaaggccgaatttactcaaaggttaatttaatatgaccaaaactgagtggttcaagggatttgcttataggcatttctaggtcattgactcaattcctttttatggtcatagttttcagtaacttggctctgtgtagcagcccattccaaatgaggatctgtaccctgttatatttctgttttgtccacaactgagaagaatattcattggattgtgtatctgagttaggggaaagtctagtgcttctagaaaactccatgacaactgtagatcaatgcacagttttctgccttgaaacttgaaatttcaattgtaagacaatattaaatagaataaaaaatgatactctggcaaatataacagagttttccttttttgtgggagtgtcagattttgagttttacaggagaactaggccttctaattctgatttgactttccaactaacatcaaacttagagctccatatctgagggataactggactggtgattgtgcaaaatatttctgtcttgcatttaaagttgtaacgaattgatagaaatcaatcttaccagcactggctgtcatttaattcttattcttaactttggtgataaaaaaaaataaatctgttgaatctgtgcaaagaagcctttctgagaccaaaatggcagctaaaattatttctgtaattaatttctgccttgtgtgtcaatgttctttagaatataaatgattttgtaaatacttggcagcaatttgtttaatttggaagggcacaaagtacactccattgagttggcaaatgcaacatccttctaaatatttttcctaaaacatcaagtatattatatgtatttaaatttatattacaacacttttctgagaaagtgtaatttttaattatgacctaagtctgactacatgcatgtctttgccttcttgtttcatgcattcattagcaatttgaatagaattttaataaaattcaacaaaaagaaaaatgaacaaaacatctgagaaatatgggattatgaccaaatatatgattcatcagcattcctaagaaataaggagagagaataagcaacttgtaaaatacatttgaggacacaggcatgaaaacttctctagtgtcactacagacattgacatgcaaatccaagaaatacagagaatttcagccagatactatacaagatgaccctacccgaggcacatagtcatcagaatcaccaagatcaatgcaaaagaagaaatctaaaaggcagctagagagaaagtgcaggtcacctacagagggaatcccaccaggctagaagcagatttctcagaaaaaaccttacaagccagaagagattaggggcctattttcagtgtccttaaagaaaggaaattccaaccaaaaatttttatatcctaccaaactaagcttcataactgaaggagaaataagaggcttctctgacaagcaaatgctgagggaatacgtttaaactagagtagccttacaagaggtccttaagggagttctaaacatgaattcaaaagaatgacacctgccaccacaaatgcacacttaagcacatagctcacaggcactataaagcaactacacaagaaccagctaacaatacaatgatagaatcaaaatcacatatatcaataataaccttgaatgtaaatgggctaaacagcccactcaaaagacacagagtggcaggctggataaaaagacaagacccaaccaatctgttgttttcaagagacccatcttacatgtaatgacacccacaaactcaacgtaaaagtatgcggtaagatctaccatgcaaacagaaaacaaaaaagagcaggtgtcaccattcctcatcattcattcattcttcatcattcaattttcattcttcatctttcatcattcattcttcatgtttcatcattcattcttcattcattcatcattcattcattcatcagataaaacagattttaaacacataaaaatgaaggacaatgaagggcactgcataacaataaaggatacagtccgacaagaagccttaactatactaaatatatacacacccaactttggagcactgagatttatacaacaacttcttcttggcctaggaaaacacttaaacaaccacacaataatagtgggagacttcaacaccctactgacaacattagatcatcaaagcacaaaactaacaaagaaactctggacttcaactcaacacttgaccaaatgggcctataaagcactccatccaacaaccacagaatatgcattcttctcatctgcacacagaacatattcaaagatcaaccacatgctcagtcataaagcaggcctcaataaattcagaaagaaattgaaactataccaagtatactctcaaaccacagtgtaataaaactagacatcaataccaaaatgatctctcaaaattacacaaataaatggaaagtaagcaacttattcctgaataactcctgggtgaacatagaaattaaggcagaaatttaaaaaattatttgaagttaatgaaaataggaacacaacttaccaaaatctctgagatatagccaaagcagtgttaagaggaaaattaatagtcctaaatgccttcatcaagaagttagaaaggtctcaaattaacaaactaactttgcacctacaggaacaagaaagaaagagaacaaaccaactccaaagctagcaaaagaaaagaaataactaaaattaaagaagatcttaatgaaattgagatgcaataaaccatacaaaagaccaatgaaaccaagaattggttctttgaaaaactaagactggtagaatccctaactaaatcaacaaagaaaaagaaagagactatccaaataagcaaaatcagaaacaacactaatgatattacaactgatcccacagaaatacaaaagaacctcagagactactatgaacaactctaggcacacaaattagaaaatctaaaggaaatggataaattcctggaagcatacaatctccaaagatggaatcatgaagaaattgaaactctgaatagaccaattttaacttctgaaattgaatcaataataaagaacctaccaagcaaaaaaagccctggaccaagtgaattcacaccccaattctaccagacatacaaacaagaactgatactaatcctactgaagctattccaaaaaactgaggagcaggggctcctccctaacttattctataagacaagcatcagcctgataccaaaatcaggcagagatacaacaacaacaacaaacttcagactaatatccctcataaacacagatgcaaaaatcctcaacaaatattagcaaattgaatctagcagcacatcaaaaagttaatacaccacaatcaagtaggctttattcttgggattcaatactgaaatcacatttgttgtgatttgtgatttgctgtgttgcaagattgcaaatacttgcatatgttgcaaatcatatttgcgtttgttgcacatgttgcaaatcaacaaacatgattcaccacacaaacagaatcaagagcaaaaactataggatcatctcaatagatgcagagaaaccttttgataaaattcaacattccttcattataaaaatcctcaataaacaaaggaacatacctcaaaataataaaagccatccaggcaaacccacagccaacatcagactgaatgggcaaatgatggaaatatttcccttgagaactagaacaagacaaggctgcctactctcaccacttctcttcaacatagtactggaagtccttgccagatcaaccaggcaagagaaagaaataaaaggaatttgaaaaagaaaagaagaagtcaaactcttttcactgacgatatgattttgtacctagaaaaccctaaagactgctaaaaggttccaagaattaataagcaactttagcaaagtttcaggataaaatcaatgtacaaaaatcagtatcatttctatacaccagcaacatccaggctgagagtaaaatctagaacacaattccacttacaatagccacaaataaaatgaagtatctaggaatacagctaaccaggaggtgaaagatctctataaggagaacaacaaaacattggtgaaagaaatcagtgataatgcaaataaatggacaaacattccatactcatgaattgaaagaatcaatattgttaaaatgaccatactgcctaaagcaatttacagttactgctattcctgtcaaactactaatgtcactgtttacagaattagaaaacactattttaaaattcatatagaacgacaaaagagtgtgaatagccaaaacaatactaagcaaaaggaaaaaagacagagacattacactacccaacatgaaactgtactacaaggatatggtaatcaaaacagcatggtattggtacaaaaatagaaacatagaccaattgaacaggttagagaacccagaaataaagccacacacctacaactatctgatatttaacaaggctgacaaaaataagcaatggggaaaggactccctattcaataaatggtgctgggataactggctagccatatgcagaagactgaagctgggcccatactttttaccatatacaagaatgaactcaaaatggattaaacatttaaatgtaaatcctcaaactataaaaatcctagaagaaaacccaggaaatagtcttctcaacattggccttggcaaagaatttatggctaagtccccaaatgcaactgcaataaaaacaaaaatatagtgagaactaattaaactaaagagcttctgcatggcaaaaaaaactatgaacagagcaaagagacaacctatagaatgatacaagatatttgcaaacaaggcatccaacaaagcctaatatccagaatctatggtaaaaaataaataacaagcagaaaataaccccattaaaaagtggacaaatgaccaggcgtggtggctcacgcctgtaatcccagcacctttgggaggccgaggagggtggttcacgaggtcaggagatcgagaccatcctggctaacacagtgaaaccctgtctctactaaaaatacaaaaaattagccgggcgtggtggcgggcgcctgtagtcccagctacttgggagactgaggcaggagaatggcgtgaacccggggggcggagcttgcagtgagccgagatcgcgccactgcactccagcctgggcgacagagagagactctgtctcaaaaaaaaaaaaaaaaaaaaaaaacaagtggacaaaggacatgaacagacacttctcaaaagaagataagtggccagtaaacatatgaaaaaatactccacatcactatcagagaaatgcaagtcaaaaccacaatgaaattctacctcacaccagtcaggatggctattattaaagagccaaaaaaacaacagatgcagaggctgcagagaaaaggaaatgcttatactctgctggtgggaatgtaattagtacggccactgtggaaagcagtcgggagatttctcaaataatttaaaacatagctaccattagacccagcaatcccactactgggtatatatgcaaaagaaaataaatcattctaccaaaaagacacatgtacttgtacattcatcactgtgctagtcacaatagcaaagacatagaatcaacccaggtgcccatcaatggtagattggataaagaaaaaatagtacatatacaccatggaatactgtgtagccataaaaaaaaatgaaaatgtgacttttgcagcaacatggatggagcccttggaggtcataatcctaagcaaattaatggaggaacatataaccaaataccacgtttgcacttataagtgggagctaagccttgtgcacacatggacatcagtatgggaaaaatagacattgtggactccaagagggtggaaggcaggggatattgggttaaaaatctacctaccaggtactaggctcactacaacagtggacgggatctataccccaaacctcggcatcatgcaatattcccatgtaacaaatctgcacatgtaccccctgtatctacaagttgaaattaaataataacaataataaaaagtaaaagtgcctggggtgggggaaggtattatcaaggtgtaagttttcagagtggatctaccctaaaagtccttatagaaagccggtttattttattcaataaaacaaaagaaaggaaataactctaagacaaaagatagggttgtcacatgttgtaaatataatcttcattcatatacaaatccaattaaatttaaatccaatttaaattggtttaaatccaatttaaattggattaaatccagtttggattgggttaaatccaatttcgaacccatccactgtataaatatgaggaaaatatgttaaattttttatatttatatctctccatttaaattcttacatattgtgaataaaatcaaattttattgacatattggcgaagcataattcaatattaaagcatatgtccacacaaaacttttacacaatgttcatagcaacatttttcataagagcccaaaagtggaaacaacccaaatgtccatcaactggtaaatggataagcagcatggagcagaatatccatacaaagaagtattacttggcaataagaaagaatgaagtactgatacatgctacaacatggataaaccttagaagaattatgccctcacattctccaccatagtgcaacctttgttcatcaaagaaaaatgaaataacgtcttttattcctttattattttggaaagcaagagaaagttattaacagtaacatgacaataaatatcatatggaaaagtttcaaactgaccaattcaccttgcacattgttcattcaaatgtaaattagtgcaactattataagaaatagtatgaagttttctcaaaatcgtaaaaatagaactacaatatgatccagaaatcccatttctgggtacatataactttttgtcaaagagatctgcattctgatgtttattgtggccttattcacaacagccaagataagaaatcaacctgtatctatcaacacataaataaatggataaagaaacaggggtatacacacacaattgaatactatttcactgtaaaaaaaaaaaaagacaatattgtcatttgcaacaacatgggtgaacttcaagcatattatgttaagtgatatgtcaggcacagtaagagaaataccacatgatctgacatatgtagaatctaaaaaaagttgaactcacacaagtagagagtagaatgctagttaccagggtcaggggcattattggttaaagaatagaaaatttcaattagatggaaggaataagttcaagaaatctattgtaaaacatgtagtagaaaatccgtgcaaggaagtattacaacagaataacaacgtattgtatttttggaagttgttaagagaataaatcgtaagtgttctcaccacaaaaaaaatgataaatatatgaggtaatgaatatattgattagctcaattgaactatttcacaatgtgtacatattttaaaatatcattcacatgataaatatacataatgtttatttgtcaattaaaataaattttgtttacaaaagaaaaaacagtatgcatatttatatttttcaggattcttgttacattgactttgtttccaatagtaattgtgaggttcttcatgaactgtgcccatgggctccagtgattggtaaattattccacctctaccatggtgactgaattaaacaagatcctcaggtggttcatgtgtacattaaaatctgagaaacacttaaaaaacaaaaaatggaacaatgaagacatttaataaaataaatcttaaacaaattatataattagataggacaatacaataacatgcattatccttgtcttaaaaccaaaaggatattttttcttccaattttcttatttttaaatttatttttaatttcaacttttattttagatacagggggttcatgtgcagatttgttatgtgggaatattgcatgatgttgaggtttggagcatggacctcgtcaccctggtagtgagcatagtgcctgataggtagctttttaacccacccagcccacttcaccctctagtaatctatacagtgttgattgtttttttccaattttctacatatgcctctagagtaattctgtcatcaattacaaataaattaaagcgctttctcatatctctgaaggatgtaaatgaatattagcaaaacagttggtcttcagaaatttagaaactaatgtaatttgaatctttcccttgccagggaacatacatgccaatctagatactcaagagctatgattaaaatttattcttttgtaaaaacaccagtacagtagctatattcacataatcccttttcttaaattagtcacatatctgatgcactagtgttcttccagagttaaacaggatttttttttttttgacagtctcgctctgtcgcccaggctggagtgcagtggcacgatcttggctcactgcaacctccacctcccaagttcaagggattctcccacttcagccacctgagtagctgggactataggtgcccaccaccatgcccagctaatttttgtatttttaatagagacggggtttcaccatattggcaggctggtctcgaactcctgactttgtgatccgcctgcctcagcctcccaaagtgctaaacaggacattttaaaagccaacatcagctaataagctaacagcattttatttttactaatgaaaaaaacatttaaatctatctgtgtagttttttatttcaatcctctaaaacaaaatcaagaactaacaaatggttaagtgaattatgcatgatagtatgattttttattataattaaaatgctctttttcaatatttctaaattataaataattttaacatatagtacaaaaactttgcagcaataagtcagcataactggtaactgaataaagacaatttattatgatcctggactcacaagacagattctctgggttcaaatcccagctctgccttttccagctgcatgacattggagagtactttaacctctctgaaccacatctgaaactaggaagaatattagtacctacatcagagggattttaggagggttcaatgggctaatacatgtaacacacttacggtgtttcctggcacataatcagtactacatgagttagctcacattattatatttattttatttattttctcagagcacagagtattatctttattttccttattactattatcctttcttattttattgttattatcttcagttatatttcatgagcaaagtagtattatctttatttattttcttagagcacaaagtattgttatacgatattaaaccaaattgtaaaatagttgtttcttattattgatattaatacgtataaagttcaggggttaatgagtctcagttgaagtaaagagtgtcttttatcaaacttaatagttttgttgttgttgttctaaagaaaataattcaaatttacttataataaaataatgagtatgccacagacacaaggtacatgttaaaggcctcttctttataatgaaataacatcaccttcatcttatcattttagaacatcatcagacatctccacttcactaaagtctagggaacaggaaaggaagaagttgaattctcctcatttatctgaatcaaaagacatcaataaaatctatggagcatgcctcctagattgacaaagacatggtctttcactaaaaccaaagtgaaagaactaaagaatttgaaatatgtctgctactttgcaggttgcaggatgtgagaaatgtctgtataaaatagaaaatatccatcatggattcagctgtggagattttccttatgattataattccatggataactcacaaagttaatttcttactacaacccagtatttcagggtgtttttgttgttattttttgtttttgttttgtagaccaaactgcatctgctctaacatcctcatagattgtatgtacaagtaaacatgtctcaggtagaataacacatcagcttcagaagactacccacaagggcacctttcccattgtcacatggggaccatgaacacctctctacacatcatgggctttgggtttttaggtacattaagcactcaatttacacaacccttctttgggtttcttgaacaataaatctgaataatgatttcttcttagatttcttacaaattttaataaattatgttttttcatcacgaaatgaaagaagctaatcagattaataagacttttctgatacagatattttcttctactctttctgaattctccagaatgactgataaggtattctgcatgttatataaacttaaaaaaaatactgatataaacaaacaaatggactagtattggtggcattagaataaactcattgttttgaaaatatatacatagaaatatagatgtatgtatatgtatgtgtgtataatatcactaatattgggacaaccaacatcatgctcacactgaggacacaatatcgctttgtgctattgttatcaaaaatgcatagtctgaatttaatcatgaaaacatcagacaaactaaaaacacaaacacaagacaaactgagaaaatcttccacattaaatgaaactaagggaaaaaaattcagtacaatgcatgaccctggaatggatcctggactgtgaaaaataaatagacataatctggggacaactgacaaaatttgaatatgtgtggactctaaactagataatattatatcaatgttaaatttcctgattttgataactgtattgagattattcaacacagtgtccttgttcttagaaaatatacaataacgtatgtaagggtaaaggggcagggtgtctccaacttactctcaaaaagtccagaaggaagagagagagaatgagaaaggaaatgatatacattgtaaacaattaatgaatctgagtaaaatgtgtatgggtaaacaagagcttcttgtactatttctccaacttttttgtaattttaagttaaactgaaatgaagttaccccagatatagcttagatttgtctccccactcaaatctcatgtcaaattagaggaggggcctggtgggaggtgattggatcatgggggtggatttcccccttgctgttctcatgatagtgagtgagttctcactagaactgatggctaaacatgtgggcacattctcattcactctctctttctcctgctccaccatggtaagatgtgcttgcttcctcttcaccttttgccattactgtacgtttcctgaggcctcccagccatgcttcctgtacagcctgtggaactgtgagtccattcaacctcttttcttcataagttacccagtctcaggtagttctttctaggagtgtgagaacaaactaatacactcccccaaaatattaatctgtcaaaaggaatagaggaatgttctttctaaaaggcctagtaattaaacaaacaagaaaaggttgatcttttaaatagaggtgatttccaatatactcttagattttatgctctttggtaaatttattatgcaaagtgatatgaaagcctagatttatttgaatatattaaggaattttctttaaataagccacccaaacaattaggctttgcatatatttgtggtagacatccgttgttttacctgctagcatctcttagtccttcttcaggaaacagcacctctctcctccctccccaacccccagttagcactctgccctttcatcacttcatatgactataaatgctgtcaatattttcactttatctttctctcctaggagtagcacacaacctcaattgaccaaccagaacatcttgtcccaagattttacatgacccaggcagagccaataagaatgtttagagatattgacatagaagaaagagggtaattatcagctaataaaaagaaccatggaagcctaaggtttcaaggaactcgctttgctacctcatagagaagtcagcctgagaacagagccaactcagaggaaaacaacagctactttgggttgttttccgaagacaaagatttatctaattcaaaaagatagacactaaacacttttcagttttaaatcaaattcaaaatgagaactagaatattcattttattttcttattgcaaccttctccccaccaaacataccacaaaaagaaatgaatcaacaacacaatagtaatacatgagacaaagttaacattattgatgattgataatggagtgtattattctctcagattcatagaacagggccccacctatacaggcagtgccaagaaaaggacttggcacatagtgtgctcaatcaatgtttgctgaataaatgaaggtcggggactcttcaatctttacaagttactattgttatcaaaaacgaaagtgcctcaaaataataactgatagagaatgagcatatcatcttcccttagaaatatattctaaatttcaaacatagctctttctggatcttcttattatgaaagcataaatgctgttctagtcaggaaaaagaatcaataaatactcaaaaaattaccaggacctacaaaatgtgggtcaaatgtcaattaacacagtcagccctaatgagctgttctgttaccatctctcaccttcacccattatctgtaggtgtgcgactgatgaggatgtttaaatgaacagataaaggggtccctgcttctatacatttcatattactgttgacatttatcaccaagctttcaaccccaactgtctttgacaatagattttaaaagataataaaattcttcaacaggctttcaattcaatcctcttgtcattgtaacaaaacagcactaaaaatgaaacgaaagccagatatgacagaaactgctgaggagctaaggatgtatgatcattctttttaatgttgatatttacatatgagtttttgcttttcctaccaaaccataaataaaaatttcaatagaaaataaataagttaattcattcttcttatcaatatggtttctatagcatttcatttattaatacctttaaagataactgaaggattctgattatataacatttgctaaggcttcaaggtaccctagataaattttccaaaaactttcttttttatattttgaggcaaacaatttctaactactatttctttccaaaacagaaaaaatagaatcatcattatactcaataattttcttcctagcacttaactctctaaacaattatttctatatttatttgtctaattatgctcatcgactaaattgtaagttccatgaacagagattgtgtttgatgatgttgtcaatctttgttacccaagcatcaaacctggtccatagttggtgctcaatcaatgtttgttaaatgaatacataggtctgctaactttcccacttcttttgaaaatactcaaaaaacatttaatttaatccaaattcattcagtccctaatactatttttaaaaagcgtgtattagaaatgttttcggaattaactgggggcttagacatcagtgtgtcactcaaagcacttagtataatgcttcaaaagtactccctaaatgttaaattgaaataaattacatgtaataaaagttactttgcttctacctgtgaaatataagaaaaatttaacaacatagcaaaactaaaagatgtcttaattaacttatttttgctcattttgtggtgtctttcattcattcaatatttattgaaggcttatactcagccatgtaggtgctagacatacccaaatggatgagatatagtttagtgaaggagacaggtgaacaaacaacaatggtataatatgaaacctctgtaatagaagtatacacaaaagagctgctggagcacaatgcagcagagaggcactctcaatgacaggaaggaagaaagtttcaaaaagagatgggtgatcaggcagaaaataggaaattattaattccatacaaagaatatagtacattcttggttctgcagaactggaatgctttttctcttcatctgttttttgaagaggaaaaaaaaaccgtgcagaagcagggtatagccactaggaatttacttttcctttatttgctatcaaatatggtggcaagcaatatccatatattagctgctttgcctcagcccgccatctgaaggtagggttcttcaagtgcccaaatggtgcaaaatctcgaagctgatatcactcactccataatgagatgaatcacagaggggtcttttgctactcacagctgggccactgtggccatgcatcaccactcatagagaagggggatggagagaggtgttatgaccgtttttgttgctttttgtggagtgaaaattatcagcctatggtgttttccaaccacaacattcttacctcatatactcctccatgctgcagagagacatcctgtttctgggaagggccttgaagactagagaccttggcttatttgagaactagggtcaccctctgtttattgcatagccctatggggtgtcacaggtcctaaggaagagactttccttaaaggtcataaagcataaaacacacacgagtgttccagcgcatgaaatgttcagagatcagcaagaattcccaaatgggtagaaaaaacatagaacaaatgagtagaagaagcagaaaatgaccttgaactaacatatgaagagatttatattctaggataatgaaattattatgactttatcctcctagcaatgtggaaccaacaacacttttgaagcaaagaaatggagcaaacaaatatgtctggctgataactatggtggtagcaagaaagatggattgaaagagaacctaaaagcaaaggggaaaactatttctgatttccaagtgcaacttattaacagttcctcatgaactgtagataggaaatacacaaaattaaagcaaatgatgctgtttgtaataatagtaagttgtaatagaagaaagagtagaaagttggtaaaggatgagttcatgtcctttgcagggacatggatgaagctggaaatcatcattctgagcaaactatcacaaggacagaaaaccaaacaccgcatgttctcactcacagatgggaattgaacaatgagaacacttggacacagagcagggaatatcacacaccggggcctgtcgggaggtgggagcctgggggagggatagcattaggagaaatacctaatgtaaatgacgagttgatgggtgcagcaaaccaacatggcacatgtatacctatgtaacaaacctgcatgttgtgcacatgtaccctagaacttaaagtataattaaaaaaaaaaaagaaagttgttaagtagtagcaacttgcaaggaaatcttgaaataaagatgcaatttaaatagctaactacttagtgcatttatgatacatgctgaaaattttcaatgtacaggaagaaacagtattttttccagattcagtcatcaagagacagttaacttaattttgaagatgagttttcatttcttattatttaacttagtgcgtggtaattaatttttaatttataaatgaacagaaaccagatggtttcacttgatggctttaacaaaattactgtatgtcattaatgattctatctgattctttatgggtaccaggcatcttttgggggatgtttaaaagatctaccaattttgcttctataaaaggctaaataaaggaggggtgactgggcacacagtatggctagtttctccaacagtcctcactcccaagagtgaggagatctgcttcatatacaactgtcctagaaaatccactctgagtcaaagccccaaataagttcctatattcctggagaatcttcctggagggagatatgccaggggaagggagtactaaaaagtgtaatgttgtgattagatatgtcatattgtttgatatcattaaatagcaattagatattcttgccttaaacaaaattatgtcatgttttggccccttctctttgtaaaaattcaaaaaactcatattactgccgagaaagctcactgccttctcgagattatttttcctctcaacttaaactgtggatgtagatacttttctcatacgtattatgtgtatatgaatatatataattcttatataaagtaaactaagatccaaaatatttaactctgttaagtgcaaagtctcatttttataaatcaataaaatgaccagggcaaaaaactagacagtgagctgggggtctgaggattcagatccattcccagctgagctttgacaccacctgttgaaggctgtcctcaccagagttcagtatgcatggggatgattctgggcccagaagatgggtggacttgcagaaaataatgatgcttacagaagacctcccagttggttagctctagttctgttagttcaatagagggagacagcttagtgaacagtgaggtctcaaggtccacctttcatctccctgcttctagagaaaaaattttcccatgaaaagtcttcttccccctcaggtctcccatagaaattcagtccactcttttgagaacaagggttaagaggaaaataggacccaattttaaattatattatatccaagtaagaattcaaaacaattaacataaacattcatgaacagccttcatatggatataagatattgaatatcccttgacttgacagtacatatgtagtagttcagaaataacaattggcatcctaggtaagtatgatgaattaaatgctcttatcaaattccatagtttacctttataattttggagtaattttagtatttacaacatttttctactataataatatacaataaaaggaaattatttatatatcattaatgagttgaagacacgtaaatgaacaaatcattttaaaatgggccttagtaatagaattagagagatgtaaattaattaagaaaatactttaataggtttttccaggaacacaactagaataattgtagttgtaaagggaaatattagcattataacatagcttaataaatggacaaatacctggggagatgagttaattactaaagtagtttcattccaaacataagtgactgtgatggttaacactgagtgtcaacttcattggattgagggatacagattattaatcctggatttgtctgtgtgggtgttgccaaaagagattaacatttgagtcactgggctggggaaggcagatccacctttaatctggtgggcacaatctaatcagcttccaatgaatataaagcaggcagaaaaatgtgaaaaggggagagatggggctagcctaccagcctacatatttctcccttgctggatgcttcctgcccttgaacatcggactccaagttcttcagtattagaactcagactggctctccttgctcctcagcttgcagacaggaccttgtgatcatgtaagttaatacttaataaatgcccatttatatatatcctattagttctgtccctctaagagaaccctaatacactaatacagtgacactttctttactcctgcaaacctcaaataatatacttcttccagaacttgattatgatgtttgtttttatccttacttggatatggcaatcacacattaactctacgaattagtttttgatttgtgtttgtctagtattaagttacttactagaactttggcccctccttacaaataaaagccctaaaattatcaaaatcaacccttcaaacttttctcaaatgctttcattaaaatagattaagaataaaatgatttagtttgcatccatatttctcccatattcttatatattttacatcttttttataaaaggcaaagagcctgaatagaaataacaaattacaatttgactataatagtggtggtgcaatgctatcaatgaataagtgtataaagacccagagttctgttttcttaataattttgaggacaattagaagagattaatgattccccaaagcaagaaatacaggcatttatttgtgttgtatatagttagctaaatagaactcattattagctagtagaactcagcaacattccaaaatagtctgatcattatttatttccatttgtatttgctagaaacagagaaacaaaaggcaacatcaagaaaaagtataaaaacatccaaatcccttatttttgcctgatcaattgtgtaggtttttttctacatgtcgaggcctttttgataaagcaaattgtctatcagagcccaatccagcatctctccactccaaactggtaaggcaattatctagaagactattctcctgagaaaaccaattataaatgttctctcaaagtaagtaagcataccaatttggatgcacatgtttttttggttagcacttaaaagagaaacaaaaaaagtgtgctgagaaaaaaagatctctgtctctctcactcgacacaaaccaaagaatcatcaattgagggaattaccaagaattaactgataaaggaaaaagacttccattgatagttctccataaaatttatttttggtgagaagagtatattactttctcttggtttgctctgccaaatctcttgtccaaatcctttatatttcattttcaagcaatgctacttggctcccacctctatagtcctcctactcttaaacattccaaatatgaccaaaaatacaatgttctttatctgttgctttagccacggaagtaaacaattcacaattacccaattcagctcaaggagcacagttggttcctagaaaagtgctagattagaaatctaaagacctggactgtagtcttggatataaatttaccagctgtgtaatcaaggcagtatcacttcaactcccctagtgtccattttcacatatgttaatggtggaggttgaattggactagatgtcctctaaaatctcttcccattaaaagaagtatgggatcttattattgtgattaggaacttctactccaaagggcaattttatatttaatagtagaaggaaatgatatatttaatagtacccagaatttttttttactttcctaatacaagggagatggaaggagataataggaaaatggttatgatcccctccttcatgtatactcaggtccaggtcattcatttattcaaaaatagttattaaaacttggtatgtgctagacatatcaagcattagacaacagtaaacaggtgtgaaacatcctttaatgcagcttagggtctaatgaaagattaaaatactgtatatgcaattatgggctggaaaaaatggtcctcttttaatgaatgagcatgactcaaacataactacacacacacacacacacacacacacacacacaccctcacacatttcgcctaaaaagaaaactgttctccaagtgggcaagaaaatcaccttttgtccccagcctaaagatattatctttagcaaagataaataaatttgtcattcttgctaaattcctctgagtttgtttataattgaaacttcagatagctccttaagttaacaaaatgggtaaatggcattaagcatgaatttgaccattaagggaaggctattgtcctgttgctcctgcctatcatctttctcaaactgtcataggtattttcacctttggatatcagttgaagtcaaccactaatggactatattaatttttcttctgatgtcagcaactgaaggaacaagtacatcccatgcctgaaatggaaaaggatggtggttatcagtgcagctttattccctaggaactctaaacttgtcttggaaaacaattccctttgcagttttcagggtctttgaccgcagacttaacatatctcagaatcagagtatctgctcatgaactacctttactggttgtttcaggtactcttctaaatgctttaagaatagggacttatttagtccttctaacaaaccccatgagatagatacctatgttatcctaattttacagatgagcaagcagttctcacagcttgtatggcagaaatagaattcaatccaggtagtctggccccatgtagatacttttaactatgtagatacgggtacaaaatgcagcaaatgacaagaagatgcagcctgaagggtacactgagaatatgaaataacccaaaatggactctggggtaacatgtacagcattcttattatattaaatacccattaaaccaagatgaacaaatctcctcttgtttaagagacacagggttagaagtgttaatttttttaaggaatataaataagattgaaaatgaacccacatggcttaaaatgaaattaatcaaacaggagcctttccaaaaatggaagcactatctcatagggactttaatcccataattcaaaatggaatatcattccccaaaacatgtttctcctccagtgttcgtattccagttatggcaccactactctcttaattagaaacctgggaaccatctgaactccaccttctcctccaacccacatattcaacctataataacttagattcaaaaaatgaaattaaaaatattttgaactgaataaaaatgaaacagcatttcaaacttgcaggatgcaactaatgcagtgtataaaggaaaatttatatcgctaaatgcctatattagaaaattaaaatggtctggaaccaattaactaagctcccacctttaaaactagaaaaaaatcaagttaaagccaaaataaaccaataagaaagaaataataaagataaaattagaaattaataaaacagaaaatgtacacttacattaaaaatttcatatatgtttctgctaaaaaactttagtacctatgtttctattagtttcctgaggctgcttaaacaaattgctacaacctttgtagcttaaaacaacgtaaatttattctctcacagttttagaggccatgaatccaaaatcaaggtgtcaacaaggctgcacaccctatagagagatgctgtaagagagaatctcttctttgccttttccagctcctggtggttccaggtgttccctggcctgtggtgctatcactccggtctttgcttctgtcttcacatcactttctcctctatgtgcctgtgccaaaactctctctgcctttttcatataaaatacatatgattgcatttagatcccaaccagatcatccaggataacctcatcctcatgagatccttataatgtgatcacatcatttaccatataaagtaacattcactcttttgccatataaggtactattcacagattctgaggattaggacatgaatttatctttttgggggtcaccattcagcccatgacaacgatcatgagagatatagtttttctttcttgcaatgtttctgtctgattttggcatcagggtgatgctgactttatagactgatttggggagttttttctacaatttttctagaagagtatgtgtagcacttgtattattttttaaatatttgatagaatgcatttttaatttccttcatgaacttttcctttgccttcacaacttggctgtttggcacaagaggcccagctttcagcctgtcttagattttgacataccttcctcactgaacttaactatttttagctttttacttaaagtgagagacatgcaactcttcctttcatttgaacactttgaggcaactgtagggttattaattgacctaatttcaatgattttgtacttcaggtaatagggaggcccaaggagagagacacagatggggaaaggctggttagtagagcagtcagaacacatacagcatttgttaagttcaccatctcaaatgggcttggtttttggtccccaaaacaattacagtagtaacatcaatgagcactgatcacaaatcaccataaaaatgtaataataatgaaaaattttgaaatattgcaagaattaccaaaatgtgacacagacaggaagtgaccacacgctgttgggaaaatggagctgatacacttgctcaatacagagttgccacaaaccttctatctgtaaaaaatgcagtaactgcaaagtgcaataaagtaaagcacaataaaacgaggtatgcctgtgtttctttgtattgcctttatcaaacacattgaacatttacagtaagaattcaatgtattgaatgtatcaaattaatatgtatgaaaatatgtattggatgaatatatcatgaaaatgtattgaataaataaaatgaatgaataaatgaacaagtgaataaacaagtgaaagttcctgtccgtgccatcatcatatattccttagacaccacttcgcacaatagctttaagtggacaaatatgaatcaaccctagccataccacctctctaaaaatgaagtgttcaaaaaattattttcctgaagtttataatcctacatctactaagtactaggcagtcagaactgcctggatttcttgaacttccctctccaacacaccctttctcacctctgagatttctatctagcctgggtacaatctcctcaatacacttttataattttgacatttcagtgacattttcatttgaaccacatattagtctttcttgtctcctctattaatctgaaactccttcaagacaggcttttgactattttttaatatattcctaaaacctaaaagaacaaaagagccacagctttggaatgagtcagaccttaatttgaatcctaagtgtttctgttaacttgcaagctgagtagccttgggtaagttacctcaactctccatctcaatgtcctcatttgaagttggcaataatagtatctatcttgtaaggttgtcattagtactaaataggataaggtccataagcccctatcacagtttctagaatactaataatgccatcaatagtacttaaagtatgggtgcttaatgaacactacaattatttttcctttaggaaaacagaaagcttcacaaggtacacattttaacagtgtcgagattaaatctatttaaatccagaaagcatcccctattatttgctgaatggcatttactgactataaaaactcaggcggtgctatatatccatatatgtgtgtgtctgtgtgtatatgtttaagcccattgtaataaagaaattgctcaattagactcaaagaattgcctaaaatatgtactgccagcagctcaactatattcacaccaaaacccaagcgacatcatggaaatttaaagctgaaacctataaggaatcctaaaaagcacctgattcgcttcttcatttttctgataaggaacctgagtttgatgaaagtcatgacttaccaagtcagcatagtgagtacataggagagccttgttgctgcctcccagatttgaaagtattactgtttcatatctaaacccacattccctctatcttcaatcacctgagtacctgtgaaatcagaaagtaaccttagcaataataaaggagtagatgtatatacaggtagcctccgaagcagtgtgatgttatgcctattgttccgatatattgctataggaatctgctccatgttctacaatttacaaataaagcatttctttttgttatgtattcaaatgttcctagctttttctttctctcattgccttttatttgtaactagtgctcagacataaaggtttctttttctattaagttttaagcccaatttcaacagtaatttcaagtgtaattactgctcctttctggcaacagctctgaagtaaacccacattcatactgttcagcaacatagacaaactcaaacatccatacatccgctttcacattttactcttaaagactgaatttgaacataccttaatgtaataaaagccatctgtgacaaacccacagccaatataacattgaataaggaaaagttgaaagcattctctctgagaaagggaataggcccactctcactgctcctcttcaacatagtactggaagtcctagcgagagcaatcagacaagagaaaaaaaatgaagggaatccacatcaataaagaggaagtcaaactgtcactgtttgctgacaatatgatcgtttaccttgaaaaccctgaagattcctccagaaagctcctagaactgatacaagaattcagcagtttctggatacaagattaatgtacaccaatcagtagctcttctatatactaacagcaactaagcagataatcaaatcaagaactcaatctcttttacaatagctgccaaaaaaataaaatacttaggaatatacctaacaaagcagtcgaaagacctatacaaggaaaactacaaaacactgctgaaagaaatcacacacaacacaaacaaatggaaaaacatcccatgatcatggaggggtagaatcaatactgtgaaaatgaccatactgccaaagacaatctacaaattcaatgcaatccctatcaaaataccaccatcattcttcacagagttagaaaaaacaattctaaaattcatatggaaccaaaaaagagcctgcatagccaaagcaagagaaagcaaaaagaacaaatctggacacatcacactacctgatttcaaactatactataaggccatagtcaccaaaacagcatggtactggtataaaaatagacacatagactaatggaacagaatagagaacccagaaataaacccaaatacttacagccaactgatcttcaacaaagcaaacaaaaacatgaagtgaggagaggacacccttttcaacaaatggtgctgggataattggctagacacaagtaggataatgaaactggatcctaatctctcaccttataaaaaatcaactcaagatggattaaggacttacacctaagacctgaaactattaaaattctagaagataacattagaaaacccttctagacattggcttaggcaaggatttcattaccaagaacccaaaagcaaatgcaataaaaacaaagataaatagctgggacctaatcagactaaagagcttctgcacagcaaaaggaacagtcagcagagtaaacaaacaaaccacagagtgggagaaaatcttcacaatctatacatctgacaaaggactaatatccagaacctacaatgaattcaaacaaatcaataagaaaaaaataaacaatcccatcaaaaaatgggctaaagacatgaaaagacaattctcaaaagaagatacacagatggccaacaaacatatgaaaaaatgctcaacataactaattatcagggaaatgcaaatcaaaaccacaaggcaataccatcttactcctgcaagaatggccataagcaaaaaatcaaaaaacagtagatgttggcatggatgcggtgatcagggaacacttctacactgctggtggaaatgtaaactagtacagccactatggaagacagtatggagatttcttaaagaactgaaagtagagctaccatttgatccagcaatcccactaatgtgtatctacccagaggaaaagaagtcattattcgaaaagatacttgcacatgcatgtttacagcagcacaattcacaactgcaaaatcgtggaaccaatgcaaatgcccatcaatcaatgagtggataaagaaactgcagtaaatacatagatggaatactatgcagctataaaaaggaataaattaacagcatttgcagcgacctggatgagattggagactattattctaagtgaagtaactcagggatggaaaaccaaacatcatatgttctcactgatatgtgggaggtaagcaataaggacccaaaggcataagaatgatacaatggactttggggacctgagaggaagactgggagtggggtgagggataaaatactacaaatatggtgcagtgtatactgcttgggtgatgggtgcaccaaaatctcacaaatcaccactaaagaacttactcatgtaaccaaataccatctgtaccccaataaatttaataaataccccaataaatttaataaataccccaataaatttaataaaatttaaaaatataaaaattacacaaaaaaacaactaattttagaaatgatctaatcatgtaggaactacaacctatgtaactggccatttgagttgtaatataaattagtaaaaatttttcactttgtctttcttttatcaatttcttagtaagaaaaaaagaaatagaacttaaatattcttagatatttttaaggttgatgtggtaattagttttataacttttttctggaatgaaatgaaaataggaaaaaagagctgttttagctaactttctgactgggtataaaaatggtaaaataagcctataattactttttctggagaaatatgaaataaaagatttaaatttgctaaagaaaaatactgaatttgaaagggcaacaaataatggcttggaggaaaataaattaagataaaataattataaaaatggtagaattttggtataaaaatggtagaataagcttataattactttttctggagaaatatgaaataaaagatttaaacttgctaaaaaaaaagaaaaagactgcatttgaaagagcaacaaataatggcttggaggaaaataaataaattaagaggaaagggtcagggagcactaccgactcacagccaagttgtttttcccacttactggcataagcagtacttggcagtttgggcatgatgggaatgttcccaccacccctcctaaaagaagaaaaattgtatgtcaacatacaagaggcaaggctgccaaaactatcaataaagtataaatttcatgagggtagaaatttttgagagtttcattcactgctgaaatctctcaggacagtatctgacacacagcaggctctctctaaacatctgctccgtgaaggcagtacatagaccttattggcctcagcatcagatcctgacagtgaaactccttacaacaccactagcatctaaaattaaatattcaagggaggagcaagatggccaaatagaagccaccatcaattgtccctaaagccggaataccaaattttaacaactaactacacacaaaaaagcactgacataagaacaaaaaatcaggtaagcaatcacagcacctggttttaacttcatattgctgaaagaagcactgaagagggtatgaaagacagctttgaattgctggtgccacccctccccaatctccaggcagtgaccatctggcacagagagagaatctgtgcacaagggggtggaagagcacagtggctggggcacttgctgccttgaaggaagattgaacttatgccctgtcacagcagagagcaaagccatgctgggcttagccagctcctgcccaaaaagggaacatttggacaagccctagccagagggaaatcgcccatcccagtggtcagaacttgagtttcttgacaaacatcaccactgcgggccagagagctctggggtccttggtaagctttaaaggcagtctatgacacaaggactgaaattcctcctactgctgagcttagagccagtggactagggtggcacatgacctagggacagagtgaaaaacggggtgttttttctactcctcccacaagcccaggcagccctgctcgcagaaatgaaagtgactctttccttctgcttgaggagaggaaagcaaatagcaaagaggactttgccttgcatctagaataccagctcacccacaacaggatagggcatcaggcagagtcctgaggccctgtattagcctgttcttgcattgtgataaagaaatacctgaggctgaaaattttataaagaaaagaggtttaattggctcatggttctgccaatcagcatcaggaaacatgatgctggcatctgttcagctcataaggaggtctcaggaaacttacaatcaatggcaaaaggcaaaggggaagcaagcacatcttacatggccggagcaagagcaagagagagagggggaaggtgctacacacttttaaacaaccagacctcatgagaactcactcactatcgtgacaacagcaccaagggggatggtgttaaaccataagaaactgtcctcataatccaatcacctcccactaggccccccacctccaacaataaggattacaattaaacatgacatttaaatagggacagagaaccaaaccatatcagacccccattccagtccgtagctcctgggcaacatttctcaacacaccctgggaacctgcccagaagggagcctgctaccttgaagggaaagaccaagtcctggcaggattcatcatctgactaaggagcccttcggccccgaacaaccaaaggcaatatccaggtaatatgccatgggccttgggtgaaactctgagacatgctggctttaggggagatgcagaatattcccagctgtgggaactatggtgaaaaattctttctgcctgagaaaagcatggggaaacgtaaagggggctttttcttgcacattaggtaccaactcagccacagtgaggtagagtatcaagctgactcttggggtccttgagtccagacctaggttcttaaacagaatttctggacttaccctgggccagaagggagcccacatcccttaagggtgacttccaggcctggcagcgttcaccacaagctgactgaagagccctttggctttaagtgaacatcagcagtggcctggaagtaactcttgtcacctgtggtggtggtggtggcgatggaaagagacagctccgcctgtggaaagtggagggaagagtgggaaggactttgtcttgtggtttgagggcaagctcagatgcagtaaaacagaacacaaggcagatttctaaggtttttttactagaatccctggctcctagacagcatctctgaacctactcaagacccaggagaactttccactctgaagggaaggacataaacctagctggcttccgaacctactgattgtagaaccctagaatgagctagtcagtagccagttagtggttacagtaagcctttggtgagacccagtgctgtcctggcttcaggtctgacctctgtagtcccagtattggtggccacaggggggattgtgttaccccatccccagatgcaggcagctcagcacagagagagaaggtccatttgtttgagagaaagtaagagaagagaacaagagtctctgcctagtaatccagaaaattattctagattctatacaagaccaccaagactgcacctctataagtttgcaggaaccacagcattattgggcctggggcccaaatcccttcaaatacctgggaagcctttccaagaaagatgggcacaaacaagcccagactgagaacactacaataaatacctaactcttcaatgcccagacactgacaaatacccacaagcaacaataccatccaagaaaacatgacctcaccaaacaaactaaataaggcaccagggaccaatactggcgacacagagataggtgacctttaagagagagaattcaaaaagctgctttaaggaaactcaaagaaattcaagataacatggagaaggaattcagaattccatcagataaatttaacaaagagatttaaataataaaaagaagcaagcagaaattctggagttaaaaaatgcaattgacaaactgaataatgcatcagaataccttaatagcagaactggtcaatcagaagaaagaatcagtgagcttgaaaacagactataagaaaatatacagtgagagaagacaaaaaaaaaaaaagaataaaaagcaatgtagcatgccttcaagatctagaaaatagcctcgaaagggcaaatctaagaattattggtcttaaagaggaggtagaaaaagagatagtgatagaaagtttattcaaaaatacaatatcagagaactgcccaaacccagagaaagatatcaacattcaaatacaagaagactatagaacaccaagcatatttaacccaaagactaccttaaagcatttaataacaaaactcccaaagttcaaggataaagaaaggatcctaaaagcaccaaaagaaaagaaacaaatcacatacaatggagctccaatacatctggcagcagacttttcagtggtaactttataggccaggagagagtggtattacatatctaaagtgctgaaggaaaaaacttttattctagaatagtatatactgtgaaaatatccttcaagcatgaaggagaaatactttcctggacaaagaaaagctgaggaatttcatcaagaccagacctacaagaaatactaaagggatctcttcaagcagaaagaaaaggatattcattatcataagaagtcatctgaaggtacaaaactcactgttaattgtaagcatacagaaaaacacagactattacaatgttgtaattgtggtgtgtaaactactcttaagtacaaaaactaatgatgaaccaatcaaaaataattactacaacaactattcaaagcctaagcagtgcaataaggcataagcagtgcaataagacctaagagaaacaaccaaatgataaaaagcagggagatgaagttaaagtgtagagtttttattagttttctttttgtttttttgtttatgcaatcagtgttaagttgttatcagtgtaaaataacgggttataagatagtatttgcaaacttcatggtaacctcaaattgaaaaaacagacaacaaatacacaaaaaaataaaaagcagtaaattaaatcataccaccaaagaaaatcaccttcatggggaaaaaagaaagagaagaccacagaacaaccagaaaacaaataacaaaataacaataagtccttacttatcaataataatattgaatgtaaatggactaaactctgcaatcaaatgtcacagagtggctaaacagattaaaaaaaagagagagacccaatgatctgttgcctacaagaaacacacttcacttacaaaaatacacatagactgaaaacaaaggaatgataaaagatactctatctgaatgaacagccccccaaaaaaggagtagctatacttacatcagacataatagatttcaagacaaaaactgtacaaagagacaaaaaaatcattataaaggatcaattcagcatgataaagggtcaattcagcaagaggatataaaaattgtaaatatatatgcacccaatgatagagcacccagatatatatcattagagctaaagagacaggtagacctcaatataataacaactagagactttaacaccctactttctttttttttaattattattatactttaagttttagggtacatgtgcacaatgtgcaggttagttacatatgtatacatgtgtcatgctggtgtgctgcacccattaacttgtcatttagcattaggtatatctcctaatgctatccctcccccctccccccaccccacaacagtccccagagtgtgatgttccccttcctgtgtccatgtgttctcattgttcaattcccatctatgagtgagaacatgcggtgtttggtttttcatccttgcaatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaagagtgccgcaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccgttctaactggtgtgagatgatatctcattgtggttttgatttgcatttctctgatggccagtgatgatgagcattttttcatgcgtcttttgattgcataaatgtcttcttttgaatagtgtctgttcatatcctttgcccactttttgatggagttgtttgtttttttcttgtaaatttgtttgagttcattatagattctggatattagccctttgtcagatgagtaggttgtgaaaattttctcccattttgtaggttgcctgttcactctgatggtagtttcttttgctgtgcaggagctctttagtttaattagatcccatttgtcaattttggcttttgttgccattgcttttggtgtttcagacatgaagtctttgcccatgcctatgtcctgaatggtaatgcctaggttttcttctagggtttttatggttttaggtctaatgtttaagtctttaatccatcttgaattactttcatttcagaattggacagatcttccagacagaaaatcaacaaagaaatgtaatatttaatctgtgctatagaacaaatggacttaatagaaatttacagaacatttcaatggctgcagaatacacattcttttcttcagcacaaggatcactctcaaggacagatcatatgttaggtcccaaaacaagtcttaagatattcaagaaattaaaataatatcaaggatctcttctggccacagtggaataaaactagaaaccaataacaggaggaattttggaaactatacaaacatatgaaaattaaacaatatactcctgaatgactagtgggtcaatgaaaaaattaagaagaaaatttacaaatttcttgaaacaaatgacaatggaaacacaacataccaaaacctgtaaaacacagtgaaagtagctccaggaggcaagttcatacctataaatgcctacatcgaaaaagaagaaaaacttcaaataaataacctaatgatgaattttaaagacctaaaaaagccagagcaaaccaaacccaaaattagtagaagaaaataaataataatgatcagagcagacataagtgaaattgaaatgaagaaaacaatacaaaagatcgatgaaatgaaaagttagttttttgaaagcctaaacaaaattgacaaacttttagccagaataactaagaaaaaaggagagaaaatccaaataaataaaatcagagattaaaaaagagatgttacaactgataccacagaaattcaaaggataattagtagctactatgagcaactatatgccaacaaattggaaaatctaaaggaaatggaaaaattcctagacacatacaacctaccaagattgaaccacaaggaaatccaaaacctgaagagaccaataataagcaaagagatccaagccataataaagtgtcatccagcaaacaaaggctcaggacctatggcttcactgctgaatcctatcaaacatttaaagaagaactaattactacaatatagtttatgaagaacaaataatcaggaaaaaaaaactaataccaattctgctcaaactactctgaaaaataaaggagggagtacttccaaactcattccatgaggcgagtattaccctgacaccaaaagcagaccagacaaagacataacagaaaaaagaaaacttgcaagcttaatggtaacctcaaattgaaaaaaacatacaacaaatacacacacaaaaaaagcaagaaattaaatcataacaccaaagaaaagcaacttcatagggaaaaaaggaaaacaacaaaacaaccagaaaacaaataacaaaataacaggcataagttcttataaataatattattgaatataaatgaactaaactctgcaatcaaatgatgtagaggagctaaatgcattaaaaaaaaaaagacctgttgatctgttgcctataagaaacacaagaaaagaaaagagaggggtgaaccctttctttgccctttgccccactcccaagataacaaacctactgcaacccacttccatgataacaacattaatccatttaagaaggcagagccctcatgacctaatcacctcctattaggccctaccttccaaactgttgtaccggggattagatttccaacacatgctttttgggagacatattctaagcatagcagagaggtctttggttcttaaagcaataccactattcagcagccaaaggtaggctgagtttaagcaggtattctttgaataataacaggatcatcaatagaaatttatgtttgagatatacaattatgggattacatataaattttatttcagcaaattactgcatacagccatcatagaatttatcatcttgcactgcaataacccatttactcatctatctcaagtagacagtgagcttcctgagggcagagaaagcttcattttgtcctagtgtctggtacatgacagatgctcaataaacatcagagagaaaagataaaagggacataccagttgacacactgacctgttccctcacatagtattaaagcatagatggcaagttaatctttcattcaacaaacgcgagatacagtctctgccctcaagcaccttacaatatggaatgcaagggaaggcaaacatgaagaaaaaggcctgtattttgaaccgaatcagtcatttgtgagctttgtacatctcctcatttaacttaagcctacaccccttctaacatctaaacccttccactgtatcccttaaaatctatactgtgctctcctacactcccacccctactccctagtccacccctgacagaactttcaaaaactacaacctccacctgagctctcctagaccgaactctcaatgcagcagatagggtttccttctaaaaccccaaaggaatgtgtcattcccctgctcaaaacttctcaggaccctcatcttactcagagtaaaatctaaagtgctgaccactgttcataaggtctgtttccttctctcacttatcatctatgtaaggacaaatacaaaatttttaaaaggcttaattttccctgttgaaaataagagaccctcctcatcttttcttatagcatttacttcagaaaacttgtaagtactttcttctcgctttgaaatgtatataaatccttttgaaaactagataggatcttaccagtttcatgaccaaggaatgtctttctcaaaaaccttggagccatctctttgaatatagacatcaagggagataggagccctatctcccagtttttgtggaaggataatagcccaacttaggtaggcactttgttccacattgcaaaactacatcctaggccaggcatggtggctcacggctgtaatcccagcactttgggagaccaaggagggtggatgatgaggtcaggagatcgagaccatcctggctaacacggtgaaaccccgtctctcctaaaaatacaaaatattagccgggcgtggtggcgggcgcctgtagtcccagctactcgggaggctgaggcaggagaatggcgtgaacccaggaggcagagcttgcagtgagctgagaccgcgccactgcactccagcctgggtgacagagagagactccgtctcaaaaaataaaaaacaataaaaaaaatgacaagttggttttcctctggataatgccaattagctaacattgatggtcactccaattaccaggtgaatctagcgtaagctatatgtggcaagtggtgctgggaagttgtcttgcttgaggactagttattgtttatcttaaaacatgcgtgtaatagattgtatcttcttggctatgtaaaagaatgagatttttttctttgaaatctttcagtagattgcctatgatatgcaacacaatctagtttaatgcttattcaatgataaaagtgttttctttctcaactacctttgtgaagagcatatctgggttggaagattttgtttttaattatatttccccaaatactaccactcttctccttgctccttgttccttcaaagaaaagcctccacctttgttctgcacatatcccctcagtctagaacattccccaccactaccacccatatctgtttggcccatttcctcccatgtattcaggtcgctgctcaatgtcactttcaaagaaagatgatccctgaccaccttgtatcaaacaacaccccttggtcatcacatttctactttacctgtctttattcatcctcatagctcttataactgcttgatgtgtatgtgtttgtttacctgctcattgtctgtcttctctgaccaggataaagtctccccaagagcagagacttttcctgtttcattcacctcttatatttccagggcctagataagagtctggcacaaaggaagagctctttcaatgttagttcaatgaataaattattgttaattatacaaagcaaaagagattcaaataaagtgctattagaatgagccacttaactttgcagaaagtgcaactctgtatagctagagctataaaagagctgagcttttggctacagaaacacctgagcaagaatttatgatagctgagtgcttcttgtcacccctgctttcaaaataactgcaaatttgtgatggacagcaaagagttgtcatcttcatgcaccaattcatatgattcgtatggtcttacctcactaatcaaataatgagggaggagagcagggaaagggactggtttttaataatgaaaagtgaaatattagaatatatgaataaatgttcctgtgtatgaagagaaattaaagaaattctgtccaattcatttatagatttatgcaactccaatcaaaactccaatgcaatttgttcagaaagtgatagaataattctaaaattcatctggaaaattaagcaggtaagataattctaaaaagaaagagattaagcatcctaaagctataataataaaacaaagtgctacggatataaaagtagattaataaaacaggatagctagcctaaaatagaaagaacttattcatgatttaaaaaactcctaatcaaagaagaatgaatgaatgaatgaataataaaacatatcatttaataaacgcttttgggataattgattatgtatttaaagaaaaaataatttgagcacctgttgtacattttatactaaaagaaattctatgcgagttgaagagttaagatggaatcttaaagattctttaagattgaattaagatggaattcttaaagattccatctttaactctttaactcgcataggatttcttatcaaaaacttgataaaaaattactatttattatagatatataattgttatacaatttagaaatatatattattttaatttctaaatatatattaaatataataatatttatatatctataggtggcagatgacatgattctatatctagcaaacctcatagtctcagcccaaaaggtccttcagctgataaacaacttcagcaaagtttcaggatacaaaaccaatatacaaaaatcacttccattactatacaccaacaacagtcaagccaaaagccaaatcagccgaatctcatttacaattgacacaaaacgaattaaaaacctaggaatacagctaacaagggaggggaaagatctctaaaatgagaattacaaaacactgctcaaagaaatgtgagaaaacagaaacaaatggaaaaacattccatgctcatggatagaaagaatcaatgtcattaaaatgggccaatctgcccaaagcaatttatagattccatgctattcttaccaaactaccaataacattctttacagaactagagaaaactattttaaaattcatatggaaccaaaacagagcccaaatagccgaggcaatgctaagcaaaaagaacaaaactggaggcatcatattacccaatttcaaactatactacagggctatagtaacaaaacagcatggtagtgttacaaaaagaggcacctagcccagaaataatgctgtatacctacaactatgtgatctttgacaaatctgacaaaaacaagcaatggagaaaggactccctattcaataaatggtgctgggataactgtctagccatatgctaaagattgaaactggaccccttccttacaccatatacaaaaatcaactcaagatgaattaaagacttaaatgtaaaatccaaaactataaaacccctgaagacaagctagccaataccattctgaacataagaacaagcaatgatttcatgacgaagatgcctaaagcaatcaggacaaaagcaaaaattgacaaatgggatctaattaaactaaagagcttctgcacagcaaaagaaactatcaataaacagacaacctaaatagtaggaaaaaattttgcaaactaacaaaggtctgatatccagcatctataagaaacttaaacaaatttacaagaaaaaacaaataaccccattaaaaagtggacaaaagacatgaacaggcacttttcaagagaagacataacatgtggccaacaagcatatgaaaaaaagctcaatatcactgatcattagagaaatgcaaatcaaaaccacaatgagatgccatctcacaccagtcaggatggttattatttaaaagtgaaaaaataacacatgctggtcaagttgtggtaaaaagggaacacttatatattgttgatgggagtgtaagttagttcaaccattgtggaacgcagtgtggcgattcctcaaagacctaaaaacagaactaccatttgacccagcaatcccattactggatatatgcccagattaatataaatcattctaccataaagacatatgcacatgaatgttcactgcagcacaattcacaaacaacctaaatgcccatcagcggtaggctggataaagaaaatatggtacatatacaccattcaatgctatgcagctacaaaaaagaatgagatcatgtcttttgaagggacatagattgagctggaggccattatccttagcaaactaatgcagaaatcgaaaatcaaataccacatgttctcacttacaagtgggagataaaggataagaactcatggacacaaagaggggaatgacagacactggagcctatttgagggtagagagtaggaggagggagagaatcagaaaaaataactattgggtactaggcttaatacctgggtgatgacatagtctgtacaacaaaccactgtgacacaaatttacctatataaaaaacctgcacatgtacgctgaacctaaaataaaagtttaaaaaaaagttaaagattgaatcatagacaactttatgaaaaaaagactttattctagatatataaattgtatgtaatttataaatatatatttatttcttttagatataatatctatatatctatagatggcctttcgagacttagaacctgctatggtttgaaagtgtccccaaagttcatgtgttagaaacttaaactgccattgtaacagtattaagaggtagggcctttatgaggtaattaggccatgaaggctccatcctcatgaatggtttaataccaactttgcaggagtgagttagttatctcaggagtgggctcctgataaaggataagtttggcccccactttctcttcatctagggtactcacttccacccttccatgcttctgccttcttctatgggatgacactcattagatacagccgcttgatcttggacttcccagccaccagaatcacaagccaaataaatatgttttctttataaattacgcagtctgtggtattctgttatagcaggagaaaacagactaggaaactataaaaataaatgtaaaaagactagaaagatgtgatgttagaaacctatggtaaaaaaaaaagcaattatgagaaaaagtttttgttgtaaacatgatagatctagcttaatatgttgaataaagagatcaaacaagcagataacagaaacactaaaatcccaaaagataagtgagcaaaggtcaaaaacagacaattcatgaaagaggaaatacatctagcaaaaagacatatgaagcaggttctggctcttatcctagattctgcttctggtatccagtccactgaactcttggtttgatgcttcctgacagccaataattagcctccattttgctcttcaactgtgcccttgcttttcaactagaatttgatacttcattgctgcatcttctgttctaactttcacacattctcagttcccagcttttctatgccctgccttatggaagggtaagaaaaccataggaaatctctattttccttacttcatattttaccattttattcattcagtgctgctacataaaggcctatattttattcttcatcactttttcttttatatacactatccaaacaggttaagtaatcccatacacaatgtacaatgatccgtgttgtgataactacatgcaaacacatagttagagttccgaaggaaataaggaaggaagaataggaagagggagaaagggatggagggagggagggagggaggaatggaaggaaggaaggaaggaaggaaggaaggaaggaaggaaggagtagggagaaaaaaagggaagatcatataagcaacactttaaagcatccaaagcaaatacaaattccagggcgttgttaatttactaggcattatagatgcatttgggggaaatataatgtttgcaataccctgtgaaaaactaatattgatatcaaaatataaaaagaaagtaaaaatgaataacgtaattgcctgcaaaatgtattatgagactcaattaactttaaattatgctatcataaacaattcattatatttaaaaagtttgtatattagtttatcttactacaaaagaattcccaatggtacctaacatctaatttaaattaaatagtatttatgtgtgagcaagaatcacaacacatgaattaaacattactcataagatattaaatttcaaagtacatttataaaaatatttccaaatttttctatatcaaaaactacgtttaatgttgggttgcattgtaagtatattttaatacatttgctatgaagtgactgaagcctccaaaaacaagagtgcttaaggcagaaaaagtttttcaatggttgtggcacatgctttgaaaattcagatatgtccaggaggagcggagggttctctttgcttaatgaaacttgtcttgaagaaaaggataggcaggaacacagataatagtttccaagtgaggactgagtttgaaatagcacagtaatgtgttgttaaaattgtccttagagtcagctgaagcctaggagtcaggggtcagggggtagttgggaggagaagactaaaatataatagcaaattaaaaattatataatcatatcagcaaaatctctaaaaggaactggtgaacacaacttggcacaaatagtagtggagggtattagccacacttcaacatgtggctggcagtgtgttactttttgacacttacctagtggagaaagagtggggccatgttaccagatagagacggaggcagccagttatgtaggagcactacagcctgggcactgggccagctgcctccactgatcatcagcttgagagctagggccatgcagccagttaccaagtggagagaaaatagtgattgtatggccagtgctaaccttatgaacacatatgaaagacatgaaaatcccacaatagatatacaaagacatttttgtcatgacagttatgatgtactcctagcaggtaaggcctagagaaacatgggttatataaagaattctattaagtagacacatagaaatccttgaatatgcattagggaaaaaatgttgtcaaatggtcaacttggccatgttatttctgaaaatataaggtactaactctgtgggaaactttccaaggtttaacttttgcttttgtccttgctacaattgttgttgcaaacttatagtaaaacattagtcagatctagatcaacaaggacactgcaaggtatttccagcatggaaaacaaacttcactttcccaaattccaattctgtcaaaccagatgatgcatccatttggaaaagaaaagaaaacaaggcaactacttcagagcaagcttcattaataaatgcagaacagtctgttatctgtaaaaatgtgcagataagagaggaagagaaaaatctgcaagattcccaggctttgttgtgaataaatatagcatggctgtcaaaacaaaattgtaaaccgtattatgtagagtttccttttgttaatttggaatttaaatgtttaagtccaatcccctaaatgcaaaagtgatcaatcccagagcaatatgattactgtttcttgacaatgtggatagaaaccatcaaagccatatgtatacttaaaaacaacagacactgttatttttattcactttattttattttatttctctgaaacccatacacacagaataagaatttcctctgtatgtaaacaatataaataaaatatgcattggatatgagataatatcatatgaaatctacagaggaaaacattcatttctttatcaggcagaatcactatattagagatgaatacattctcttaagactctcaaacacttttaggttgcctatcctttagttttaaggtacattactaatacaacatcttttaaatttgaaccaagtgactttttaacatctattgaagctattggtaccttcaatagacaggagatggatcagaattctcgtggttatttaagaaatacatatgtaagtaagttcaattcacaactgagcttatgtttcctctatatgataaacatgctgaaaacaagttattcagggaaaatttttctggctgtattggaaagcttaggccaaagtcaaagagaaaagaagaactaaagcaatctagcttttcccatatgcaaacgtctatttcgaaacataggatgctgatttacagtgaaatttccgagtcaaataaaaatgaagcattgttgtatagtgggggaaaatgctggcctcgcatcaaaagttctacattccaatctcactttgttcttgctagctgataacctatgccaagtctcttatgggccttattaaatgaggagtgaattagatcatttctaacgatgttcaactctaacattttatgaacctctaccaatggaatcaatgtataagaaaatgagccaaacaaaagaaaataaaaggtattaaagaaagtggaataactaacagagaactatactcaatttacattgaaaagacaaaacattttgtaccattctaatctcataaataaaatataattcaatctattttgtgcaaaacacagtttagagaattacaaaataaagatatgaccctaaaatctactttagtttattgtgcatataaagaatttcaaactgatttaaatttaggtgatgtttccaattttatgaaacaggaaaaaattaccttaaatcactgcatccaagatttaagaaagaatttcttcataatacagttaataaaaattctttctaaaggaatttgtgaaactgtcctccagatgattcgattgtactttctattatactgcatggcatcaattttaacatgcacattttcccatatgttcacatttctcaaattaggatatgtcttccaagtgatggcatcttagatacaataaaatagggtagtttttaaaataggcatgccttatcttctctatcatattgtatttgagaaggaaaaaatagaactgtgcaagaaatcaatatcaagtcataataaacaaataaaagaaaaataaaatcccaattgttgggataccgaagaattccaactagtttacagatactccccctccaggaagaggagcttaaatctccccaccttgagtgtggactgcattagtgacttacttccaaacaggagagtaggaaggggaagggacagggtgaggaagtaaccttgcagtggaaaaacctggcaaacactacattggtcagtgatcaaagttaatatcatcattgataagtcatgtcaatagaatgtcccctttatataatgtcagagaatgtcactttacctttgtggtcatcctccccaaaacccaaaccccagtctaaccctaaggaaaatgttcagacaaatcccatttaagggccattctacaaaatgcctgaccagaccagtattcctgaaactgtcaaagtcatgaaaaacttccttgtttttcatgtctgaaagactgtcacagagcagaatgtggagacatgatgattacatgtaacactgaatcctggcacagaaaagacattaaaggaaaaattagggaaatctgaataaaatgtagagtttagttagcaataacatatcagtgttggtttattggttgtgacaaatgtatcatagcaatataaggttacaatagaagaaactgcaagaaaggtatacaagaactcctctgtactatctgtaatttttctgtaaatctaaaactattctaaaattaaaagtttatttaagaaaaccaagccatgcataattttatatacatattctacaataaaatgacccaacaaatcaaaatggaagagaattagatcctaaactaatccagatttttagaaaaataaccaagctaataagtgtaataatacaggaagataaaatgtaccaaagagaattaagaggctcttatctcaattcttaccatgggaacaatttttcatttgtgacaagacctgaattatatgttagtccatttagtacaaagtaaccatcaaaatagttaaatcctcaactgttgtacactcctatggatagcaatatttctagaataatgaaccttgtcctccctttttctgataacccatcataactctggatgtcttgggtttccaagaaagacttgtgggaaaatatgtgaaacaagtcattaaacttgggcttcaactgctatacagctcataaaacaaatagaactaaactgatttatttgagccatctgattttttgctcaagagacagggtcaaaaccaccctttagggttcaaatggtaatattctttctctgtatgaacatgagcagtgtagtcaacaattgctatgtagtctaattccttaattgactaaaaatactgtcaggccccaacttataatcaaattgtgttttaaactgctgtcatatctgttatgtataatttataacacatgttctcaatgacaaaattcttataaaggatggctaaatgcagtctagttcagaaaactttttaacccgtaaaataaaagatgttcacagcaatgtaaccaaggtgactactgccctgaaaatagactatgagccaactctagcagaaagcgagccccctccaaacaaacaaacaaacaaaaaaacatatcctggattattccctattcagactccacctcatgttttctaaagaaaatggaaagtaagcatccagggtaagccagttgcagtgtttcagagagtggatagaggtggaaagcaggatttataatattagatagaaaggaaggatagctaatataagaaatactctgtgaacaggatttttccactaactgtcagcagcactgaagtttcaagaaaaactgtggacatttccaaggtcctggatgaaaaggtatggacagcaatccccaaagccaaagttatggccaagaagagctgaagatgctttgcataaccaagcaaggcactcagctaggaaaaacactagaatggcccactaagacaggcaagaaagtcttgagcccagggcctgccaaggacacctgaaggattccaagtaacagtggaaggccacacactaaatagagtgcaggctttggaaataaatctgaatttgaatcctctgcctttaattagacctgtgaccataagaatctttcttaactgctctaagacgcagttctttcattcatcaaatcagaataaaaaatatccatttctgaatttctaacagttttatattgatgttctaacaaattatcacaaatttggctgctgaaaacaacacaaattatcattttacagttctggaggtaagaagtctgaattaggccgcatgggctaaaatcaaggtgtcagtaggactgcgttccttctggaggctttagggaagaatctatttctctgccttttccagcttcagcaggccacacacatccttggctctttaccccatttctctgttctcaaagccagcaacatggggccaagtccttctcatgctgccatctctctcctgcctctctcttccatgtttaaagatccttgtgattacaccggacccacccaggtaatccaggatcatctccatattttgcaggtccattgattagcaactttaattccctccgccatcctaattccctttgccatgtaacacatttcatatttatagtacagaattagagcatagaaatcttgggggttggggggtctattattatgctaccacatcatcatatagagtgtgagaattatatgccataatgtatataaagcagttggcatgtagcatgagtccacaaaataatagttttctcagcctccccagcttccctccctcatttaccatcagaaatcttcctctaataaatctcttgcatatctgatactgtgtgaacatcttcttcttggatgacccaattaaccagttacatcaactccagcagagcttccatactgtcaagaatcatagtattagaatcaaaagacacataataaatgctctattccaatcacttcattttataaatgagggaaacaagaccagaacaaagagtaacttgcccaaggtctaaaatcagtaggcagcatagcttgtacaagaatacttgtagcaccattaggattattctatgctgcctgtgggattctggggcaggaacaagctcttttatgactacaaaagttgatattccagtgtaaaacttctggaagtagaaaagaagattctaacagtgatgaatctcaagggaacagagaaaaggagtcctcttctagaagaggacaggccaggcacgatggttcatgcctgtaatcccagcgctttggaaggccgaagtggtcagatcacttaaggccaggagttcaatacctacctggccaacatgacaaaaccccatctctactaaaaatacaaaaagaggtttatgaaaccatcagatctcttaagaattcactcacttatcatgagaacagcatggaggaaactgcccccataatcgaatcacttcccaccaggttcctcgcttaacatgtggggattacaattcaagatgagatttgggtggggacaaaaagtgaaaccatatcaatccccaagaacgtggattatttctcatgtgactttctcaaacaacactttttctccaactccctagcaatggtgctaaaagaaggaaagtacacaccatggcaatagcatcaaacaatagttttaagaaggtgaagcctagaatagaacaaatttgtgagaaaagagcaccactattaatatatgaatattgagcactatgtctgttttaaccatatattccatgttcaatatatacctacaacagtgccatcagtagaaactcactgtccttgctctaatacactcaatattttcacccaaataatagaatcctttcccccaattagtatgagtgtagaagaaatgacaatgatctacagtgcaacttctcatgtaatcagaaattggtagagcatgcaaatccaaggctgatgtattcacatcatgtccgaatatcaggctttgcattagtagtggggatggggtaggataatatcagtgtctgatttctgcccacgtggtcagccaccattagtatgttttgcaggaaagtggataagtgaaaaccaacttaagcttcttctgcttcaaataggatattttcatcttttcaagccatgtattttttctttgatgaatgttttataagtcttctctattttctctccttcatagtaacacttctgttggacatgaataagatttagaattcatgactgtctgtgacatgtcctgaaaactagtttcactatctcagatcataaactgtacttgtctcatgtcatggagcaaaagcaaaatgtcttcatcactttttaaaatcaccatgtaagtaaattactcttttgacatatgccttaaaattatcttttacctcttagcaaagattaaatgccttagctttgccctacaacaatataacactacttcttatacttccatctctgaacctgaagaatctacattacagccaagcatgctccaagaatctacactaaaaccaagcatgctccaaagtcaatctgatatattccttttctctcttgaaacattgtatattaactttcatttttatgacttgcttttctcacattgttatcgtagcttctacattctttatccttcaaatacatttttataattccctgattttacccaataataagattaaagcatgtgagtgctctaggcaggctaatgacatggtattccttcataccaatattctttaaatactgtacatattcaacataggtttatatacttaacactgtccaggagataggcaaagaatgaagaaagcactttcctatggctttgttttcattctaactgttgaattagagctttgacttccagatatagggccactggttggacctgaacccaaatgaattgatgttatttccaggacatagtccctgggtgtggaaaccagttgtgtaactgactaatactggtaatatgtaaagtgtgtaatggcagcacattgtttaaatttgccaaagtctggctcgtttggtttaagagaattttttaaaaattaaataaatttgcccaagtgattttttgtagttgacaatccagcttttctatctaccaatctcaaaaaaagagacatactgcaattagtaaaaattatttgagaagttttcaagacttatagattattatttcaaaacgaaacagcataaatagcttactttttcattttattacttttctatgatagtaatctgttttaagattttctttacatttattcatttattttgctgccaagtgtcctgagactcttctggcattatttttgattacagggagtaggaaaaaaaagactttaaaaaggccatttatttttccaatacaaatttcattatggaggtaatattaatcataaaagaagatactaaccaaaaaaaggagaaaaaagagaaatgaaaatatattgtgtccaggttagaaggtctctgataaaagacaatctaaatctcccaatactatacagtaaattactaaggtaataatgttctgtcatgtgaatatccattcctattgtactttatatgatttgtgagttggtgatgtatgaagctggcattgaaagcaagatcagtgagtaatttgattaaacatgctgaatttacagaatttacactacttggatactaaaaattatcaggctttctgtctcactaaaatttactaggaaaagaggcaagttcttcctagaacagcaattctcaagctatggtctagaaacaagcactttcctgaacatttggcttggtagaatagaatgaacacactatagagggaaatatcccaagaggacattgagagaacactgatatattaggttatttctctttttcagtgagtcttcagagtagaacatttggagtgccactaaccattaaaattgtattccaagatcttagaagggtactccaagatcttagaaggatatcccaagtacctgtcttatgcccctatcagcaatgtgccccaaaatccccattcctgacctacttagcttgtagtctatgaaaaggaaccacagtaagataaagaaaagtgaaaaattgtcaatgttcaatatacaacctatatttttcaatcagatttatttatatgaccacacttaggacaatctcactatttgcaattttctgaatcaccaaaaagaaataaatagggaagcaaaaaggttgtataaaatgaccacagaagaatcacaattatttcaaaattttgccaaataaagaaatcataagacatgaagaaatcataaaatctctattcctctttgagctctatttaatgcaagtctttcctagtcaattaacctccaggctttatatcattaatctaatatttatatcattggccattctgtcttaaaaacatcatgtatgtttcattaaacatccagcaacacaaacaacatgatgcattaggagatggccagtcctagaaagagaagctctgattaacctttcattatttattcacataagaagtatgaattcacagaagaaatctagatggccatcaatcaactccagaaaagaaatgattttgtttttaatcacagctacttatgtttgcattagccaaattcctcattatatttgtagtcaccagttttgtaggtatgaaaggaagttgttgtaatatgttggtggtagcagcttcctgacctctgaatctcagctctggatctcagtttcatgatatcccttctggcttccactgccccagccattctagcaggtgttataagcacctaattctctctgttccctcaattccaagtgaaaatgtctagagtggttgctatttccagcactgaactcattgacagatgccttctctgactcctcttccacagcaggagatgctgtaagtcagcaccttgttactactcaacattcaggtaattaatatcctcgattaacacacactttcaaactccttaccatctttgtcttgcctgttaaaaacactcacagttatctgaatctgtaagtgtgtttttcattttaaaaacatttaacaagcaagacaaggaaagggcaccttctagtgcctgggaaaatgacatcacaaatttgcatacttcctctcttcaaaaagggaaagaaagaagcagaaagtttagtgtcttatacaaaatcccagggcaagactctgattggctcagcttgaatctggctctgacatgcatccctggaccaatctattgtgactagaatgaagctcacataataaaaaggtgtctgctagaaaccactcctctaacaatgagtaaagggaagacgtggtgatctgagaaggtgagataaacagatattctagtagatttttattatacctgtgttcaaatcctagctttgctaattgccagctgttgacctagggattgttatggaatctcactaacacagagttttcttttccatcaagagaaaataatttttaaaatttacatcgtaagatttctgcaaggattttttttctttttcttttttttttttgagatggagtctcgctctgtcacccaggctggagtgcagtcacatgacctcggctcactgcaacctctacctcccaggttcaagcaattctcctgcctcaccctcctgagtagcggggttacaggtgtgtaccaccacacccggctaatttttctatgttcagtagagacggggtttaaccatgttggccagtctggtctcaaaactcctaacctcagctcatctgcccaccttgacctcctaaagtgctgggattataggcgttagccaccacacccgacctctgtaaggattattttacataatacaaatgaagcaatgggcacggcatccaatatattgtaagtgctcagtaaatctgagtagtttgtttttatcattatcaggatgcttcagctaagtgggaacaatcaccatcagttttcttggcaaaagaaaccaaaatttacccttgatttcatttgcttgatgtctagaccctacacccaaagaccatctgaaaaaactgaccacacaaactcatatcaggttatcagctcaaaaaggacatcgcctttctagctgaacttaaatgacacaaaggcaagataaaaggaatccatgattacagtcatgtcctctggagaagggagcaatgcacattcacctcaatacatgtgttcaatttaatctaatacataaaagatctggttttctgggagccttttgttaccaaaccagcatctacaactataaataaggtttatttaaatgatttatcttgaattacctaataatttcagacaggggttagtaaattttctctataggctttgcaggccatatagtctctcttgtgaatattcaacttttcaatgaagcacaaacacagccatagacaatacattttttataatgagcatggctgcattctaatacaattttgtttacaaaaacaaacagagatctgtatttggctgataggctgtcaattgccaattcctagtttagatacaaaagtccttccctcccttcctacctccttctaccccttctcatgatcctcaattatgctcctacgaatgctctaaccccagttcatcaccatcagatgaatcattctaaaatactgttgtgtatgccattttccagctcaaaatccttcaagcatttctattacctaaaacaaaacattgaaactcgatcctgttatttaaaacattctataatccggctctaactgattttcccatgttatattcctcttctcttttacagaaatcatcccataaactgatctattcatgcttgcccttggatatttccttcttaattcttttcctcatgttttccccactatagcagtctttcgctcccctatcttcttcaccaattcaaattttttatattcttcaaggtccagaaacaaaaataataactcgcgaataaaaagtaccttgatccctttagatcccaattatctttcttgtgacttttcaaataaaagctattgttcatatcactcctgcggcccttatcacatactatttactcatccaacttgtgttggttgtgttgctgctgctgatgtcattttattggaagagcagacagcctgtatgtttcttgaaagtagtggctgagtattaaacctctttgaagagcccagcagaccttttggggtactttgtacatacactgaatatataattcattaaagctaaaggacaaaaagatatccatgtatccctttttgcagtaagtgcctttcagcaattagtgggccttttaacaaaaaaggagtttgaaatgattctataaagaaaaaggacactttgtccccaagaaagaacccagggaatgattattcaggatgtataaaattctggacttttgtttttgttttacctaaaaccttccacattgaccgtttcttatcatcctcttcaaaactgtaggtaagaaaaaaaaaaaagaaaaagaaagtacagatcattcagtattcttccttcttagaggcttcgggggagaaaagtttaatgggggagaaatagtaacaaatacctaaaagatttttaatgctttatgaaggcaattgcctgtgtttttgctgtctctcataaccatagatgggtaattgagaattagcgttgcttctgtcaagtgccatggaagcattttagtttcaagctggaaagattcagtgacattttgcatcatttaaaataataaagtcttatgcatgtggtgtcattataagcagtaacttttgatatctgaaaaatgttgcattctatttataaaaggaccctgtttttacacagaattttatttttttaaagtaattctgttactctcattctccagtctaacaacaaaaccattttcagccttaatcgcccaactcaaaataccagctataatactctcatgcaatagaaagatggtttcaaagctgccctccccaagtatttcacaataagagagtttgtatattctagattatagacgaggaaaggaaaggaaaagagaggaaaacgatgaggctagaatcaacttttctagtaaagttttatcaatttatgatgcctgctgttcaaaggaaaaaatccaaaacaagcaaataaataatagaggtttcaagtaaagagcacatttcaaaaaagggtccacagccttcagggaaagatgtaccataaaacaattatccttgataatactgtatgcccttgtccccagctatggttataactcacatggaggtcaactcagcacccaggggagagaactactgcctatcagaaaaataaacaacaagaaaataaaacacagaggagactgtagaatgttcttttatttggagaaggtgaaaaacagcctctgtactgcacatgcacaaaaaattaataataaccacatgaaaatcaagcatttagttattttcccccacatcgaaagacactgccatttaccttgtcaactgagaacaattcctctcctcccaaagtcatatttttgtttcaatttgtatagtattttcacttgcatggttttatctctatagaattcctgcaggtatgttttctacctgtcaggttattttttatttgccattttagtttgtatctaaaattctatatatgcttccaaagaagaatcaaaacttattttggagttaattgtacacaattatcaaatgttctttggatctaaagacatactaatatgcaccataatttgtttctgccaaaaaaaaattttctctcttcatctgtacaatgctattttttctaattatatgtgatgctttattaatggtatctcataggggaaatatgcccagattcttttttaaaatgtaagcaatctaaatatgttcaaagttgtgccacaaaattataaaatagagttggaaaacaatacaacaagtttttttgtgagattaacccagcaatagctttctacatgcagtcaaataatcaaatacaacaatgaagtagcaatactgtggtataatcaattgttttcttctctttctacgtaattataattgttctactatagaaaagtttaggtgctaccattgcttttaggataatcagatatgcagagccaaaaactgagacatatttttctccctaggaagaatttcagtgttggctgtacattcatgtgtgaacaaagccaaagaagatggcaagagtaaaatatgggtttgctatatccaaagcgggacaaaatgagcttccggggaaatgagggtagagaaatatcacaaactatgagatgtcaagcggtgtttgaaaatctaaataatatctgatggtagccaagacatgcctataaaattgtttcttacatatgacaaacagttgtttgtctttctggatttgtaccactttcccactgattcttcatcataacttaataccagactctaacctacaagcactttaaaagatcatagctatgttatggtgaagatccacaattaaggtagcaatcaatagatgctccctaaatttcaatgtggaataacgagggagcagacagaaaaccaaaaggcacactgaacaaaaagaataatgttgctgggcacagtagcgcacatctatagtcccactggctagggaggctgaggtgggaggatcacataagcccaggagttcaagactgaagtgaactatgatcacaccactgcacttcagcctgggagacagagtgagatctcctctcaaaaaaaaagaaaaagaaaattgttgaactggaaccaaatctcatagtaacaaagtttcacattttaaaatttcagagggaaaacctactttaatcactaaaaatctacagtctgagcatggctagttaagtttttgactacacattattgtcttggtaaaccaaatattgacagaatcttccagcttttttcatgctcaataaccacactaaatttgaaatattatgatattagccctacataagtttggatgatcttagtccttcacagttttccctacttttagacttcgttctctaatagactttcatgccattcaaatattgctttttttaaaaaaaaatcctttattatctacccctaggcatcatttcacacatcctttacacctaaaatgataaacatctgattcccatttattgaacaacatattttcattctaaatactcatttaatctaacatcttagagaacatgtgtttaaaaacataggctctatggttgactctctaggttgtaactcatgactatgtgactagtgtgactgtaagtttctttattttattttatttattattattattattatttttgagatggggcctcactgtcacttaggctggagcacagtggtgcaatcatggctcactgcagcctcgacctcctgggctcaggtgatcctcccacctcagcctcctgagtatctgagactacaggtgtgccccaccatgcctggctaatttttgtattttttgtagagactgagtcttgccatgttgcccacgctggtctcaaactcctgggctcaagcaatctgccatcctcagactcccaaagtgctaggattataggcatgagccactgtgcctagcctccaactttcttttttttttttttaactttaagttcagaggtacacacgtgggtttgttattaatacattggtaaacttgtgtcatgggagtttgttgtacagattatttcatcacccaagtattcagcctagtacccgttggtgtttttcttgatcctctccctcctcccacctgccatcttctgataggccccagtatgtgttgtttccctctaggttaataaagtagggaataggccagttgtggtggtttatgcctgtagtcccagctactcaggaggctgacgggggaggattgcttcagcctagaagtctgaggccagcttgagcagcatagcaagaccctgttccttttaaaaaaaaaatggaaaagaaaggaagaaaaataatttaaaagttttttaaaaaaattagtgtatgcaccgccattgtagacatgtgaccacatatattcagccacagagtgtcagtatagaagtctttaaaagactgaacaaatcttatgtagcatggattgcccctccagggtacagagatgtagcttggaggcactcaggccccctcacatctgtgtacaagccttctaactagttctcatcaaaagaacatgtgaacgtaagtgatatatgccgttttctgctggtgctattaagaagcaggtagggatttttctctctttccccttttactggttagaggcagatgatacagaagtcacacaatggaatcagctttttattcctggatcccagaattaccaggtagatgaaagctgcccagcaaccgggaacacacacattggattatcaggtgactgagcaaaaaattttttattgtgaatacccccactgaaatgagggggtttctttgtcacaacagcaaatgacagcttacctaaaacaatcacttctcctatttttattttcatttgttttgatgagaacttgcattcgtataaggaagcttaagcttaagttcactgctttgaggcagatgggtacatcttactgtctactgtcagaggtagttgggaaataagaaagggttggaagagtgtacctgggaccaatgctaattttttgaaaattctgtgagctgaaaactctaagaacaaaaaacagtcttttctgttcacttaaagctttaaaaagcactgcataaaaaatttcatgagagttactaaaaggagacatacagtgttattcattctatccaaaatcattctgatttcctgatttttctccgtactttcaaagtcctaacacccttaaaaatatactaaatgaaataatagaaatgtaagaatctcttatgaaggacacataaatccccctaaagttgaaatcaatttaatcctttttgaagctgctttgttcaacctctgaaaaacatatgcatgtttaggaaaagtgggtttttttaaggatgagttcatgtccttcacagggacatggatgaagctggaaaccatcattctcagaaaacgaacacaggaaaacagaaaaccaaacaccgcatgttctcactcataagcgggagttaaacaatgagaacacatggacacagggaggggaacatcatacaccggggcctgtcggggggtggggggctagaagagtgatagcattaggagaaatacctaatgtcaatgatgggttgatgggtgcagcaaaccaccatggcacatgtatatctatgtaataaacctgcacattctgcacatgtaccccagaacttaaagtacaataaaaaataaaaaaaagaaaagtgatgttctttaatttttaattttaatttttgtgggtacatagtaggtgtatatatttatggggtacataagatgttttgatacaggcatgtaatgcattataatcacatcatgtaaaatagggcatccatcccctcaagtatatatcctttatgttacaaacaatccaattatactcttttagttatttttaaatgtacaattaaattattattgactataatcaccctgttgtggtatcaaatactaggtcttattcattctttctaactaactttttgtacctattaaccatcctcacctcccctgccaccctcctactatccttcccaacctctggtaaccgttctcttgctctctatcttcatgagttcagttgttttgatttttagatctcacaaataagtgagaacatgtgatgtttgtctttctgtgcctggtttatttcacttaacataataacctccagtcccaaccatgttttgcaaatgacaggatctcattcttttttatggctgaatagtactccattgtgtataagtaccacattttctttatccattcatctgttgatggacacttaggctgcttccaaatcttagctattgtaaacagtgctgcaataaaaataagagtacagatatctcttcaacatactgatttcctacaaaagttctttttaaaatcagcttctcaaagccaatccagccttttaggtaaatacgttactgagtttatttttttaaaggcacattatatatttgatagatcacttgaatcttgtctagacatacagactgccttagacaagtgatgtttccttattcaacagactagaatttgtgttatttggcaagtttgcaacacacacacacacacacacacacaccgcagtgagactataactatgacccaaatctgtgttactttaacacagaattcctcaaccccagcactattgagtttttggggccagaaaaaaactttgggttaagattttttgtctttttcttttctttgacacagagtcttgctctgttgcccaggctggagtccagtggcatggtcacagctcactgcagtcttgacctcccaggataaagtgatcctctcacctcaacctcctgagtagctgagactacaggcatgtgccaccacacccagctaatttttgtcttttttatttatttatttatttatttatttttgtattttttgtagagaccaggtttcaccatgtcggccaggctactctcaaagccctggggctcaggtgatcttcctgcctcagcctcccaaagcacgggggggtggggcaattaccggtgtgagccactgcacccagccaagacctttagtcttaacaagtaattctgtgttgtgggggttatcttttgcattgcaagatgttctcacatccctggcctctacatggtagataccaatagcactcacttccccttttaaacacaatataacaaccaaaaatgtgtctaaagattgccaaatgtcccctctagggtaaaactgcccctagttgaaaaccactgcaccagcaaaaagcttccatttctcttggaatatcagaacgtaaggatgtactaagcttacaaagcaagcatctattatgaagctaaatctgaacttcaatggcttaaacttctgctgaagcagtggtgctagactatcgtctacagcttttactttacggattcagtaattccttcccaatctcaagttcctcttttaaaaatttcattaaaagaaaacttaattctgtttaactcttcagaaactgaagaaaaaaagaactggattcccctaataagagttgcaaatccttcttgttgaggatagtaagaaaaagagaaaacaggtttggtacaagaggggcaaagtgaaagttaaatcgggagtggatgtttttagacatgcctgcatcttgccaaagatgagaccatgtacattttggccttaattatgtatgcttttgtctctgtgaaaaggaagacattttagtcagtgaaatatttattatgtaactattaagggccagaaactgttctagggtctttctgcaaaaagaatgagaatgtttgctccaaatataaaaaaataaacaactataagatacacagatcaatgatggaaaccattgctctttagtctcctacaaactctttgctaaagcaaagtagcaaaattgtgtctttcttaaatcaaatcgtaccaaaaattataacctcacaataagaatactttccaaaatcatcacaaaacttgattcaatgattatttagttatttactagttgctaggcaatgtggcaaatgtgtaagtttcactgcatagattcactcataaaggaactcacaaacttttgagagaagtttgatttacagcagcctacactccagccatattaaagtatttgtacttcctggactttcacctatatttcatatctctgcacttctacacagagatatgaatactaatcactctatacatagaattacatttcccctcttatctgttctatcttagataaaaatgcagcaggactagtttccaagacaacaggtcacaagacatcactggtaaaacaagagacagtgaaggaaactggccaaaaccagctagaaccaaaatggcaatgaaagccatctccagttaccttcactgctcattatatgctaattataatgcattagcatgctaaaaaacactccttccagtgccatgacaaatgtcatggcaatgcccaaaagttaactctgtatggtctggataggggagaaaaccaccgttctgggagctccctgctcctttcccagaaaactcatgcataatccaccccttagtaagcatatgtaatcaagaaataaccacaattataaccaatgacgagcctgggactggggggatagggtgctctgcctatggagtagccttccttttgttcctttgttcttccaataaacttgctttcatttctctctgttggctcactcttgaattctttcctgcacaaagccaaagccaaggaccaacttggccttctgagttgagccccaattctgcatttcaccttgcaacatctccaccttcaaaatgtaaagcccttcatgaccctttccccaaatggagttgatcacgttccccttttacctttctccatagctgtacatgtttactgaattatcactacgtaaggcaatcacttgctcatatgtttctctctcctcctatacctagtttcatgaatacttgaatgctatctttaaatgttgtaaccttgtaaaacagtacaacaaattaatgttagatgtatgacaaaatgaatgaacaatatatgaagtgaagactattattacatgatgaaatgcttaactattacaatctggctaagatcatccttttctttaatatccagataaaatgtctcaagccctcatcatacatgctttccaggattttcaaagattcccaggagctttacactctcaggacacctctcatggaattctcactcactgtcttctatacttgccatgcttttcatatatgctcacgctatatgtctccaccacacctcctctactattctccatacttgactaaaaaaaatccataacatttgtactaaatattagcgataacagagaaatacacaacaacacagaatatgaaactaataatatttcatgtcagatatccatgttcagcctattactttattatgcagagcaattagctatcactttccatccaagactagagtctaagtatacctttgcataacttaagaggctcattaaattacactgtaaatacagtgggccctacatattcacagattccaaatccacagactgaaccaactgcagatcagaaacattggaaaaaaattaaaaataaaaaataacaatacaacaattaaaaataatgcaaattttaaaaatgatatattataacaactatttacatagcatttacattttataggtataataagtaatctagagatgatttaagctctatatgggaggatgtgtataggctatgtgaaattaaataattcaaatttaaatctattggaactttatattattctgagccttgacaggaatgtagctatgtagcccgagtcacatggcatatgcagctgcaacttctgactttttttcctgtaaatattaataattaggaaggccacatgacaacagagataagattcccttagatctttacccctcctcattgagtaataaagtaaacttccttggaatatagcaatctgtaaccaaacaaatcattgtaattggtcttatatggaaaatgctttaactctgccaaaacttctctggctttgtctatatacttcaggtatatgcaaatactatgccattttatataaaggacttgagcatccatgattttggtatccatggagggtcctgaataccagaatgtgactgtattttgagataaggcctttaaaaaggtaattacattaaaatgaggccatcagggtggaccctaatccaatacgaccgctgtccttataagaagagaaaatttgaacacacagagtcaccaggaatgtgtgtacacagaggaaaaaccatgtgaggatacagctaaaaggtgactgtgtgcaagctaaggctttggaagaaaccaaacttgttgactcctttatcttagactcctagcctccagaactgtgaagataaaaatttctgctgtttaagccacccagtctgagttcttttattatggccatctagcatactaatacacctcccctaaaaaaaggcaaaagactttaacagatacttcactaaaaaaagatctatggaaagcaaataagcacatgaaaagattattaacatagtcattagggaagtacaaattaaaaccacaatgagataccactaaattcttgtaagagtagctaaaattaaaaacattttttaaaagtcttactacaaaatgcctgtgaggatacagagcaactgaaactcttattcattgctgctgggaatgcaaaaaggtacagccactctgaaaaacattctggcaatttcttataaagttaattatatgctaccatatgacctagaaatcctactcctggatatttatccaagtaaaatgaaaacttacattcatgtaaaaatcagagcatgattatttatggcagcttttttcatcataatcaaaaattgcaaacaactcaaatatccttcagctaatgaatagaaaagcaaattgtgacacagccatatattaaactattcagccataaaaataaataaactactgatacaaacaactggatgaatcctaaacgcattatgctaagtgaaagaagccacacacaaacagccacattattacatgattccatttatgtaacattctgaaaaaagacaaaactacaaggatagcagacaaagcaatcattgccagatatcaggaagaggagttaaccacaagggacagaagtgaattttgtgggtggtagaactgttccatatttttattgtggtggtagatacacaactgtatgcattttcaaaactcatagacctgtataaaacaaacagttaattttgctgtatgcaaattatacctcaaaaaaatctgtcataaaaaaattcctacctatggcttcctccttcaaaaaacacagcatacctaggaagaaggtagggaagatgatgggtttaaaataccaaattaccaaagactatatccctatagtacttcagtgaatataaataatttaaattaaaaagcatggatatatagaggtatttaatttttaagattccagtcaaaaacaacaaaaaacgttaacttccaatattagaaatagtcacttatctgaaactcttaatttcaaagatttctgtaattttgattattcattatcatgactttatattcattatcatgagttactgaatggtgaaagttcaataaatacagatgaaagcaatgaataaaagcttccattggattttcaaagatcagaagaagtttggatttaatctgaatggaggtaagaaatcactatcgtttctttagaatgagggaacatgacaaaatattatgttaggaaaattagtctagtaatcatatatgagattgagttgaaggaaaatattaaagcaaagatatagaagatagctgcagtgatgaagagggccggggccaggatgatagccagaggattgtaatcattatattcaaaatgtgtatcttttccatatttaactgaatacccagaaatgatgtcacatttgctacacaaagttcatttgaaattgaggctcaggtggcaacttggcctataaaatttaaacccgcgagtgcacttgctcacccagactgcagcctgagtcgtccccacccacccttcctatgcagaaaccgtggtacagcgcagaaaccgtggtactgctccatgcccaggcagatctccaggcactaaagcacctgctcacctggattgacagcctgagccatcccattagtcctgtgcaaaaatccagccatcagggggcactctctgctggttcagcagccagagacacccactgttcttatgcagagagagtggtgcagtgggtccctctccaccccactcccagacagatctccaggcagtcggagcacccactcctccagcctgagctaccccacccttcctgcacaaagatcatggtgcagcaaggccctttccaatccatacccaggcatatctccaggcattgaagcacttgcttgcctggaacagcagcctgagctgccccacccttcctgcaaagagatcgtagtgcatctgagccttctttgcaccatgccgattaaacttcagatctccaggtgtttggagaacccactcacccagatcaacagcctgagccaccctacacttcctgtgcatagatcgtggtatagtggggccctatgtactccatacccctgcatatctccaggcattcaaagcacttgctcacacagagttacagcctgagccaccccaccctcctgtgcagagtttcaggtacaggggagcgcctctccactccaccctcaagcagatctccaggcattcagagtacctgctcacctactcagcatcctgagccgcctcagccttgctgtgcagagattatgatgaagtagggccctctctgtcccatgcccagcgatacctccaggcagtcagagcacctgttaatctgatttaacagcctgagctgcccaacccttcctgtgcagagactgtgtggtgcagcagggccctttacactccacacccaggcagatctcaaggaatctagaacactcactttcctggactaagagtttaggctgctccctctctccctgtgcagacaacttggatccaaggaggtttccatctcaacacctaggcacacctctcggtggatgctcactacattctccctcagtccagatgtttgtacctgccatcaggaaacctgtaggtgggcctaccccgtatggccccacccatcttgctcccaccccacccccgggggcaaagcagggagctcagaccactgtgcactccatgaattagcccactgcctgaagcaacagagagcttctcccagtaaacaatgatcaaatatatacccagctgcactgaccatagccagcttgtaggtcaaactgcacagcccaatataaaacctgcatagcccaatacaaaacctgccagtaaagtgcagccctatagtgcgtagggctataacagaaaagccaaaagactacccatcattgtctacagtcacacttcctaagaagcggggaaagggaaagggagagaaaacaatattacaaggaaagaaagcaaagaaaatatcctccctgcaagaaaataattacaaaaattagaagtaccagtgactacagatgagaaggaaccagctaaagaattctggcacctgaaaaacctggatgaagcaacaccactaaaagatcacactagctctccagcaatgatacctaaccaaaatggaaacatagaagttacagataaaaaattcaaagcacgaactgcaaataagctcaatgagatggaagacaaagttgaaaatcaacacaaagaaactgctaaagcaatgcaggacatgaggaaagagataaacatcttaaaaataaatcagtcagagcttctggaattgaaaacttgcttaagaaatttcaaaatacagttgaaagctttatcaattgccaagatcaacatgaagaaagaatttcagagcttgaagataggtctttttgaattaactcaatcagacaaaaataagaaaaaactatttttaaaaatgaacaaagtcattgagaattagggaattatgtaaagtgaccaaaaccatgaattatcaaaatttctgtgagaggagaaaaagtaaacaacctggaaagcatatttgagagaatacttcaagaatatttgcctaatcatgctagagagctagacatctctagcaagatgtatagtccggtgactactcaaggtcaatgttataaaaaaaatcttaagggcagctgggaaaaaacatcagatcacataaaggggaatcccatcaggctaacagcagacttctcagcagaaaatttgtaagccaggagagattgggagctcattttcagcattctaaaaagaaatttcaaccaagaatttcatatcccactaaattaatcttcataagtgaaagaaaaaataaaatcttgtccagacaagcaagcactaagggaattcattaccactagaggagcctaacaagagatccttaagggagtcttaaacatggaaatgaaagaacaataactgctaccacaaaaacatacttaaataaatagctcacagaacccataaagcaatcacacaatagaaactacaaaacagccaggtaacaactttgataggatcaaaacctcatatatcaatattaaccttgaatgtaaacagtctaaacacccccacttaaaaggcacaaattggcaagttgaattaaaaaaaaaaaaacaagacctatcgctcacacacacataatgacacccataggctaccaagtaatgagttgggaaaagatctatcatgtaaacagaaaacaaaaaaacggcgggagttggtattcttttatcagataaaaccaactacagtaaaagaagacaaagaaggttattacacaacgataaaaggtttgattcaacaagacttaaatatcctaaatatatacagactcaacagtagagcacctagatttatagaacaagtacttctagacctaccaaaagacttagccacataataatagtgagggacttcaacatcgcactgacaaaattaggcagatcactgaggcaccaactaagaaattctggacttgagattgacacttgaccaattggatttaatatacatctacagaatattccactcaacagccagagaatatataatacattcttttcacctgtacatggaacatactctgagattgaccacatgctcagcaataaatcaagtctcaataagttcaaaaaaatgaaaatcataccaaccatactctcagggcacagtggaataaaaatagaaattaataccaaggagacctctcaaaaccacacaagtatattaaaattaaacaacttgcttctaaatgacttttgggtaaacaacaaaattaaggcagaagtaaaaaaattatttaataaaaacagagacacaacatccaaaattttggggatgcagcaaaagcaatgttaatttataatactaaatgcctacatcaggaatttagagagatcttaaattaaccatctaacatgacacctagaggaactggaaaaacaggaacaaactaaccccaaagctagctgaatgaaagaaataaccaaaatcaaagcagaactaaatgaaattgaaaccccaaaatacatacaaaggatcagtgaaaccaaaagttggttttttgcaaggatagacaagatcaatagaccactagctagattaacaaagaaaaaaagaaagaagatccaaataagtgcaatccaaaatgacaaagatgacattactaccaatcccacagaaatacaaaagatcctcagagactattatgaacacctcaatgcacataaactagaaaatctaaaggaaatggataaatttctggaaacaacctaccaagattgaatcgggaagagattgaaaccctggacagaccaataacaagttccaaaattgaaccagtaatacaaagcccaccaaccaaaaaaaaaagccctggaccagaagaatttacagtcaaaattccaccagatgtacaaagaagagtttatagcaatcctactgaaactattctaaaaaactgaggagaagggataggactcctttctaactcatgctacaaaagtagcatcagcctgacaccaaaacctggcaaagacacaaaaagataagaaaactacaggccaatatccctgatgaacacagatgtaaaaatccgcaacacaattgctaggaacaggcctcaagcctggccataaacaggccatgagaaacaagccataaacaaaatctctgcagccctgtgactgcagagatttcttgctgctatgatggcttgatggctatgatgcccatgctggaagttgccggtttaccagaatgaggacaaggaacacctggcccacccagggcagaaaactgctcaaggcgttcctaaaccacaaacaatagcatgagcaatctgtgccttaagaacatgttcctgctgcagataacaagccagagcctgtccctttgtttcctgtaaggaatgcttttagctaatctataacctatagaaacaatgcttatcactggcttattgtcagtaaataggtgggtcaaactctgtttgaggctctcagctctgaaggctgttagctccctgattcccactttgtactctatttctgtgtctttgtcttaattcctctaacgccgctgggttggggtctccatgaccaagctggtcttggcaacgatactagcaaactgaatccagtagcacatcaaaaagttaattcaccataatcatgtaagctttattctagggacgcaacgttggttcaacatacacaaaaaaataaaactaggcctagtttgttaggagttttttatcatgaagcagtgttagattttattaaaaggtttttctgtgtccatcaagatgatcatatggttttggttttaattctttttatgtggtgaatcacattttttttgtacatgttgaaggaagagacctcaaaataataagaaccatctatgataaacccatagccaacatcatactgaatgagcaaaagctggaagcactcccctggagagctgaaacaagacaaagatgcccactctcactactcatcttcagcatagtactggaagttctagctgcaacaatgaggcaagagaaagaaataaaatgcatccacataggaaaaaaagaattcaaatgatctctcttcactgacaatatgattctgtatctagaaaaccctaaagactctatctaaaggctcctgaaacagataaacaacttcagtaaagtgtcaggatacaaaatcaaagtacaaaaatcagtagcagttctatataccaataatgttcaagctgagagtcaaatcaagaatgcaatcacatttacaactgccccaccccaccaaaagaaaagcaaaaaacataggtatacatctaaccaaggaggtgaaagaaagatctctacaaggagaactacaaaacactgctcattgtagattctggatattagccctttgtcagatgagtaggttgtgaaaattttctcccattttgtaggttgcctgttcactctgatggtagtttttttgctgtgcagaagctctttagtttacttagatcccatttgtcaattttggcttttgttgtcattgcttttggtgttttagacatgaagtccttgcccatgcctatgtcctgaatggtaatgcctaggttttcttctagggtttttatggttttaggtctaatgtttaagtctttaatccatcgtgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtagatatacggctttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcggcctcttttttggttccatatgaactttaaagtagttttttccaattctgtgaagaaagtcattggtagcttgatggggatggcattgaatctataaattaccttgggcagtgtggccattttcacgatattgattcttcctacccatgagcatggaatgttcttccatttgtttgtatcctcttttatttcattgagcagtggtttgtagttctccttgaagaggtccttcacgtcccttgtaaggtggattcctaggtattttattctctttgaagcaattgtgaatgggagttcactcatgatttggctctctgtttgtctgttattggtgtataagaatgcttgcgatttttgtacattgattttgtatcctgagattttgctgaagttgcttatcagcttaaggatattttgggctgagacaatggggtttctacatatacaatcatgtcatctgcaaacagggacaatttgacttcctcttttcctaattgaataccctttatttccttctcctgcctgattgccctggccagaatttccaacactatattgaatagaagtggtgagagagggcatccctgtcttgtgccagttttcaaagggaatgcttccagtttttgcccattcagtatggtattggctgtgggtttgtcatagatagctcttactattttgagatacgtcccatcaataaacaaccccatcaaaaagtgggcgaaggatatgaacagacacttctcaaaagaagacatttatgtagccaaaaaacacacgaaaaaatgctcaccatcactggccatcagagaaatgcaaatcaaaaccacaatgagataccatctcacaccagttagaatggcaatcattaaaaggtcaggacacaacaggtgctggagaggatgtggagaaataggaacacttttacactgttggtgggactgtaaactagttcaaccactgtggaagtcagtgtggagattcctcagggatctagaactagaaataccatttgacccagccatcccattactgggtatatacccaaaggattataaatcatgctgctataaagacacatgcacacatatgtttattgcggcactcttcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatgttctcactcataggtgggaattgaacccatggacacaggaaggggaacatcacactctggggactgttgtggggtggcgggaggggggaggaatagcattaggagatatacctaatgctaaatgacgagttaatgggtgcagcacaccagcatggcacatgtatacatatgtaactaacctgcacattgtgcacatgtaccctaaaacttaaagtataataataaaaaaataaaaattaaaaaaaaaaacaaaaaaaaaacaaaacactgctcaaagaaatcagagacaacacaaacaaatgggaaaacattccatgctcatggataggaagaaatcaatattattgaaatggccatactgcccaaagcaatctacagattcaacaatattcctatcaaactgccaatgacatttttcacaggattagaaaaagagtattctaaagttcaaatggaaccaaaaaaagaatttgaataggcaaaacaatcctaagcaaatagaataaagccagaggcatcacattacccaacttcaaactatactctaaggctacagtaaccaaaagggcatggtatttgtacaaaaacagtcacatagaccaatgtaacagaatagagagcccagaatcaaagctacacacctacatccatttgacaaagtttacaaaaacaagcaatggggaaaggactccctattcaataaatagtgctgggacagctgactagtcatatgcagaagaatgaaaccagacacttatctttaaccacatataaaaattaactcaaaatggattaaatatttaaatgtaagacctcaaactataggatttcctaggaaacaccattctggacattgactttgggaaataatttatcactaaatcctcaaaaccatttaccaaaaaaaaagtgagaagtgggatctaattaaacagaagagcttctgcaaaggaaattatcaacagagcagacagacaatctacagaatgggagaaaatattcacaagctaggcatctgacaaaggtctaatagctagaatttataagaaacttaaacaattagataagcaaaaaccaaataaccccattaaaaagtgagcaaaggacatgaacagacacttctcaaaagaagacatacaggtggccaacaaacatatgaaacaatgctccacatcactattcatcagataatgcaaaataaaaccacaatgggacaccacctcacagaatggctattatgaaaaatgaatggctattatgaaaaagtcaaaaaaacaacagatgctggcaaggctatggagaaaaaggggatgcttatatattgttggtaggaatgtaaattagttcaacccctgtggaaaggagtttggagatttctgaaagaacttaaaacaggactatcatctggcccagcaatcccactactgagtatataaccaaaagaaaataaatcattctaccaaaaagacacatgcactcatatgttcatcacagcaccattcacaatagcaaagacatggaatcaacatagatgcccatcagtggtggactggataaagaagacacagtacatatagaccatggaatactatgcagccataaaaaagattgaagttgtgtcctctgcagcaacatggatgcagctggaggccattatcttatgcaagttaacacagaaacagaaaaccaaataccacacgttctcatttataagtgggagctaaacattggatactcatgggcataaggatagcaacaagctttcttggggactagtagaggtggggacattgggaactactagaggttagaggaagaagaggagtaatagctgaaaaactacctattgtgtactatgcccactacctgggtcacaggatgaatcttagcccaaaccttagcagcttgcaatataaccatgtacatgtacaaacctgcacatgtaccccttgattctaaaattaaaattaaaacagaaagaaagataaaaacctccctagtgactatgctgacccatttaaggtcacagcaagagcagcagtacccaagttaggtggtgataacacagtggaagttagacccagtgatgatagaaattaaacccaattttactttctcatccttggctttttgttttctactagtaacaagtgttaatctcccctttgaacaggagtatgtggcttcactgcagcactttcagtcagagacagaggctaacggcatacctagccaaagcacaagaaacctaaaaggcctcagctttggtctgattccactcagaaaagctttccttcaaataagtcaactagacgtctcttccttttaaagccaacagtgatcatctgataggaaacacttctttgttggttttcttttgtttcagtgaaattcatattttccctacagggatataaataatgccgtatcttctgctatttaaaaattcctaattagaagccttttatgttataaagctgctaaaaagcaacccaaacctaagggaattttaaaagataagttattggtgacatagatgttacaacttaagctatgaagtcaaaagtgttgattgatgaggcacagaaggagtcttgttcacactcattcacctgtttcatttttgagactgtccatgccctgggaacaagaatctactttagccagaaatacataggcgtgctggatgaagttgaagtttgcctccagaattaaggtctttttgtatatgtcacctcatatctgataaacagaccacttatctggattctgatcttcaccatcttcttttactatatgggttcatgaccctccacccttcacctagtactcaattccaatagatcttctagttcttgatagtctagatatttaaccactacttttgcttcactgtgtcttcctaattcctgtatttttgcttcatttcttacctgtgactttcacatctagtatttgtatctacattcaatttctgcttccctaccatactttggtaggtccccaagtttaacctctatgtgcctcagttttctcattcatagaatgagaaaaacagtaagattattgtaaaagtatttcaaggattacaggaaataataagtaaagtgattagcataacctgagatagagaaagtgccaaataactgctagctgcactcaagcatatttatgcctgaataagagctttgtcctctgattttgttctacatttgtggaaatagataatagccatttgctaccttaagagaaattcctttgttttatatatgaagaattattctcttcttacctttctcttctaagggttaagtaaattcattttctttctaatgaatcatgttttctcacactttagtcattttactactttcttccaaggtctccaatcttattttagttgtagaaaaaaatacaaatctccagtaatattgataccaatccaaaaagtatttaactaaacctatcatcccaaatgattacctggcacccccagccatgatgaggccccatcagtgtcccaggcaatgctccccattctgcccaatgcttcagaggaaccaagatgctactgactgcactaagcaccaaagagccactccagcacttggatccaggaagaaatagcaacaccaaaaaagcctgcgaaagtgtcagttttctgtgcatagttcagttaacagctagataacaccaatcatccaaggcataactgttataggttttgacagtaagacatcccccttggcaaaaaatgtctcctccactggctgccaaggctcctgatcatcctaggatcacctcctgtgtgttgattaagcttttgctggctgagacgcagctggcctttacagcaggaaacccacggaagagtgtgtacgtgtgtgtcctctctcaacttctggctgagtcactcaaatcaaatagtcactgaaacataaagggggttccctacacctaattttggtggtaggggaaaaaatgtaaaatcatctggggcaatcaaggactattttcaggaacatttgtctttaaaatctaaaattaagccacctcacaacctgggtggttccccatggaggaaaagaggatgagctctgaaaagctagagttgtaacctgtatccttgggaacacggctataggcagtgtgaagagctgtacatataactgataaagggtccagcaggttgtcccattcctgcaggaagagcagagccccaaatcccatttcaacctgctttagcactcacacacctcaccaagacagtggtgactgccagcttctctcttgaccttcctcacccctaggtaccacaggatgtctaatgggaaggcacaagagcataaaacttgttgctctcagagttctatggatgaggaaactctgaaatatgaggacagatgtgagagaatctctagaaaccttaagcttaggacagaaggaggagagcatcccgctcacactgtctaacaatttaatagggattcatgcatctaagtatgtttgtgagggaggtagatgttaagaaatcatacatacagaacctcgttgagtttcgaaattggaggttcttgggcaacaagggacagcatggggtaacagactgtttggggaggagaggaagggaaagacaggaaatgaaaaattaagcacctggctagaacagtacagggatacaaggatggtatttgggaaatataccaaaataattaacttttgaaagcaagaaatgaagacattgaaaggaaataaatggctctccaagaaccagaaagacaagtatgaaatgggcaagactctatgggtcagagatcccttgcatcagctgatttctttcttctttttgagacggagttttgctcttgttgcccaggctggagtgtagtggcgcaatcttggctcactgcaacctcggcctcccaggttcaagtgattttcctgcctcagccccctgagtagctggaattacaggcacatgccaccaagctcagctaattttttgtatttttagtagagatggggtttcatcatgttggccaggctgttctcaaactcctgacctcaggtaatccacccacctcggcctcccaaagtgcagggattacaggtgtgagccaaagtgcccggcctcttttttttttttttttgagacaaagtcccttctgtcacctaggctggagtgcaatggcacgatctcagctcactgcaacctccggctcccaggctcaagcaattctcctgtctcagcctcctgagtagctgggactacaggcgcatgccaccgtgtccagctaatttttgtatttttagtagagacagggttttgccatgttacccaggctggtcatcgcatctggctaattcttgtatttttagtagagatgtggtttcgccatgttgcccaggctggtctcgaactcctgagctcaggtgattcgccagcctcagcctcccaaagtactgggattataggcatgagccaccacgcccagatggatcagctgatttttttatagtacttgattatttttccctaacatgtatcagtacagctagtatcacataggtaaaaaaccaaactaaattcctttttatagaacaattatttctatatccctgttaatgtatcttttacagatttccctgggagtcttttctttatgtacctaagatttaaatttcacttgcagtagtaaattatttaaactcaattcaaaatgaaatgtgttttcatttaattatcggaaatgcatttcataatgccaagtgctggttaaaagtaagtaatttcccccattcctcacccaagccacctctgcaccaccacccacaaaaacaaattagtctttttggttgagaaaaatgaatcattacttctcaacctaagttgcaacttgtcatttttcatttgagcatgtattcactagaagcaggtgctctttgctcttttgacagtaaccaaacatttaagcgtggaaagagaccaagaaaagcaccttggcccaccttctcaggggcttagataagtatctggaaaaaaatcaatatcatggaaatgaagtgccaaattgttttaaaactgcttagctctcactattgctcctaggactgaatgcaacaaaaccaattagcaggcattcactgaggcaggaaatagagtggaaagaaagggtagaaatggagaaaatgaggaaataaaaatatattaaatttatatatacttaagtatatttataatacatgattttatatatatatatatatacacacattaggtgtgtgtatatacatatattcattcattcatttaaattttggacatgttgagcttgaaaagcccattaagtaactagataaagttgctttgggttccacatttaagtgagatcatgtaatatttgtctttttgtatctaggtcatttcattcctcttgaaaagaaaactcatcacaggtatctttaacacaaagcaccaatcttaatgtaattttattctcatgtattttcccactggtcataaattttgaaggccctaatttgctttccattgcccatgttctaatctgaattcatccaagagtgaaactgatgcgaaatctcatcttctatttctcttaatgttaagcactttgtttcttaaattgatgctgtagacaatttatgtagccaaacagaaatgtcacaacaattttgggaaacatctcaagttatttgtttcaaagaaagaaaataaattattttaccaagagataagtgaaaacattgtttttcaatccctttaaacatttatgatcgaattctggatagccaaggtgatggcagctgcttaagtctgaatctcccagcacatactccaaaaataaaaataaaaaataaataaaactacagaaaacctatgctgtcagcataactagaaaagagagaacaacctagatttcaaattacacgtgaataaaaaattaacaccaactcttagcatggaatttctcacccttctggtgcaagcctacctggggaacaagggcaagatggggccagagtggagggatggtgggagatgggggagaaccatactgaaaacagaagagagaacctagcaatgaaatttaaaattgatctaaaatcacagctataaagagaaattctactctcattgcaaaaataatggaaaaagagtcctggtagatcagagcctactagaaggaggaatgagtatgtggggctctaagaggtggtcttagaaaggccttgggagagagaagggtaacaaaggaatggagaagcactctggaaactacacagtgaacataagaagaaataagaaagggaaaatcagaatccagtaagacaaaagaatttttcttaattgaagaaagctactgaggaaataaactatcttttacaaccttaacagaagagttctaaccagggatcttgtaaaccatcccaaaccatcacagaattgctgaggcttaagcaacctacaagtattctaaaaagaaaaaaaaactaatatgacaggaaaacagaaataaaaattttaaaaactcagttgaaaatatcccctcaaaaaaaccaatagtgaatcaaaataaaatagtagcataatatcccaaagtgaatcaaacagcctcaaaagattatgaagactttcaccaaaattacagacagatatagatagaaataagaatatagatatacacaaaactgtgcaaccatagttcatttggcaaccatttattaaaacattaaaaatcaactttgtccctggcactgtcctagttgttggggaatagagaggaaacattctctatgacttcaaggagcttattacagtagaaggagaaacacatacagtatgacaagtgatgggataaaagtatacaggaaatcctttcgaaacaccataaagtagtatctacctccaaattaggagccatcacatatgcaactgaagtacaagtaagagccagatcagaaaattccaggaggaaaataatcatgcagctgtaacagtatatgcaaaggcatgaagtcagaagaaatgtgatgtattcaaagaacggaaaatactctgatatggctgaaaacaaagctctgggaaaataaagggtcacagttgctttatacaatttagatttcattctaaaggcaacagagaaccagaaccattgaaggatttttacttgaggatatgttcagattttcattttaaaataatccttccagtaataatatttaggctgaattagaaaggggtgaatttgaatgcaagataaccagttagcaggcattcaccaacaaggaatataagtggaaaaaaagtataggaatggaggaaagaaaagataatatattaaatgtatataaaaatgtatttacaatatatgatatataatacgtttaaattttggacatcttgagcttgaacacctcattaagtaactggataaaatcttgaattgaagagaaatatatggggtagaaataaagatatgggaatcatccaattgttagattaaaggcagttattgactccgtgggtgtatatgattttactctatagagtatacagagggtgtaggggaaagaaagaaaaatgagaaggagagaaaaggaagagcaagttatgttctgggcaatatcaacatttactctgacaggaactgggaagagtccagacatgtaggagaaaaattgggagaaaaaaaaagaaaattaagatttacaggaaaaaagaacagttgaagttaaaaggtctgaaaaatgtcagttggataagtgatcataataacagtgtttgtgcaagtgaaaggcagaaatagattactgagaagtgaaaagtcaagttaataaaaaatagtatatacaaacctctccttagaaatgtttgacttctgactcacttgtatacttaacctttcatatcattcatttctccaacaagtgtttattgagtgccacttaatatcaagagagacaatgtgcttatgtcccaatggagaagccaggcaataaacaacttaaagatcaaatgtgcaagataatttcctacagtgataactgctatgaagaggcgaaagtctacattagattaatcagagaaatccactgtaaggaagtgatacttaagctgaaccctgaatgataagaaggaattgtcctgtgagctctaggggaaaatcattccacgaagagggaacagcaagtactaaggacagattagcaagcacataattaaaacatccacagtaataactatactgatacttacatccacccaacaactgctaataaaaccatgccttcactgagtctgctggcagggctgttgagctggtcacaaggaggcaaataagctggctcatattgaaataagagaggaaggaatcatagaaaaagaaaagaccatggaaacctcccctcctctacaattaacaattttaaactgttgggagtatttcatgttcattgaatgaacaaaaatgttaataatagattgccctaaatcttgaattttagctgcattttgaagatccttgaagcaataaaaatgcctgtgctttttaaaggtagttttgttttgtttttttaaaaggcgggggttgcctttcaggccagatttctttgatttcctgtttcagaagcttcacctagctcaacgtgggggaaaaaaaaaaaaaagctcgcaaaaggaatatttgtacagcatagcttttatgttaagagtttgattttaggccggacacggcggctcacccctgtaatcccagcacttgggaggccgaggcgggtggatcatgaggtcagggaatcgagaccatcctggctaacatggtgaaaccccgtctctactaaaaaatacaaaaaattagctgggcgtggtggcacgcacctgtagtcccagctactcgggaggctgaggcaggggaatggcgtgaacccgggaggcggagcttgcagtgagcagagatcgcaccactgcactccaggctgggtgacagagcgagactctgtctcaaaaaaaaaaaaaaaagtttgattttatatgcttaacatgtattttttaaggtatatattaacatttctttttaattattttcatgattaactggaatttttgtggcatctgatacttaatggaaatagaacaccagttaacaaaactagctccaggaaacattcgactccctcgcttctgtccaaaaatggatgtagttagtaagcaggtcagcgcacctaaaatctttcagaaacttagcatgaggaaaagaagaaagacaggactgtcgctggatggggtattgctttgaaagaaggttaccattgctgctgctgttgttgccagcatcgtcatgtcgtttggatcaaactttaacaggttaatatgctgaaaaggaaaaatgagtagaaaaaaatgaaaagttgacagtaaaggcaaaatacaacttcctataaaggaaggtcctcaggggacagaagaaaatgggattcagaatacaggattattctgggcacaagagaaaactaagtttaaggatagcatactttttgtgactctgggatctcaaaatagatgctgaaacccagctatccaaaccagatgaaatgcttcatacaatcactatggattccactgaagaagaaaactgagggtttttttaattgctttataatttgaaagttgctgataattagagctatttaactcagcacaacattcttctaaatggcatcattgtgtcactgtactattttggttaaactcccactggtttaatttcagaaacatcctttgaataaaatgccaagttaaaaagaagtaatatctcattatttctttaaaataattcaattaatttcaaaaggatgtttcctgggaaagacttgtaaggtttcttttgtaggcctgaccataacacaagagtacattatagaaaatagcagcagctacctaccagtcagtttttaagagcacctttctttacacaataaatatgttcctgaggagctttttaaattttgaatgtgtattgtggaggctatttggacctgcaaaaacctgatgctgccatttactatttgtgtgttctagaacaagctactaaataggttaccctctcgaaattttctagggattaaatattttccattctatttggcctaattgggctgcctcagaaagacagactaacccatcaagaattaagaattacttcttgaactgagaattacttcttctatgaaatgtaatattaacacctgttgtggggcacccacctgttgtcaaacttcaaagatggataaagcacaggatagtttgattccttcactggctcagggcaccaaagagttgtgttgccagatttagcaaataaaacattcccagttaaatttcactttcaaaaagaataaatatttttattagcataagtgtgccccatgcaatatttgagacataattctactagaaaattattcatcattgatatgaaattcaaatttaactgggcattctgtattattttatctggcaaccctaaccaaagcaacagcttgtctcccacctggctatggcagaagtggaatacaaaagtcaaagtacatgataaagtgctgtacccacacacaccgccatctaaacctctgtatacttccaaaattacaatgtttcctgactgaggcctgcttcccctgctctcctccatgtgatcaagctccctgacaccctctctccactgacttctacccacactctggacctaagacaaaatttctgatgcccctacacactatcccagaactaaaaagactccaaggttacaacatggcagaaacattctctccgtttccctaagactcctagaagcattttttagagtcataggtccatacagggcctgagattcactggccatctcagatctcccaaatttcattgcagtaaattctatcatgtctcctaccctggaggaatgggcgggtagtggcagacagtagtggtagaccagcacaaaaacaaaccatgtctaagtttattctattcctatccaactctcctcttctccccaagttggagggtatttgctcaggaggcacagaagaggtgacatggaagaggcagtataacaacttggttatgcctattgtctctcattccaaaatatcaagaatttgccattttttattacttaggcctgatttgaaacttacatcctgtgtgagtggcccaataggggagaaaattgatattcccattatatgggaattataaggggaaaataatattcccattatatgattattgtaagaattaagtaaatcaaagacctaacctgtatagtaggcacttccacagcttcagagatggaaaatctgtattactaaataatgtccagtaggcactatctcctaacattccaacctctctgtcaataattcataaatgaatattcacatgctctaaaagttcctgttattatgtgaataatcatcacatattttctgtgaaagtgaaatgctgtgtagtatatttcttatatcgagcaccctagtagaaagtatttacataatgcgggaagagtctaccttctttccataaattgactttctttataattgtattattttttacaacccttctaaaacaaaatgatatccatgcataaagaacacagctttcatcttgcggtgtgacagactcctatgtgcctttttatttttaatagactggcctcacacactggtgggggttgtattcatgaatatatggcttatgtttacggttaggagaaagataggtttaaaaataataataaaggactttctgcctttactgaagccacgttcccagcctttcataatttactacactatctcattattttttaatgcacttgcctttttaaaaaaaatccaaaccttccaaattgttgcatgataatttttcttccttttcaacaggaggttctcacccctctgttgtctactccagcactggcccaagagaacctcttgtacaacccagttttaaagaatgattaagaaggatttcatataggtaactgaatatgaaattagttataattttgagagcatggttatctcatatgaataaaattttaattgcttataacattaaataatgaaataaatttgtagcgctgtcctaattccatcaattttggaatacagttcaaaatgagatgtagcaagtaagaaatacaaattgtatttctcattaataatcataagccatatataatatctgttgtctataattccaatgataaacacttactgttttcagagaagttctaggtaatacacactcaaccttctataagctatcttaacttttttatttttctggcataaactatgtgtctatctttttttaaaaaaattacactttaagttctgggatatatgtgcagaaagtgcaggtttgttaaataggtatacacgtgccatggtggtttgctgcacccttcaacccgtcatctacattaggtatttctcctaatgctatccctcccctaggcccccacccactgacaggccctggtgtgtgatgttcccctccctgtgcccatgtattctcattgttcaattcctacttaggagtgacaacatgcagtgtttggttttctatccctgtaatagtttgctgagaataatggtttccagcttcatccatgtccctccaaaggacgtgaactcatccttttttatggctgcatagtgttccatggtatatatgtgccacattttctttatccagtctatcattgataggcatttgggttaattaccagtctttgctattgtgaacagtgctcccataaacatatgtgtgcatgtgtctttatagtagaatgatttataatcctttgggtatatacctagtaatgggattgctgggtccaatggtatttctggttctacatccttgaggaattgccacactgtcttccacaatggttgaactagtttacatacccatcaacagtgtaaaagccttcctatttctccacgtcctctccagcatctgttgtttcctaactttttaaagatagccattctaactggcgtgagatggtatctcattgtggttttgatttgcacttctctaatgaccactgatgatgagcttttttgaatgtgtttcttggccgcataaatgtcttcttttgagaaatatctgttcatatccttcacccacgttttgatggggttgtttgtttgtttcttgtaaatttgtttaagttccttatagattctggatgttggccctttgtcagatggataggttgcaaaaatcttctcccattcagtgggttgcctgttcactctgataatagtttcttttgctgtgcagaagctctttagttcaaattagatcccatttgtcaattttggcttttgttgccattgctttgggtgtttcagtcacaaagtccttgcccatgcctatgtcctgaatggtattgcctaggttttcttctagggtttctatggttttaggtctaacacttaagtctttaatccatcttgaattaatttttgtataaggtgtaaggaaggggtccagtttcagttttatgcatatggctagccagttttcccaacaccatttattaaatataaaatcttttccccattgcttgtttttgtcaggtttgtcaagatcagatggttgtagatgtgtggtgttatttctaaggcctctgttctgttccattggtctatatatctgttttggtaccagtaccatgctgttttggttactgcagccttgtagtatagtttgaagtcaggtagtgtggtgcttccagctttgttctttttgcttagaattgtcttggctatgcaagctcttttttggttctgtatgaaatttaaagtcgttttttctaattctgtgaggaaagtcagtggtagcttgatggggatggcattgaatctataaattactttgggcataatggccattttcatgatattgatttctcctatccaagagcacgaaatgtttttccatttgtttgtgtcctctcttatttccttgagcagtggtttgtagctctccttgaagaggtccttcacatcccttgtaagttttattcctaggtattttattcactttgtagaaattgtgaatgggagttcactcatgatttgggtctctgtttgcctattattggcatataggaatgcttgtgatttttgcgcattgattttgtatcctgagactttgctgaagttgcttatcagcttaaggagattttgacctgagacaatggggttttctaaatatacaatcatgtcatctgcaaacagagacaatttgacttcctctcttcctatttgaatatgctttatttctttctcttgcctgattgccctggccagaacttccaatactctgttgaataggagtggtgagagagggcatccttgtcttgtgccagttttcaaagggaatgcttccggtttttgtccattcagtgtgatgttggctgtgggtttgtcataaatagctcttactattttgagatacgttccatcaatacctagtttattgagagttattagcatgaagcggtgttgaattttgttgaaggccttttctgcatctattgagatattcatgggttttgtcgttggttctgtttaggtgatgaattacgtttattgatttgcatatgttgaaccagccttgcatcccaggtatgaagccgacttgatcatggtggataagctttttgatgtgctgctggattcggtttgccagtcttttattgaggatttttgcattgatattcatcagggatattggccccaaattttcttttttgttgtgtctctgccaggttttggtatcaggatgatgttggcctcataaaatgagttagggaggagtccctcattttctattgtttggaatagtttcagaaggaatggtaccacctcctctttggacctctggtagaattcagctgtgaatccgtctggtcctgggctttttttggttggtaggctattaattactgtctcaatttcagaacttgttattggtgtattcagggattcgacttcttcctggtttagtcttgggagggcgtatgtgttgaggaatttatccatttcttcgagattttctagtttatttgtgtagaggggtttatagtattctctgatggtagtttgtatttctgtgggatcggtggtgatatccctttatcattttttattgtgtctatttgattcttctctcttttcttctttattagtctggctagaagtctatctattttgttaatcttttcaaaaaaccaactcctggattcattgatttttggaagggtttttcatatctctatctccttcagttccgctctgatcttagttatttcttgtcttctgctagcttttgagtttgtttgctcttgcttctctagttcttttaattgtgacgttagggtgtcaattttagatctttcccactttctcctgtgggcatttagtgctataaatttccctgtacacaccactttagctgtgtcccagggattcttgtatgttgtgtctttgttctcattggtttcaaagaatttatttatttctgccttactttggttatttacccagtagtcattcaggagcaggtttttcagtttcctcgtagttgtgcagttgagtgaatctcttaaacctgagttctaatttgattgcactatagtctgagagactgtttgttaagatttctgttctcttgcatttgctaaggagtgttttacttccaattatgtggtcaattttagaataagtgtgatgtgatgctgagaagaatgtacattctgttgatttcgggtggagagttctgtagatgtctattaggtctgtttgttccagagctgagctcaagtcctgaacatccttgttaattttctgtcttgttgatctaatattgacagtggggtgttaaagtctcccactattattgtgtgggagtctaagtctctttgtagggctctaagaacttgttttatgaatctgggtgctcccgtattgggtgcatatatacttaggatacttagctcttcttgtcacgttgattgctttaccattatgtaatacctttatttgtctttttttatctttgttggtttaaagtcggttttatcagagactaggattgcaaaccctgcttttttttgctttccatttgcttggtaaatattcctccatccttgaggaatgtgtgcctctgcacgtgcgatgggtctcctgaatacagcacactatgtgtgcctctgcacgtgagatgggtctcctgaatacagcacactgatgggtcttgactctttatccaatttgccagtctgtgtcttttaattggggtatttagaccatttacacttaaggttaatattgttatgtgtcaatttgatcctgtcattatgatgctagctggttattttgcccattagttgatgcagtttcttcatagtgccgatggtctttacaatttggtatgtttttgcagtggctggtaccagtttttcctttccatattagtgcttccttcagaagctcttgtaaggcaggcctggtggtgacaaaatctctcagcattttttgtctctaaaggattttatttctccttcactgatgaagtttaatttggctggatatgaaattctgggttgaaaattcttttctttaataatgttgaatattggcccccactctcttctggcttgtagggtttctgcagagagatccactgttagtctgatgggcttccctttgcgggtaacccgacctttctctctgtctgcccttaacattttttccttcatttcaaccacgatgaatctgatgattatgtgtcttggggttgcttttctcgagaagtatctttgtggtgttctctgtatatcctgaatttgaatgttggcctgtcttgctaggttggggaagttctcctggttagtatcctgaagagtgttttccaacttggtttcattctccccatcactttcagatatatcagtcaaacgtaggtttggtcttttcacatagtcccatatttcttggaggctttgttcattccttttcattcttttttctctaatcttgtcttcatgctttatttcattaagttgatcttcaatctctgatatcttttcttccgcttgatcgattcagctattgatccttgtgtatgcttcaggaagttttcatgctgtgtttttcagctccatcaggtcatttatgttctcctctaaactggttattctagttagcaattcctctaaccttttttcaaggttcttagcttccttgcattgggttagagcatgctccttgcctcagaggagtttgttactctccaccttctgaagcctacttctgtcaatttgtcaaacttattctccgtccagttttgttcccttgctggtgaagagttgtgatcctttgaaggaaagaggcattctgagttctggaattttcagcctttttgtgctggttttttcctcatcttcatggatttatatacctttattggtctttgatgctggtgaccttcggatggggtttttgtgtggatgtcctttttgttgatgttgatgctattcctttctgtttgttagttttccttctaatggtcaggcccctctcctgcagtgcttctggtgtttgctgggggtccactccagaccctgtttgcctgggaatcaccagcggaggctgcagaacagcaaagactgctcctgttccttcctctggaagcttcatcccagaggggcacctgccagatgccagtcagagctcttctgtatgaggtgtctgtcaactcctgctgggaagtgtctcccagtcaggaggcatgggggtcagggacccactagaggaggcagtcttacccttagcagagctcgagcgctgtgctgggagagctgctgctctcttcagagctggcagatggaatgtttcagtctgctgaatctgtgcccacagccaccccttcccccaggtgctctgtcccagggagatgggtattttatctataagcccctgactggggctgctgcctttctttcagagatgcctgcccagagaggaggaatctagagaggcagtctggctacagcggctttgctgagctgtggtgggctccacccagttcaaaattcccacagctttgtttacattgtgaggggaaaactgcctactcaaacctcagtaatggcagacatccctccccacaccaagctcaagcatcccagtttgacttcagactgctgtgctggcagtgagaatttcaagacagtggatcttagcttgttgggctctgttggggtgggatccgctgagctacaccacttggctccctggcttcagccccctttccaggggagcaaacagttctgactcgctggcattccagttgtcactggggtatgaaacaaaattcctgcagctagctcagtgtctgcccaaacggcctcccagttttgtgcttgaaacccacggccttggtagcataggcactcaagggaatctcctggtctgcaagttgcaaagaccatgggaaaagcatagtgtctgggccggaatgcaccgttcctcacagcacagtccctcacggcttcccttggttagggaaggtagtttcccaatcccttgcacttcccgggtgaagcaatgccccaccctgctttggctcaccctctgtgggctgcactcactgtctaaccagtcccaatgagatgagccaggtacctcagttggaaatgcagaaattacccaccttctgcattgatcttgctgggagctgcagaccacagctgttcctattcggccctcttgcccctatatgtctatcttaactatttttttttattattctggtgtgtgatttctctctttcgtttaatggttttcacaataaataagccttaatgccagatatcttaaaaataatatttgtagtgtcattcacttaatctaaaaatactcacaattgttcttcagtgttgccaagtttttcagtctactataagagcttgatcttagagtgtgttcactgacctcatattacatatagaatgtatacaaaaaagacctttaaaatgtagggtgataacatctattccatatatgccaacattcttagatattctcaactttagtcttctctcaaattgatcccctactgacattaaaaaattactaactttttatagcagcactgtgcacagctcttatatcaagagtaagaaataaacttttccaaaaccgcttaaaaacagagtaacattcagccaggcgcggtggctcatgcctgtaatcccagcactttgggaggccaaggcgggcggatcacaaggtcaggagatcaagaccatcctggctaacatggtgaaaccccgtctctactaaaaatacaaaaaatcagctgggcatggtggtgggtgcctgtagtcccagctacttgggaggctgaggcaggagaatggtgtgaacccagaaggtggagcttgcagtgagccgagatcacgccactgcactccagcctgggcaacagagcaagactccgtctcaaaaaaaaaaaaacaggtcggtgccaaggctcatgcctgtaatcccagaacttgaggaggctgaggcgggtggatcacaaggtcaggaaatcgagaccatcctggctaacacggtgaaaccccatctctactaaaaatacaaaaaaattggccgggcgtgatggcaggcgcctgtagtcccagctactccggaggctaaggcaggagaatggcaagaaccactgcactgaaatcgcaccactgcactccagcctgggcaacagagtgagactccatctcaaaaaaaaaaaaaaaaaaaaaaaaacagagtaacattcattagaagaacatagaagaaagaaaaaaaaatagagtaacaaagatgtcaagacattctctatatccactaggccaggtgtttggagtagaagaaaaatgcatagtgactgatacaagttactcatgagcaccaaccacatgttcacaagtggtaccttacttatcacacattggttaataccaagtctaacttaagattccttccctggataaacatccgatcatttttttatggatccaattctagcccactattttagcataacaaaggtcaaacatgttagatatcttaaacccagagttatttactctctgtttttaagacaaaaatgtttcctgatagatttcaaagagattccaaaaagacagcttcctctaaatttaaaataaagttcaggtacgcttaatttatttgcttctgtttcatctttggatttaatgttttccatcccaggtaaaataaattcccccagttgttaaatgaatttgatcttaactatgcccaatcttaatatatggtatagatgtatgtttatattagaatgggcaaaaggccaacaaaaacttcctgtctgatttttttcttaacaaattgtacactgctgcctaccaaaacttctgtttattcacataatgctgtatcatattcccaggacttgctgctctgacccaaggtgagaagaaatgcctttgtcctacaaacatgagcatttagcttaagttcaaacactgacaaagaagactgaaattggatacttaccagaataatctcccatatttagtttctctaaattcacagatgatcattatcaaactttcaaaaatatcataactattctcaatgactttaacattaaagttgggaaaatgactaaaattcagttacctttaattttaaaaatgcaaatttaacatgaagacataaatgtgtcactatcagtaatgacacatgtggtggaccattacattctgcaccaaaagtaccaagaagggcttcagtaactcccaatgtttggatggggagcttagaacaatagagataaataccaacatcaaaatgagagggaggaaacattataatttcttcattaagcaaacagtaaggttaaaacaaaatatgtaacttaaacttcaaagcacaaaaataattcttcaaaatattctaaacattttcatccaataagtactccgtatcaacaatcagcacctcacttggaaaatcagtcacaagtcagctgttaatgctgtgtggatgcaaccacagatcattacctacttaattgtgtatacatctaataggctcatacagctcttttagaacaaaggttttataatggagtagatgataaatactgaactgtagtgctaccaggtgctatactaatatgagcagaatttatatagagaattttagcctgtattaatgctgtaactaaaatagaaaaaaatgatttaaaatcaggtttgtaataatacagttaaaaaagaaatgcaatattacaagttcatattgtggcatcttgctaaaatcccataagtgatactaaaaatgttaagctaaatatagtttatctggtcaatgaatgcaactgtcagttgaccacagaagagagaaaagcaatttacattgtaaaaatttaaagacatccaatctaaaatttaatgttgactctgaagaatatcaattaatttatattttctgtcatttgaaactagagtgtatgaaagtaaacctgtacatacacatactcttctaaatcattgaacaaaatatggagcaaaccagcaacactactccatcttctggtgacattttccctcacctagatgtatttcagtgtaagtgtttctactgctgtcacatttggagcatgagatagggtataaaagatgattagcttcttcctaaatagcaaacatgaaattgtccaaacatgatagtttagagagcaaaaataagtacgccttaaaaaaaataacagaacaaactaaacttctcattacatattaaattagccctcaggtaatcagcccctaacaaacagcttaacatctacaaaaggctgcatgactggtgtgtgcctgtttaaagctctgctgtaagctgaactgttggtctcagctaggcatcctcaacatttcctttgaattttagccaacagtgccctaggcatgctcctagcactactattaacaaaacagctgtagttgaagcagtagtctttttgcctgacaaggacaccgtaacagtcattgtgatgtcttctgattgtgaacacaggtagagatgtacagcttggatacaaaaatttaatatgagtgtatttgagattataatttttactagttgtatagtaaatatgtgactaagcttgcttttctgaaacaaatgctgctgagtcaataccagacagtcccatgatcagtttggccaagtcacagtggacaacccagagctaaagtatgacatttttactcttcttcagctccctgtaccttagtctcagctgttcccatattcagtctctttagctagactaacaaaaaaagaatggagactcaaataaaaccagaaataaaagaggaaacattagaagtgataccacagaaatacaaagaattaaaaaagactcctgtgaactattatatggcaagaaattggataacttagaagaaatggataaattcctagacacataaaaactaccaagataaaatcatgaagaaatggaaaatctgaatagaccaataatgagtaagaaaattaaatcaaggccgggtgcagtggctcacgcctgtaatcccagcactttgggaggccgaggcaggtggatcacgacgtcagcagttcaagactagcctggccaacatggtgaagcccagtctctactaaaaatacaaaaattagctaggcatggtggcacacgcctgtaatcccagctactcaggaggctgaggcaggagaattgcttgaaccaggacccaggaggcagaggtttcagtgaactgagatcatgtcactgcacttccagcctgggctacaaagggaaactccatctcaaaaaaaaaaggaaagaaacaaagaaaaaaaaaaagaaaattaaatcaataattaaaaagtctcatcaaaggaaagcccaggacctgatgacttcactgctgaattcaactaaaatttaaagaactaataccaattctcaaactcctccaaaaaactgaagaggaaggaatactacaaactcattttatgaggccaacattacctgacaccaaagccagacaaggaggctacaagaaaagaaaattacaggccaatattcctgatgcacaaacatgcaaaactcctcaacaaaatactaacaagctttaaaagaccattcaccatgatcaagtggtacaccacattaacagaatggagaacaaaaatcatataaacaactcaatagatgcagagaaagaatttaacaaaattcaacatgctttcatgataaaaacctctcaacaaattagatatagaaggaatgtatttcctttttttgttgtttgtttgtttgtttgtgatggagtcttgctctatcacccaggctggagtacagtggcgcaattgtagctcattacaacctccacctcccaggttcaagcagttctccttcctcatactcccgaatagctgggattacaggcccacaccaccacacctgctaatttttgtattttatcagaaacagggttttgccatgttggccaggctggtctcagactcctgacctcaagtgatccacccacctcagcctcccaaagtgctgggattacaggtgtgagccaccgtgcctagcagaaggaatgtatttcaacacaataaaggccgtatttcacaagcccatagttagtgttatgctcaatagtgaaaagttgccaaaaatacacaatgtggaaaaaatagtctcttcaataagtggggttgggaaaattgaatatccacataccaaaaaacaaatttatttttatcctacatcacaaacaaaatttaactcaaaatggattaaagctgtaaacataagccctgaaaccataaaactactataagaaaacaaaggggaaatgctctatgacattagttttcacaatttttttaaatatgatgccataagtaccagcaacaaaggcaaaaataaataagtgaaattatatcaaactaaaaagtttctgcacagaaatggaaataatcaacaaaatgaaatagtaacctatggaatgaaataaaatgtttgcagaccatacatccaataagaggttagtattgaaaatctataaggaagtcatttaactcaaaagcaaaaaagaaaagaaaagaaatgacccacaaataacctaattaaaaatgagcaaaatacctaaatagacatttttttttttttgagacctaagtctcgctcttgtaccccaggctggagtgcaatggcatgatctcagctcactgcaacctccgcctcctgggttcaagcaattctcttgcctcagcctcccgtatagcagggattataggcacctgccaccacgcctgctaatttttgtatttttagtagagacggggtttcaccatgttggccaggctggtcttgaactcttgacctcaggtgatctgcctgcctcagcctcccaaagtgctgagattacaggtgtgagccactgtgcccgaactaaatagacatgtttcttttttttttttttaaatcctttaagttctagggtacatgtgcacaatgtgcaggtttgttacataggtatacatgtgccatgttggtttgctgcacccatcaactcgttatttacattaggtatttctcctaatgctatccctcccccagccctccacccaccgacaggcctcggtgtgtgatgttccctgccctgtgtccaagtgttcccactgttcaattcccacctataagtgagaacatgtggtgtttggttttctgtccttgtgatagtttgctgaggataatggtttccagcttcatgcatgtccctgcaaaggacatgaactcatccttttttatggctgtatagtattccatggtgtatatatgccacattttcttaatccagtctatcactgatgaatatttgggttggttccaagtctttgctattgtgaatagtgctgcaataaacatacgtgtgcatgtgtctttatagtagcatgatttataatccattggatatatacccagtaatggggttgctggatcaaatggtatttctgcttccagacccttgaggaattgccacactgtcttccacaatggttgaagtaatttacactcccaccaacagtgtaaaagcattcctgtttctccacatcctctccagcatctgttgtttcctgactttttaatgactgccattctaactggcgtgagatggtatctcattgtgattttgatttgcatttctgtgatgaccagtgatgatgagcattttttcatgtgtctgttggctgcataaatgtcttcttttgaaaagtgtctgttcatatcctttcctgactttttcatggggttgctttttcttgtaaatttgtttaacttctttgtagattctggatattagccctttgttagatgggtagattgcaaaaattttttcccattctgtaggtttcctgttcactctgatggtagtttcttttgctgtgcagaagctctttagtttaattagatcccatttgtctatcttggcttttgttgccattgctttgggtgtttgggtaatgaagtctttgcccatgcctatgtcctgaatggtattacctaggttttcttctagtgtttttatggttttaggtctaacatttaagtctttaattcatcttgaattaatttttgtataaggtgtaaggaagggatccagtttcagctttctacatatggctagccagttttccctgcaccatttactaaatagggaatcctttcttcacttctttttttttttttggtcaggtttgtcaaagatcagatggttgtagatgtgtggtgttatttctgaggcctctgttctgttccatcggtctatatatctgttttggtaccagtaccatgctcttttggttactgcagccttgtagtatagtttgaagtcaggtagcatgatgcttccagttttgttctttttgcttagaattgtcttggcactacaagctcttttttggttctgtatgaaatgtaaagtagttttttccaattctgtgaggaaagtcattggtagcttgatggggatggtattgaatctataaattaccttgggcagtatggccattttcatgatattgattcttcctatccatgagcatggaatgttcttccatttgtttgtgtcctcttatttccttgagcagtggtttgtagttctccttgaagaggtccttcacatcccttgtaagttggatccctaggaattttattctctttgtagtaattgtgaatggaagttcactcatgatttgggtctctgtttgtctattattggtgtataggaatgcttgtgatttttgcacattgattttgtatcctgagactttgctgaagttttttatcagcttaaggagatttggggctgagacaatggggttttctaataaacaatcatgtcatcttcaaacagggaaaatttgacttcctcttttcctaattgaataccctttacttctttctcttgcctgattgccctggccagaacttccaacactatgttgaataggagtggtgagagagggcatccctgtcttgtgccagttttcaaaaggaatgaatgcttccagtttttgcccagtcagtatgatattggctgtgggtttgtcataaatagctgttattattttgagatacattccatcaatacctagtttattgagagtttttagcatgaaggctgttgaattttgttgaaggccttttctgcatctattgagataatcatgtggtttttgtagtcggttctgtttatgtgatggattatgtttattgatttgcatatgttgaaccagccttgcatcccagggatgaagcctacttgattgtggtggccaagctttttgatgcgctgctggattcggttcaccagtattttattgaggattttctcatcgatgtttatcagggatattggtctaaaattctctttttttgttgtgtctctgccaggctttggtatcaggatgatgctggcctcacaaaatgagttagggaggattccctcttttactattgattggaatagtttcagaaggaatggtaccagctcctctttgtacctctggtagaattcggctgtgaatgtgtctgatcctggactttttttggttggtaggctattaattattgcctcaatttcagagcctgatattggtctattcagagattcaacttcttcctggtttagtcttgggagggtgtatgtgtcccggaatttatccatttcttctagattttctagtttatttgcgtagaggtgtttatagtattctctgatggtagtttttatttctgtgggatcagtggtgatatcccctttatcatcttttattgcttctctaaatagaaatttttcaaagaaagcatacaaatggccaatagatatataaaaaggtgctcacatcactaatcatcagagtaatgcaaatcaaaacaaaataagatatcacctcacacttgataggatagctactaccaaaaaacaaaaggtaacaagtgttggtgagtgtaatcagaaatgggaatgcttgtagagaaatgggaaccttggtgggaatgtaaattggtacagccactatgaacagtagtatgaaggttcctaaaatagattttaaaaaaatagaactattatatgatccagcaatcccacttctgagtatatatccaaaggaaatgaaatcagtattttgaagaggtatctgcactctcatgttcattgcagcatcattcatgatagtcaaggtatagaaacaacctaagtgcctaggatatactttaaaggtttagacgacacgggattctagaaattgtcaataaatcaaaattccattgcagtagaaaactacaaaatgatgtactttctgtattgtttgtgtatccacgataaagtggctgaaccagatgatgcttataagtctttcctttgtctacagtgttgtaatattattgcattttcttctttaaaaaaaaaaaagggccaggagcggtggctcacacctgtaattccagcactttgggaggccgaggcaggcagatcacaaggtcaagagatcgataccatcctggccaacatggtgaaactccatctctactaaaaatacaaaaattagctaggcatgatggtacacacctgtagtcccagctactcgggaagcggaggcagaagaattgcctgaacctgggaggcagagattgcagtgagccaagatcgcgtcactgactccagcctggcaacagagcgagagtccatctcaaaaataaataaataaatatttaaaaatttaacatttttaaaaaggcactactgaattattttcatttactggcacctcaccgcctaatacagtatattcgcatgtatagataaatgttaaaagcatctttgttgttcctgcagtttgatatgaaacccaatttcctggattattccatagtcccaatgcaacaaggttcctacagactcaagaaagtccatacccattctggtactcctttcatcctggtagaaaattctgttctacttcagattcctagggctcaatctgaaagagcagaactcccacctggaggacaagcataatcagaaagaagtggacttcactgaaaagtcaattgtgctgcatcctcatttcagtcctttgttgtacatttctgtgaacactcaaagaagttcactcctttcttcttgagtaggaaagtggaaatgtagagtggctggaggcttgcgttttagagaagactgcacccacatcttttattaaggggactatgaggggctcctctattccacatgtccctgaatacaggacagaatgtcactactcgaccacctagcaagtgtccagcaaaggaaatgctcctcaagacacaggaggtagcagaagtatgtttttccctggagagaatggggctcacttccacaaaggctgccatcagagcctttcattatagccatatataagcaaggcctcccaaaccatgaaccccagtgaaataaactgaatgtcctggctttgttttaacattagaagagatttctgcagccagtccaatctcagcatcatgcagcttttcaaacaggaaaagaatgcttttcatactataggtcctctcttggtttcaggatacaaaccagataccaaggatcaatagagggctcaccaaagaaccaaaggttgtgagaatatatcatttcctgttattgtcccaactcttgtcattagcaaagtatgtggccttgtacaagatatttaatctccttgcaactcatttttttcatctttaaaataaaacagttggggccaggcacagtagttcatgcctctaatccttgcactttgggaggctgagacgggtgaatcgagttcaagaccagcctgggcaacatggtgaaaccctgtctctacgaaaaatacaaaaaattagctgggcatggtggtggatgcctgtaattccagctacctgggaggctgaggcaagagaatcacttgaacccaggaggcagaggttgcactgagctgagattgtgccactgcactccagcctgggtaacagagcgagattgtctcaaacataaaaaataaaataaaataaaacagttaggttagatgaattctaaagattctttacttggtttaaggttctctagtatagcatagcctctgtaatttgcatcttaaaccaccaaaagtcataatcttagtagtgaaagattaccttcttttcatgcacagatcactttcaaagtgcaaaacagactaaagaagacattttcagagttaacttgtctatttttttttattattatactttaagttttagggtacatgtgcacattatttctcctcaataccaacttttattgacaaccttatggacttaggtatgtcaatataagacatgcacaaataagcaccatattgatgcaaacactgaagttgttttttgtttgtttgtttggttggttttgggtttttgttttgtttttgttgttttttttttttttgccatctctggaattcctatcagcattgtaaattttgaaacaacccataacaaagaattaacttgtttcaataaacattccccacataaagtagctataagctgcccacaacgcaaactactgtatagcaaacaaccttgtaaaaattaataaatcttctctggtgcatgaaaatcagctaacgcttgactcaacagctttctacctaagtgccaccaataaactgagccccagagacaacagacggaaacagaatagcaaaccttaggaattaaaagatgtctctataatgtttttactttgctaatttaatagaagacacttagttatcatgaccattaactatccaatgtggaaatcaaattttaggaggacaaatgtataatatgcatcattttcatcattcattttaaaataaaggcaagtttcttacattaaaaaatccataagattttttcttcagactgtaactatagaaaaacaaatcaccctataaagatctgtagtttatgaagtagtgaaaatgatcaaatggctattgcaaaaagctggatattaggaaatgtgaatattaattctgaatttgttactgactcaggatgaccttgcatgatgcatccaaccttcttttctctatatcagaaaactaaagaataaatgtaacatcacattcttttctcctttgggacaaacaactatgtacaattgaataaaaatgaaattgcataagtagtggatagaatatgtttgggttggtttgaacttagcacactgtttaataattcaacattttttatacctgtgcaataaatttttaaatgatgtctgaaatgctttgaaatcttcagaaacaggtttataaatggcataaaaaatcattttatttgatctggtaaataagaaatagaataccacctaagacagacatgaatattttagtatagcagtccttggttcacttacccttaaaaggaataattcaatcagaattctttcaggacagttagattaattacagaagaaggaaaaaaagaatcttctcccaattgagcaattaacatacttcatcttacaaaggtcactgaagttaatccatggctatagaactattgctctagaagcttagcacctccccttagtactcattcagtccagctcccacttacacccttccttagactgcatctaaacaattccagatacacatgttctttatcttttattttattgatttatttattttttgacatggagttttgctcttgtcacccaggctggagtgcaatggcatgatctcatctatctgcaacctctgcctcctatattcaaatgattctcctgcctcagcctcccgagtagctgcgattacagttgcctgccaccatgcccggctaattttttgtatttttagtagagacggggtttcaccatgttggtcaggttggtctttatttttaaaggtcttaaagaaaatatatttacaattccattttaatgttagccccaatggaaagttagtccctaccttataaggtccttgtagataagcaattcccagtgcaatattattctagctgattcactacttttttcttgctataagtccttacatgattgaaggatattatcggaactcatcaactttttcttctctatatgctatagtacaaccacaagcctagcactatttagtttcattttctaagcatttcttccacaggatccctacattgttttgttgtatcctcagagttctcaagttcccagagtaagcctaagagtattttctatgtggtcagtcattatctatctagaattttattttttgttttgaaatatttgattgacaaagattgaatatattcaaagtgtgcaacaagatgattgagagatatatacacattttgtaatgactaccaccattaaattaacacgtctatcatcactcgtgctgtttattaggtccccagaacttgttcatcttataagtgaaaatgtgtacctttgatcaatatctactaatttcctccacccaccaatccctggaaagcactcctctaccctctacttctctgagtttgacattttcagattccacatataagtaagaccatacagtatgtgtatttctgtgtctggattactttgcttagcaaaatgtcttccaggttcaaccatactattgcaaaggcaggatttccttcctttttaaggctaaataatatttcattgcttatatgtataccacattttctttattcatctgttaatagacacttaggttgtttcaatatcttggctgttgtgaataatgctgcaatgaacgtgggagtgcagctatctcttcaagatactgattccattttctttggatatatacccaaaagtaagattgataggtcttatgatagctctatttcatatgtttttagcaacctctatactttttccgaaatgactgtaccaatttacattcccaacaatgtgcaaaggtttccttttcttcacatcatcactaactcctgttatctcttgtcttgcacacctgttaggatggctatcatgaaaaagataagagataacaagtagaattttatttttcaattgaaaaatattaacccgcagtcatttttatcaaataaattttatctaacttatttttatttttcttctgtttaataaaagtttgttttaaattcaatttttatcctacaaggtattatgtacccttctggctttggaattacctaaaaggggtcacacacccagtttagtaaaagaaaaaaaaagcagttgttcactcctgagcatcgtcactaaaaaagtaccatgtgctgaacaatacctgaagcataagggaagcttggatatatagaatgtattattaacctgaattggacgttagccagaacactgaacctacttcccccaagagattgtcatagtacaagtcctcagtactttaactgcccatcaagagatatcaccttagaaacatattagaacaaaatgttgcagctcccttcttgagaggtgtcagcatgttctttttgttacatagatcaccaactgctagactatgtatgtccaaaaacattctatcccatatgttcagaacagtgctggaccctatgtacagcacagaagtatacaaaataaagaacatatccatatccttatggaacttacaacctatttaagaaaatggcttatgagaataacagaaaacatataatagctaccaattatactaaacacatgtcaggtgcaatgttaagtcctttatacatatttcataggacttactttatacttgatatattgtttcctcaaagcaagctatttaagttagggttatttttccgatgctttttaaaaagaaactcaggtatccagtacaaacagtctaaccaggtttgggtaactacaaagctcacactctaatcactgtactacatggattctcaatgagtatatcatcaatcaaatgctaaattgtatgacacaaataaaagctaagaatggcaaagagtgaagagttatattgactagaggtcacaggaggaggtgttatgagggaggctagacttcagtttgactttaaagaatgatttaagtatgtaaaatgaaacgggctgtacattctaaatacgaagttatataaaccttgtgcacaggtcagaaggcaagaatagtatgccgtgatcagagagacaagaatcagatacgtgatgtgttccaacatgcatgcaggtctgaagtacaataatttaattttacatatttttatatcaatgtctaaatgtgctttagtctatataatgttcaactcaataatgtcaactttaatttatatcaaaagacttcagaagcctctggaaatggatgtgttttataatgttattataagttttaagggtagataaagagaggaatgaattacattagagtccacattatcaaaccttattttgttttacttcacaaaacgaaagctctaaggaaacctcttgatttataagcactcaaattaatacataaatctgagatcgatataatagctggaacttgttattaccattcctatgtcacaccaactagaaggatgaaaaccaagtagtccaagcagataaactccaagactgtacctgcctttcgatagtaagaaccaaaagagtgtccaaattctccggttaatcctgctttgtcatccgtttactttaggctgattcatcccagtaaacccaccacctcacctatcacagcctcctctcacaccttttccaatcaaagctatttcaacattagtctttttgaaagtaggaaaatgtagagatgttgtgccctgacccaaggaatagctgatgtgcaggcactcactcttttaaataaataaatactaagttcagacctaggaaagaaagcacagtaacctcagaaaaacagaagtgagagaatggagcaaagaactccagtagtcttatcttgtgccgagaaagaaatctctcaaagatgatgttaaaaatatcatagaaggggacagaaaataaaacctaatggatgactccaataaaataattatagtcaattcattggacatccataattcagagttaacactggcattttctgtttgttttaaaaaatggatagaagaataaaatatgttaggagaaaacctcaataatacataggggcaagggaaaatctctcagcccttggtatccaggaaaccaaaggcttatgctcttttgaattttaaatgtgtagcaaaacacattgattttaattgcctataatctgaggtcaaaccttttggcatggttctttgttcatagcaacaacaccaccaataatatttactgaggatttgccatgagtcagatactgttaggagcactggagaggatacagcattaaaggtgacagacgaggccctgtccttttggagcttatgttctgtcccagtgcggaatgataaatatggttggaccagggaacaaaccatgactaattctctaatacaaagaataccaccttataaagaggaaactttcttgctaaactggcaattttacagaggcctgaatcttttccattagaagaaaaacactttctggcgtgtgcttcatcaggttttggagctttaaaggaatagaatgcgagataaaagataaatcccatcaagctagagaagagctgatgttctgaccctttgaccctgcccatcaagaagacataacactccaggtttgaagtcagacttgatttagatttgaagcccagtttcacgccttattagctccatgaccttaggcatgttacttaacttccttaacaattttctcatctgtaaaatggtgctaacaaaagccacctcactgtattgttataagcatttaaagattcaattcataaatgtttaaatcataccatgtgccatatgcttttcatttaataaatagtatagatgatttatataggcatatatgtatacactccatgtgctcatcttttctttatgcacatataatttacccatctatcctcaatgccattctcccagagttctacccttctgcccctgaggcatttacattcttccaaattcacaattagctaataaaagaatccaatcactgaaaatgtgttaatgagaaacgataacagaagagtacagtgactactgcctgccagctcaaatacccctccatggtaaaatatggttttggaaacaaaactgtactaaaaattgcataggccggaggagtgactctggtgtgaacgctaagcagcatcctctgggggtttgttatagtagcactcagtaaccatcaagtgctaatacctagatcatcattaatttttttaaaaaaacaaaacttaaatggacattgtatcctttttcatgtaaattaatgtgtctgcaaaaagaatgtatttgccctggaacattctataaaacaaatataacccctaggaaaataaggccatagaaaggttaaatgtccatgtaacatctgtgatagagcaatacctagaacacaattctctttttggcccagtaattctagaccatatcatgttgacttaatgagatttaactaaaaatagaaaattctgctttgaaaaccttcatccaaaaggatccaaaacttgtgaattaggcaatggtgagaatgccacaccctttgctactctaagaggaaagtctctcaagtgatcgactcgaggcctggccatgcaagtcagacatttagtcatttttctagactctatccatcatggagcacattaccgaatttcatgcaacctcatttaaacatttaactggctgttctgatcggaataaacctttggtggaagtaaaagcttgacaacgctgacacctagtggctgtgaagaaactggagcagattcagcctaggaagagtagtgagctactgtggcagtgtctccaaaacacacagcatttaatcatgatgaatattaggttataaagtaccagttctaaaacaaaccctataaaagtttatttcagctctctatttatctaggggcctacaaaaggaggcaattaaaaaccttgtatttgaaaagtaaatcttccttcaatcttccacacttagcaaattactcatcttcaaagatcaaagaaaactaaagatcaattcatattttggcatatttatgactattttccttaatgttgcatgtacacccacaaccttatcctggtcttcaggtgatttttctccccaggtcaaatataaaagccaactggccaagccattatagagactccctttatgcctctgaagcgtccctagtcaaagggtagttggattttcacaaaccagcaggaattttctttaagagaggtataaggacacatgtggaaacccctaaagtacacatctaaaagcaaggaccacattgaacactgtgggaagccatatgaacacagcagatcagcacagcacaacctgtatctgctctaaccattagaagataagtttcctcagacccacctgcacctctgacaggcaggatggcaggaagcctaaagtgttcatctcctccaccaaggagagctctgactcctacctgctgacgtttgaaggctaaataatccaaattttccagctccttcccaagcttctggtaggttttctggaggtcagatttgttggcaacatttttgagagactcaaatgtcctttgaaactgaaattgaaaacaaaagtagatcattaggatagcagcagatttttctcaaattctcaacttgctaacacgaagagtcgataatgagcctcagtttctcccattcataatacagtgataacaaatgctagctaattatctttcaatgaaataattagggacacagaaagagttataaaccatattctaagtataaccaacattactgcatgcatgagaagcctgttcagtcctcattctaacaaaagagcatacttcatttaaaaaaaataaaaaagaaagttcatcttttaggatatacttctgctttaaaattttttagaaagcactgtgaatgtataattttaaatcataatgaggaagcattaaagagtgctcacatttcaatcatggaaacaaacaaatttatgaaaatgtagttgcttacacgatattttgctataatggcatggaatctggcttgcctctataataatatctatgcagaataggtcacccaacaaacttcagcaagaaagatctctcagagcttgtattttgagaaggaaggaaaacttaacattttgatgatcaaagcatatgtggcatgttcagcaaacatttattcatttctgctctataacacagatgagctatgagcagatgagttatgatcagaaagagagttctgatcagttctgctgaatcagaatgctcctattctttttaaatcagatactagataaatacaaaggtgaaaaattgcaacgaaccacagaatactgtctgctactaataattaattaagcaaaggaagctcacaagaaattggattcttggtttattttcataaattagaacatactttggagggttagtgattgaaaatgtcaagtaatgtaatttgcaagacatttgcatttgctctctctttatgtcatttatttcccatattctcactctgtgccattagacagatttctacagatagagacttgaccatcttaaacacaccagaactccactgtgactatgatgccatgagacaggctaataagattttatagaatataattaagtttccagggaaatgatttgacccttactatatcaaactctatgaaataagtcatattaaaatggcattctactgaattaaatccctaatttcatgaaagcaacatgtttatctcaatccaaggtgacagagggaaaagaaatgggaaataacagtgctaagcttccatgacaggacagtaaattaaattcaacaaataatcatttagaacctactatgcacaaagcactatgaatataaaagacatttcctgccctgaaggaactcataccactggagaaactagacatgaaattcggaaatgagatggacactgacacttactgagtgcccactcagccccaggtacttgatgctttccaatttaatcttcacaagaaccacaggagttcctatttctcttctcattctataattgagtaaactgggtttcagaaagtttgattgaactgggtttttattacaacattcatgttctttctactctatccttaactctaacacaaggcaaggtagtaaagagagtgcaaaaaaagagagataaaggtaacattggtgaaaactcggaaaactcactgatactgacactgacggagggactcagaccacgtagaagacgtaagacaatttgagttgggccccaaaggacaggaagtcttttaagagtctgacgtggaaaccaattctacccaacatattaaacacagccaaaatcagttcattttcccccacttataacaataaacaagttcctttcaacataattttaatgacctttatatgaaatatttattatattgtataatcatttctgtgccttgcccatttcttggttcattctcactatgttcaaatcaaaataaaaccttatctaagattctaaaaaatttaagtaattttatctatgatttaattaatacaagctattttactgacaaatccatttaactctaaagcatgttttagcccctgcactttgtcttccctaagaaatattagctctacttcttaaaatattttttcttcatatttatctctgtaaacattatacaactccaaatgggaactttagagcaaacacacttgtaaagagtgttcaaaatagccgggcgcggtggctcacgcctgtaatcccagcactttgggaggccgaggcgggcggatcacgaggtcaggagatcgagactatcctggctaacacggtgaaaccccgtctctactaaaaatacaaaaaattagccaggagaggtggcgggcgcctgtagtccccgcgggaggctgaggcaggagaatggcgtgaacccggcaggcggagcttgcaatgagccgagattgcgccactgcactccagcctgggcgacagcgagactctgtctcaaaaaaaaaaaaaaaaaaaaaaaaagagtgttcaaaataagaaacacagaaaaccaacacttcaggtaatatgcccatggccaaaggagaaatggagaaaatccagtaacaatacatgatcacaagaatgttttaactaaaggtcggactttgtataatatggagatttcagcttgaacttttgttatcaggaattatatcctccatttattgataataaagagttcaaaatactgtaaaaccatgataatttcattcatttaagcagttttttttgcttacaacaataattaattgtcaaggagaggtcatatgaaagctgtggtatagctctggcttagctccctattaaacacaccccatccccacctgcacacatgtacgcttaaagatactaaagagtgaaagcaataatcttactttccaagtgatgctgaagtacagaagataaaagttaggttgaggcctaggttttaaagagtattcacttggcttgaagatttttctaataggccacaatggttaatcattgaaacaaacctccaagattttctatatttgttcagtacatgataattttcttatattgattatttctccaaataaatgatctcccagttggagacaagttggggaaaggaagcacaattaattgaagagatttttaatactgctggattttacttattcatagttttgagtgggaatttaaaatgagccaaaaaccccagaataatttgttgaaccttgaatttatcctgtgtttttttttttaactcgttataaaccaaactcaaactttaaaaagctcagtgaattagactaaacccaaaacaaaccttggacatacaagataagaatgggtagaggaaaacaatatccctaagcccagcacttgctggaaaagtaagcactgtcaacactcccagagtgtgttttctcatcaaattatttctgctcagaaataataatagtaatccatcaaataaaacagcagaaactataattgctcatctcacattaaaatagctgacaaattattttgcaagaaagagaagcatagaaaaggcaacaggaaaatgtctactttgtctcagcagtcccttttcccagatacattttttctcctttttcctgacaatacatatataaataaatctaagccagtgttctatacaaattatgcatccaatgagttcatgtaaattatgtagatttgtggagtaatttgagaaagacacgaagaaataggctgaaacagcaggaaaaaaaaatgcagccaaggctctggcaaataaagttttcctctccctcactgccaacgccctggcttccttttgtagtcagatcgattgattcaaataactctagagctccagcagcctactaattcccataatttaaaaacatcaagtagcattgctccaaaacaagagccagctccacagtcatcatgttttcttatttaatatttcatgcatttatacgaggtgctgggtgctacctgtaacatgaaaagaaatcccatacccgcagcgttatgtgtacaaaagggtatacagtaagtgcctgatggaaagcattatatcaccaagtgtgatcttagtgtccctaaatcatctgtttaaaacaatgctaaaagtttctggagcctaaagcagaaggaaagaatagtcaaaaaaataatatattgatgctctataaatattaatacctagagtaaaaagaaattgttttaagcataagaaatagctaatctaccttacttaaatatggcaaccacagagcaatcaaaaataaagtattacagagaaagaaattatttaatgtttctgaatttaatccattgactttcatattttccaaatgaacttacaagatgataataccactcaataaaaagaagtttacaactgaagcagaaaattaaagctcacatacatatctcaaatgatttttttttttttttttttgctgtaaggaatgactataaaagttaagaacatagagcaaaattgggcttgagatctaaattagaaatagttctatgtaggtgaaggcacactggccttgaggtctgaggttcaagtccttgctatgccatttaataactgcatcactttggacaagtcattattattccaattttgattgtgttatctataacacaggacaaattgtctttgcctgcctacttcactcagttgttgtgaaatcagttgaggaaaaataaaagacattcattcaacaaatatttatcaatgagcaacataccagacatgtaagaaacagaggaaaacaaaagagaaacaactcttaccctaacagattttacaatctagctttataggttactgctttataaacttaaaagttccataaaattgaaaagaccattgtcattaagatcatgacacctttcagtagtgaataaggactgaacaaaagggtcattcaataattgtttatagagcagcatcactgtgcaaagcactgggcttgacgctgtgagaaacatcacatttatggtgaggcttgggtggaaaaatgacgaaatcattgatgctttatgaaaagtttggccaggtacagtggctcacgctgtaatctcagcactttgggaggccgaggctggcagatcaattgaggtcaggagttcgagaccagcctggccaacatggtgaaatcccatctttattaaaaatacaaaaattagtcaggtgtggtggcatgcacctgtaatcccagttacttgtgaggctgaggcaagagaattgcttgagcccaggaggcagacgttgcagtgagccgagatcgcaccactgcactccagcctgggtgacagaaaaagacttcatctcaaagataagataaaataaaataaaataaaaagtttatgggcaatgtccccaaagaaatcagcagtttacaaatggataatccattttgagaagggtcaagatgatgttgaagacaaaacccacagcagcagaccatccacatcaatttgcaaggaaaaaattaatcttgtttgtgtcctaattgaagaggaccaacaattaacaccagaagcaatagccaacatcatagacatctgaactggttcagcttacacaattctgactgaaaattttcagttgagcaaagtttcccctggatgaatgccaaaattgttgcacatagatcaattgcagataagaccagagctttcaatgaaatgttttaacaattttaatttcatcaagctccttaagtattcctttggagaaatctaacaaaagatgaatgtggatttaccagtatgatcctgaagactgagcacaatcaaagcaatatctaccaagaggtggaagtggtcctgtcaatgcaaaagcaagctagtcaagagcaaagatcatggcaatagttttttaagatgctcaaagaattttgcttgttgattttctggaaggccatggaatgatagtatctgtttattatgagagtcttttgagaaagctagccaaagctttagcagaaaaacactgggaaagcttcaccagagtccttctccaccacaatgctcctgctcattctgctcattctgctcattaaacaaagccaattttgcaagtttcaatataaaatcattaggtatccaccttacagtcctggtttggctccttctgactctttttgtttccaaatctcaaaaaatatttaaagggcactcatttttcttcagttgataatgtaaaaaagactgcattggcacggttaaattccaggacattcaattctttagggatgaactaaatggctagtatcattatttacaaaagtgtcttcaacttgatggagtttatgatgagaaataaagtttatattttttatttttttcttttaattccatttttctatgaactttgtgaagtcccctcatcattaccctgcttaaaattctttcatggtttccccttagctttcagactatagttcaaactttgtaacttagcacatagacctttcaaattaggtctatgcctacctctccagcttcaactcttgttcctctcacacagttcacccttcatctcagccattcaggactattacaagtctttcagcatacatcctcttctgcaggtaaaatgccctctgccccactaccttctttctctagtcaactctccaaactcagccacacagtattcatttaacataccctctcttaatacaattccaacctccataacactttgtaccaacctctaccataataacatattgttaatttactttttatctagtctgtaaattccaagagagcaggatcatgatggtatttttagaaatttgaatccctagcacatactagagtgatggtgactgccacaaagtaagcacacaaaaataaccatttgctgaggtaatccattaattaatcaaatcagagataactggaaagatgctgattccttcttaaaaaatgaaaattttacatggtttaaatttgtatggtcaaaggtcataaaatttcaattaaacaggaggaataatctcaagagatctattgtacatcatggtgactgcagttaataccaataaattatatacatgaaaattgctagagtaaattttaagtgttctcactaccaaaaattgataagtataaaaggtaatgcatatatattaagtagcttgagttagcgattccagaatgtatacatgtattaaaacatcatgttatataccataaatatatataatttttacttgtcaaaatagggggatatagaagggatggttaatggatataaaaataaagttagatggaaaaaaatctggtgtttggtaacataatagaaagaccatagttaacaataacttatcacatatttcaaaataactaaaagagtagaatcagaatgttcctaacacaaagaaatgataaatgcttgaggtgatggatattccaattaccctgatttgatcattacacattatatgcttttatcaaaatatcatatataccccataaataagtacaactattatgtatctatatgagaacacatggacacaggaaggggaacatcacactctggggactgctgtggggtcgggggaggggggagggatagctttaggagatatacctaatgctaaatgatgagttaatgggtgcagcacaccagcatggcacatgtatacatatgtaactaacctgcacattgtgcacatgtaccctaaaacttaaagtataataataatacaataaataaaataaaataaaataaaataaaatttaaaaaatatacgtttgaaaaaaaaatttcttcttccctaaaatttccaataggaaattcatgacaaatccagcaagtatgccctatttgtctctatttctaatttctcctcttatatcttgatgtggtttggctgtgttcccacccaaatctcatcttgaattgtaactcccacaattcccaagtgtcatgggaggaacccggtgggaggtgattgaattatgggggcaggtctttcctgcactgttctcgtgatagtgaatgagtgtcacgagatctgacggttttaaagatgggagtttccctacacaagctctctctttgcctgccgccatccacatcagatgtgacttgctcctccttgcttccaccatgattgtgtagcctccccagcaaggtggaactgtaagtccattaaacctccttcttttataaattgcccagtctcaggtatgtctttattagcagcatgaaaacagactaatacagtaaattggtaccagtagagtggggtgctgctgtagatacctgaaaatgtggaagcaatttgggaactgggtaacaggcagcggttggaacagtttggagggctcagaagaagacatgaaaatgtgggaaggtctggaacttcctagagacttgttgaatggctttgcccaaaatgctgataagcatatgcgcaataaagcccaggctgaggtggtctcagctggaaatgaggaacttgttgggaactggagcaaaggtgactcttgttatgttttagcaaagagattggtggcattttgccctgccctagagatttgtggaaatttgaacttgagaaagatgatttagagtatctggtttaaggaacttctaagcagcaaagcattcaagaggtgacttgggtactgttaaaggcattcagttttataagggaagcagagcataaagtttggaaaatttgcaacctgaaaatgtgatagaaaagaaaatcacattttctgaggaaaaattcaagccagctgcagaaatttgcataagtaatgaggagccaaatattaatccccaagacaatggggaaaatgtctccagggcatgtcagaggacttcccagcagcccctcccatcacaggccaggaagcctaagaggaaaaagcagtttcatgggccaagcccaaggtccccatgctgtgtgcagcctagggacttggagccctttgtcccagctgctccagccgtggctgaaaggggccaatgtcgagcttgggctgtggcttcagaacgcagcttctgaagccttgccaccttccatgtggtattgagcctgcaagtgcatggaagtcaaaaattgaggtttgggaacctctgcctagattttagagaatttatggaaacgcttgtatgtccaggtagaagtttgctgcaggggcagggctctcatggagaacctctgttaggaagagtggaagggaaatgtggtgttggagccctcacacagagtacctactggggcaccacctagtggagctgtgagaagagggccactgtcctccagaaccaccctagaatgatagctccactgacagcttgcactgtgcacctggaaaagccgcagacactcaatggcaacccatgaacacagccaggaggaaggctgtatcccgcaaagccacagggggagagctgcccaagaccatgggaacccacttcttgcatcagcatgatctggatgtgagacatggagtcaaaggagatcattttggagctttaagatttgactgccctgatggattgtggacttacatggggcctgtagcccctttgttttgaccaatttgtcccatttgtaacagctgtatttacccaatgcctgtaccctcattgtatctagaaagtaactaacttgcttttgattttacaagctcataggcagaagagacttgccttgtcttagatgagatgttgaactgtggacttttgagttaatgctgaaatgaattaagactttgggggaatgttgagaaggcatgattagttttgaaatgtgaggacatgagatttgggaggggctgggggcagaatgatatagtttggctgtgtccccacccaaatctcatcttgaattgtaactctcacaattcccacatgtcatgggaggaaccagtgggaggtgattgaattacagggccaggtctttcctgcactgttctcatgatagtggaagagtctcaggagatctgatggttttaaaaacaggagtttccctccacaagctctctctttgcctgctgccgtccatgtaagatgtgacttgctcctccttgccttctgccatgattgtgaggcctcccctcacaatcatggaatccacatggaatccatgtggaactgtaagtccattaaacctctttcttttgtaaattgcccagtataaagtatgtctttatcagcagagtgaaaacagaatacacatcttaaataccagtcttgacttgctctttttctttacatcttaatatgcttttacatattttgcctaagatcttccacaaaatatacatagcttctaacagctcttaattatacagtaattttccctttatcagctgctgatatcttcagtaataaaaggctttagaaaatctttttgttggtacacatctgccttttaaatagagggtggcctcggagagtctcagctgccaacatggtaatgtgatttttctgtcaatataaatatttgtcatagtcagaattattgtttgtccacaaatgctttataaaattatgtagcaaatgttaaatatacatttgacaaaagttgttaaattctggacccatttcctgtaagacactggtctattacctaatccaaagggatcaacattcccaaaacaagtaaaacatgactatggtatgataaatggaaaaagttagaaaagttagttcaactcaatagtcaaatttcccttcatttttaggaataagtacaacatttcactccaagggccaaaaagtgggagcaagataccaaggagaagaaagatgggacagggaaagaaggtgaaagagaacttataccagttcttgccaagtaatttatgtcatatatcattcagtcttcacaaaaccctttcaaggtattcggaataagttttattctccccataactcagaagaagaaaccaaagctcgcagatttttaactttcccaaaatcacccagctaatcaacaacacagccaggattcaagcaaggtctccatgctgccaaaagccatgttttcttcccacgatgtcctgacccagtaagcagaagccatccaaacctattttcttccaaataaaattgacccttagaaatccagatgccaaggtgggcacggtggcggacgcctgtaatcccagcactttgggaggccaaggtgggcagatcacccaaggtcaggagtttgagaccagcctagccaacatggcaaaacactgtctttactaaaaatacaaaaattagcctggcatggtggtgcacacctgtaatcccagctactcgggaggctgaggcaggagaatcacttgaacctgggaggtgaaggttgcagtgagccaagaccatgccattgcactccaggtgtgcaaaaagagcaaatctctgtctcaaaaaaaaaaaaaagaaatccatatgccaataaaacaagatgtggaatcctaagaagaacaaatagtacagaaaagtctgaaacacttgaacagtatcatagagataaacattttaacttaaattcctataaaaaatttataaacaatggtgacaatagagccaaaatacctttccaagtttctacaattgatgaaatattgaaatatcagcacttttttcctctgtcccctattacctttcatttggacctgtttttccccaaaagaacacacacatttccttaaggaactagacacgtttaaaagtgccatgtcaggaatccttgattatttaatttggcagtacttgtccatttttggttgctcagtgacccatgtttacactagttggtggtctcagactgtgtccttgtaaatgttctattgtaattgcttctcctggggcagtctcagtggaaagagtataatttaatagaaataagaaagctttacaaaatcaggaaatatatagatacatgctattaaaagagagtaacatctcatttatctgacatctaaaaggaaatatacttcaacgggattgaaaaaaatctgttatgtaagaaaagtcataagaaggaaaataagagtaaggccacttaaaaaaaattgtgagctcagaggaattctttaatgctatgaaataaagaacaaaaacagaaaatgtagcaggaacttgtataagtgtcaggagggaaaaaaaaaaagtccagaagcctgaatgaaatagtaaagacaaggagaagaaaggcaggccttggcccattacatgcaaaataagggcaagaaataaaaaggcagtcctctgttttgggggaaaaaaagtgtgttcccaggagaaattcatgtctttaaagtggataccctcctcccaccaaaaatctataatagattattatatagtaggattggggagtgtgatggctgactacagaatgcttcttaggaagggcactacctatactgaagaaaataccttaaggagtaatttaaggtgggtagtgatatcctaaggacagaaataagcaggggccaagtggagtgctagagagataactattctttactgcattccaatgaacataatttagaagtttgagggaaagtagctagagaaaaaatgtggaagggcaatgagatggagttgctatcaatgagattttgaagatttcgaacatacaaattgaagccctttagaatatattgttgcaatatagatatccctcccttccgtcttcctgtaagtttctgtaaggtttactacattcatgtattctggtctgctctggtaggttggagaatgtgtgtatctgtgtgtctattcgtgcaaggggaaaaggccaactccagattctgggtgaatataatgtagaatagagacagaaagacaatctataaatgaaaataattcagtggaagcaaaagcttggagacagagttgaccctgaaaatatgagctcccaaggaatttgcagaaatttgggggagaacattatacttgataggacacagaatgagggtttaaactaattatattgagatcttaagagcaagaagaacccagcaacaagtggttttgcatcataattaagtggattataagtaatttaaaaaatgaaggtcagaacaaaggagaagaaaataaaagcaggcaagcaatggtcacttagagctcttattgggtcattaaaaagtaagtcatgccaaactaacttcatttcctttataactgggattactagactgataaatccacaatgccacaaacagtatatcttgatttcaagaaagtctttcaagaagtgcttgaaaatgaaataaagaagcatggtttatacagcagcccaatgaagcaagcttgaagctcatttcaacaactttactcaaaggatgttcatatttgattggtattatctaaaagaaagatataatactgttttccatgtcattaaacattttttcatgaataaatttgaaaatgatatcaggttaggaaaggaagacaaaatcgagagtcaaaggatgatggactgtaacaaaaagcaggaattaataagataaagttcaatgaatataaatgtaacttctacctttacataattaaaaaaaagactagtatcagaggaggaagacctggattaggagtagtttgagctcagagagttggaggttgtaattgctttcaaaatcaatatgaaccaacaacatgacaaggctactgtgataggtaagatcatgttagacattaaatcagggatgtaattgtccatttatatcatggaatgttcacatcagagagtttgttttgatttcaagacactgatttcaacatttcatggaagttacctacaatctagaatgcatagaaaaggatttacagagatgatttgggggacttctatttcttgtaatagcaaattagaaattcagtctgatcctctgctgaaggaaacgaaggtttgatgataaaataattcatcttaaaaacatcacagagctaataaggcagtgagaaatttcctgaagtgggtttcagaagaggtgatgttcagtatccaatcaaaaatagccattcacattataagacaagacaccatgagtaaaagcaaggaaaatgatagcagaagcaggcacccaaggagtccaaacaccagagttctcaaaccatgaggatcagacagttctgctcaccatgtcgagtagatcaaaataaagactgaaaatttcagcaggaaactaaaagtcatacaaagaaatgtaagccaatttgaaaaatatatagaaattctatggtatttaccatataaagaacatccaaaagtcaaaaaatttttagcctagaaaaggggagacataggtaagtcctaagagtaatcatcagttatttgaaaagagccttttctattgccttgattctgtgttgctccagaaagcaaaactagacgcactgtttgaaatagcagggaggcagttttaagctcagtttgagaaatttgtctccaacaattagaagtgtccaaaatcagcttcactgtctcagaaaattgagattgttatcattgttagtgatcatctattgttaggcagttgcatatgttgcatattatcagagagtctttctacgtcaggtaaaatattaaactgtaagggcactgaagtttctccactatgattcttttgattccaagtagaagctaatattgtcataaacattattagaaaaattccaaactgatatttcccaaagtatggtttcagaaatttccaggattaatatactatggaagagttctggggtcaaaaacatttgggaaattctgagttaagcagagttaaacaggcttcttcatggcaatatttctcaacaattttaacgcgctaatgtgcatcaaaacattcatgggaatttctatgtgcagcattgatcattacaaaaagaaacaacttttttcctcttccatattttcaaagcatgctctacagaatacttttggggaaatgttgggctaaataattctaatcctgatgatctcagaaacaatttagtgattttcattctacatgaagtcttgaaataattgagttgataatgattcatatataaacttttcatgaggatgaaaccatgaaaaactatcacgatttaccacaaaagatgttcccttctctttgataagatgccacttcctttttcataacatataattgttttactacacatacttatatgtgacatataatccagttgaaattcaggctctaacaaggcaccaagtgtgagagaggatggttagaatttaaaacaccttctggtgtatctaacttactttaataactggttgtaggtccatgaatttgcctaaacttttaaaagctgtttgtagttaaagctgttctaaccattagagtagttaagttccaaaagttttaattctttcctgtttccttgagcaagttacttaaattcaatgtgcctcagctttctcatttgttaaatagaaatcatgatcatagggctgttataagaattgaattaaaagaaataatccagcacagtgtttggcacattataaaaacccagcaaatattaactataatttttactgcaagaggtactttgcttttgtttgatctacaatgccatcctgcttcatttgcatggtatgatgtatgtgaattacctacctctgtgcctaactcctagtggacactcaattaaaatggtagtgaaggtggttttattctttatatacagttacctcctaattggttatgaaggtggcaattttcaccttacaaaagccctgcattctgccctatctcaacaaatttagagtctaaaataggaattattgggtcattggaactaggaattacctgccacttaatcttttgtacccatttcttgtttacagcatttgttagtgtctgtattcaaatatgagacaaatgaatctcagaaatgttcagtaatttgtctgtggttattaaacaaaccaagaagcaagtaacagaaatctttgctcaattatgacacctacaaatccactagtaaacagctgctggtgatgagaacaattccctttcctaaaaagctacttaaactaaaaaaaaaagattgaattgctctttttactgtaataaaactatcagttcagtaatttgtctatggttactcaacaaaccaagaagcaagtaacagaaacctttgctcaattatatcacctacaaatcttctagtcaacagctgttggtgatgacagcaattccctttcctaaaaagctacttaaactaaaaaaaaaaaaaaaaaaaaaaaggtattgaattgctgtttttacagtaataaaactatcaaaagaaaaaaatgaaagtacacagagagggtcactctagcgttaaaataagcaatagtgaatacaagaaagatgtggctgggagcactggctcacacctgtaatcccagcactttgggaggccaaggtgggaggatcacgaggtcaggagttcaagaccagcctggccaacatagtgaaacccccgtctctactaaaaataaataatacaaaaaattagccaggcatggtggtgtgtgcctgtaatcccgctattcaggaggctaaggctggagaattgcatgaacccagaaggcagagattgcagtgagccgagatcaccactgcactccaacccaggcgacagtgcgagactccatctcaaaaaaaaaaagaaaaaaggaaagaaagaaaagaaaaagaaagatgcaaagaaaggtttagcttagcagttagagaaaatgattttgacatgaaggttaatcaaataagaccattgcttacttaatagagtagttatattaaaatcacagacactttatgaaaatgcagatttatttatagacagagtataagggtcctatttcaagcagaaaatacaacagatataaaaagagttctttgcaaccttttcatctgaacactactaatgatttggtcaaactctgaaaacaggctttaataaaattctctctctactaaaaatgtgctaagtgggtttgtctgacaaaataaagcattcaggatatcttgctaactttatatcctcctagctaatatacattatttactcatattaaatacatgtctacattttcctaatggattactacagacatcacagactacctgtaaacatgcactctttatcctgaatcaagaggacatggcaaagtagaattcatttacaaaccaggataaatttccaaatgtcttcaactttaaggtttctatttctcaagttatttatactcatatgtttatcatatattatctatataattatgttatttatttatttatagagagcatagttatttaaatgatcaaaagtctagaacttttcctagccatttccttataagcaagccatctcctgtttaatttcccattggctttagaactactctggcttccttattttgaggtatacattagtcttcacaacccagtctagtctgcttctgaaggggtgatgttaagaaatgagagtgaagccaagatgcactaggatcgacgccaggttcagagaatgaaattagaagtgaagacaatgccaaggtaaactaagccatcttttacttacagctgacacatgttgcaagaggcacatgacatcaatcatgtccgcaaggataaggagtctcgtcaccgcagccagcaaggcacgggcagcttgaaccacagcctccctttttgggagaaaacaggggtcatctgtaaatctctcagctgatactttcagagcttcacctgaaaaatacaaccccatataagttatactttaagtttcaactatgcctatttcaggatttatcagctaacctaattccaagtaaattccaagactaagcataatataaaaatattgtcagttgacaattttctctctcaataaacaatgcagtttcaaattaacatttgtttttcacaaatattttggaattaagaagcataatatcattttcctgcaagaaagttgtgctcaactgactaggaacatctagtaaaattgctgccaacttctgcatttgctgaatctcatttcttgtaaaaggttttattactaaagcttcaatcataaacaatcctgcttataaaaacaaggtaaatctttattgagttactttccaaatcaatggatgttaggactgcagctctctgataaaagtttaacataggcaaatttattctaaactatcaatataatgaataaactatatcctaaatttagtcacagaaatagtacttcatagtacctaattgttagagaatattgtgtccactatttttaatgccttttcatttaaaatatattttattataaaagaaatatgtattctttcattgttttaagttcccagttcaaaagggtataaaatgaaaatatttaataaaaaactctctttactcccatccaacaacataattgataattaccacatccactattttttaagtttttaaatctaaacttctttttattataaaagtactataatacgtgtccattacttttaaataatttaccacactaaagaacatcaagtaaaaattttaaaagtctccaaactaatcccccaaagcaccaactattcagctcttgcatatctgtccagaaatttttccatgaatgtatgatttatgtgtataagcatatatagatacatgttttatatacataaatgtatatgtatgttttatacatgtatgtgttttatgaatatattcatatacattcatatatacaaatatgttttataaagacagattttataagaaaacatattttatatgttataagaagaaaatgtaaaaatatagagcctttagcaagtagtatcctactagagagattttctgtaatttcttctttttgcttttcaatttattttcctttcatactgggaaacagatgaccaggaggcaatatagcacagtaattaacagtgtgtactctggagccagactgcttcaatgtctctgtcctagtatctcaatcaagtcacttaacatcattactcttcgttttcttctttttttaataatataaaataataaacctactattttatgagtattaaataagagtacataagttatatttcattgatacactgtaacttattttaccaggcccctattgaacacataagtcatttccaactttttcctattttatataatactataaagaacgtccaggacatatatctttacatgcatgaacaagtttagctttaggataaattcctaaaagtagaattcctgagtcaaggggcaaatgaattttaagttttgttatatattgccccaaaattctccaaaatacagtcatcccatcaaaaatatacaaaagggtctgtcttatccatttatggattacatccataaatattttagtttcattgactcatgaaccttaacataaagaaaactgagtcagttattttattaaataaaataaagaatactgtttcttataatagacaaaacttgtgaggagggtctgagactgtctcaacatgttagtatgtctcatttagatctctttagcaataccaagttaggaactaggactctagacacttctgagatcaaattcatatattccccctctagttctgggaacttggacagtaaatgccttcaatgtccttatctataggaaaggggtaaaaatatgacttatctcatagtgtttcttggatgcttagatgacagcattcatatatttagcacagtatttaaacatggaaagcactcaacaaagattaactgttattttggaggaaatttctaatagagatggtaaatttttaatgccaataagtgggtgattttcatctgcttctctgcaagtcagaattgctgctatgagactgtgaaaagttaaactgacttccagaatttagagagcagatgaatgcccacaaaaaagattaattttttctttttgtgattctgagttggaaagttataatagcctttttagaatactgtctttgacttcacatactaaaactaaatatatatcaaaaaattatgtatttttgactctaaaaatgttggaatgttgaacaactggctggagagccatattcagaaagagatcatttaaacaattagtatattcttgtctttgttaaaggaatataaacagccagtcaggtagctctgttgggaagagaaaagtcactcccaaaatacattaataaagatgctacaacttaaattcttattgctggacttatccctaatttccccaatattcctaacccttttcagctggtttcagcccacactctggtcctaagttaaacatcacttcctatgggaagcttggaccccccattaccaagataggtcttacaataagattctatgttttctagcataaccttcatcataatttattataacaaattgtatcaaaacctgtcttttcttctggatcataaaactagtaagtgcaagagctgcattggccctggtcaccacagcatttccaggatctagaagagtgcctactctgttgcagatattcaatacattgactatctactgccaaatgaatatatgaatgaacattattcaacttttctttgataaacatttgttgttccctctataaaacagctgtatcctaggtatccaggatatagatatcagtatgaaacagtatttttgcagcccaagaagttcagatcaagtgaaagtcaacaaacactgatacaggtttctggtacaggcctgtacaaagtactaagagacacagaggaggatctacctctgcctgaggtgtcagaagatatacaaaggaatgttctaggtaaaagaaacatgttccaactattgataaggtattgacaacgacagctggtttatagaatttagccagttcactgtcatattgatttctgacaggagaaaatggttattttcctaattaaatagaaaaaaaggtacaggtttcctttccatctagaatattagcatctatgttttataaagtctacatgtggagagtctactcttttgaaatatcattcccaatcttgcttataatgcttttactttgaagtttgctgaataggaaatttcacttttaaaatacatacaaataaaaataactacattttttcttcaagaaatcccactctatacataaaaataatttactaaaggtcttgaaaatgccagaagaactaggtttagaaaacttctttctactgagtccatttagttcctttcctaaaaacgggattttttttaatcgttaaaaaaaatcagttatgaaatgcctaggtactagagtatatagtctacaaatatctatagagataacttttacacacctatataagtgtaagagatgacaatttctgaatatacaaaaatctggctgataaactttttatatgatcaaataaataaactccagaagtacaaaaaaattgttggccaaatacacatattaccaaatattctttattttataaagcttcctatatggttattttacaagttcctttgcttcatttaaaagtataattctactttctaaaagtgcttatattgattataaacttaaaagtcaaggaaaacatagtataagaaaaatatccagaggaaaaagagaataaccaaaatgaaaaggggcaggtactaaagataaaaaacttcccaaacttttacttgacattatgtttattattcaattaagatttctaatatatgcatctgtccaagtgatacaaatacatcatggtaaaaggtttatatcatacacatataacatgcattagtacatattcattgattcaatatataatagggttcacagactgagactcaacattcagggtttggttttatttgtttttggttgggaaactgccattttgaatttgaaaactctgaagaggtagaagcttgaatttaactttttagcagacaattattttatttggcagggaagagaggaggatgacctcaattcgatcctaaacttacacagatgttaaaaaaaaatagtaaagactcccctttaaaatgttcaagacagtttgactactaggagcaaacatgttttgtatgataaaagaaaaccttatcatggcaggtggaagggcagcaaagctagccactgctgtgtggacccaaggttgggtgctacggcagggttatagactaggaatgtggctgcatatggttgctattgtaaactattggctatgtcttatttccattttattatcttcgaactcagtaaagtcttattaaaagttataatttgcttccagtcaagggagaataacagagaccagattcctttcctacctgaaacaaaaaaatagaccaaataaatgcaaaaatggttataaggcactggatgttaggcagtgaaggacagtaatccctgagaaatggaccaaaaaaaacaggatgagccctttgatagccccagcttaccaccatgagagactttccaggcaatgatacaggaaggggaaaccaaggcagagcctggcaaactctctgagctggggagacaaagctgagagtcctgggagatcaaggcagtaaatgtataaaacagaatagagaatgataaagggaagagatacacagagaaagaacactgataatctgcacatgctccctcttgagtattcagctgaatactgatcaaccagtatactggaggaaaccacccaaggctagggaaagaaccacccaaaaggatttgaggtaactgtacttgccactcacacaggactgggaataatgcttgtccaaccaccagactggaaaacttcataactcatgggacattggatagaatacaaagaagagtcttgcctcaatagtggggaagaattagccttagactgaacattgccctagtgccttctaacaaagcaattcagagaaaacagaattcccaatttcaagaccagcagcattcatgcatcagagaagagagatagccaggtaaaggcaacagcagactagcataatgatttaatgaaaatggaaggacatgagcagccagtcactgagcgctgcaccattgggaactctcaaaataagctgggaaatactttgattgggctgattctattaaaaaaaattttttcataactaatctgtgtttttttattattatactttaagttctagggtacacgtgcacaacgtgcaggtttgttacatatgtatatatgtgccatgttggtaaaattatataaaatgttttataaaacataaaatttgatggggctagtttctataaaagtaatagaaacatctcccaacatcatagataggatatagtagaagctgtcttaaaagacctcctcttaaccacctctctagattaataaactttttattcctctcagcaacatattaatggtatctcctttccggtatgtaaaatatactgaagaccttctgcttccaataattgaagttaatcaagaagttgaaaaggcttgctccccaatcttttcatgtgagttgtaattataattatatagttttattaactatataaacctatcaaatataagtgtaaaaatatctattaattctttaaaaactaatttttaatgctttagagacattcagtaaagatgagttgttaagttgggtatggaaggaaaaaatggtaaaagttggagcagggcaaggcaaggaaaaggattataaaagatcaagaaagattctgcagttaggtagcttcgcaagtgtcattaagttttcttccatgaagacaccaaaactggaaattttagtcaatatagtttggttgtggtttcggtcaaaacgactatataagttatgcgtttgtgtgtgtacaactaatgaactaatgaactttttacttctaataatgagaacaaatatatcttgaagcaaaaattatctgctatattttaaaacactggaaataactttcagtcacatttagtcaaactttaattatgtacttgtatgtaaaagtacacaactcctaacttaaaactttattaatatctttttatgagcaaaatattttgtacaatgtatctataaactatgcacctaaataaatttcaatattaaggaagattttaaaatagagctaaacatctcttcagaatttcaaagaaaaatgaaattttttaattttcaaaaaattgaccaagtaatttcatgtcatatttaaatttgacaatttttttttctatgcaggctctcactttgtcacctaggctggagtacaggggtaatcttagctcactgcagtctcaaactcctgggatcaagcaatcctcctgcctcagccttccaaggagctgagactacaggtatgcatcaccaaacccaattaattttttgtatctcttatagagatagggtctctttttgttgcccaagctggtctagaactcctggcctcaagtgatcctccctcttcggcctctcaaaatgctgggattatagccatgacccaccccactgagctaaatttgacaataattttaagataataaaatacacaaaatatattcctgcaacattattatcatctcctggggttagaagtttcatatacctaaagtggtttacagtaaaacaaactgacaaaggaacaaagcaatccatattgtaaaccagtcaataaaaagaaaatagtatggatttataacttaaataaatgtttaaactttgagctgaaatagctgcccataattattctctattgaatttctttcccaacaacctattgactgatatgccacccaccaataaacacttttatattattcttgatgtaaatttaattcttttgaggtgaaaaaataaaccttataactaagatttccgactaaagttaatttatcattttttctaatatttccttttatggctaaatgtagtaagcttagccatgaatacacttaaattatactatgatgaattggcaaaaactgatatctttgcttttttgacatctgctaaaagaatctcattctagtgctttgaagttgaaagttaatttttaataaatgatacctaacccttacaaacagttcattcattcatatatcaactattcagcactaaaatacgcaaagcactatggggtatacaacaacgattataacatggtctccaccaggtaccctcaaataggaaaatgaaccacttcaatgagaagattcttctgtttggttttaaatgtcagcatcttcagatacacctaccttaaagtatattaagacataattccatagcacctcccccccaaaaaatacaagtataataattcttcatatgcacaattcctagatttcaatattttatgtatgatttaaaagttctctgagaaaaaatgaaaaacgagagtgactacatcaaaggatcactcaatcattttaaaataaaattaccagttatcaattatcacttataatcagcctcaacaaagttctattcatcaagaggttaagtaataaagtagaattcaggcttcaccttactagaaattcaagtcccacagctgtgatcagagcaataaatatttaacaaatttattctttcatatatcaccccattcagagtactacagctgttaatcagtaaggtcaaatttggccctattgatatgctccttatgcagaaatgacagaagttattttagggccccattataaagtcttagttcacaagctcacacaaaacttgcaaggaagtcaatgtggccaactgtacatactgaaagtacagagtgaaacccaaaggagcataaaaatttagtgaagataaacatccaggattctgaaccattacaaaagtaaatacattccattcacaagagcatccaacaaataaaacatttaggaataaatttaacaaagaagtgtaagacttgtacactgaaaactgcaaaacattgctgacaaattaaagaagacctaaataaatgatcatatctcatgctcatggattagaagacttaatattgttaagatagcaatactccccatatcggtccacagattcacaataatccctgactgatatcgcttagatgtttatccccgccaaatctcatgttgaaatgtaatccccagtgttggaggtgggacccagtgggaggtgtttgggtcatgagggtgcatcccttatgaatgtcttggtgctgtcctcatgataacaagtgagttcttgctcagttcccatgagatctagttgtttaaaagagtctgggacctcgcactcctcttgctcccactctcgtcatgtgacaatgctagctccccctttgccttccaccatgattggaagcttcctgaggccctcaccagaagcagatgctggtgctatgctccatgtacaatctgcagaaccataagccaattaaatctcttttctttataaattacccagtctcaggtgttcctttatagcaatgcaaaaatggactaacacttttaacaaaatccttactggctctttcaaagaaattcaccagctgatcctaaaattcatacagaaatgcaagggacccagaatagccaaaacaatcttgaaaaagaggggcaaagttatagaaatcacacttcccaatttcaaaacttactaggaagctataataaccaatagaattgctatctcagaaataaacctttacgtttatggtagatcatagacctacttgcaagagctaaaactataaaactcttagaaaaagaaaacaggaatacaactttataatcttgagttaggcaacaatgtcttatatataacaccaaaagtacaagcaataaaaaaaattgatgaactggacaatcaaaacttaaaccttttggactccaaaaaaaaaatcattaagaaggtaaaaagacaacacacagaatggaagaaaatgtttgtaaaccctatatccaataaggggcttatatccagaatctattaaaaaaaaacttactacttaataataaaaagacaatcctgtttttaaaataggcgaagagtctaaatagacatttctccaaagaaaaaatacaaatggtcaataagcacataaaatgacattctatcataaatataatctaaattattaaagcataattaaagatgtacagaggttttagtaaggacctttgaataagttttttttattatttaaaaataggcacatttcttgtgtagtcaaaaacacaaggctaaaaacatacctgcagaggggaccaaaaaaaaatcaatgtgtatgtatatgtactggaaactgtcactttaataactgtaaaaactagtgagtaattattataatgaagcagtagaaaagtaacatttacatacattgcagctaacttctctccttggggggaatatcaagatcattaaaagggtgggggtagagggtgtcgatcttgttcaccatgctgccccaaaaccatgagcagaatgcatctctctcggaaatccctggagaccccatagagctcattttgtagctaaaagcaaactctgagctataaatattagttgtcttttgcacaaaaattaacagtagctttaattgtcctttctttttacttttcccaccaatgatacattcagtctgagaaacttgagattcttaacaagtaagaggtcaaatatttttgaaattccttgtattcttagttcctttacttcagacagagtcggcaaactatggaaacaagccaaatccagcctgccctgtttatgtgcagcctacaagctatgaatgttttttatatttttaaaggttgggaaaaaatcaaaagaataatattttatgacatgaaaaattatataaaatgtaaatttcagtatacataaataaagctttattggaacacaaccataactttttgtttattgcttacatatttctatagctattttcattcttcaacacacagagttaaatacttgcaacaatgtacggcccacaaagcctgaaatatttactttctggcctttcacagagaatgtttgctgatccctcatctgagataaatgaactaataaaattcataatctgtttttttaaaaagcacttcatttttaaaaagttcatacaactaacaagggtctccattttgatatatataaatgtggccctaaaaattctttttcaaaaattatttagttggctttcatatcttaagctgaatacatggaccttgcctgaaaatcccagacaacataaagttgagtttatcccttaaaagaataaaatttgacccagcagtctttcagcttcagtattcatatatctaataatattagcatctcaggaatttcccatatgcctcagttaaatagttccccgaagaatactcagccagctctaaataatgctcccagtgtaatatcaaaaggaggtatgaattttctcctcaccccaaagcataatagtgaaaaactatactgcaggagtcaacagccagctcatctaccttgttcgctacctttcaatgaaatcctgagcaagtcacataattttttggtatcaatatccttattatgcaaacacaaagattatggaaacacatagaataaagaaaataggtgaaataaagaaataaaggtgaaatgaagaaagaataaagaaattatttaaagaataaagaaattctttttttaaagaataaattatttaaattaagaattctttatttaaagaataaagaaattcttttattaaagaataaagaaatttctttaccgtagaataaagaaatttctttattcatagaataaagaaataggtgaaataaagaaaataggtgaaagcctttagttctcagagaaacatactaaataaacatggagtttttaaaaggcaaaagtatcctcactgctgtgttcatattttatatattttagtgtgaagatttatcacgtcaaaatcaaggctactcccatgaaacttacagaagaatttcccatggagcttcagcaaactttcgtgtctcagtctatcataaatctcagcttgctattgacagggaaaggaggcagagaagagctgggtagaggagggtgtggttcctggcgagggctccacctccaggcctgtgcccacagacctaggtgaggacaggcactcctgactttgcacccaaatgttgcatttcccaggactgtcctggcctgccactccccagtcctgtgcctgtaaaaactcccgagactctggcaggcagacacacaagcggctgcacgtggagagaaacacatcttggtggaggaatacacaagcagctgaacattgagagggcgtcgagaggaggagatcggtggaagaagacacaagtggctggacgtgaagaggacatcaagagcagacccgcaggccatcgaccggtggaacgacgtggagttttactgggcagtcggagaagagtcaggcagttttctaggggaaaccatctcctttctgtctcccccacctgctgagagctacttccactcaataaaagcttgaactcattctccaagcccatgtgtgatccaattcttctggtacaccaaggcaagaaccccaggatacaaaaagccctgtccttgagataaggcaggggtctcattgagctaacgcaagccgtctacggatggctaaactaaaagagcaccctgtaacacatgcccactggggcttcagagctgtaaacattcgcccctagacactgttgtggggttggagccccacagcctgcccgtctgtatgctcccctagagatgtgagcagcggggcactgaagaagcgagccacactcccatcacacaccccctgaggaggacaagggaacttttcccgtttcactatcaatcacactattttaggggttcaactgtccataaccagtggactatcaatagaaactctcacttccaaatgcctccctcagggatgtttgaaactggtatttattaaactgggtaaatgccatagactaaagaggaaagaagaggtcaaaaatattgggtaaaaaaaggagcaatgaaaaattttggaatagaaggaggaaacggtgaagcaagtaagggaaaataagagttgctaattctttcttttgggttatcagtatagactgaatatttgatgaggaagataaaacaggagatctcattgatagccgctagtgtccaaaagcaaagaaaaatgagaagtattatctcatataatgtgctagcacacagaaaaggataacaacgcacattcaagaatacaatacgacaattcaaggatgcatttgatattacaggtccatgcatatttaagtacaatcattccttattttatagtttcttataggttttttttcgttgttagaggttagacctgaaccagccaaatccttgagccaacttggaataatgattatatgattttcatgcaatactattttttttcttcaacttttaagttcaggggtacatgtgcaggatgtacaggtttgttacctgtacatcgacgccctctcaatgttcagctgcttgtgtattcctccaccaagatgtgtttgtctccacatccagccacttgtgtgtctgcctgctagagtctcgggggtttttataggcacaggactggggagtggcaggccaggacagtcaggtaaatgtgtaccatggtggtttgctgcatagatcatcccatcacctaagtattaagcccagcacccattatcaattattcctgatgctctccctccccaacccaacccctgacaggacccagtgtgtgttgttcccgccttgtgcccatgtgttctcatcactcagctcccacttatatgtgagaacatgcagtgtttggttttctgttcctgcattagtttgctgaggataaggacttccaattccattcatgtccctgcaaaggacatgatctcatttctttttatggctgcatagtattccatgatgtatatgtaccacattttcttcatccagtctgtcattaatggatgcaatactattttgagtggattcttcatcaatttttttctttggcccttttttaaccccgtttttttaccacccaatctctttcattgccagaaacttctcttgttctgtgatcttaaattttcactgatttgggggcactggtgcaccttttagttttgtctttcaactgtgatttcaatttgagcaggaatttagtatggaatgtgtgtgtgataaaaacagttttgctgtaaagaacatgctcttcaataaagttcaacaactcctttctctccataatagaccctcaggcacttagacacactagctcctaaaaatcgtttgtaactataccccttaaatctatatttaataataatatattatgtacaaaatttaattcattttacctaggtttatacatactaactggtactttgaagtcaagtcattctttctaaatgcttcttttattagaaatgagttcataagctgtgatcctggaaaaacatcttgagtcactatcgaaatctaaacattttaaagtcctcttaaaatgttactaattaactgagagagtctttagcccaaagcgtctcctattagtgtgggagaaataatagtaatctggacattaagaaacctgcattttacttattagcagcatttgaggaatggcatttaaaaatacgggaaataagattattctctgggaattaaactgcagtcatcacttacacaatggatggaagagatatacaaaaaaagaaaaagaattttcttctcacattcaagaatacaatagaaatgaattatattttgagggtcaaatgaccagtcatctttttttcttttcttttttttttaattatactttaagttctagggtacatgtgcataatgtgcaggtttgttacgtatgtatacatgtgccatgttggtgtgctgcacccattaactcatcatttacattaggtatatctcctaatgctatccctccccgttcccccaaccccacgacaggccccagtgtgtggtgttccccaccctgtgtccaagtgttcccattgttcaatgaccacctatgagtgagaacatacagtgtttggttttctgtccttgtgatactttgctcagaatgatggtttccagcttcatccatgtccctacaaaggacatcaacccatccttttttatggctgcatagtattccatggggtatatgtgtcacattttcttaatccagtctatcattgttggacatttgggttggtttcaagtctttgctattgtgaatagtgccacaataaacatacgtgtgcatgtgtctttgtagcagcatgatttataatactttggatatatacccagtaatgggatcactggatcaaacagtgtttctggttctacatccttgaggaattgccacactgtcttccacaatggttgaactagtttacagtcccaacagtgtaaaagtgttcctatttctccacatcctctccagcacctgttgtttcctgactttctaatgatcgccattctaagtggtgtgagatggtatctcattgtggttttgatttgcatttctctgatggccagtgattgtgagcattttttcatgtgtctgttggctgcataaatgtcttcttttgagaagtgtctattcatatccttcacttactgtttgatggggttgatttttttcttgtaaatttgtttaagttctttgtagattctgtatattagccttttgtcagatgggtagattgcaaaaattttctcccattctatacgttgcctgttcactctgatggtagtttcttttgctgtgcagaagctcttcagtttaattagatcccatttgtcaattttggcttttgttgccattgcttttggtgttttagacatgaagtccttgcgcatgcctatgtcctgaatggtgttgcctaggttttcttctagggtttttatcgttttaggtctgacatttaagtctttaatccatctggaattaatttttgtataaggtgtaaggaagggatccagtttcagctttctacatatggctagccagttttcccagcaccatttattgaatagggaatcctttccctatttcttgtttttgtcaggtttgtcaaagatcagaatattgtacatgtgcggtattatttctgagggctctgttctgtttcattggttgatatctctgttttggtaccagtaccatgctgttttggttatgtagtcttgtagttcagtttgaagtctggtagtgtgatgcctccagctttgttcttttggcttaggattgtcttggcaatgcgggctcttttttggttccatatgaactttaagtagtttttttccaattctgtgaagaaagtcattggtagcttgatgcagatggcattgaatctataaattaccttgggcagtatggccattttcacgatattgattcttcctatccatgagcatggaatgttcttccatttgtttgagtcctcttttatttcgttgagcagtggtttgtagttctccttgaagagatccttcacatatcttgtaagttggattcctaggtattttattctctttgaagcaattgtgaatgagagttcactcatgatttagctctctgtttgtctgttattggtatataggaatgcttgtgatttttgtacattgattttgtatcctgagactttgttgaagttgcttatcagcttaaggagattttgggctgagacgatggggttttctagatatactatcatgttatctgcaaacagagacaatttgacttcctcttttcctaattgaataccctttatttctttctcctgcctgattgccctggccagaacttccaacactatgttgaaaaggagtggtgagagagggcatccctgtcttgtgccagttttcaaagggaatgcttccagtttttgcccattcagtatgatattggctgtgggttttcatacatagctcttattattttgagatatgtccaatgaatacctaatttattgagagtttttagcatgaagggttgttgaattctgtcgaagccttttctgcatctattaagataattcatgtggtttttgtctttggttctgtttatatgatggattacatttattgatttgtgtatgttgaaccagccttgcatcccagggataaagcccacttgatcatggtggataagctttttgatgtgctgctggattcggtttgccaatattttattgaggatttgtgcatcgatgttcatcagggttattggcctaaaatcctctttttttgttgtgtctctgccaggctttggtatcaggatgatgctggcctcataaaatgagttaaggaggattccctgtttttccataaattggaatagtttcagaaggaatagtaccagctcctttttgtacctctggtagaattcaggtgtgaatccatctggtcctggaatttttttgtttggtaggctcttaattattgcctcaatttcagagcctgttattggtctattcagggattcaacttcctcctggtttagtcttgggagggtgtatatgtccaggaatttatccatttcttttagattttctagtttatttgcttagaggtgtttatagtattctctgatggtactttgtatctctgtgggatcagtgttgatatcccctttatcattttttattgcatctatttgattcttctctcttttcttctttattagtcttcatagcagtctatcaattttgttgatcttttcaaaaaaccagctcctggattcattgattttttgaagggttttttgtgtctctatctccttcagttctgctctgatcttacttatttcttgccttctgctagcttttgaatgtgttcgctcttgcttctctagttcttttaattgtgatgttagggtgtcaattttggatctttcctgctttctcttgtgggcatttagtgctataaatttccccctacacactgctttaaatgtgtcccagagattctggtatgctgtgtctttgttctcattggtttcacagaatatctttatttctgccttcattttgttatgtacccagtagtcattcaggagcaggttgttcagtttccatgtagttgagcagttttgagttagtttcttaatcctgacttctagtttgattgcactgtgaccagtcatcttaaagtaacagaatggatcccaggcttcaatggctaaccttgactataaattaactaaaagttttggtatatctaaaaaaaggaattatcaatcaaaaagggactgtgtcaaccatggaaaaaagaaagttggtgatattcatccaaacagtttccaacagagtaagagctttatataataaaccatacatagtagaaccccattggtaagattatctctacagaaaggatagatgaatctgatgatttttaactttcaccattaagcattcaatttatccagcctcctttgttctatctctatgctcactaagcaatcttctgattattatttatgttgcctatattgatccatctacagtgagagaacatattggttgtgtgggtgtactttgttctgcataactttttcattataaatttaaaataggttctgattttacatcttagcttcatgatcttagttaatgtgagtatactcctgagagacaaatctggtcttggcatatgtatctgaaagggatctcagtttcaaataacagaatctattctaactaatttaaaaggtaaaggaatttgttcagggttattgggttgtttacagaatttctgcaaggcccagaaaagccaggtttgaatgatattaaggcaggaacatcaaccaagaacaacttctaatgccaccatagctctattttaggtagaaaccccactactaccaccactcattactcaacacctatgatactaggaactgggcctgagaaactctgtcagggctgccctaaaagaacaaatgcttctgccactagattgcaacaagaccctatctctctaaacatggccactctcatactgcttacctcatccttccaagtttcacaggtatgcatcttttttgcagaacctaagccatattcccaaatgcaagaagagtcttggaaatgtatctttttatctttccaacctttctaaacatggccactctcatactgcttacctcatccttacaagtctcacaggtatgcatcttttttgcagaacctgagtcatagtcccagatgcaagaagagccttggaaatgtattttttatctttccaacctctgtagtatggtccctcccaaatatactccactagaaaggagctggaataggtcaagtgaatcttaccttattaaaactattatactgcttaaaacacttttaaaactgtgtcatgtttgacacctcttccacccacccctttttctctcagttctaccatgcttaaaaataggcttttaatatcaattctattcttcactgagattgctataaagatcttgccattgatatatgtcaaagtgttctgaaaaagcatgaaactatctgaatgcggctggcagccaagatggccgaataggaacagcgccggtctacagctcccagcgtgagcgacgcagaagacgggtgatttctgcatttccatctgaggtaccgggttcatctcactagggcgtgccagacagtgggcacaggacagtgggtgcagtgcactgtgcgcgagccaaagcagggcaagcattgcctcactcgagaagcgcaaggggtcagggagttccctttcctggtcaaagaaaggggtgacagatggcacctggaaaatcgggtcactcccaccctaatactgcgcttttccaacgggcttaaaaaatggcacgccaggagattatatcccgcacatggctcggagggtcctacgcccacggagtctcgctgattgctagcacatcaggctgagatcaaactgcaaggtggcagcgaggctgggggaggggtgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtgcttctcccagcacgcagctggagatctgagaacaggcagactgcctcctcaagtgggtctctgactcctcacccccgagcagcctaactgggaggcaacccccagtaggggcagactgacacctcacacggctgggtacccctctgagacaaaacttccagaagaatgatcagacagtagcattcacggttcacgaaaatacgctgttctgcagccaccgctgctgatacccaggcaaacagggtctggagtggacctctagaaaactccaacagacctgcagctgagggtcctgtctgttagaaggaaaaataacaaacagaaaggacatccacaccaaaaacccatctgtacatgaccatcatcaaagaccaaaagtagataaaaccacaaagatggggaaaaaacagagcagaaaaactggaaactctaaaaagcacagtgcctctcctcctccaaaggaacacagctcctcaccagcaacggaacgaagctggacggagaatgactttgacaagttgagagaaggcttcagacgatcaaactactccgagctacaggaggaaattcaaatcaaaggcaaagaagttaaaaactttgaaaaaaatatagacgaatgtacaactagaataaccaatacagagaagtgcttaaaggagctaatggagctgaaaaccaaggttcgagaattacgtgaagaatgcagaagcctcaggagccgatgcgatcaactggaagaaagggtatcagtgatagaagatgaaatgaatgaaatgaagcgagaagggaagtttagagaaaaaagaatgaaaagaaatgaacgaagcctccaagaaataggggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacaccacaaagatactcctcgagaagagcaactccaagacacataattgttagattcaccaaagttgaaatgaaggaaaaaacggtaagggcagccagagagaaaggtcgggttacccacaaagggaagcccagcagactaacagcggatgtctcggcagaaactctacaaaccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaacaggcctgccctaaaacagctcctgaaggaagcactaaacatggaaaggaacaaccggtaccagctactgcaaaaacatgccaaattctaaacaccatcgaggctaggaagaaactgcatcaactaacgaggaaaataggcagctaacatcataatgacaggatcaaattcacacataacaatattaactttaaatgtaaatggactaaatgctccaattaacagatacagactggcaaattggataaagattcaagacccatcagtgtgctgtattcaggaaacccatctcttgtgcagagacacacataggctcaaaataaagggatggaggaagatctaccaagcaaatggaaaacaaaaaaaggcaggggttgcaatcctagtctctaataaaacagactttaaatgaaaaaagatcaaaagagacaaagaaggccattgcataatggtaaagggatcaattcaacaagaagagctaactatcctaaatatatatgcaccaaatacaggaggccacagattaataaagcaagtccttagagacctacaaagagacttagactcccacacaataataatgggagacttaaacaccccactgtcaacattagacagatcaacgagacagaaagttaacaaggatatccaggaattgaactcagctctgcatcaagtggacctaatagacatctacagagctctccaccccaaatcaacagaatatacattcttctcagcaccacatcgcacttattacaaaattgacaacatagttggaagtaaagcactcctcagcagatgtaaaagaacagaaattataacaaactgtctctcagaccacagtgcaatcaaactggaactcaggatcaagacactcactcaaaactgctcagctacatggaaactgaacaacctgctcctgaatgactactgggtacatgacaaaatgaaggcagaaataaagatgtcctgtgaaaccaatgagaacaaagacacaacatactagaatctctgggacacattcaaagcagtgtgtaagggaaatttacagcaataaaagcccacgagagaaagcaggaaagacctaaaattgacaccctaacatcacaattaaaagaactagagaagcaagagcaaacacattcaaacgctagcagaaagcaagaaataactaagatcagagcagaactgaaggaaatagagacacaaaaaaccctgcaaaacaatcaatgaatccaggagctggttttttgaaaggatcaacaaaattgatagactgctagcaagactaagaaagacaaaaagagagaagaatcaaacagatccaataaaaaatgataaaggggatatcaccgccaatgccacagaaatacaaactaccatcagagaatactataaacacttctacacaaataaactagaaaatctcaaagaaatggataaattcctggacacatacaccctcccaagactaaaccacgaagaagttgaatctctgaatagaccaacaacaggatctgaaattgtggcaataatcaatagcttaccaaccaaaaagagtccaggaccagatggattcacagccaaattctaccagaggtacaaggaggaattggtaccattctttctgaaactattccaatcaatagaaaaagagggaatcctccctaactcattttatgaggtcagcatcatcctgataccagagccgggcagagacacaaccataaaagagaattttagaccaatatccttgatgaacattgatacaaaaatcctcagtaaaatactggcaaactgaatccagcagcacatcaaaaagcttatccaccatgatcaagtgggcttcatcgctgggatgcaaggctggttcaacatacacaaatcaataaaggtaatccagcatacaaacagaaccaaagacaaaaccacatgattatcttaatagatgcagaaaaggcctttcacaaaattcaacaacccttcatgctaaaaactctcaataaattaagtattgatgggacatatctcaaaataataagagctatctatgacaaacccacagccaatatcatactgaatgggcaaacactggaagcattccctttgaaaactggcacaagacagggatgccctctctcaccactcctattcaacatagtgttggaagttctggccagggcaatcaggcaggagaagtaaataaagggtattcaattaggaaaagaggaagtcaaactgtccctatttgcagataacgtgatagtatatctagaaaaccccatcatctcagcccaaaatctccttaagctgataagcaacttcaacaaagtctcaggatacaaaatcaatgtgcaaaagtcacaagcattcttatacaccaataacagacaaacagagagccaaatcatgagtgaactcccattcacaactgcttcaaagagaataaaatacctaggaatccaacttacaagggatgtgaaggatctcttcaaggagaactacaaactactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcatcgccaagacaatcctaagccaaaagaacaaagctggaggcatcacactacctgacttcaaactatactacaaggctacagtaaccaaaacagcatggtactggtaccaaaacagagatatcaaccaatgaaacagaacagagccctcagaaataataccacacacatctacaaccagctgatctttgacaaacctgagaaaaactagaaatgaggaaaggattccctatttaataaatggtgctgggaaaacaggctagccatatgtagaaagctaaaactgaatcccttccttacaccttatacaaaaattaattcaagatggattaaagatttaaatgtcagacctaaaaccataagagccctagaagaaaacctaggcattaccattcaggacataggcacaggcaaggacttcatgagttaaacaccaagagcaatggcaacaaaagcctaaattgacaaatgggatctaattaaactaaagagcttctgcacagcaaaagaaactaccatcagagtgaacaggcaacctacagaatgggagaaaattttttcaatctacccatctgacaaagggctaatatccagaatcgataaagaacttaaacaaatttacaagaaaaaatcaaacaaccccatcaaaaaatgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacactttaacactgttggtgggactgtaaactagttcaaccattgtcgaagacagtgtggcgattccttaaggatctagaactagaaataccatttgacccagtgatcccattactgggtatatacccaaaggatcataaatcatgcttctataaagacacatgcacacgtatgtttattgtggcactattcacaatagcaaagacttgaaaccaacccaaatgtccaacaatgatagactggattaagaaaatgtggcacatataatccatggaatactatgcagtcataaaaaaggatgggttgatgtcctttgtagggacatggatggagctggtaaccaccattctgagcaaactatcgcaaggacagaaaaccaaagaccgcatgttctcactcataggtgggaattgaacaacaagaacacttggacacagggtggggaacatcacacactggggcctgtcatggggtggggggaggggggatggatagcactgggagatatacctaatgtgaatgatgagttaatcggtgcagcacaccaacatggcacatgcatacatatgtaacaaacctgcacgttgtgcacatgtaccctagaacttaaagtataacaactgtatatatatgcatatatgtgtgtgtgtgtgtatatatatatatatatatatatatatatatatatatatatcactatgatcaggtgggttttatatcgtgatgcaaggatagttcaacatggccaatcaataaaacctgatacattacataagcagaatcaagggaaagaaacatatgttcatctccatagatgcagaaaaagtatttgagaaaatacagtatcccatcatgatacaaactctcaacaaagtgggcatagaaggaatctccctgaaaataagaaagaccatatacgagaaacctacagttaacatcatactgaatgggaaaaagttgaaagcattttctctaagaactggaacaagacaaggatgcccactttcgccattcctattcagcatagtaccagaagtcctagccagagcagtcaggcaagacgaagaaatgtaaggcatccaaattggaaaagagaaagtcaaattatccctgtttgctgatgatatgatcttatatttagaaaaccctaaagactccatacaaaaactcttagatttgataaatgaattcagtaaaatttcaggatacagagtcagtgtacaaaaatcagtggtgttcttatacaccaataatgatctatctaggaaagaaatcaagaagtaaatcttatttacaatagctacaaaaagatatgtagaaataaatttaaacaaggaggtaaaagatctctacaaggaacactagaattcacagataagaaattgtagatgacacaaacaaatggaaaaacatcccatgctcatggatcaaaataattagtattgttaaaatgaacatactgcccaaagcaatctacaaattcaatgcaatccttatcaaaatactaatatcatttttacaggattagaaaaaacaatcctaaaattcatacagaaccaaaaaacagcccaaatagtcaaagcaatcctgagcaaaaagaacagaatagctattattttttttcccacacagttcactgatgtatagaatggctattattaaaaggacaaaaaataacagatgttggcgaggatgtggagaaaagaaaacccttatattctgttggtagaaatataaattagtacagcctctatggaaaactgtatggagatttcccaaaggactaaaaatagaactaccattgcatccagccatccactactgaatatctacccaaatgaagccaatatataaaaaagataccttcacttgtatgtttattgcagcactatttacaatagcaaagatatgcaatcaaactcagtgtccatcaatagatgaatggataaagaaaatgcagtatatatatattatatatatatacacacacaaacacacacacacacatatgtgtgtgtgtatatatatatatatatatatatatatatacaaaacctaggcattaccattcaggacataggcataggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcgcaacctactcatctgacaaagggctgatatccagaatctacaatgaactcaaacaaatttacaagaaaaaaacaaacaaccccatcaaaaagtgggcaaaggacatgaacagacacttctcaaaagaagacatttatgcagccaaaaacacatgaaaaaatgctcatcatcactggccatcagagaaatgcaaatcaaaaccacaatgaggtaccatctcacaccagttagaatggcgatcattaaaaagtcaggaaacaacaggtgctggagaggatgtggagaaataggaacaattttacactgttggtgggactgtaaactagttcaaccattgtggaagtcagtgtggcgattcctcagggatctagaactacaaataccatttgacccagccatcccattactgggtatatacccaaaggactataaatcatgctgctataaagacacatgcacatgtatgtttattgcggcactcttcacaagagcaaagacttggaaccaacccaaatgtccaacaatgatagactggattaagaaaatgtggcacatatacaccatggaatactatgcagccataaaaaatgatgagttcatgccctttgtagggacatggatgaaattggaaatcgtcattctcagtaaactatcgcaaggacaaaaaaccaaacaccacatgttctcactcataggtgggaactgaacaatgagaacacatggacacagaaaggggaacatcacactctggggactgttttggggtggggggaggggggagggatagcattaggagatatacctaatgctaaatgacgagttaatgggtgcagcacaccagcatggcacatgtatatatatgtaactaacctgcatgttgtgcacatgtaccctaaaacttaaagcataataataataaaataaaaaaagaaacagatgcaacaactatatttccaataaaacaagacaataaaaataagaaatgagaaaatggcaaaaaaaaaaaagaatgaaatatgtcttttgcagcaaattggatagaactgggtatcattatcataagtgaaacaagccagggacaaaaagacaaatattgcatgctttcataagtggatgctaaaaattgtgtataaatgaatgtagaaagtggaatgattgataatggagacttggaagggtgagagggttagagcggagaggatagtgagaaattggttaatgcgtacaatgtacgttacttgggtgatgaataccttgaaagccctgacttaaccactatgtaatctatgcaagtaataaaattacaggtgtaccccatatatttgtacaaagaaaaatctgtatcctttcatgtgaattatctggagcttgaatgtgcagtctaatgtctatagcctcggtagttatgcctaccagaggtagcaattccaaacagataccacgggcttcatgttcatgtatgtttactgggagaggtcttgcaaattaatggaagcttgccactgctaaactgcctcccatctatttttaattgtaggcctccaccaaggtcatcaagagtcagttggagggctaggaagattaatgtggagctttcgaatctatcagaagctaactatagctctccttcctaaatatggggttatggtattttgtattaaaagaaatgctatggtatttagtatattaatgcaggagcctcccagctgcatgtttgtagagcttaggcctacagtagttgacaacttgccccactttgcatggctcatgaatatgtctggcagggtagtggatgtagccagaaactaggggactttctctctcccttgtgagtagtaaactttgggttaaaaaatgttcacatacctcatgtgcataacatatgtacttgtgtattttttctatttatctctctttctacattttcatagttcttcatctcaatgtttgcaagactccaggctacagactgtttttttttttgcagtaggaattaggagtcaaggcttaccaccatccatattagtcagagaaaaccattacttccagaaatgattattcttggaaagtggcatcctggaagtgtacttaatcttcctatcagtatacttaggtacttaaacaacaaatggcattatagaattttcaatattgaacatttaaaatgttacctatcttctccctgattgttccagtatatatatatgtgtgtgtgtgtgtgtgtatagtacagtacatatttccttgcacgcacacacacacatatatatatgcatatttatatgcacacagacacacacacatatatatatatgcaaggaaataaattttgtcctagggaactagagattagaaaaatttttactggtgtccattttgggttacctgtattgaaagagcttttgaaactcagctatattgaatatttatttataaaagaaaatagcagttcaatttttgttaacgattcctaagtaacgggtcagctccatctacttgttcaacaatgttgcagttaggacttaggtgaaatgtttggtatttaccaccaattgctcacagcctatatatggtttcaaaggcaacagctgctgccctcattacttccatctcttactatgttggtgttgtgtgcatttaactgttattataacttaacaatgtccttagataagcattaagacacaaatgcaatattcttttcaacttggtatagcatgcttcaggagacgcagttcgttcttcatttgaaagagaatgatgaactcttgttctaacacattttaacatgcatgcattgtgtcctgtagctggcagaaagtttatggaaacatttccattgaagactgatgagataattagctacattgcttgtaaactactaattgctaaaaaaacgttcaacatggtattccataatgttctcttgaaaaatcttcagcagacttttcttttagtgcatttgatattttcagcaaactcctcagtgtcaaccattatgaggtgtgcggatgattgggaagtacttaatatgtgtgcatagccattccaatttgagttacttgatatgctggacatatagacaagctgatttaagaaataacagtaattccagtttttaaagtatgagaaattctgtaagctgtgtaccatttactttgaagtataattcaaaggtgggagcaaagatttaatgcatgttaacaggttgatttgtaagtaatgagtcctagaaactaaaatgtggcctgaaatctcagctggtaaagagtctgaaatcagaggtgtgattcttatattagccatggctctgctctccttcacagctatagcgatggcaccacagcgtagccatttcataaatgtgtgcaaaggtaacagagtgacctaaagtttatgttcacagaagatgggtctgaaaattattgttgtgttgcacattctagcattaaagagtgcattaagctattgcagttgctcagggggaggaataaaaatcttaagaatttctgtccttgactgtttcttctcatccctttcttaagtttcaaaagaagtggtgttcctttttgctctttaaaactaatctttccaatcattatctggatcttagctcatcccttctcttctcttctcgagagacttttattctacaattacctttttttctgtagcatgttcatttaccttccttttcattagttctttcttcacacatattagcttgcccctgctttacaactggcaaatattcaataacaattccactttcttttagtctactcttttcttaaactcctaatcctgttttacctgacctgttctgcttggtgtatttgttgtttaatccaattacttttgaacaattttaattctcttcaactcctgtgctgcattcgacatttatttactcatcctgaaactttccgcctttcttttagaatattatatatgaaattcttctattacttccccacatcgtctttctctttcctcattgacttcttcctcttgtctctttttttagtgttagtcttggtcctctctgtcacttcttgtttcctttcctgggagagcttcttcattctcatgatttgaattacagttgctatattgacaacttttagttctcatgtaaagttccactgccaaattctgagtgcttctcaataatttttctacattaatacatagataatcatactcatctcactcccacaaataatggccactcttgggaatgtttgatgttcaacatactagttgaaactgttcatttcttccccagtgagtagtgacacatactgtggacaacattactgctgtaaccttttactaggtggttccacctggctgttttggtattacatactcaccatgtataaactgaactcagcatcttcttcacaaggtctttacaaactttgctatctctagtgtcatctgacttgaactctcagcatatttgacatagttgattattttctctttttgaaatactgtttccttgactaatggagcactgccagtcctggtttctttttcacatctttggtaatttcttttcaatctcctttttggttcatcattttcatactggccatccagtgctggaactcctcaaagctggttcattatgtgggatagatggaaagtgaagttggaaataaacttggaatgataaatttggaataaaccttggagatccttcaatggcaagataaggatgctggggcatccttacaaaattttttagtcaaacagtaacaggactaagtctatgttttaggaagatttatctggcattaatatgtggaagataggttacatctccacagtgcctctctaatattaatgatgataataataactacaataatactgatttgtatttatgtgtcttgatgagataatgcacataaggcaaataaggagactcaaatctagaaagaaaaaatgatttgcctagagctacctggttagttattcacagagttgggattgcctttcaagtttatactaaagaaatatttgttgactgtttgataattgtgtatctccatttccctttattttttctgtcatttaatatatgttactctggtcactctaagtatctttgaaattgcttgagaataattctctagtacagcctcaaactgtgatccttggaaaacaagtgtttctagaaatgttaagaactcttctgtaagaaaaacattaagtaaattcataaaactcaattaaaaattctaagcatgggttcattactagataacttctcagtcaacattcttaaaatgctgaattgtattgcaaatctctgcgagtagattataatagactatagtttatacaggctgggtgcccaagtagcagaacctaagatggaggttcttgtgcaactgatttactggagtcccgtcaagtgaaatctacgagggggtgagggaagcaggagagggcagagaagaagctgagagaagttgaactaaagcttggactgtacgggatggcaaacattgactgcatgtggccgctgagcacttgaaatgtgcagagtgtgactgaggatctgaatttctaattttatctaattgtaacttaaattttaaaaaccaatacttcattcagctattgaaaaactttaaattatgagtatgtgaatcatctttttcaactataagtttttatgacatctaaatacagatcaagtatttctgatgaaaatttagtatctgaattcagatgttttataagggtaaaatacataatggatttcaaatactttgtatgggaaaatgtaaactgtcaataatctttttatattgattgcatgttgaaatgatatattttagatatgttggattaatcaaaatacagttttaaaaccaattttacctttttttacattttaaatatttgatttttttctatttacttaaattttttttgtaaatgctaataatttttaaaatatgactaccaaaatatttaaaatcacatatgaggctcacattagcttttctactggaaagtgctgagctaaagtatagctctaactgatcccataggaggtctggagagtgaatcgcaccagaatgatctccccttaaggcaacaggtcagtcttttgtgtcccagggtcagccagtcattggttgatcctttatcccctcgaagcataacttccaggcctaatgcagtttggaattttcgagagattctttcataaactttaccaccagcctgttgtgtgctatattggatttgatgagaccaccatacaatcagtaagtctcaaaggatggaaatcaccaaactccattgattttctatgtaatattttatttcctaagatgtctgcctttctcaggcagttaagcatgaaactcactacacagaaatagcaacatttagcatatctgttctgatgcttgtttctgagttacctaagtgctaaacaactatcaataattttgatttctcttgagaaagacttctagattaggtgccccaaggagaattttatgatcgaaagctatgttgggccccagtagctcatgcctgtaatgccagtactttgggaggccaaggtagatgaatcacttgagtccaggagttcaagaccagcttgggcaacatggcaaaaccttgtttctacaaaaagtataaaaagttagcttggcatggtggtgcacacctacagtcccagctactcaggaggctgaggtgggaggatcacttgagcctgagaggttgaggctgcagtgagccgtgattgtaccactgtgctccagtctgggtgacagagtgagaccctgtgtcaaaaataaaagtaaaaaaataaatagaataaaagctatgctgctctcctacgccttttagatcgatgtgattatcatgacatcattacgaattggtgtatagacaatgatgggattaggatacagtcaattcattggcattcaaagaaatgggaaaagcccagtgtccctacgaccaacccccaaaaaaaatttcctcaaaaccagagataaaatttgcttcctctttcagtttgcaagcatgcagcctggacagaaaaggaagcaagtgcaaaacttgcttggagaagggtgactgataagtcttgaggtacatggaagagacaacattccatagcttatgttttcttttttcacccccttgaaatcagactatgagacagagaacaggtgccatctccctatcttatgtgaactgacaggattgaacacatattcccgggaatatctcagcactcctaaaaaataatttcagaaacatttgtaaaagctgaaaagaagaataaaacactggcatatgagatgaagacagaaggttagatagactacagaaaatcaagtattatattagataagaaagttgaaagtcaagtccttccctttccttcccttcccttcctctctccctccctcccttcctccctccttccctctctccttccctccctctatccttcccttccctcaacacttaatacattatcacaattaaaaatatattgtactatgtatcaaatgctgataatctcattaaaaataagttctgattactgacttcaaggaacttcagtataacttagttttaggaaagtaaatgagaataattatagcagatgaaaatgttcaagatgttatagtacctttaaatataaaagtgttaagagagtacatgtggaatggtaagaatgaagaaggctaattgataattttccaggagttgaagttcagttcagatctataaaaattttagatcaaaatatgcatatcataaaacattaaacagagcagaagagcttatgatgaaaagcaataatcttttgccctgctccttgctactttcaatccaacaccctaggaaaaacctcctttgcttccagtcccacaatctggaggaagcaggtttgattttagatcttctggtgcttacttcataactttaagtcgtatgcttatatctcttttctttgattgatttatttaaggaattatctatttactccctacaatgaaatatgaaagttttgttcccctacctctgtgtccttaccctttcttccttccaatgtttgataatttgaattattttttgttttattattatccctctgttttgtattctatcatttttaattagtgtcctgaccactctttgtgtatagtaagactaacagcatccattccacttcctccccctttacttctgcattccacctttcccttctgttttctgtcacttcaaattgtattcttacattgacaaggttgttaactttttttttttttttttttttgagacggagtctcccactgtcgcccaggctggagtgcagtggtgcgatctctgctcaccacaacctctgcctcctgggttcaagctattctcgtgcctcagccttctgacaagctgggactacaggcacccaccgccatgcccggccaatttttgtatttttagtagagatggggtttcaccatgttggccaggctggtctcgaactcctgacctcaggtgatccacctgcctcggcctcccaaagtgttgggattacaggcatgagccaccaagcctgaccaaggttgttaacattttaattctgatatgcaaccataatgaagtcatctgcatttgttcgttagctaatagtaaaagttgaaaatcacagtgcaccattaatgttactgtgactctatacattttatttagtacagggtgatgtaggatactgaaatcatatcttcttctccaaggacccaatgtcacaacccctgggccactcagaggggaatgatttatgatgaaggtcaaatagattctcttttctattgcttaaagttgtgctacactgatctagtttatgtttgggttatgcgtttcctatatatattttttgttttctctggaggttctgaatcttgatcatagcctaaatttggtctctctttcaatcataataactattttgtgaagtcttcttctttttttcccccatagagatatttcttctgaaaccgtatgtcgtcctttcaattgtgtgttttgagacatctctggattaggcacaccattttatttatcctatgtctttctgtttctggcattttccctctttcttgccataaaacagcttttctctggggccatactccccagataatttcctcaaattatgttgtgaaaaaaagccctcattttatgacttggggttaagcgttgagctgttggcaaacagtaatagagaaagtgacagggagcacagcatttcacatataggaattcaagtgatcacctcagttttcagacccactgctcatttctgccttgtatcatacttgcctactccaagccagagattctttggattctagtgggcagagtgactctgacatcctctgcagactcctcatatcatattctaaactgtagctttctcttcttgttttcatctgtcaacacccttctgttagctttccttcttcagaaggctctcagctactgttggctccccttaacaatcttgttatggttgtattcctttgctgtagtttctctatttctgtctctgtgaagtctggagaaagacttgattaaaagagctcggggtgccattttgaaaaggactgatacacccagtggacctcctagtcaagggaatggtctgagcaaagatagattagtagagttaaaaggattatggtaaatagttcacctgaaacagagaatgaatcaagtgaaagtaaacactttaggacttgctgattcaaagttgaacccacccttagacagaaaagattgcattgatatgtgaggaatcagggagcaaccttaagttcttaagcagccaagtgttattatacatagactttagcaggctgggcttagttatttaaaagcatgaagcttctgaaggccatttcctgggcaggtttctgtaaaaagtaaacagttgtttacttttacatttcaggtttaattttaagccttgaccttgagagtcatttgacctaagtaaatagatgaattatctgaagtatctgggaatttatttaactactttaaatggccacatacaaatataatgagaggaggcattattgtatagttgttaatagttttccttaccccctctactataattgttgtataaaatctaaagtttttagttccatgagtggtacacggtaagctttcaaaaattagtaattataagagtgttctcttgcattcagatagtttctttattttattttattttattattattatactttaaattttagggtacatgtgcacaatgtgcaagttagttacatatgtatacatgtgccatgctggtgtgctgcacccattaacttgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcaatagtttgctgagaatgatagtttccagcatcatcgatgtccctgcaaaggacatgaactcatctttcttatggtgtcatagtattccatggtgtatatgtgccacattttcttaatccagtctatcattgttggacatttgggttggttccaagtctttgctcttgtgaagagtgccacaataaacatacgtgtgcatgtgtctttatagcagcatgatttatagtcctttgggtatatacccagtaatgggatggctgggtcaaatggtatttgtagttctagatccctgaggaatcgccacactgacttccacaatggttgaactagtttacagtcccaccaacagtgtaaaattgttcctatttctccacatcctctccagcacctgttgtttcctgactttttaatgatcgccattctaactggtgtgagatggtatctcattgtggttttgatttgcatttctctgatggccagtgttttggctgcataaatgtcttcttttgagaagtgtctgttcatgtcctttgcccactttttgatggggttgtttgtttttttcttgtaaatttgagttccttgtagattctggatattagccttttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacgtgaaacacccatgcctatgtcctgaatggtaatgcctaggttttgtatatatatgtatgtgtatatatatacacacatatgtgtgtgtgtgtatgtgtatatatatacacacatatgtgtgtgtgtgtgtgtgtgtatatatactacattttctttatccattcatctattgatggacactgaggttgattgcatatctttgctattgtaaatagtgctgcaataaacatacaagtgaaggtatcttttttatatattggcttcatttgggtagatattcagtagtggatggctggatgcaatggtagttctatttttagtcctttgggaaatctccatacagttttccatagaggctgtactaatttatatttctaccaacagaatataagagttttcttttctccacatcctcgccaacatctgttattttttgtccttttaataatagccattctatacatcagtgaactgtgtgggaaaaaaaataatagctattctgttctttttgctcaggattgctttgactatttgggctgttttttggttctgtatgaattttaggattgttttttctaatcctgtaaaaatgatattagtattttgataaggattgcattgaatttgtagattgctttgggcagtatgttcattttaacaatactaattattttgatccatgagcatgggatgtttttccatttgtttgtgtcatctacaatttcttatctgtgaattctagtgttccttgtagagatcttttacctccttgtttaaatttatttctacatatctttttgtagctattgtaaataagatttacttcttgatttctttcttagatagatcattattggtgtataagaacaccactgatttttgtacactgactctgtatcctgaaattttactgaattcatttatcaaatctaagagtttttgtatggagtctttagggttttctaaatataagatcatatcatcagcaaacagggataatttgactttctcttttccaatttggatgccttacatttcttcgtcttgcctgactgctctggctaggacttctggtactatgctgaataggaatggcgaaagtgggcatccttgtcttgttccagttcttagagaaaatgctttcaactttttcccattcagtatgatgttaactgtaggtttctcgtatatggtctttcttattttcagggagattccttctatgcccactttgttgagagtttgtatcatgatgggatactgcattttctcaaatactttttctgcatctatggagatgaacatatgtttctttcccttgattctgcttatgtaatgtatcaggttttattgattggccatgttgaactatccttgcatcacgatataaaacccacctgatcatagtgatatatatatatatatatatatatatatatatatatacacacacacacatatatgcatatatatacagttgttatactttaagttctagggtacatgtgcacaacgtgcaggtttgttacatatgtatgcatgtgccatgttggtgtgctgcaccgattaactcatcattcacattaggtatatctcccagtgctatccatcccccctccccccaccccataacaggccccagtgtgtgatgttccccaccctgtgtccaagtgttctcgttgttcaattcccacctatgagtgagaacatgcggtctttggttttctgtccttgcgatagtttgctcagaatgatggttaccagcttcatccatgtccctacaaaggacatcaacccatccttttttatggctgcatactattccatggggtatatgtgccacattttcttaatccagtctatcattgttggacatttgggttggtttcaagtctttgctattgtgaatagtgccacaataaacatacgtgtgcatgtgtctttatagaagcatgatttatgatcctttgggtatatacccagtaatggggtcactgggtcaaatggtatttctagttctagatccttgaggaatcgccacactgtcttcgacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccattttttgatggggttgtttgattttttcttgtaaatttgtttaagttctttatcgattctggatattagccctttgtcagatgggtagattgaaaaaattttctcccattctgtaggttgcctgttcactctgatggtagtttcttctgctgtgcggaagctctttagtttaattagatcccatttgtcaatttaggcttttgttgccattgcttttggtttttaactcatgaagtccttgcctgtgcctatgtcctgaatggtactgcctaggttttcttctagggctcttatggttttaggtctgacatttaaatctttaatccattcttgaattaatttttgtataaggtgtaaggaagggattcagttttaactttctacatatggctagcaagttttcccagcaccatttattaaataaggaatcctttcctcctttcttgtttttgtcaggtttgtcaaagatcagatggttgtagatgtgtgtggtattatttctgagggctctgttctgtttcattggttgatatccctgttttggtaccagtaccatgctgttttggttactgtagccttgtaatatagtttgaagtcaggtagcatgatgcctccagctttgttcttttggcttaggattgtcttggcgatgcgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtgtcctcttttatttcattgagcagtggtttgtagttctccttgaagagatccttcacatcccttgtaagttggattcctaggtattttattctctttgaagcaattgtgaatgggagttcactcatgatttggctctctgtttgtctgttattggtgtataggaatgcttgtgatttttgcacattgattttgtatcctgagactttgctgaagttgcttatcagcttaaggagattttgggctgagacaatggggttttctagatatacaatcatgtcatctgcaaacagagacaatttgacttcctcttttcctaattgaataccctttatttccttctcttgcctgattgccctggccagaacttccaacactatgttgaataggagtggtgagagagggtatccctgtcttgtgctcgttttcaaagggaatgcttccggttttcgcccattcagtatgatattggctgtaggtttctcataaatagctattattattttgagatatgtcccatcaacacctagtttattgagagtttttagcatgaagggctgttgaattttgtgaaaggccttttctgcatctattgagataataatgtggtttttgtctttggttctgtttatatgatggattacatttattgatttgtgtatgttgaaccagccttgaatcccagggatgaagccaacttcatcacggtggataagctttttgatgtgctgctggatttgtttcacccttattttattgaggatctttgcattgatgttcatcagggatattggcctaaaattctctttgtttgttgtgtctcttccaggctttggtatcaggatgatgctggcctcataaaatgagttagggaggattccctctttttctattgattggaatagtttcagaaggaatggtaccagctcctcctcatacctctggtagaattcggctgtgaatctgcctggtcctggactttttttgtttggtaggctcttaattattgcctcaatttcagagcctgttattggtctattcagggattcaacttcttcctggtttagtcttgggaaggtgtatgtgtccaggaatttatccatttctttgagattttctagtttttttgtgtagaagtgtttatagtattctctgatggtagtttgtatttctgtggtatcaatgatgatatcccctttatcattttttatgcatctatttgattcttctctcttttcttctttatttgtcttgatagcggtctatcaattttgttgatcctttcaaaaaaccagctcctggattcattgattgttttgcagggttttttgtgtctctatttccttcagttctgctctgatcttagttatttcttgctttctgctagcgtttgaatgtgtttgctcttgcttctctagttcttttaattgtgatgttagggtgtcaattttaggtctttcctgctttctctcgtgggcttttattgctgtaaatttcccttacacactgctttgaatgtgtcccagagattctagtatgttgtgtctttgttctcattggtttcacaggacatctttatttctgccttcattttgtcatgtacccagtagtcattcaggagcaggttgttcagtttccatgtagctgagcagttttgagtgagtgtcttgatcctgagttccagtttgattgcactgtggtctgagagacagtttgttataatttctgttcttttacatctgctgaggagtgctttacttccaactatgttgtcaattttgtaataagtgcgatgtggtgctgagaagaatgtatattctgttggtttggggtggagagctctgtagatgtctattaggtccacttgatgcagagctgagttcaattcctggatatccttgttaactttctgtctcgttgatctgtctaatgttgacagtggggtgtttaagtctcccattattattgtgtgggagtctaagtctctttgtaggtctctaaggacttgctttattaatctgtggcctcctgtatttggtgcatgtatatttaggatagttagctcttcttgttgaattgatccctttaccattatacaatggccttctttgtctcttttgatcttttttcatttaaagtctgttttattagagactaggattgcaacccctgcctttttttgttttccatttgcttggtagatcttcctccatccctttattttgagcctatgtgtgtctctgcacaagagatgggtttcctgaatacagcacactgatgggtcttgactctttacccaatttgccagtctgtgtcttgtaattggagtattcagaccatttacatttaaggttaatattgttatgtgtgaatttgatcctgccattatgatgttagctagttattttgctcattagttgatgcagtttcttcctagcatcgatggtctttacaattggcatggttttgcagtggctggtaccggttgttcctttccatgtttagtgcttccttcaggagctcttttagggcaggcctgctggtgacaaaatctctcagcatttgcttgtctgtaaaatattttatttctccttcacttatgaagcttagtttggctggatatgaaattctggattgaaaattcttttctttaagaatgttgaatattggtccccactctcttctggcttgtagagtttctgctgagagatccactgtttgtctgatgggcttccctttgtgggtaacctgatctttctctctggctgcccttaacattttttccttcatttcaattttggtgaatctgacaattatatgtcttgtagttgctcttgttgagtagtatctttgtggtgttctctgtatttcctgaatttgaatgttggcctgccttgctaggttgtggaagttctcctggataatatcctgaggagtgttttccaacttggttccattctccccgtcactttcaggtacaccaatcagacgtagatgtggtcttttcacatagtcccctatttcttggaggctttgttcatttcttttcactcttttttctctaaacttctcttctcgcttcgtttaattcatttgatcttcaatcgctgataccctttcttccacttgattgaatcggctactgaagcttgtgcattcgtcacgtagttctcgtgccatggttttcagctctatcaggtcatttaaggtcttctctatgctgcttattctagttggccatttgtctaatcttttttcaaggtttttagctactttgtgatgggtttgaacatcctcctttagcttggagaagtttgttattcctgatcatctgaagcctttttctctcaattcatcaaagtcattctccatccagctttgttccgttgctggcaaggagctgcattcctttggaggaaaagaggtgctctgatttttagaattttcagcttttctgctctggtttcttcccatctttgtggttttatctacctttggtctttgatgatggtgacgtacagatggggttttggtgtggatgtcctttctgtttgttagttttccttctaacagtcaggaccctcaggtgcaggtctgttggactttgctggaggtccactccagaccctgtttgcctgagtatcaacagtggaggctacagagcagcaaatatggcagaacggcaaatgttgctgcctgatccttcttctggaagcttcatctcagagggtcacccagctgtatgaggtttcagtcagaccctcctgggaggtgtctcccagttaggctactcgcgggtcatggacccacttgaggaggcagtctgtccattctcagatctcaaactctgtgctgggagaaccactactctcttcaaagctgtcagacagggacatttaagtctgcagaagtttctgctgccttttgttcagctatgccctgcccccagaggtggagtctacagaggcaggcaggcctccttgagctgcagtgggcttcacccagttcaagtttcctagccactttgtttacctattcaagcctcagcaatggcagatgtccctccctgagcctcactgtcaccttgcagttccatctcaaactgtgtgctagcaatgagcgaggctccatgggcatgggaccctgtgagccatgtgcgggatataatctcctggtgtgccgtttgctaagaccattggaaaagcacagtatttgggtgggcgtgtcctgattttccaggtaccgtctgtcacggctttccttggctaagaaagtgaattccccaagcccttgcacttcctgggttaggcgatgccccgccctgcttcagctcacactccatgggctgcacccactgtccaacaagccccagtgagacgaacctggtacctcagttggaaatgcagaaatcacccatcttctgcgtcactcatgctgggagctgtagactggagctgttcctatttggccatcttggaacccttaatccagtgtaatatatttttgatgtgctgttgggttcagtttgctagaattttgttcaggatttttgcatctctgttcatcagggataatgatctgttttcttttatatgtgtcacctctggtttaggtatcagaataatactggcctcaaagaatgagttagggagaattccttcctcctcaattttttgtaaaagtttcaggaggattagaattagtgctttgtatatttggtacaatgcagctgtgaatccatctggtcctgggcttttcttttgggggagtttttttattactaattcaatattgctactaattattggtctgtttaggttttctattctttcctgcttcaatcttggcaggtggtatgtttccaggaatttctccatttcttctaggttttctagtgtgtgagtatatcaatatttataatcgtctctgatgatcatttgtatttctgtagttatcagttgtaatctcttcattctaatttctgattttacatgagtcttccatcttcttggttggtctagctagcagtttatcaattttgtttatcttttcaaaaaaccaaccttttgttttgttgatcttttgtattttttttagtctctaattcatttaattctactctgatttttgttatttcttttttcctgctaatttggggttttgtttgtttttacttttctagttccttgaagtgttattagattataaatttgtaatacttctacttttatgatgtaggtatttaatgccataaacttccctctcagcactgctttttctgtatctcacagattttggtatgttgtgttttaattttcatttgtttcaaaaaaatttttatttcaataataatttcttcattgacccagtggtcattcaggagcataatgtttaatttccatgtgtctgtatactttccaaagttcctcttggtattgatttctagttctattccactatggtctgagaagatacttgatatgatttcaattttttttaatttgttgtgactgttttgcagcctaatatatggtctatcttggagaacattccattgctaatgtaaagagtgtgtattctccagttgttgggtagagtgttctgtaaatgtctgtcaggtccatttggcctaaagttcaacttttctttattgattctctatctcaataatctgtgtaatgccaggagtagggtgttgaagtcccctaatattaccatattgctgtctctctctctttagatctagtcatatttgttttatgaatacgggtgctccaggattggatgcatgtatttagaattgttctattctcttcctgaattgatccctctatcattatataatgatcttgtcttttttatggtttttgacttaaattctgttttatctgatgcaagtactcctgcttgctttggcttctgttttgtggaatatctccccaccccatccctatttttagtctatatgtgtcttttcaggtaagtttcttataagcagcatatgcttagatcttttttaaattaattcagccagtctacatatttaagtggagcaggtagtccatttatgttcaaagttattattgatatgtaagggattttttctgtcatattgttaattgttttctagtttttaaaaaaattctttgtacccttctttttctcttattgtttatcattgtggtttggtgtaattctgtagtggttccatttgatttctttctcttcctcctttgtgagcttgctctaccaatgacttacacttttaatgtttttcatgatggtaaatgtccttttcctttcaagtttagtactctcttttttgtgtgagacaggctgtggctctgttgtccagactggagtgcagtggcctgatcacaactcactacagcctctacctcccaggctcaagtgatcctcccacctcagcctcccaagtagctaggaccagaggcatgcaccatgacacccagctaacttgtgtgtgtgtgtgtgtgtgtgtgtgtgtgtgtgtgtgtgtgtgtgtgtagagccagagtctcactatgttgcccaggctggtcttgaaatcctggactcaagtgatgctactgcttaggcttcccaaagtgctgggatcatagattggagccaccatgctcagcctaagttcaggattcccttgggaatttcttgtaggtctggtctggtggtgatgaattctcttagcatctgcttgtctggaaagtgtttatttctccttcatttatgagggttaatcttgctggatatagaattattggctgatagttgatttctttcagcactttgaatatatcatgcaattcttttctggcttgtaaagtttctgctgagaagtccactgatagtttgatggagtttctgttgtgactaggggcttttctcttgctgttttagaatgtgcctttcactttggctttagacagtctgattataatgtgccatagcaaagtcctttttgcattgtatttatttggggatcactgagcttcctgtatctggatatctaaatctcctgttatacttgagaagttttcatctattatttcattaaatgggctttctaaaccttttgatccctttttgcccttatgaacaccaataatttgtaaattcagttactttatgttgtgccaaacttctcaaaggctttgttcattccttttcatattttttatatatttttgtctgactggattatttttaaagatttgtcttccagttctcaaattcttttttctacgtagtctagtctattgtggaagcttttgaatacattttctatttccatcaataaattcttcagttccagaatttctgtttcttatttaatatctgtctccttgatttctcattcatattctgaattgttttcctgatttctttacattggtttcagatgtctcttgcatctcaccgagcttccttaaaatcagtattttgaattcttcatctgggattctgataatttcttttttgttaagatctatcttattattaattattaataattaagaattattgtgttcctttaggtttaggtttcctgaatctttacattgatatctccacatctggtgtaaccgttgtttctatttttgaatttactttttttcatggagggtgcttcttcctgaagctgtgtctctggtattgcttgggtggggccctttggctttgcttgtgtgtgtgtgcagtagtgaagtatgacttctttggctataaaccttagtggtatctgcggtttccttgatacattaggtaaagttattagtggagactgtattgaatttatgggggggggactggattggcagatggacctgtcgtcaggctttagtggtagtagtggtgggctaagcattaaagtatgcatgggtttgattagtgctgtgctccacctttgtaggcatcctggcttctctgagtagtatacaaaaagttgagccttaatctttccctgaacactcttgaaattttaagttaattatccacttataagttaaggaaccattatattcattttattttactaggaatctaaaaatgtgttagatttttagaaatctaacacatttttagatatctaaatctaatgagaaaactattttatactaatatcatttttaaacgtttcaagaagaaagaatctatacactttaagaattaaaagcaaatctctttactttttttcctgtctgtctcccactaaaatgttagtcagctcagtgagggcaagccttatctatctagttgacttttgcgagcccagcatatataacagagcctggcccacaaaaaggtttcaataaataattatttttaaaagagagaaagaaatgtaaggctctggggaaagacagatagtatacagataatacttatctgtattcatatgagggagattcactttcccctacttaataatggaaaatgaaagaactttggaaacactatttggaaacgctatttgattgctttttcctatgtgcctccacagcctttgttcataccattacagtgtcatttatcagacattattacagctatttgcatatctatttttcccaatatactctgggtgcccaggacatatcttatttatttttatatacccagggcccaaaatagtaccaaatataggcactaaatatttaaccaaaataggtaaacagtagacattcaataaatgtttgcaaattaataggaaaaaggcataggaaaatagtataaatagtttcttttgtgatcctcttctttctctcctaacaacacccactgttatactgactaatcacttcctttccataatctttctctctcattataaactcttatttctgattagaacaaatgctgagccaggcttattttatattccactattttttcctgttctttttatattcatcaaagcattaatgaaaaaacaagagaatgccttttctattgcaattaaaatctataattccatgtgaaaagtttttagtagttgaaagcaaaagctaaaacctggataactgagaaccttaccctctgtggggatctcatagtactactaagccacctttcaagtaaatttcaaccaagtttgctctacaactctaaatttgactgacaaatctttaagacttgttacacacagatcattagttatctttttccccaacaacaaaactaaataatatttttgcttactatttgtctctagaatttattctgaaagacaactcatgatgctaaaaaaatctcaaagtcaagttatcccagctaccataataatagatcatgtatcactatgctgactacactgtatacatttttctctatcttagaaaaaatattcctaaatgtttatgaatacaaaatatattaattatctgttacaatactctgttctttgcaatatcatgtataagcagcaagtatcatatactacattacatcacttttgcaaaactggttactcacataagccaaacaaagtactaaggctttactatcctaggggatcccaaagggacaggccatgtgtgtttgcataattcaaatgttttctgctttttaaaattaccattcaaatgtttcatttcagagaaaacatctcatcaagtacctatcttaaaaaagtctattgcatttctatacaccaccaccaccagaaatggaattgatctgagtcaagaaacatagccatgcatatatggaactttggcatttgacaaacgtgacataccaaaactgtttttcaaagtagttgtaccaatttacattcccacaagcaatgtttaaaagatcctattgcttcaaagtctttctaacatatggtattgtcagactttttaatttttgccagtttaattgcataaaatgatacctcatttgcatatctatctcactaatgaggacagacatctctttatattcttattgatgtcatgtgtatactcttctgtgaaattcttttcgggccattttccttttgttcattttgcttttctttttgatttgtgaaggttcgctatatgttcttgttacaaatcccttgttggatttataccaatatcttttctcagtgtatctttccattttcttttaaaaattttttgacagaacaaagttcttaattttgaagtagtaagatttgaattagtaaaatttaaactagttaactttgagctagtaaaatgtatgtcttttcatagctttttgtttcatgtttaacaaatcttgctctactcccaaagcgtaaaaaaaaactcttattttttaaagagtatttaaaattgtttttgacatttagatcctaagtctacctggagttgactttttgtctatagttatgagaagccaagtggtagagagactgaacaacaaagaagtcaaaagaatgttgcagctgattagaggaactgggcaaataattttaagccttttctcagcaagttaggaaggtaaaattggagttctgggcctacctaggaagaaatgtctagccaacattccacattttaaatggtactttaccaaactttaaaaattaattctataattttaatacacaatatccagcatccaataaaaaattatccaacataccaaagacaatattggatacttaagaaaccaaaaggaaaaatagacaataggaacaaacctacaagagagccatattacacaaattagatatggatattaagtataaatgagatgatcaagaaaaattatatcatgatgaaaatttcagcaggaaattataatttgtaaaaacatattaagtggaaattcttgaaccaagtaatataataaagattgaaacagttggattcaatgtcacatagacatagctaaacacaggattattaaccataatatgttaatagaaaatgtccagatagaagcatgaagagaaaaacaaatgtacaaaatacagaaaagagcataagagacctatgagacatgatgaaaaaatattaaatgcataatcataatttgaaaagacatgtaagagaagaagaaaagggatatctgaagagaaaatgatcaagaattctccaaaataaatgaaagacatcaaaccatagacttccaagtgctataaacccctagcaggataaataccaagaaaaccacatgaaggcatattataataatattactgacagcaacaggagacaaattcctctgcagacagggatgggtccccagtgaaacccaaccttcaagcaaaggaaagtctaaaacctgaaaatcgaactgccagttcagcattagagtccacgactggagtgagaactttcatccctatcttaccccctctctctcaactggttccttctgaatgatgtcttttaaccaattgaatggtgctttttccaagaccactcaaggacctatcagcatgcagtcccccattctaagcccataaaaaccccagactcagcctcacagccttacccactttcaggacccctctcattgctgagagttttctttctgtcactcaataaaattttactttgtcttactcaatctccaatgtccatgtaccttattcctcttggtctcaggacaagaatttgctgaactgctggagcaaaatagctgtaacattcctcctcaccaagctgggggcagcaggagtaaaattgctgtaacattccctcccactcaccaaacaaagggagagaagaagctgctggacaccactctcttccactcgccgaactatgggagcaaaaaagccacaatatttctaaaaacaaaagattttaaaaatggtttaaacaagtcagagaaaaaaggcacagtaccttcaaggaagttgcaaaatgacttatagttaatttgtcagtagcaacaatggaatccagaggcaaaagaataacctctccaacttgctttaaaaaagaaaaaaagaactgatttccaacttaaaattatttactcagaggaaaaaataaactcaaaacagaaagtggcagtttccactgctagcaataataagatagaatacatatgactaatcctctcacaaataacagacaaaatatataaaccaactactttttttaactttctccttccaacatttattttaggttcgggggtacatgtgcagatttgttacatcagtaaactgcatgtcactgggtttggggtacaaattatttcatcacccaggtagtaagcacagtacctggtaagtagttattcaatcctaacccttctcctaccctccacctttaagtaggccccaatgtctattattcccttctttgtgtccatatgtacccaatgtttagctcccaagtataagtgagaagatgtgatatttggttctctgttcctgtgttcattcactcaggataatggcctccagttgcatccatgttgctgcaaaggacatgacttcattcttttttatggctgcatagtagtctatggtgtatacatggtacattttctttatccaatccaccattgatgggcacctgggttgactccatgtcattgctattgtaaatagtgctgcagtgaacacatgagtgtatgtgtctttttggtagaatgatttattttcttttggatatatatgtaaattgctttaggcagtatggccattttaacaatattgattcttctgatccatgagcatggaatgtttttccatttatttgtgtcatgtctgatttctttcagcagcattttctagttctccttgtaaagacctttcacctccctgattagctgtattcctaggtattttgtactttttgtggctattgtgaatggattgtattcttgatttggctctttgcttggatgttattgctgtatagaaatgctggtgatttttgtatgttgattttgtatcctgaaagtttgctaaagttgtttatcaggtctaggagcctctgggcagagacgatgaggttttctaagtataggcttaaatcgtctgcaaagaaagataggttgaattcctctcttcctacttggatacatttttttttctttctcttgactgattgttctggctaggacttccagtactatgttgaataggagtgatgagggtgggcatccttgtcttgcaccagttctcaaggagaatgcttccagcttttgcctattcatatgctgttgactgtgactttgtcatagatggcttttattattttgaggtatgtacctttgatgcctagtttgttgagggtttttaaactgaaaggatgttgaattttattgaaagccttttctgtatctattgagatgatcgtgtgttgtcttttagttctgtttttgtgattaatcacatttattgacttgtatatgttgaacggaacttgcatcccagggataaggcctatttgattgtcatgaattagctttttgatgtgctgctggattcagtttgcttgtactttattgaggctttttgcatctatgttcatgaggtatattggcctgaagttttcttttatcattgtgtctctgccaggttttggtgtcagagtgttgctgacctcgtagaatcagggaggaatccctcctcctcgattttttgaacagtttcagaatgatgggtaccagctcttctttatatgtctggtagaatttagttgtgaattcatctgttccagggctttttctgattagcagggatttttttattactgattcaatttcagaactcattactgatctgttcagggtttcaatttattcctggttcattcttgggagcttgtatgtttctggaaatttatcagtttcttctaggttttctagtttatgtgcatagaggtgttcataatagtctctgagggttttttatgtttctgtgaggttgatggtaatgtccccatttttatttctgattgtgtttatttggatcatctctatttttttttcataatctaggtagtagtctatcaatcttatttgttctttcaaaaaacaaactttaggtttcattgattttttattttttaaaaaaattatttccatgagttttggaggaacaggtggcatttggttacatgagtaagttctttagtggtgatctgtgatattttggtgcacccatcactcgagcagtatacactgtacccagtttgtagttttttatccctcaccccacctcccaccctttccaatgagtccccataatctattgtatcattcttatgcctttgcatcatcatagctcagctcccacttgtgagtgagaacacacaatgcttggttttccattcctgagttacttcccttagaataatagtctccagctccatccaagttgctgtgaatgtcattaatttgttccttttatgtctgagtagaattttatcatgcatatacacaccaaaatgtgttttacgtctcaattttattcagttcagctctgattttggttatttcttttcttccattaactttgaggttgtttttctcttgcttttctagttcctctagctaaaatttagactgtcaatttgagagccttctgcctttttgatgtgggcatttggtgctataaactttcctcttaacactgctttagctgtgtcccagagattctggtacattgtatctttgttttcatttattccaaagtatttcttgatttctcccttaattttattgtttacccaaaagtcattcaggagcacattgtttaattttcatgtcattgtatggttttgagagaccatcttggtatttatttctatttttattgcactgaggacctggaatgtggttggtatgatttcagtttctttgaatttgttgagaattgctttatagctgagcatttggttgattttagagtatgtgccatgtgcagatgagaagaatgtatattctgtggttgggtggagtcttctgtagatgtgttaggtctattcagtcaagtgttgagtttaggttttgaatatctttgttagttttctgcctccatggtctgtctaattctgtcagtagggtgttgaagtctcccactattatagtgtggttatctatctttataggtctgtaagaacttgttttatcaatctggatgctctagtgttgagtacatacatttttagaatagttaagtcttcttgttgaattgaaccctttaacattatgaaatgcccttctttgtcttttgtcatcattgctggtttgaagtctgacttgtctgaaataaaaaatatcaacctcagctcttttttgttttccatttgcttggtaaatctttctccatccctttattttgaacatatgggtgtcactgtaggtgagatgggtctcttgaagacagcatgcagttggatcttgcttctttatccaacttacttctctatgccttttaagtggggcatttaacccatttacatttatggttaacattgatatgtgcagatttgatcctgccatctatgttgttagctggtgtttatgtagacttgattatgtagttgctttatagtgcattggatctatgtacttaagtgttttgtggtggctggtaatagtcttttgtttccatgtttagcactcccttaacccatttatacctgaggttgcaatttttttaatttttacaatcagaccttggtgatgaccttgagtagtaggatataaataattcccatatgcttattgttccaatgatggaacactaggtgtaaatgggttttaaggacctcttgaaagacaggtctagtggtaacaaattcccttagcatttgcttttctaaaaagggttttatttctcctttgcttatgaagcttagtttgactgaatatgaacttcctggttggaatttcttttcttcaaggattaagcatgctgaatataggcctgtagtctcttccagattctagggtttctgctgaaaggtccactattagcctgatgggattccctttgtagatgacctgccccttctctctagatgcctatagtactatttctttggcatttgccttggagaatgataattatgtgtcttggggatagtcatcttgtatagtatgtcacaggggtctctgaatttcctgtatctgaatgtcaacctctttacagagattggggaaatttttgtggacaatatcctcaaatatgttttccaaggcattctctctttccctctctttcagggatgccaatgagtcatagatttggtctctttacataatcccatatttctcagaggttttctccttttttgtctttttcctttatttttatctgactgagttgtttcaaagaaccatccttcaagctctgagattccttcctcagcttgatctattctgcttttaatacttccagttatattacaaaattcttttggtgagtctttcagctctatcagatcagtttggttctttcttaaaatggctattttatctttcagctcttgaatcatttgactggattccttagattccttggattgggtttcaactttctcccaaatcttgataatctttcttgccatccaaattctgaattctatgctgtctttcagccatttcagttgggttaaaaaccactgctggtgagctagtgcagtcatttggaagtaagaatacattgacttttagagtggccagagttcttacactggttctttctcatctgtgtgggttgatgttcccttaaatctttgagcttgttctcctttggatcgagctttttgcttttatattctttgatgcccttggtggtttgactgtggtataagttggatttggtcaactggcttcatttctggatgatttcagaaggtcaaggctcagctcatcacttctgtgctgcatgctctaaccctgtgggggctgggaccaagcccacagctttgttctctggccctgctacactggagagaccaagattttcctggtccactggcaacaatactctgatggagggtgctgacaaaagcccttcatcagggtggtgtcagtggggttcatgctcacatgtgtgcacctgcagcaacagggcagtggtagggcggtgggggctgtgcatgcacatgtgctccagtggcaccagggtggcagtggcaaggtttataggaagaggctgcaggtgaatgcacaccagcaaagtggtgggtggaagctgtgagagggtgcacactggtgagggcccatctgcaaaagttatctgacagttatattggatctaccagccaaagagttatggtggtggctacaggaaagtatatcagctgggcgtctgaggctgtactgcaagtggatgcagccagacagagaccttgggagaggctgggcagacagaggagcactcatcagactggctccaccctacagttagatagccctgttctgtctagatctgacagttaagaaaggccaaaaccacctagaggagtatggcaagccttgggggctgggcatccctggccatgtgccactgtgatcattcttgttccaaaccttctgggttccatgcaggctggattcctgtctttgccagctctccaaacagctctccttgtcagttcaaatgtctatggggatcatggggtctcctgcacctaggattcttgaggtccctggtgagagcaggccactctatgcctatttaactcatcccttccctgggagcctctcagggccaggaatgagtcctggtgcttggcaaccccatgcagggttcccaacttcctccccccttcagcccaggatctgcattctccttccaaccactttcaatgccttccttccgaagtactgttcagaatgtgctgattttgacggtgtggtctcttggtgggagaagctcttcctgaaccctgtagtcagctatcttggctcctcccaaaacaactatttcaaggcacctgacaaggacagaaagaaaaaagaaactggagagaatttgactcttgaaatactagaaaccgtagtggttgagagttacatttatatggcatttcctgtaagtacactctccactgggacagcatagggcagttagaactcaagtagaaagctaccatcttactgatttaagatgtcacaggacagagtctgggaaaggacagaatgagcaaaaactgaaggtaaaaaaatctcataaaagagaaaactacagactggggagccctaaaggtacacatgaatttttctaaaattggggagatgctgaagaacccaatagaaaccaatactcataaggaaaaaaaataaaaataaaaatctgtgctgtgatttcaattgctgcccatttcatttcaggaacaacagagtttaaagtttgaatcctgcaagttagatgggttttgtaaacacatcaaactgtccactgaaactccaccaaggccacactatagaataaaagactatgtcccaggactaagaattctctgtaagaataaaaaccgaatcaacctgttaaaaaggctacacaaactcctggttattcatcagtaatttaaccacctgctgaagtaaaactcaacactcttccaaggaaaataaaagaatccgaaacatctctttctttttccatctctaccatttcacccaaacaagaatccaaaatacttatagtctattttctatgctgtcaagtatataaccaaaacttactatcatatgaagaaacaggaaaatgtcacccatagtaaaagaaaaatcagtcaacagaaacaaaacccagttgtagtcagcaaataaagggtgtaatgcaactatcataaatagattttaaaagaggctagtcctaatggatgaatagataggacatttcaggaatggaaactattttcaaaaaacaaatgaaaattcaggaactaaagtaaaaaaaaagttcactggatggattttaaaatagactggagagggcagaaagaattattgtgatatatttaaattaaatgttataaagtaccatttaaaatatcagaagatatgaaatacttggggacaaatttaataaaatatgtgcaagatttgtatccacaataaatgtagagatatataccatgtttttaatcagaagactcatcactgttaaaatgtcagttcagcacaaattgatccatagatctaatctagtcctaaccaaaatctcagtggacttttttgtaaaaattaacaagctaattctaaaatttctatgaggttcaaggcacctagaataacctaataaaaataatttgtatttcaattactatgaggtacagtaattaggactattgtggcattggtgtaagaatagatatataaatcaaagattcatattcatgtaagagcacctaagtagacccatacatatatggtcaactggttttcaacaaaggtgaaagagtaattcaaaagaaaaaaacagtttattcaataagtggtactggaaaaactaaacatctaaatgcttataaatggtactggagcaattaaatttctgtatttcaaaaaaaatatgacctctaattcacacaattcataaaaatttattcccaggtagattataaaacaataaagcttccagatagtaacgtaagaaaatatcttcttgactttgaagtagttatgttaacaaagtttttttttaacagaacataaaagtctctacccataaaggaacaaaataataatttggaatttatttaaattaagaacttctgaatattaaaaaatggttaatattatgaaagggagaagatatttgtaatacctacaactaacaaaaggactcatatctagaacatataaaaagttatcacagaaatacaaattaaaactacaatataataccactacatacatttgaattaaaaacactgacacttgccaacaccaagttcaccaagttcacaagaatgtggagcagttggagctcgtattagaaaattcactttggaaagctgtttggtaatatctactaaagctgggcatatgtataccttatgacccagaaatttcattcctaggtattagtccaaaagaaagtctacattaatgcactgaaagtaatacacaaatgtgtatataatagcaatgctcattaaagaaaaaaccagaaataattcaaatgttcatcagcaatagaacagatagataaattatggtttattatcaatgaatgaatgaactactacatggtgagctctcacagacatacaacattaagcaaaagaaatcagacacaaaatacaacatactgtatagtctcagtatttgaagttcaaaaagaggcaaaactcacctatggtgttagaagtcaggatagtgacagagtagtagctggtagcggggacaaggggccctcttagggttctaataatattctatttcttgacgtgggtggaggttacatgagtgtgttcactatgtggatatgtattgttgttagagataatgtgtgcacttttctgtatatatgttattcttcaataaaccatttaaaacattaaaaataaccacttgtgtggcttagaacagttgtccccaaccattttggcaccagaaaccggtttcatggaatataatttttccacagatggtggatggggggaatggggatggtttcaggatgaaaccattccacttcaaatcatcaggcgttagagtctcataaagagcacacaaactaggtccttcacatgcgctgttcacaatagggctcacactcctatgagaatctaatgccgcagctgatctgtcaggaggtggagcttaggcagtaatgctcacttgcctgccactcacctcctgctgtacggcctggttcccaataggccatggaccagtaccggtccacgacccagggttggggacccctggcttagaagcaatgtctagagattttagggtaatagaaactatataaaggtagtatatatgctacaggcaaaacatgtaatctagacattataaacaactcttacctaattcctgggtaactgctatacgaatattctaaaactatttaaagaaaatgtcaaatttaatactttgtcattgtattggtagtgtaggagtaagccataagatcatgagtaactataagtattacttacaatgtgaaccacctctgctgaatctctacacttctacccacatactacacatactacctttcctttcaccgtctctcctttatactacccctgtttcacctttcatgggcaggttctttaggtaaccaaaatacccacattatttatcacttcaagtctgtaaataaagccacggatagcaataaaacagaatcttgtagtaaggctacataaattatagtatgtctttattggaaggaaaagttttctaaattggtctcaaaattcttaaaaataagtcaataaatatataataaagctatctgtactctcaatatattttcacttttccaaatactttaaccttattagttgttcttcattagtccttcaccttatgccactggacaaatacctttaaaaaaaaaaaaactcaaagcaggaaactacttaaaatatgtttcaagtattttgtagagtttattggatcagaatccattcttcttatacttcaaccccaccactgagcttaaaattccttccaagcttttgggaacagtgctttcactgtcactatccctactatccataggataatcattggctgttccccaaattccagaacgatgtgccattgcattgctttcctcccacactgaagttgctggcggtagctcattttggcagtttgtcaaataaatcacacagtaaagcatttggtgatctttaaccaaatgaatctgttgtgtatacagcatatgacatgtagaggtatttcacacattataatagaacacagtgaaggatataccctgtacagcataatcctagaatcaagacttctctttgagaacttctctttaaaataacatcttttttttgaactaaaaagattaacttacttaaaaacaaagggaaataccatctcatggcaattattgttcccttctgagaatgactgatgacgtacatacttattaccagacagtttatggaaactatgttgtcaaatagatcacattttcctacagaaacaatgtcaggatagggctcatatcccttaccaaagaatcaacagagaaactataattatgagagttaattttccgtaaaagcaaagataagactattacaaaattttataatataaagtgacaaaaggatgcttcaactttttaatttatttaacaaacgtttaacaggtgtctgtgatgtgtcaggcattggtaatcaaataacacttggtacctgccacgctcaataaattaactaacagtcatgatttactaaacaagtacatcaatgtttactgtatggggtggttagtgtcatgaacgagaggtgctcagtctgtaaggacacagaagacagtcatctaaatcagcatacggggtcagtaaacacttcctggaaaagatgacctgggctcagctttgctacatgagcaaaaactggctgaattagaaaagcaatccaagtgacgggaataaggtcatgttttgcataacaacattttggtcaacaacagatgcgtacatgacggtggtcccataggaatatagtagagtcgaaaaactcctattgcctagtgacctcatagccatagtaacattgtagtgcaacgcctgtgggttttggtaacacttccagaagaaggcattgttatcacaggagatgaaaattcccatgcgtgttattgcccctgaagacctttcagtgggacaagatatgaaagtggaaggcagtgatattgatagccctgattctgtgtaggcctaggctaatgtgtgtatttgtgtcttagattttagtaaaaaaaactttaaaccgtaaaaaaaaaaataattaaaaatgtaaaaaagaaaaaaacttatagaataaggacataaaaaagaaaatattgtgcagctgtacaatgtgttttaatctaagtattactacaaaagagtcaaaaagttaaaaattttttaagtttataaagttaaaaagttgcagtaagctacggttaacttattattgaagaaggaaaaatatttttaaataaatttagggtagcctaagtgtacagtatttataaagtctacagtgatatacagtaatgtcctaggcattcatgattccctgactcactgagagcaacttccagtcctgcaagttccattcatggtatgtgccctacataggtgtaccattttttaattttttataccatatttttactgtgtcttttctatgtttagatatacaaatacttaccgctatgttatattaataattgctggcagcattcagtatagtaacatgctgtacgagtttgtagcctaggatgcctaggtgtgttgtagactatgccatctaagtttgtgtaagtacactctatgatgttcacacaatgacaaaatggcatatggatgcacttctcagaacatgtccccattgttaagtaaggtatgactgtagctgataacacatgcacagaggcataaagcaacacggaacattcaagaaactgcgagttcctgtttggaggaacatatgagggaggtgcatcacaggaaagaggtgcaagataatggtagaagccaaatcatgaaatgctttgggaggtaggtttaaaagtttgaactttattgaaaaagatagtccccctgatcctccaacagctactaaaaatgattttaagcagagaagtaaaatgagcatattttcatttttaaaagatctatttgattttactatggaggaaggctaatgcaataatcctgaattcatgaagcaatgttaggaatagagtagaaggaacagatctgagagacaacaaggagaaaaaattcattgaacctgactgataaaagaatctgtacaccaaacccccatgacgccaatatgacaaacctgcatatgtaccctgaacctaaaataaaagttttagaaaagtttttaaaagttcattgaacttagacattaattggaagagagggtggaatgaaaggaagagtctaaactggcttggtgactaagatgatgatcaagaacaaggacaaagagagggtctcagttggtagggagcagggaaaaacaacaaatatatttcaaattattttgcacattatgttttctatttattgtctgaagaatacctataaaatataaattgtatataacatacataacaaagtgtagccattttggaaaacagtatggaggttcctaaagaaattagaaatagaactaccattaagagccagcaatccctcttctgggtataacactgaagtaaaggaaatcaccacttcataaagatgcctgcactcccatattcactgtatcattattcacaatagtcaagatatgaaaacaacctaagcatccatcaacagatgaatcgataaagaaattggtctatatatacaaaggaaaaaaggagaacctgtcatttgccacaacatggatgaaagtgaagaacatcatgctaagtggaataagctagacatagaaagaaaactattgcaggatctcacttatatgtagaatctttgtttaagaaagtcatacagagacagagaataaaacagtatctaccaggggctgggggcaggagtgaggaaatgggtcagtgcaaatcaaaggatacaaagttgcagttatgaagaatgagctctagaaatctagtacacaacatgaagactatagttaataatgctgtattcaggatttttactaaaggagtagatttagatgctcttgctacacacacaaaaaaatgggtaactgtgagattatgaatatgtcaatttactttattacagcaaccattttactatttatatgtatttcataacatcatgttgtataccttaaatatacacagtaaaatttattttaaaaataaattcacataaatacaaaaatttttttttttgagacgaagtctcgctcttgtcccccaggctggagtacaatggtgtgatctcggctcactgcaacctctgcctcccaggttcaagcgattctcctgcttcagcctcccaagtttacaggcgcctgccaccacacccagctaatttttgtgtttttagtagagatggggtttcaccatgttggccaggctggtcttgaactcctgacctcaggcaatccacctgccttggcctcccaaagtgctgggattacaggcatgggccaccgcactcggccaaaaattttttttaaatcccctgtatcatacatgtgacataaagcttattgttactagtatattcattttaattatttaattagcaaaggcttcctgattttcttaaagttacgttgggggattgagggagaaaaatatttaaaaatcccaagtctcttttacaaagctgaacaagaaaatttaactttccttttcctcccaaaatagatacttgcagaaagctgatatatacgaaatcattccactaaccaaagaatattcagcaattattttaaactgtcctacagttgagacctatattcattagaaaattgctgtattatcataagtaaagatctcaaaaagatgaaatatatgcttttattatgtaatattaacaaagcagcaacttggctcattcacagtttatgcaaagcattttttgaaaagtttaggaagtctaaacctccagaaatttgcaaggttaaaaatgtacttctgagatggtcaggtctgaaacttctatttcccagctgttttcaaggaacttcataatttatttatgtatagacaaataaatcttcagcttcattagtcatttctcactatattctaagaccaaaaaagggtactcttctctttgtttattatggaaaagctatggcaaggcaggggaggaagaggaattgcctggggggaccgagcaactaaaaagaagagcctggagtgggactgagccttggagctgtctaatgagccactctgcctcccacagctagctcctcacagctctgcaaaagactaaaaaactggagccaacaaaaacaaaacactcacaaatctaatttgggtgactaacaccctaaagatatgcagtttgctcctgaccaggattggagtactcactttctttgcgaacttcctcaagtgaagccgtaagctcatcctttaaaactgtagcttcctgggcaatcttctctcccttgtctaataaattccaagttgcttcctccacagaagctagaaggacactggctcttttcgaacgtccttttttcctgctggaagggttctggggacagtttacaagtgtggtaacctaaaattggaaaaatacaaagtactaaattgacaaattgtaaggagaacacagtcctgggatattacagaccagaacaaaagacagtacagttgacacttgagcaactcaagggctaggggcgccaacccaccgtgcagttgaaaatctgagtataactttcaactcctcaaaaacataactacgaatagcctactgttgaccagaagcctgataacataaatagtcaattaacacagattttgtatctgtatgtactatataactatattcctacaataagatgagctagagagacgatagtgttatttgttattaagaaaatcataaggcagagaaaacataattaaataaatcaacaagtagaaatggatcatcataaaggtcttcatcctcatcatattcatattcctgaggaagatgaagaagaagaggagggttggtcttgctgccttgggggtgtaagaggcagaagagatggaggaggtggaagggaaggcaggagaggcaggcacacttgatgtaacttttattgaaaaaaaatctgattaaaagtgaacctgcatagttcaaaccagtgttgttcaaaggtcaactgtatttcatagtaacatgactcatttccagtgctgttggtacacctacaaaagtcaagtcatggcaccaagaacagcaacagcagccaccgtggagttcccaactaaaaataggaaggaagtgggagtcttagtgattgaatttcaaaatatagacattaaaatgtcctctcttcaactaccccagtcatcaaatcatttctatgttaaatatttactgaacacctattttttacattgttctggatgatggaaaagaaatgcatttcatgctttcatggagtttacattcttaatatcggcagcatacaataaacatataaacaaatttaaaaatgtaaggttcagtaaatgttttgaggaaaaataaagttggcggagggaatacagtgagagagagtggggatcggggtggtcaggaaaggcctcttgacaggggactttgagtgagacctgtttgagaggccaaatgagttaggggaaagggtagaagacagatctgaaaggttacaaagggcaagaaagtaggtcatagtaaggatttggactttgtcccctgaagcaaccactgttctatatgattcagaatgtttctccctctcctaatattagttatctctattctcagcctaaatagactaatactgacttaattataattatttttggctccctcttaatgtagattgctggcttaaaagtggtataaattttattttataattatttgatattttggagatacataattttctactctcatttttgactgttttatcaaagttctgtattttttatatgaagtttctgtaattaaaacaatacacacatacacagccttctagagcattcttcgagtagcaaaacttgaacaaactcctcaccacaagtatatgaagtgagaaatgtgttaattagcttgatttaatcattttacaatgtatacatatatcaaaacatcacagggtacaccataaatatatataaattttattcgccaattttaatttaataaagcttggggaaaaaaagaaagaaatgaatcttaacaaatacaagaacaaactcataataagaacattatttgaagataaaaattaagcttctgtatttggaaacaaaaacatcatactgaattacattattaaaaaacacccatttctggccaggggcagtggctcatacccataatcctagcactctgggaggccgaggcgggtggatcacctgaggtcgggagttcaagaccaacctgaccaacatggacaaaccccctctctactaaaaatacaaaattagccgggcatggtggcgcatgcctataatcccagctactcaggaggctgaggcaggagaatcgcttgaacccggcaggcagaggttgcggtgagccgaaatcacgccattgcactccagcctgggcaacaagggcaaaactctatctcaaaaaaaaaaaaaaaaaaaacaacccatttcttaattaaatcttggatcacaattacaagttttggattaaatttttataaacaaagctttaaaatcaccatcgtagaggaatgagagaaaggaaaaaaacaacttgtatctaatatttaaaatagaagacctgaaactcctcttgaaagctaatctgctgcatgtcatgaaacagtggaggctcatgataatcatgcatcacatctttgacagcaaactacataatgcttcctgctcagtagtccctagagattttcgttgttgtttgtttatggagcattcgatgtttgtttacttggatatctggacccagtttttatccatgaactaaaaaaaaaacttaagaagttatgggggaaatatgcggatgaaaatcattttcatctgccctcctaccctcctccccttacccaatagatcctctgtttcattctaatttgctttatttccatgttcatcacccagagtggaatgtcttgtggcaggcctttgtttcctctcttagaaaataaaaacaatcattgttatcctacaagactggggaaggtcaaataaggtaaagtattttggaaaatgcataatatgacacaaatatttgttggcatttcatgtatattttctagtttgttccccatgtaggtgcagaaaattggttataggaatctttaacaaaggtattctctctggatctaagtttatcttgctcttggggccccccatgctaaatgtggcagttagcaaagctcattctatatgctttacaagcagctaaataagatcatgtgtcttcatcatggattatataagaataataataagcctgatttattacatgggttttcacaaattccaaaaggcaaatatctcactcttgtcagtctaatttatatattgagagttgaaaggtatttgtccagattaagacaaattataactaccagtttaaaatctttgtttaaaacaaagaataagtatcattgtctgaagtgttccctcggaatgtattttaagtgctgcaattcatgatgcttcccactgcacattcctcctctattgttcagatcctccatgcgccaaatgttttccatagaatagcctgggctttgaaattaaaatgagcgttccagaaatgctttgttccttataataaatgccagagaagtaagaaatgtgaaaagaactttgtataagaacatcatgcttccatcaaaaaaggcaattgcaacttgcaagttattcacttttataagttgtttgtacctacgtcttcttttaaaatactccaatacagttatttgatattgattaaactaaagtcaagtgaggttttcaatgattccttttatttcagaaagtaaatatggcttggcaatcctgtggaaaaaaagaaagctgaaactattttttttaaccctaactcacctaagagatttaacttactcctatcagtgactgtgactcaccatagcagatgattctcaccaaggcggaggataggagggcgctatttgaaaaggtctcccacctcttgaaggaataccagcaaccagtaaaattagctttcaagttatcctgtaaaataaatcctgtgtcctcattttctttttcagtactaaatcagttatatttctgtaaggaagtttagttggaacaacttgcaacaaagatgattctaatgtagggtttaagcccatgtcttgctaactttaccttttgccatagatacaaaaccctcccattcccctctttctcagacttcaggggtccctctcatatagaaaatctccaagcttgcagcattagagagcttgggtttgcttactttctttagtctgtaaatctgtgctaggctataaagacacaccttcatcgtagatacaggaaggaacttccatgggaatggtgctaaattaaaagtttcaagtaatttataaagaagaaattcccactctattaattctgcaagtttaacattccacaaaaccggacatattttcaatggtgtgtaaaaatatttatatattaaaattaagagtataaaaaaggtttttatagattttccaaatttaggtgtgcttctctaaatgctctaaagatgctgaaaattaaattgataagcttaatgaaccaagccatcaactgtcattatatagagccacactggcacacaatatgaacactgtagaatatgttgacttttttttttttttgagacggagtctcactctgtcgcccaggctggagtgccgtggcacgatctccgttcactgcaagctccgcctcccaggttcacaccattcgcctgcctcagcctcccaagtagctgggactacaggcacctgccaccacgcctggctaattttttttgtattttttagtagagacagggtttcaccatgttagccaggatggtctcgatctcctgacctcatgatccgcccgcctcagcctcccaaagtgctgggattacaggcgtgagccactgcgcctggccgtgaaatgtcttttttaatgccaacttgggtaacacaattatattctataaccttgttccttcccaatatagttctgattttttttaattctaccctcattgtagtataaaaaggccctgttaacagccatctcttttcttgtttattagctaaaacactttgaatttcaaccttcctccaatagctcacaggagccttcagggctacttttgctcccttgagttaattttaatgtatgaaataaaatataagacatttaagctatgttaattagctaaaacttcaacagggttctgaaagaaattagaagggtagaaaaataaaactgcctatagataagtaaaaactgtgatctttcaaagtaaaaggtacaaaccagtctcggggaggagagggggtgtcccttcttcaagtcattgataatttcaactattcttttacttctaccaaaacaacccttactggattaacaaaagtacagaggaagattaaagggttgagaacccaaaaaatgcctctagataacattcaacacccccccaaaccaacttcaatcttcttttagttcctttcaagccaataaacacttatattttgttcaaaataataccctaggcattcaggaaataaatatgaataagctccaatatggcaataagagaaatacacaactagttgcaacattaaaggcagaatgataactgtttacacttatataagtacaaagaaagtgctgccaaaattgcaaacattcacaaggattaagtaggacttccaagaagagcctttaagaacagataattttctaccagaagagataaaagggaggtatgtaagccagggaaagaaaattgtgtgcaaaggggcagagaaaaaaatttattttgtctgaaaatagcagatagccaaacttagcaaactgtggggtaaacacaggcaatagggtgagaaggccaagaaataggtttcatcttaaataaaaagttataaaagtcaaagaaagagttaatatttaatgtaataggtgatagaaaatgaaaacacagcatgcccaaagtagagaagcctttgcccatcaacctgcctctccaccatctgtattttttacctcagtggctaacacctctaacctgaagcagaaacccagaggtcatctgggctagtctctctctcatcttcctctccaagtccttgtcatccaagacacagaaacggggcatcattctctgccccattcaccaatctatcattatgaaaagtgtgtgcaatgattctgccctcgttgaatctttcatgaagcgtcttctgagaggtctcactgcctctgcaccagccctacattcccactagagccgtctcttgaaaatgtaaatctctcatatttgcactacctgtaggctacctgctgcctacaagcaaagtccaaactctttagcgtagcttttgaggcaattttgatctcactgctcactaaattttcattctcatcttctatctgtggaatctgaccacaaactacttgttaggctcagaacaggaaatgttcagcaacctcaacctggggtgactccctcccctcacagctccttgttcgtagctcttgtatcactcattatactgtcttgtaattagctgttcacatattgcctcctctgctctaccacgaactcaataaggacaggggccgtgcttgactcatcctgaaaacacagagccagcgtactgtgaaaaataaacaaacagtggtttactggatgaaaaaaaaaaaagaataaaaccctacattttagaagcctttaaatcaagagtcacaatgttcagtgattcatacgaggttaccaaaagaatgggttgctacagcaaaattaaagtttagtgataacacatagcagctttcattaaaaggaagtccttaatgtgggattttctgccatatctcctgtctagtttagttggggtctgatcagttcaatgtaatctaggatcaagtatattatatccagtctttttttgccccccccaacaaagacacgttacataattcattttcaaactacaaataaaaagagctggcacatcctttttattactgattttttcatttttttcaatccttgtgttagttttctagggctgccataacaaaataccacagactgggtggcttaagccacggttccccaacctttttggtaccagagacccattttatggaagacaacttttccacagacccaggggtggagtgggggtagacgtttttgtgcccggagttggttccttctggtgggttcgtggtctcgctgacttcaagaatggagccacagacctttgcagtgagtgttgcagctcttaaagatggcatggacccaaagagtgagcagtagcaagatttattttgaagcgtgaaagaacaacacttccacagcaaggaagcggaccctaccaggttgccactgctggctggagtggccagcttttattcccttatttgtccccgcccatgtcctgctgattggtccattttacagagtgctgattggtccattttacagagcgctgattggtgcattttacaaacctctagctagctgcagagcactgattggtgcattttacaatcccttcgtaagacaaaaaagttctccaagtcccctacttgacccaggaagtccagctggcttcacctctcagtttcaggatgattcaagtggattacatttattgtgtactttatattattattacattgtaatatatatgaaataactatacaactcaccataatgtagaatcagtgggagccttgagcttgttttcccacaactagacggtcccatctgggggtgatgggagacagtggcagatcatcaggcattagattctcataaggagtaggcaacctacgtcacaataaggttcactttcccatgagaatctaatgccactgctgatctgacaggaggcagagctcaggcagtaatgcaagcgatgggggttggctgtaaatacagatgaagtttcttttgctcacccacccactgctcatctcctgctgtgtggcccagttcctaacaggccatggacatgcaccagttggggtactcaactggtactggcactggaggcctaggggttggggacccctgggttaaacaacagaaatttattttcttacagttctggaggtcagaagtccaagaccaaggtgtcaacaggtttggtttctcctgaggccttgctccttggctatcagatggctgtcctctctctgtgtcctcacatgtatgcacacaacaatgatgtctttccctgtacatcctaatctcttctgataaggacaccagtcatattggattagggcccacccaaatgaccccattttaatttaattacttctatatccaaaggccctgtctccaactacggtcacattctgagaaactggggttagggcttcaatatgtgaatgttggggttggaaatggcacaattcaatccataacaatctttaccacaagtgatacaaaaagtgtaaaataaccataacctttttaaaaatataatttagggttttgtttgtttgttagataaacaaccactgctaacataagccattactccgaactattgagggacagtaacaaagcacatgtagatccctctccaattccaccagccctctgtgccacacagatggcataacaaagcaaagagatttacgtgtcaaacacataagcagttgtagctaaatatcctaatccaagaagtgcacttactcctggataaatataaagctaaacacaactaggaaaagaccacatgctgagaataataccaaattagtttcttctagttttcacttaaccacttaccatccaaaaacaaacgagtttggactttaccattcatttattcaacaaatattgatggtgcacctacactgtgccagaacatggcaatgagcctcattctaagaaggtgggggaacagagaataaacaaatacataagtaaatgtgtaacacaacggcaggtattctttttttttttttttttttttttgagacagagcctcactccatcacccaggctagagtgcagtggtgctatcttggctcactgcaacctctgcctcctgggttcaagcgattctcgtgcctcagcctcccaagtagctggcattacaggtgcctgtcaccacgcccagctaatttttgtgtttttagtagagatggggtttcacccatgttggccaggctggtctcaaactcctgacctcaagtgatccacctgcctcggcctctcaaaatgctcagattacaggcgtgagccactgcacctggccaatagtaggtattgacagatgctatgaggaaagtgaaaaagggtaagaaaataaagagtgaaagagaagagctagtttagactgcatattagggaaagcatctctgattaagtaagaaggatccaaggaaacagaagaataagacatttaaatatctggaggaaaacatcccaaacagaagaaacaggcgcaaaggttccaaaacaagagcttgactgttgtattccaggagcaataggaaggctggtatggaggcaccaaattgtgcaggacttgtagatcaccactaatgctctcaattctattcttatgactggaagttactgaagtgcttgaaacaggaaagtaacatgatctgaccccaaattttaaagcatcattctaaatgctctaggcaaaacagactagagacagctctatgcaaaacagactaggcaaggatgggatgaggaatagaagaagggaaagcagttaggagtccgttgctgtagcccaagtgaagaccacactggcttctttgaggaagcagtggcggagttaagaaatgacaaaattttggtatattctaaagtgtcaacaaggtttgctgacagattgaatatgggttatgaaagcaatatggcatcaaggatgactctggcatctggcctgagcagctgagtaaatggaggtaatatttactagttgaggaaagtaaagggacatgagtaggaagggaaatcaagagttgatggattaccatggcattagccatgttaaatttgccttttagagtttttaaagtggagactagtatacaattctggaattgaaagaggtaaaagttggagatatgtttcgtataggttactttttcaatttaattgttcacttgtcagtagttttgctgatcttaccaaaattgcaaagacgtttggggaaaaatttttttttaatcagagattgaatgagatctcttaaaaacgatgtataactggagaagaagtcacaggactgagctttgagaaaccccaacaattaggtgtagtatttctcaggaaacccaaccgttaacatattaattctaggatatgtagattttgtcatttcgaacattactattatttagaggaaatgcctggtttttgaaactaaatttaatagttgttttttaacttttattttaagttcagaagtacatgtgtaggtttgctaaataggtaaactcacgtcatgaaaagttgttgtacagattatttcatcacccaggtatgaagcctagcactcaatagttatttttcatgattctctccctccaccctcttataggacccagtgtctgttgttcccctctatgtgtccatgtgttctcatcatttagcttctacttataagtgagcacacaagtggtatttggttttctgttcctgcattagtttgctaaagataatggcctccagctccttccatgttcctgcaaaggacatgatctcatttttttttaatgacagcatagttttccatggtgtatatatgccacattttctttatcctgtctaccactgatgtatatttaggttgattccatgactttgctattgtgaattgtgctgcaatgaacaggcacgtgcatatgtctttatggtagaatgatttatattactctgggtatatatccagtaatgggattactgggtcaaatggtagttgtttttaggtctttgaggaactgccgcactgttttccacaatggttgaactaacttacattcccaccaacagcgtataagcattcctttttctctgcgacctctccagcatctgctttttttttttttttactttttaataatagctattctaactggtttgaaatgttatctcattgtggttttgatttgcatttctctaatgatcagtgatgttgagctttttctcatatgcttgttggaaaaatgcctgttttatacagaacaaaaattcagacaaattcagttttaaaaatgtaatgttaatcatatagtctccttttctacaaataaatatttcaaaaaatgagaagaaaaactataaagatattaaattaagcaaactaaagagaaattatattcatgctgtaatttattcctaaatcaaacaactagtaattccagtaaatcaataatccatagtttataggacagtactgattcaaagaaatgttgaataagaaaaagcaaaaagtcaacctttttccatcaataacctttgactgcttaaaggaagcaaaacaaaaagtaaaaaatccaatcataccaaagaagactctaaaataaataagttgactgcacatgtaatagcttagatatgttcacataatcccttggtccgtccagccccgcattccacttccagcagtgactgatggtagaatatggttatgactcctacttacgtattccagaattgtttgataatcatttacaaccctatcaaccataaattgaataaactatgccaatattttgtcatttgtgtttgctttaccaacataaacttagaaagttttatctgcatttccctcccactatctgctgccggattccctttttcacatctaccttagatggtcagatttactctttcttgttctcttctaacacaaaactccattttattgacgatatccaggagaaaatatacatagctacttgctcatcatgatgaatatgagagataataaacattaagcaaaaaagatcatcaaagatagtgattagatttgcagggctgaagattttatagcaaccaaaatatgatttaaatatagctcatcagcaaattaaatacttatattcagtttaagattgattaggctgtatccacctcatttgtcagaactctctctaagtcaatagtcattttgtctcattgtttggggtaaaaattaaataccagtcacccatcttgaatctcattggccagcacttgatctttaatgtcccaaagtcccttctttgatattaccatagtctctcaattctaaaatactatcaactacaacacaaaccaccaatgtaatcacttctcttaaaagtgtaaatatggatattttgtcaatattgaaccttccataaccaaggtgaagccaagagacttattgtctaggaataaagacagcagacagaacaaagataccattgatcatctttgagtttcaaagctgactttcttaagctctcaagaaagaaaataattgtgaagctggaggcatcatactacatgacttcaaaatttactataaagctatattaaccaaaacagcatggcactggcataaaaacagacatgtaaagcaatggaatagaatagagaacccaataccaaatccatacatttacagccaactgatttttgacaaaggcaccaagaacactcactggagaaaggacaatttcttcaataaatggtgctaggaaaactggatatccatacacagaagagtgaaatgagacccctatctctcaccatattcaaaaatcaactcaaatggactaaagatttaaatgtaagaccaaaaattatgaaactagtagaagaaaacacagaaagagaaaatcattttctaaatccttttggctctcatttagcaaaagctagatctgatagactagatcacagttttatgataaagaagatctggtcagacaggaaaaagaagtgtggactattggaagaaaggtctcagaaacaggttagacacattttatttctcttctctgggcttcacccagattaaaagctgtaatggctctcaactaacacagttagttgggaaacacagaaagccgaggaatttttattccatttatcttcaagactttgaaagaaaattgttttatgagctcccctgcacaaaacttcaggggtagctacagtgtaatcttgccatcacaatcttgaagctcaataatacataacaatgtaaatgggtagagagaaggtcagcttagctttcttaaatcagtcttgattcccatgaggcttagatgaaacccagaacatcctagataccatgaaaaacaatcaaaatgaggctatgttgaaaagcagtgggcctgccctgagttcaccatggtgaagagccaagtgatctagcagagtctgagggtacacagataatgccagatactggatggaggatgtagctgggacttcgaatctgaagcaccatcaagggccaaagtggggttaaagcatcctggagaaaccacagaccctagccaagctacaaaagaacgccccacaaagcatataaggacatcaagaaatgcacagaggtgcccacaagatgaccatgcatgggacccatcactccctcaaaggtcacagtccagagagcattccagaccagccactcggcaggcactaagtgtccaaaggtcaccacatgggtccaaaggccgcatctcccaccgtgaaatcatataagcaacaccctcaacccaatctcctgttttagagcattttatctaaaaagactgagcatttaccaaaagggactgtttatattgttgaatcacatcagtttaccatcttattggcttaaacagaaggcatttattccaattcccagtaggtaggagtttatgaggaaggtcagatcacttacgaaagataaactaaagtgtgctgtgggaaaacttgtaatcccctacaagtacaaaaaggaaagctacattaaatgtttatttccattatacgatgcatcctaatttcagaaatggtaaaaaatgtgaggtggacaatgtgggaaaatgtgtttaaattaacgaaatatggtatcttgcaaatcaagattgcgaatgcaaactgtttcctaaaagaaaaaactcatctgaaaaaccacatttattaagccttaatttatttaatttgtagagctttcactactgtacatatatatgtgtatatatatgtatatgtgtgtgtgtgtgtgtgtgtatatatatatatatatatatatatatacagaaatgtggatatctatgtattcaaattcagctacaatgaggttaaaaaggcatagaaggggcaccattttatggcaagctttggaccaagaggcagaaccatgctcactactggctgatatcatggccagcataacagttctgacatggtaatcacctgggagctttaaaaattattgtctagtcctacttccagagattctgatttaactggttttgtgtaaggcctgggcatcaggacttttaagagctccccaggcaattttattgtgcagccagggttgaaaaccactgggctaacagaatctcaacaataacagggattttctgaattgcctacttagtactcttcctccaagtaagccttctgtatctcccatagggcttggccacaaaccactccatcatactttatctcactgggggctctcaattgtgtgtgagataatgcccatttcttacccttccttaaccagggagtgcagagtagctccatgagaaaatggtcagtctaggccaggcgcagtggctcacgcctgtaatcccagcactttgggaggctgaggcagacggatcacgaggtcaggagttcaaaacctgcctgatcaacatggtgaaaccctgtctctactaaaaatacaaaaaattagctgggcatgatggtgcacgcctgtagtcccagctactcaggaggctgaggcagaagaattgcttgaaactgggaggcagagattgcagtgagccaagatcgagccactgcactccagcctaggcaacacagctagacatcatctcaaaaaaaaaaaaaagaaaagaaaagaaaacggtcagtctagaaccagggccttccaagacatagaaggggcaccattttacatcgtaggagccaaatctggcctcttgtctattttggtaaataacaaaattttactggaacacagccacacccatgtgtttacatattatctaagtttgctttcacattacaacaatagcagagtagttgcaatagagacgctatggtccccaaaactgaaactatttactatctggacccatacagtaaaagtttgccaaccactggtctagagtcagagttttcaagctgcaacagtatctcataagacaagttagatgtcctgaaatagccccggggagtctatgaagggtagagtcagaccttgagcagtgaaaatgacgacatctggggagatatggactcttctatcctttcagccagctgaagcacaattgcttctatcaatctattaatatcattttccactaagagggcaggtgtatcttggcttatcagtctgcatcacctggctgcccacacaatcagtttataagagaacaattatatcctaaagctaagttagaagtgggtatctatggaatcagtctgaattcattgaggaaaagatgagctgtgattgaaagataaagtattaacagaaacagagtgaactggggttggttggagaaccctgaaaaagaggggagcaacattaaagtgaagaaaatcacagtctaataggacaaaaggtttaggaagcaagctgagaagaggtgaagcacatacaatgaatggcagctacccacagatcatctcaaagctaccagtttctgctggtgggggcctccttgtatccttgccatgcacgctcccactggacttgtactattttaatcaattagctatgggttttcctatccttattttaatgtaatgagtgacttcctttttctccactatttgtgtcttaagaaatactatagcctagccattttcccatgggagcagttttctggcagtaaaatcatgcagaaattggagaattcactttattagaatcaactcagctatactgaatcatcttaaactttaaaacattactgaggcagaattaagtttatttcttcatcctaccataaaaataacatctttatacttattaagccttaagcctattagtatttaaaagacacttaatttactaacttttaaggttactcgttgaggttatagtcaaaactccaatatttgcttacaacgtgccctacaagaacactctatgtgtgcagacttccttttgagatttccttggaagcttcaagattaattctgatacaaattctattgatagaataatcagcaagagtacaaaaaagaagcttggaggtaaaaccaagaaagcataagtaaatggcatcatgcttattcaaaatgacctatagaaatgacagaaagcaaccacaaacaaaacttgaactgttttctgaaagaaacaaaggaaattatcttctagaaggctaagaagccaaagggggcagacatgttctctccctgctacctgaaagccaatcaaatctgtctgtagagcagtggaaaattaactctttgggcatctaggcatctctttgcataaattgatatatatgattgcttgctgcctttagagggggttgtggtcaaggagagtagaaaggaattttgacgagagtggggtgtagcagagaggttcttcataggagccaggcaggaaagaaaaacatggtgcttggaaaagctaggactaactactccccatgcagtcactaggactggccttgactctagtaaggagcggggagagagtagagaagaagctgaaagggatcattttcataggaattgtgtgtgactctaggtgcaatcattgcctcactggggcccatatgagagagtgcagcacagaattgggaagagaggcattctcccctcttttgtaggagcctagcgccattctaccacattgaggattggcagctgaaggagaccagagaatttcaccccaaaatatggtaccctggtatgtttattattattattattttgagacggagtttcgctcttgttgcccaggctgaagggcaatggtgcgatctcggctcactgcaacctccgtctcccaggttcaagcgattctcctaccttagcctcctgagtaggtgggattagattacaggcatgcaccaccacgcctggctaattttttgtatttttagtagagacaggtttctccatgttggtcaggctggtctcgaactcctgacctcaggtgatctgcctgcctcagcctcccaaagtactgggattacaggcatgagccactgcgcccagccgattattttaaattaaacacccctggggaccagcagacactggaaggagctttactttgatactccctaatctgcctaatgtccagactcgccaaagaaaaaaataattacttctggtcccttccctgagttttcatcaatttaataataactctaatcacaggcaggtagactgaagtctgtcaacacacctggacagacgtttgtcaaaaatcatgctctgcgggcccaacaaactttgtcccaggccactgtatgttctccaagtccactgaatttcccctaaaaatcatttactacaccccaagttgacacatttcccctatctcccctcctctatgaaaaagggtatataagcttctgtacccgttgggttatgaggtaatcattctcctactattcccctgtgttatgcacattgaaataaattttgtgtgtcttttctcctgttaatctgcctcttgtcagttgatttttcagcaaaacttcagagggcaaagaggaagcaatccctttgaccttacagatttggcattgttggtgggataaccaaaactgctctgctcctctagaagctgcagtcaaaggaacacaggacctgataggtgaacagaatgataagaaattcttaccagtcagactcccagtctctctctctgcataatctggtcaagcagacgagaaaaatcagtttgtctcttttttctttccaaatttaagattaatgggagaaaagcatttgtatgactagtcttagatgtaatgactctggtatatttttgctatgaatattcatattgtccatccttttcctcacagaagtagtctttattttttcctttgtctctgtctttctgtgaagagtccctcttgttttatgtccttgagagcttgacttttgaccacgtaggagccctatctcttggtctctgccatccagtgggcatgatttttgggccacgtctggtggccagcctaaaaggactaggaacccggaggtacctaagatattaagcagcacactctgttccaaatgtgccaagctctcagcaaagtttttcttaaataagaaatcccatccataaggggcttttgttgtcctaactcttgttgcctggatagtcctggaaagtccaatcccaggaggacctactcagtgtcacagattaacagatctatgactggtgcccctccctcctcaatactggaggcaccatatgaacaaacacctcctcaaccatctgtcacaagtgtcctttgctatattagactttttctgaaagtgaattttgaggggatcatgagaactacatcatcttcccatttttatactgccacttatactgtccatgatagtctaaacctggaaagctacctctgagactccatgaaaatggctcattaacttgagtcatttatggaataaataaattggctatacttaaaagaaaactttttagagagtgcttgtcttaaacagctatcttattcgtacctatttttaaaaatattaaaggaatatagccttagaaattctcttagtaagatttttaaagcagaaataatattcaaaggaaacttaaaatcctgtacactcaattgcctgctttggatccatctaggatctgcaaaaagcactctggcctatggtctaatggctaggattccactgtttcattgcctcaactcaggtttgatttctagtcagggaaccagccccttggagatgtaaatcctttaactcaggggaaaaaggaaacatttataaaaattagtttgagggtcaggcacggtggcttatgcctgtaatcccagcactttgagaggctgaggcaggaggatcgctggagcccaggagtttgagactagcctgaaacagatcccttctctacaaaaaattaatttaaaaaattagccaggtgtggtggcatgcatctgtagtctcaaatactcaggagactgagacaggaggatggcttgagcccagagatcaaggctgctatgagccatgattacaccacttcactttagcctgggcaacagagcaaaaccctgtctcaaaaaaaaaaaaaaaagaagtttgaattacttattttgaatttatatttgtgtgacccttgactttttggggtacccatttgtcattgatctttttcccttccatggacagttatgttcctgttcatcactaagtctctattttcttccagaggtctttgtggggtggctctggattttgtgaagactgcttctttgtacctctttggagatgtcttgtgctcccttggttaaatcataaatggcttttttggttctgaatcacttggtagttacctttggtttaaaagaaaaaaaactgaagttcagataaataaagttttaaaaaaataaagtttacttctccttcctttctctacgtctgatacacatgaagggatctagatgggactttgagtgaccctgaagcctcttgagaaccacaacaaaaaggtaccactgactccctgttttggggttctctgttttcctcatggagactcaaaagtcgtgaatgggttcctctcaggtctgaaatctctactcttttttgcattaaactccctcatctatttgacttttgtatacatacatgtatacgtgtgtgttgtatgttgtgtctacatgtatgtgtctatacatgtgtttgcatattatctacatgatatcaaattgacttaaaaataaatgagtactcataaattatataactagcccaaaacttttcaagttcccttgactttaataaatctttggtaaataaagctagttttaaaattgctagtaaaataaaaatgtcttcaaaatttaatttagacatttttgcctaggtctactggtcacacaggtttatgctacctctgttagatgttttaaggtcataaaactgttgtttctatgatattcttgatattttcttgatttgtatataaactaaaactgtaagtgctggctgctgggctcccaaaagtcttacacacatcctactgtggcttgttgagccaagcccaatatggccccatcctccctggtccagctctgcctcctggtcatgctgagaggggtcagatcctcccaacattgtcttcacaagtccgtcctctgccctgggccctatattaggtgtgcaaatccaggattcagacaggtcctacccttcgtagtcatcctgggtgccacatgggtactcagaacccaggacaactagagtagggacaatggggagggacctgtgtccagtatctcaaaggccttagttaagataaaattagctgatgctggttttgctttttcaaaaaaaatacataataacctaaataaatagctttattttccatgaataattcaaatataactgttaaaaaatatttttcaataatttaaaatcttaaggacatgttatgttaagtagtagagaatcatgaaatgtttgagtcatttctaagtaagttaaaatactaaaacattaattattaagcatagtttagataattttgacatcttgttcttatatggcatagaaaagctaaatatatctgtatctgttaatgagcaaaaaactgatgaaacatctttctaaaaattataaaattgttttcatttacaaacactgatataaaacagttcaaaattacttacttcctaggttttcagtagaaactagggttactaagagttactattataattagtatataattaaaactactgtatatgataaacaactatgtatggagtatgtaagggaagtaaaatgttataaggtatgaggatgtgcttttgttgagaaaaagcaatttcatatagttcagagattatgtaaaggttgtttcaaaatgagaaaaatgatataaataaaactaaatgggtatagaaagttgagaaagagagaatttcaaaataattaaggtgaatgaaatatttaatatttaatattaaatttatttaaaatttactatttgtttttaaactgagccttaaaatcaaaaatagtctacaaaactagaattttattttctcctttgaacaagattttcatatagtatcaataagaaatagtaaacgactttggttcacattttgagtaaactgcaaaaaaaaaaaaaggggagaaacagcttttgtgtgcctcatgctatcttaataggtcttttgagtatttgaaaaactaagtctcatctctgtcaaactgtcaaagagtaaaggttttggcttttggaaatcctttattacaccagctaaatgaatgactttatttcacagtaatttttgatcaaatattttaaatgtttgacatacttgacaagcttcccaaaatcaaccttcaaattctaaagtaagtctttttgacttcaaactaactttgggattttcccaaagacccctgaagtatccaaaagagaaataataaacaggtttagtttatatattaaattatatgggaagaactgtcaaataacaaataatgtttaaccttttttctgagttatatttatatggctatcttgttagtatgtgttccaaaactgtatgagatttcttaaaatatgatatatcttggtatatgttgtcattcataattatgagtgttatgttgaattgttgtaggccacaaaaaaaagaccaaatatctttgtcaattgtttatttaaccatggccattttaagtcccattgtccacagttaattgttttattctgatgctttttttttcttgaaagctcttcccaaatcctgaagtatgggtcttcaaagaagttcatgggaataacactgacaaataaaggtttctgacaactctgaaactgtataagtgaatcaatgaactgtgtaaaaattccagaactctaataaaaaaaaaaactggactcataaaattgctaaactaccatcaagcagaacaataattaattacatgggactgaactgataaaagactgaaatgattatttatgattttttatttaggctaattatttttatgttttgttctccagagttaaaaaaaaaacaacaactttttaaaggctacaattcccctgtgttatgcacactgaaataaattttatatgtcctttctcctattaatctgccttttctcaattgatttttcacccgaacttccagagggcaaaggagaaatttggccttcacccctacactgctttgaagccactaggacatggctaccttggcatgttcatttccagtttcccagagtaccaccagcagcagtcaccatccaccagcaataagctgaagccagacaaaactggaatacacggcagatacgctggtttgggagcacaagtgagtcataattcagagacttcaaaatttggaaatgcaggaatgaacagaagagaaaagaggttttataggaaaatccccactctagcacaagcaagtgaggtcaattacaggaactctggattgctgctgctaatgggacttcctttgaacttgcaagggtagagtaggaggccagggaatcagattacataaggataagcatctggcctacatggcccagtggtctgggaactgaaaacaatgagtcccacagaggctgaagtataattctgagaatagaatgtagtttggaaactgaaaaaaatctgttaaaaccctggcaactaggtaatcttattgttcctgaacagcaggagtttgtgaatccaaacctgaaaatgccacattcactatgactcaactcttccccttgtttctactttctgtgtatctttcagctttgcacctaatagaactgtttaaccctaggtactaactgcttaaatctcagaatatagtcaactcctcaaaaagaggatgctaacgggaccaattcataatcatcccccagaggcagagctctcatggcagagcacgtcacagggttcttgccaacctataactgagtgtcactaagtcagttgcccaccctgataaagttagctgtaacaagggtgccaaagtgtcttgagagcattatggagacttaacaaaaggaacccctaaaaagaaggcaaagggaatgtaatagttattaaggctgttcacaaatattcccattgtcctctgggcacagggcaggatcacatacccaacatccactttgaccacataacttgctttgacaaaagcaatgtaaatagaggattgacatatgtcatgtccaggtgaacattttaggagttctcgcatgatttatcatgttccatttccccagttgcaatgacagtggaagcacatgttgagataagtctatattagcctgggtctctgagtgcctgtctcaagcagaaaccccagctcacattgaacatgtagcttgagcaggaaataaattttattaagcctctgagatttgggggttgtcttcttatcacagcacaaccttgcttatgctgactaatacaggggctggtaggtaaacttgccccagtgagtattaaaagctatccccaaggggacaggtgggagacactatggaggtagaaatgaaaaaaaggccaagaggtcctacaatacttagaggtgaacgacaaagaaataatgtttattactgttcttctaactctagatttacttcttgaaaacatgggatatatttacagtcagaaaatacatttgacctttgcccttcaaaaaaaaactttacaaaagataacacattataaagagtttgttattactattattttaagggattttgagtaagtcaattcttttaactcacattcaacataaatctgacacctaccaaactgtattttgcagcaaataagattatagacagtttcattatataatgactgtagcatgatctagcagtttatatccccttcagagagtatacaacatagagatgtaaattctttgaagcacaattctgcataaatagactttctgcattgcattgccaaacttggatcttgaaagtgataaagtgcagatgcctacagttgcagtcataaaaatgtaattgctgagaaattatttctgatccattggaagaatttattacagagggatgcaactgtgtaagttatcacacaagaaactgaaagtgaatgattgaaatatatcccaggctaaatatccctgcaaaatgacccaagagaaaaaaatctctgtgcccaagagaaaaaaaaaatacattaaagataaatcaggtttggtagggaagaatttggtaaccataaaagagcagaataaagatttatgaagaaatgaattcagaagttagagtgacataatagtatctatgaccaattactccaaaaattaaaatgtaattttgactttgagttatatacagaggtgataagtaatttctgtggaaccctggaagcaaaggaatataacatgaagataaatcatgaggaaagtgaagaaatttttaatgggactactgaattaataactttagctggtggcaatgtgaacttaaagacatgaacttcttttggaatgttttccagtgaaatcagagactatatcatgtacttaaaccatgtaactatttcaaattaaacactctttgtaacagtagccaaaatatgggaacaaccatctacagatgaatgaataaagaaaatgtggtgtttatgcaatcgaatactattcagtcataaaaaaaagtaaatcctgccattttctaacatggatgaacctggaggacattatgctaaatggaataagccagacacagaaaggcaaatactgtatgatctcacttatatgtgaaatctaaaaaagttaaattcaaagaagcagagggtaaaagggtggtttccaggtgctagcgaattggggaaatggggaagattgttgatcaaaggatataaaatttcagttttaagatgaataagttttgggactctactgtgtagcatggtgactatagttaacatattgtattctttacttgaaatttgataagaaagtagattttaagtgtcttagccacacacacacacacacacacacacacacacacacacacagtggtaactatgggtagagatggatgtgttaattcatttgactgtggtaatcattacacattgcatacatacatcaaatcatcacatcgtacaccctgaatgtacagaatttttatttgcctcattacctgtccattaaatatattaaaaaaaaaaaacactccttctcctcctcccctggggtagatggcggcggctagatttggagccccaacctcgctgccggcaccaagatggacaattagaagcagctgcggtctgcgcactcagagaggaaggaaaggagcaagtgaattcagcaccttcaactgaagtatccaggttcttgcattagggctgactaggcaaacaatttgacccacgaagaacaaagaaaagcagggtggggcgatggtccacctgggagcagcacggagccaaatgaacccccaccctgagccaagtaaagcagtaagtgattgtgagaccccacctggaaaaccacgcttttcccacggatctttgtaatccgtggatcaggagatcctctcgtgagcccacaccaccagggcgttgggtctgatacacagaactgtgtagaatgttggcaaagcagccgtccaggcacacacagagacccaggagttttccacactccagccccaggatccctggcaagacgagagatctgtccgtatatatccctaggaagggggctaaaaccagggagccaaacagcgtcattctgcaggcctgctcccacagcaccccacaagttaagacccactgattggaattccagccagccaatggcaacaggctgagatgagaccaagttccttgcgggaggggcggccaccatctccatggttcagtcgactcagccattccagcctgatggctttggagaatacaaatggtccagacaaagaagggtccccgacaatagcacagctgccttgccagattatagccagactgattctttaagtaggaccccaatccattcctcctcacagggtgggacctccctgtgggggtttcagccaccccagcaagggctctacagacaaagccctgatctctccctgggatggagctctcaggaggaggggttgccacaccatctctgtggttcagtggactcagccattctagcctgccagctttggagaatacaaacggtccagatgaagaaggatccctcactccccgccccaacgcagcatatctgctccaccagaaagcatccagactgcttctgatcccattcctcctgaccaagtgagccctcccaacaggagtctacagacacttcctacaggcacattaggaacagcaacatgtcagtacccccactgggacagagcttccagaagaaggagcaggctgctgtctttgttgtttcacagccttcactggtgatacttccaggtaaggaaaactgaggcaactagggtctggagtggacccccagcaaaccacagcagcccaacagaagagtgacctgactgttaaaagaaaaacaaacagaaaacaacacaacaccaacaaaaaagaccccataaaaaccccattaaaagtgagcttgaagactatcttgctgaaatagagcaggaagacaagattagagaaaaaagagtgaaaaggaaaaaacaaaacctctgagaactacaggaatacataaaaagaccaaacctatgactgattggagtacctgaaagagacagggaggatggaaccaagttggaaaacacagttcaggatatcatccaggagaacttccccaacctagcaaaacaggccaacatataaattcagggaatgcagagaaccccagtaagatgctccatgagaagatcaaccccaagacaaataatcgtcagattcttcaaggttaaaatgaaagaaaaaatgtcaagtgtagccagaaagaaaggccaggtcacctacaaagggaagcccatcagactaacagcagaccactcagtggaaaccctacaaggcagaagagattgggggccaatatttaacattcttaaagaaaaaaattccaacccagaatttcatatctggccatactaagcttcataaatgaagaagaaataagatccttttcagacaggcaaatgctgagggaatttgtcaccattcagtctgccttgcaagagctcctaaaggaagcactaaatatggaaaagaaaaagcattatcagccactaaaaaacacactgaagtacacagaccagtgacactattaagcaactacataaacaagtctgcaaaataaccagctagcatcatgatgataagatcagattcacacaacaagattaaccttaaatgtaaatgggctaaatgttccaattaaaagacacagaatgacaagttggataaagagccaagacccatcacagtgctgtcttcaagtgacccatctcacatgcaaagacacacatcagctcaaaataaagggatggaggaaaatttaccaagcaaatggaaaacagaaaaaaagcagaggttgcaatcctagtttctgacaaaatagactttagaacaacaaagatcaaaaaagacaaagaagggcattacataatgataaagggttcaaactgacaagaaaagctaactatcctatatacatacacacaatatgggagcacccagatgcacaaagcaagtccttagaaacctataaagatacttagattgggaaatttaaataccccactgacaatattagacagatcatcaagacagaaaattaacaaagatattcaggacctgaactcagctctggatcaagtagacctaatagatatctacagaactctccacccaaaaacaacagaatatatattcttctcattcaccacagagaatactataatcacctctatgcacataaactagaaaatctagaagaaatggataaactcctggacacatacaccctcccaagactgaaccaggaaaaaactgaatgcctgaatagaccaataatgagttctgaaattgaggcagcaataaatagcctaccaaccaaaaaaaaggcccatgaccagaaggatttatagctgaattctaccagaggtacaaaaaggactggtatcatttctactaaaactattcaaaaaattgaaaagaagggactcctctctaactcattctatgaggccagcatcatcctgataaaatctggcagagatacaaccaaacaaataaaacttcaggccaaaatctttgatgaacatcgatacaaaaatcttcaataatatactggcaaactgaatcgaagagaacatcaaaaaaattatccaccatgatcgagttgtcttcatccctgggatgcaaggttggttcaacatatgcaaatcaacaaatgtgactcatcacataaacagaactaaagacaaaaaccacatgattatctcaatagacgtagaaaaggacatcaataaaattcaacatcccttcatgttaaaaactctcaataaactaggtattgaaggaatatacctcaaaaaaataaccatctatgacaaacccacagccaatatcatactaaatgggcaaaagctggaagcattccccttgaaaacgcacaagacaaggatgccctctcttaccactcctattcaacatagtatcaaaagttctggccaggacaataaggccaagaaaaagaaataaagagtatccaagcaggaagagagaaagtcaaattatctttatttgcagatgacatgatcctatatctagaaaaagcccattgtatcagcccaaaagctccttaagctgataagcaacttcagcaaagtctcaggatataaaatcaccgtgcaaaaattgctagcattcctatacatgaacaataggcaatcagagagccaaatcatgaatgaactcccaattatgattgctacaaaaataataaaagatctaagaacacagctaacaagggaagtgaaagccttcttcaaggagaactacaaatcactgctcaaagaaatcagagaggacacaaacaaacggaaaatcattccatcctcatggataggaagaatcaatgtcgttagaatggccatactgcccaaagcaatttatagattcactgctattcctattaaactaccactgacattcttcacagaattagaaaaaaaactattttaaaatgtatttggaaccaaaaaacagctcaaatagccaagacaatcctaagcaaaaagaacaaagctggaggcttcacactacccaaattcaaactatactacagggctacagtaaccaaaacagcatggtactggtataaaaacagacacgtagaccaatggaacagaatagggaactcagaaataagaccacaaacctacaaccatctgatcttcgacaaacctgacaaaaacaagcaatggggaaaagatttcctatttaataaatagtgctgggagaactggctagccacatgcagaaaattgaaactggacccctaccttacaccatatacaaaaagtaacccagaggaaagatcaggcagcaacatttgctgttcaccaatattcgctgttctgcagactccactgctgatacccaggaaaacaaggtctggagtggacctccagcaaactccaacagacctgcagctgagggtcctgaatgttagaaggaaaactaataaacggaaaggacatccacaccaaaaccccatctgtacgtcaccatcatcaaagaccaaaggtagataaaaccacaaagatggggaaaaaacagagcagaaaaactgaaaattctaaaaatcagagcacctctcctactccaaaggaatgcagctcctcactagcaacgtaacaaagctgcatggagaatgactttgatgagttgagagaagaagacttcagatgatcaaacttctccgagctaaaggaggaagttcgaacccatggcaaagaagttaaaaaccttgaaaaaagattaaacgaatggctaactagaatacccaacgcagagaagttcttaaaggacctgatggagctgaaaaccatgacactagaactacgtgacgaatgcacaagcttcggcagctgattcgatcaactggaagaaagggtatcagtgatggaacatcaaatgaatgaaatgaagcaagaagagaagtttagagaaaaaagaataaaaagaaatgaacaaagcctccaagaaatatcagactatgtgaaaagaccatatctatgtctgattcgtgtacctgaaagtgacgggcagaatggaaccaagttggaaaacactctgcaggatattatccagaagaacttccccaatctagcaaggcaggccaacattcaaattcaggaaatacagagaataccacaaagatattcctcaggaagagcaactccaagacacataattgtcagattcaccaaagttgaaatgaaggaaaaaatggtaagggcagccagagagaaaggtcgggttacccacaaagggaagcccatcagactaatagctgatctctcggcagaaactctacaagccagaagagagtgggggccaatattcaacattcttaaagaaaagaatttttaacccagaatttcatatccagccaaactaaacttcataagtgaaggagaaataaaacactttacagacaagcaaatgctgagagattttgtcaccaacaggcctgcctaaaagagctcctgaaggaagcactaaacatgggaaggaacaactggtaccagccactgcaaaaacatgccaaattgtaaagaccatcaaggctaggaagtaactgcatcaactaatgagcaaaataaccagctaacatcataatgacaggatcaaattcacacataacaatattaaccttaaatgtaaatgggctaaacactccaattaaaagacacagactggcaaattggataaagagtcaagacccatcagtgtgctgcattcaggaaacccatctcacgtgcagagacacacataggctcaaaataaagggatggaggaagatctaccaagcaaatggaaaacaaaaaaaggcaggggttgcaatcctagtctctgataagacagactttaaaccaacaaagatcaaaacagacaaagaaggccattacataatggtaaagggatcaattcaacaagaagagctttctaaatatatatgcacccaatacaggagcacccagattcataaagcaagtccttagagacctataaagagacttagactcccacacaataataatgggagactttaacaccccactgtcaacattagacagatcagtgagacagaaagttaacaaggatatccaggaattgaactcagctctgcaccaagaggacctaatagacatctacagagctctccaccccaaatcaacagaatatacattcttctcagcaccgcactgcacttattacaaaattgaccacatagttggaagtaaagcactcctcagcaaatgtaaaagaacagaaatcataacaaactgtctctcagaccacagtgcaatcaaactagaactcaggattaagaaactcactcaaaaccactcaactacatggaaactgaacaacctgctcctgaatgactactgggtacataacaaaatgaaggcagaaataaagatgttctttgaaaccaatgagaacaagatacaacataccagaatctctgcgacacatttaaagcagtgtgtagagggaaatttatagcactaaatgcccacaagagaaagcaggaaagatctaaaattgacaccctaacatcacaattaaaagaactagagaagcaagagcaaacacattcaaaagctagcagaaagcaagaaataagtaagatcagagcagaactgaaggaaatagacacataaaaaacccttcaaaaaattaatgaatccaggagctggttttttgaaaaggtcaacaaaattaatagactgctagcaagactaataaagaagaaaaagaagaatcaaatagacccaataaaaaatgataaaggggatatcaccgccaatcccacagaaatacaaactaccatcagagaatactataaacacctgtatgcaaataaactagaaaatctcaaagaaatggataaattcctcgacacatacaccctcccaagactaaaccaggaagaagttgaatctctgaatagaccaataaaaggccctgaaattgaggcaataattaatagcttaccaaccaaaaaaagtccaggaccagacagattcacagccgaattctaccagaggtatgaggaggagctggtaccattccttctgaaactattccaatcaacagaaaaagagggaatcctccctaactcattttatgaggccagcatcatcctgataccaaagcctggcagagacataacaaacaaagagaattttagaccaatatctctcatgaacatcgatgcaaaaatcctcaataaaatactggcaaaccgaatccagcaacacatcaaaaaccttatccaccatgatctagtgggcttcatccctgggatgcaaggctggttcaacatacacaaatcaataaatgtaattcagcatataaacagaaccaacgacaaaaaccacatgattatctcaatagatgcagaaaaggcctttcacaaaattcaacagcccttcatgctaaaaactctcaataaattacgtattgatgggacatatctcaacataataagagctatttatgaccaaccgacagccaatatcatactgaatgggcaaaaactggaagaattccatttgaaaactggcacaagtcagggatgccctctctcaccactcctattcaacatagtgttggaagttctggccagggcaatcaggcagaaggaaataaagggtattcaattaggaaaacaggaagtcaaactgtccctgtttgcagatggcatgattgtatatctagaaaaccccattgtctcagcccaaaatatccttaagctcataagcaactacagcaaagtctcaggatacaaaatcaatgtgcaaaaatcacaagcattcttatacaccaataacaaacaaacagagagccaaatcatgagtgaactcccattcacaattgcttcaaagagaataaaatacctaggaatccaacttacaagggatgtgaaggatctcttcaaggagaactacaaaccactgctcaatgaaataaaagaggatacaaacaaatggaagaacattccatgctcatggataggaagaatcaatatcatgaaaatggccatactgcccaaggtaatttatatattcaatgccatccccatcaagctaccaatgactttcttcacagaattgggaaaaactactttaaagttcatatggaaccaaaaaagagcctgcattgccaagtcaatcctaagccaaaagaacaaagctggaggcatcacactacctgacttcaaactatactacaagactacagtaaccaaaacagcatggtactggtaccaaaacagagatatcgaccaatggaacagaacagagccctcagaaataatgccacacaagtacaaccatctgatctttgacaaacctgacaaaaacaagaaatggggaaacgattccctatttaataaatggtgctgggaaaactggctagccatatatagaaagctgaaactggatcccttccttacaccttatacaaaaattaattcaagaaggattaaagacttaaatgttagacccaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttccgcacagcaaaagaaactaccatcagagtgaataggcaacctacagaatgggagaaaatttttgcaatctagtcatctgacaaagggctaatatccagaatctgcaaagaactccaacaaatttacaagaaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaaaaacaggtgctagagaggatgtggagaaataggaacacttttacactattggtgggactgtaaactacttcaaccattgtggaggtcagtgtggtgattcctcaggggtctagaactagaaataccatttgacccagccatcccattactgggtatatacccaaaggattataaatcatgctactataaagacacatgcacacgtatgtttactgcagcactattcacaatagcaaagacttggaaccaacccaaatgtccaacaatgatagactggattaagaaaatgtggcacatatacaccatggaatagtatgcagccataaaaaatgatgagttcatgtcctttgtagggacatggatgaagctggaaaccatcattctcagcaaactatcgcaaggacaaaaaaccaaacaccacgtgttctcactcataggtgggaattgaacaatgagaacacttggacacaggaaggggaacatcacacacctgggcctgtcgtggggtagccgggagcggggagtgatagcattaggaggtatacctaatgtaaatgacaagttaatgggtgcagcacaccaacatggcacatgtatacatatgtaacaaacctgcacattgtgcacatgtactctaaaacttaaagcaaataaaaaaacaataataataattaaaaaacccaagatggattaaatatttaaatgtaaaacccaaaactataaaaaccctagaagaaaattgaggcaatagcattcaggacataggcaaaggcaaagatttcatgatgaaaatgccaaaagcaattgcagcaaaagcaaaaacagacaaatgggttctaattaaactaaagagtttcctcacagcaaaagaaattatcatcagagtgaacagacaacctacagaatgggagaaaatttttgcaatctattcatctggcaaaggtctaatatccagagtctacaaggaacttaaacaaatttacaagaaaaaaaaaacattaaaaagtgggcaaaagacatgaacagacacttctcaaaagaagacatacatgcggccaataaacatgaaaaaaagtttatcagctgggtgcggtggctcatgcctgcaatcccagcactttgggagactgaggcaggtggatcacctgaggtcaggagttcgagaccagcctagccaacatggtgaaaccccgtgtctactaagaatacaaaaattaaccgggtatggtggcatgtgcctgtaaatccagctaccaggaagctgatgcaggagaatcactgaaacccagcaggtagaggttgcagtgagctgagatcatgccactgcactccagcctgggtgacagagcaagactctgtctcaaaaaaaaaaagttcaacatcactgatcatcggagaaatgcaaatcaaaatgacaatgagctaccatctcattgtcagaatgcttattaaaaagtcaaaaaacaacagatgctgacaaggttgcagagaaaaaggaatgcttttacattgttggtgggtatgtaaattagttcaaacattgtggaagacagcgtggcgatttctcaaagacctagatgcagaaataccatttgactcagcaatcccattactgggtatatacccaaaggaatatatatcattccattataaagatacatgcacatgcatgttcactgcagcactattcacaatagcaaagacatggaatcaacctaaacgcccatcagtgatagactggataaagaaaatgtggtacatatataccatggaatactatgcagtcataaaaaagaacaagttcacgtcctttgtagggacatggatggagttggaagtcattatcctcagcaaactaatgcaggaacagaaaaccaaacaccacatgttctcacttataagtgggagctgaaggatgagaacacatggactcatggggggaacacactggggtctgtcagcaggggtgggaggagggagagcatcaggaagaatagctaatggacgctgggcttaatacctaggtgatgggatgatctgtgcagccaaccaccatggcacgtgtttacctatgtaacaaacctgcacatcctgcacatgtactcctgaacttaaaataaaagttgatgaaaaataaatactgaggtctacttagtcttttcaaataaacaggttactctttttttttcttttattataccttaagttctgggatacatatgcagaacgtgcaggtttgttacataggtatacacatgccatggtggtttgctgcatccatcaacccatcatctacattaggtatttctcctaatgctatccctcccctagcccccacctcccaacaggccccagtatgtgatgttcccctccctgtgtccatgtgttctcattgttcaacttccacttatgagtgagaatatgtggcgcttggttttctcttcttgtgttagtttgctgaaaatgatggtttccagcttcatccatgtccctgcaaaggacatgaactcatccttttttatggctgcatagtattcaatggtgtatatgtgccacattttctttatccagtctatcattgatgggcatctgggttggttccaagtctttgctattgtgaatagtgctcccataaacatacgtgtgcatgtgtatttatagtagaatgatttataatcctttggatatatacccagtaacaagatggctgggtcaaatggtatttctggttctagatccttgaggaattgccacattgccttccacaatggttgaactaatttacactcccaccaacagtgtaaaagcattcctatttctccatgtcctctccagcatctgttgtttcctgactttttaatgatcaccattctaactggcgtgagatggtatctcattgtggttttgatttgcatttctctaatgaccagtgatgatgagctttttttcatatgtttgttggccacataaatgtcttcttttgagaagtgtctgttcctatccttcgtccgctttttgatggagttgtttgttttttcttgtaaattttaaacagctattcttatctaaaaaaataaaaataaacactttttgaaaaacaaaaaagaatgtaatgagacacttaacatgatgttatcctagaaaaaaaaacctttaatataatttaatgagatattttatttgtgttggtgggttatacatgatcaaagtgacagatacaagaaggctgaacatcaaatccagaaagatcagttattttaaaatataactctttgactttgaaatgtactggtttttgataaggagaatcccattattaaaaaaacaagagtgtatacaaataatttagttaaatagaattctgctttataagatagttattgcataagttgatattatataaattattaatattttaatttaatatcacttgagtattgctaagaccataaaatcatttttatacctgagacgttgatgttttataccaaagtacttttaagaaatcagtgactattttgaaaacattgacatcaatcttaaggaagacaaaattagcaattatatttacatgtaacagaactgtctggtatgtaaaaggtaatgagttccatttctgtgactcatctacttgtggatcatgaaaagtttgaatccaagaacatcaaaagccctctaaaactagtataatcacactttttaaaagagatacatttctttccaatcaaacaagattactcaggtcattttcatccttctaattttataggtgaactcaataaatgtttatagatggttattatctatttagaacatgccataaaatgtgcacgtgcgcgcacacacacacacacacacactgtgactagcattaccctttaatgtgaatttacttagaatactttctattaacttctttagcaatgtacttgactaaagcaaaatatctattagtttcagttagaatataaaaagtagtttccccatgatactctctctgtttataagcaatatgtcagcaacctttgtgattagcaagttttaagtgaccaactgtaatgttccattgttatagagcaaataagggttataaactagcattaatgtatttgttttcaccagccatctccgaaatgaaggtcatttccctattcctactccttataattggataggaacaaaaccttaaatgacttgtgagaactcatttaaaactgtccccaaaaaacttggtgatatgtatgaaaaagtataaaaatattcatatcttggccattaacttttacatttgtaactaattctagtgaaataatacaaattgatgacaaaaatgtatatacaaagatgttcagcagagcaatatttataataggaaaaaaatagaaacaccctaaatgtccaaaaatgtgaggctactttaaaaaaactgtagtgcagccatatcatatataagtaaatagcagctttattaaaccatgcttacaaataaatagggaaattattaaaatatcatttaaaatggaaaagtgggattaaaccctgcatatatagtactagctccacttgttaatatatatatattcttcatatatatatatataatatatatacgtgtaaggatatatataaagaagatatattctttaatattacaaagtacaaagatgataaaaatctcccacaactttattgtactggaagtaaacgcaccaaaacattaatgtttatctcttggtaaaattatgagtgtttttattcttttttttaactttttttgacattccaatttttttgtgaacttcattagaaaaacaaatgagggtttttctttctttttttttttttttaaacagggtctcactatgttgcccaggctggtctttaactcctggacttaagcgatcctcctgccttggcctcccaaagtgctgggattatacacatgagccactgcacccagccttttttctttttaacatgaaactgtttagtgagtggctaagacggactttaatgaagtctccacagtcatctagtataaatttcacaccagatattagtgccgttaagactgccaaagttaactattaaggtatcatcagggatgcacatgttttgaattgtctttcgagtagcagatatcaacttgtacaacatgtacaaattgataaaaatatgtaaacttgtaaaaatatatacaaagtctattctcagagctactcccctccccacatccatctcacaaaaaagataagcagaacatatttaaattatctgaggaaaggtcggcatagtttttcacccaagtaacccttgggttctttgagtccctaggaaaagggacttgaatcttgtattaggaggcaagatgtaaggcaggcctaaaggggagttccctcacaaattgtgggttaatgacaaaaatttaaatctataccactgcataagtttcttcaagccctgctctaagaaaatccaatacatgaaatctcgacttacataataaaaaaagtcagagaatcattatgcatatcatcaaaggattattcaccttatgaaagacttcatcacagaattcctttaaatagctgcttttctcatacattttagtattttaaaggtagtttcccatttggcaaatgagatgccatgtgcctgaggcaagttagtgaaattctctaggcctcagtttcctcatctatgtaataaagatggttttaaccatgttacctgcctcattcagttttcacgattatcaaagaagataatttatataaaggtactctgaaaattatatatatatatatatatatatatatatattattactgctattcttgctaaaagagaatgtgggggaaactttcagaatacatactttttcacatcttaacaacacacatacctacttttcacatcttaacaactctttaaaggacaattttagatgacatatttatatataaaaatcaaatcttttattcttcattattcatttttcccacatatttttcattcttctgcagttactatatatcataatttccatggtattaatacctggattatgagaggctccagtagcttctccacggtgaatgtttggacctgcagatcctgaggatcgatattcaatgtgattggtgtttcagctgacatgctgcctgtgcacaaacacaaaaggatgcttattaataaagaaaactgttttctaaagaagaacacttatgaaatcatggaataggtaaaacttgtattcagcacctcttcctgatatcaaccatagccctcagaggaccaggctacaaaatctaccttcagagaaagaagatattccccaactgttccctgaggtcatgctgcctgggcttaggtcctgtaacaaattaatctacacaagtatgttcatgattaaattaacaactcatccggggtgggtttgtatttgatcagtagtcttaagtgatcagaaaggtaagacacatcttacagcattcaagtcctttggcttctgtgaaatcacagcactgaggcagcctatgcccatattttgcttcttcttgttaatgatgacttagacaaggaacaagtaaacctttgaaagacatgggaacaagtaaagatatgtccttacttgatttagagattgtttatttgagggttttgattggagaaggttaaaggcaatttaccttcttggacaggaaaagaaactaatacaaattgcacagttgttgtaaaaagagagaagcccctgagaaggcattgatatttggtcaagacaaaataagaagaaaaaaaagaattgcaagccattctctaaggcattaacgttatccttaaaaatcaattcagtgagatttttgcctaacaatatacatttataccaaatgaccatatgtggcatgtcatagtcggattaacgttcaaaaactctagccatattttcaaatagctataatatattatttattaatctactaaaaactacagtaagtgttaagaattttagatgaaacccactggcatcgttgattgcaaagagagagcacacttcctgaaatgtagcacatttctagatagttctctttctcttattgaaaataacccaaatggcctgcccagggccccatttgccccttcaaacctgccaagtgtgtccttgttcctagtctgtgcttaactctatcacaagccacttacagggtggctacaattcctttactttttgaaagattttgccttgaaaaaataattattcaaattctattaagtgaaaagatattacttgagtttcttctcaaatcaaagtttcaaattactgttattggcatatgatacatcaacatataaagtcaaagccctacaatttagccctgttttaccttgtttctctctcctttgcgttgatttcattctccttctaaaagtagaaacatggtctcttttctcagcgattcagctgcaatgtaagagacacgcttcaagaaaggctccaaacactattgccaaatggtttctctcaaatgcatttctagaactgaaatgttttagtttggtttggttttgattttgctttttcaatcatttcacctaccactttgattccttctaacacagggaaatctaaattgacagatagcctattcctgtggtgacctttctgcatagcccagagccaatctgtgcaataggatatgtccttcagtgtatagccttagggttctatcaaataagtgctcacaaaagaatttatttgttactcctctacgacaggtactatcctacataaaaatcaagtcaagatttctgccattgctttgttctttcatctgaaggacaaaagtagaggagactgttgtgaactaaaataaaatttggtgaaccttcgcagcctttaaaaacatgtcattttcaccgtgaaattcacgactggtttccaaagctacatggccaccagaaattgaaagtaaggaagataaaaaattaaggagagcaaaaattatccatatcatatgtaaatccttctagaagaatttttcaacctagaaggagctttctaaaaggagtgctttttagccaagagataaaagacaacctaatttagccaaagtatcttttaagtctgtgttcatgtctttaacacaaattaagtaaaagtttttcaaaagttcatttttccatggtaaaaattacttaaaaaaaataaatccttaaagaacttggcttcatataattattaatctttaaataaatgctatttcttatttttaaaaagtcttcctgctcttttgtatgtcctggtcagtattcctgactgattggaaattagggctatcataggcagaaaactgcataattttgcaaatgaaattgaagcaaagtcaaaatctgacaaatttgtagatatagcaataccacaacgcaaatccaaaacaaaaatcctactaggttgtaagtattacattctgaggcatttgcattttattttgttttatttttgagactgagttttgctcttgttgcccaggctggagtacaatggcctgatctcggctcaccacaacctccgcctcccaagttcaagtgattctcctgcctcagcctcccaagtagctgggattacaggcatgcacctccacgcctggctaattttgtatgtttagtagagacagggtttctccatgttggtcacgctggtcttgaactcctgacctcaggtgatccgcccgcctcaccctcccaaagtgctaggattacaggcgtgagccaccaccctggccggcatttgcattttgtaatctataaaatcttaggagttaggcagtacctcccaaacgattcaagaataccttctacacaaccttcatttcaccaacacactgggcttggatgaatagaaatgatgagaagcttactataccattagatgctcgttgagttgaaacctgccacttttaaacttttatccaaaagagatggcttaataaaggggaaaaagtacgctttataaataaagtaagaaaagtacagatttggagagagactataacaaaattccagttttcagaattaaaggaaggagaacaaatctcttgacagtggtgatagatgtctccagagaaagacaccaaggcagggcaaacccaaccatatggatccttcccttctccccaaactatctttgtctgcaatgactcaattttcttcattccactttattccctgctggaaactgaacttttatcattttatatcaattttaagttcatttggtttaacacacatttcatttctaaatgcagttaattctgagaggtcatggggtgcacacattcagtcacacattagtatgaactagctcattgcttgccatttgacaccctgtgcacgtctctattacagcacgaaccacgttgtgttttcatcgtgccctggcagcaaaggagagggatgatggaagatcagagagatgcacagagaggccagtggaaaactattcatttccaaaatttgcctaagggttgccattccctcacaaatattaaacagaaaacatttggcacctacttctcctccctacagtaacacataaccaccaccccctcccccactgcctccccactcttcaccacccactctagagctcaggctcctcttagtaaaactacaattcttttacataagttgtcatgttcttgtgggatggcttggaaacctaaccatctgtaatgtggttcctatagaaaattccctaatatcaaatatttaatttaaaaaaaaaaagattaacttttgtaacacaattagtttgtaaggtgatggctgattctcctttaagcttattaaattccatgacacagtcatcatacttacctaattagtctaactttatactcacttttcaactaaaatgtttaagtcttttttatttcaaagattattgcaaactcaagtctctcatcacatctttaaacaaatgatttttatttactcctaaatgcagaattttattttgtcttcctaacaccttatcctgtagaatatggacttttattcctgctagtcaaaaattggtttgggagaacccaacacattaacaccccctcccatttccctgtttatccattaatttgtccagtatgaattctagaattccctattaagtcattaaacaggtgaaggccagacataaaacctaattttgatactgttacaaatctctttccagatatgtaatgatcaattaataaacactttagacatgattttcaatattattaaacactgttgtgtgaaataatctacctttttcatttcgtcaaaaatatagatatatcatgaagaggcttttcccaatgttttaatgaaatagaaacaccctttctacaccttcctgtttaagagctcaaaaaatatatatttatagtttggcatgacttgttcgtgaagaattcatgctgactgctagtaattactgccctttatttacaaattaggtttttagttttcctacagattggcacctagatgtccagtctaattaaagagatcatctttttacctatgttgaaaataagaatatttgctcttctctatgtattagttcatggtgctataacaaatatatcatagactgggtggcttaaacgacaaacatttacttctcacagttctggaggctgggaagtcctagttcaaggtactggcccatctggtgtctggtgagggccagctttctggtctgcagatggctgccttctctctgtatcttcgcatggcagatagcagaacacatcatgtctcttcttataaggacactaatcctattgatgaggactatacactcatggcctaattagctcccaaaggctccaccattctaatatcatcaccctgggagttaggatttcaacacatggatttgcagtggcaggtggggaagatacaaacattcactccagagcactctgctttctggcaggtctaccatttctcagggattcccaagaaagtttctgttatcacatctaaagatcattttagggttcagggatatactccttttggatgtatgtacttcaactaatttaaagagactaggctatcttctttactttcatcatctagagtttcaattattgtttaattaattaaacattttattaggtaatacaaggtttaataatgtatatagtgaaaccaagtctctctctctctcatccctgtcttcctaccacctaatttccctcccagaggcaactactttgggcacttactcttatagttccagagatatcatacataataccagaacatatggatttatatatttaatacgaattataacatttttgtttttctactcaattcaattcccttaatctttgttccacccttgccaatttgacatcatagtttagatgtatcataagtcatctattaatcccttatcatgtgactaatgtagaggatctattccttcctgtttttgtttttcttaccttcagcatgtcctgccagacctagcaaatgagaagtgctttagccttcccaactttacttttcctagtttctgccattctcttttatttgccttcagtcaggtgtccctgtattaagctattcttgtattgctataagaaatacctgagattgggtaatttataaagaaaagatatttaattggctcatggttctgcaggctatacagaaagcatggtgctggcatctgctcagcttctagggaggcctcagggagcttttactcatggcagaaggcaaggtggggagcaagcatctcacatggtgagaacaggagcaagagagaaagagagagaggtgccacacacttttaaacagccagatctctcaagaactcactcactatcatgaggacaacaccaagaggctggtgctaagccatcatgagaaatccgcccccaaagtccaatcactccacaccagaccccacctccaacactgggaatcacaattctacatgaaacttgggtggggacaaatatccaaactacatatgtccctcttctcatctttaattcatattctttcaaatttgtacccctacacagatacattggagtttggggttgtttatgttgttgttcaacaactatttatggaggacttaaacacatcagccacaatcttaggttccagtgaaagaaaatgtagtaaagcccaggccctaccaactatgcatcttctttcttcatgtttaatttatcacattccttttatgtcatatatagtcccttggaatcatatttcgtgttaatctgaaattgttgaaatttacttctcttaaagtctaggaggcatgtctaacattatcttatttgggattatcacccaaataaatggccactttctctataaccctgggcaaaagcttccccaccccctatcctcatgctttggaagtgtccatggggccaagatgatgcacccacccagagcccacatctattctatcctatcctacccagggtagccagtgtctcaactccctgctcaacgagtgcaaacccacttccagtgcctatgttggcctcttcgtggaatccatccttccaagactgaaccattcaatgtgcccaaccctatacctgagaggtagccaaaaggcagctgtttgccaatgagtgcagattgagtttgggtgtacaggctgggctgtcaacttgcaggcactcaaggcccctcaagtgcaagacagccagaagtgggaagagaagagaacaggccatgtgtcagggacacagaggtgagctccacctccaccacctccttctaaaaggaacccaaggattctaaaaccaatcttgccttctgggttatttgaaggtatatttctcaaagtagaaagattggcgagtagagcctactttagcagcctattacatagaattgtaacttatacacataggcatatggtgtgcaggcctccgtctgtaccctcacacttcccaatacaaacgttaaagataggcctgcccagactttctagcactccatatcaccaagtggtcagatttgcttctttcattgtttcctcaatatgccaagatatataattgccaaagagttaaggtgaaaagtcatgttattccacttttttttttttttggaggcagggtcactctgttgcccaagctggagtgccagtggcgtgatcacagctcaccactgcaacctccacctcccaggcccaagcaatcctcccactcagcctctcaagtagctgggaccacaggcgcgcaccaccacacctggctgttattccacttctaagagaaggtttcttaaaatttttagaatgtgtcatctgttactgtaatagttttttaaatctggaccagtaaagttactgaagtattaagctgtgtgacaatatctcttctcttacttctctttcctccatccaaatgctctctgttattattctttccttaagcttctgatttccatgcaagagtgtgcattcactatatgtgtatttctctacctcttttattaaaattattttgtgaacattcaaaattccattcatgagtaaataattaaaggttaaatagtcgaaaacacagaaataaaaaacattcatgatttattagtatatctgtgattatatttaatttgtgttctcccaggtaactattcttatttattatcgaccttctcccatgttttctcctgataagtactatacatcatctctattaacatggttctttctatgccctgattattgtcataacactaacacatacacacaggtgtgcacattcatatatgtttgatggttttatctggaaataagtgtctcttcctcaagtttaaactattctgatcatgtcaacaagtcttccaccaaaagtatctttgggcttcatggattcacagtggatctcatttagtgaaactctatttagttaaatataaaagagaaatatttgtattaatagtaggtgccaatccccaccatcatcacaaatgttaacctttgcctaatacctgtctcccaaaatatcagaagaaaggatcagcaactagtgaaagactgtcaagtactgaaataatgttataaaagagtattttaaaaattttcattaagaatttatcttgaggtcgcgtgcggtggctcatgcctgtaatcccagcactttgggaggcagaggccagccttccactacaatctcctgaggtcaggagttcaggaccagcctggccaacatggtgaaaccccatctctactaaaaatacaaaaattagacaggcatggtggcatgtgcctgtaatcccagctactcaggaggctgagacaggagaattgctggaacctaggaggcagaggctgcagtgagccaagattagaagatcgtgaaacagagcgagactccgtctcaaaaaaaaaaaaaaaaaaaatttatcttgaatgcataactgaactttataagcctcgctctcccccatcaccatgcctcagaaaaattagtataatatagtcaggaataatgtgaaggattgaaaccagatgttaactgaaaaaaaaaatctaaatcatcacaagaagatttaagtaaaggaaaaggaggcaagggaagtttgccatacaatattatcatagctgattttatacaattgagtcttggctagagtgaaataaaatggaaagaagacaactgtaatataaaacttccactacaatttctatacacactggttttccaagccccacctccatgtttccagtgcaataatttgctggtatgtttggcctaccaagaaagaaatacatacaccttctactctcttggtaaacaaaaggatctgaggtttgtcagatcaataaaatcaagaaactgcctgatatcgtaagtgatgaaggaatagttgggtctcattcttttcaaatgctcttcctggactttacaaatatttttgatgtgtttacatagagggcaataatctatataaactctcccacctagctttttggtaggctataagagcaaaatgatgtgagatcagacgtatccctagactatagggcatcattcatttattcattctttcaacttatatttactgactatctactctgtgccaatcacgaggagagtgtgaccataaacaataaagataataaatagtaaatgatttcgtatattagaaaataacatatgccattttaaaaaagaaaaagcagaatagagtaggcagggctgggtgatagggaagttcagagcagatttcagtattaaataaggtcaagactagcctcattgagaaggggacatctgagcaagactcgaagaggcaagaaaattagccaagcagacagccgggggaagagcactgcaggcagaagtaacatcacaacagaagcctaaggcagaaaagcagtggcagaacagcaaggaggccagtgtaagcagggcagagtgagctacaaagagcatagtaagagagaaagtcagaaaggtatggaggctgcagatcataagaactattgcagatgtttgagcactaaaacatcaactgttttatttagaggaatcactctggtgaatagaacgaagtacgaagggcaaaagaaaaaatagggacagccattgggagttcccatagtaacctagatgagataaaataatggcttagaactggttggtggtagcagaagtggacacagggttcagattgtagatatagtttgacaattgagacaacaggaattcatgaaagattaaacataggctagagagaactcaagatatctttaagtttttcgatctggagcaactggaaggatagagttgccattaactgaggtgggaatggctgcaagaggagcaggaagaagaagagtccagctggggacatgataaatttgaggtgcatattaacatcaaagtgaagatgtaaagtaggcagttagatatacaagagcagggtttgaaagagaaatctgaaatgaaaatataacttttggagttgtcagcataaaggtagatacaatgagactaccaaggaagcatgtagactagaaagaggtaggttgaagtccactattgcaagtgaatggaaatacaggcagtgatattcagagtatgactgtagaattgagatttgccttcaggtgaattaaaaaaatatgccccttctggacagatggattagaaaactgaccaggcacggtggctcacacctgtaattccagcactttgagaggccaaggcaggtggatcacctgaggtcaggagttcgagaccagcctggccaacatagtgaaatcctgtctctaataaaaatttaaaatattagccgggaattgtggtgggcgcctgtaatcccagctactcgggaggctgaggcaggagaatcacttgaacctgggaggcggaggttgcagtgagctgagatcacgccattgcactccagcctgggcaacaacagtgaaattccatctcaaaaaaaaaaaaaaaaaaaaaagacaagacaagaaaaaaaagaaaactgtgccactctctgagtagacacagccctgcaagtgttagcagaaaggcccacagtttgcccagcagagggagggctagatttcatctccactcagacccttagcagggtaatatgcagcagcccatgtgagacatcctttcgcttcaccctgcaacccccaccgtctgctaaagagttcttaaattctcttacctctcaccactattgggcctcagtgattatcagcatcagctttaaagttggactgcctgggtgagaatccaggctctgttccctgctcgctggtgactttagataaattactgatctttcctgaacatcagtttcctaatccataaaatgagaataataagagtacctacctcaaaaggatcttaaagattacctaagaaaatctatataaaatccattaacttagccaatatctctgacacctggcaggggctcaacaaacattagttgatatcattatccccttttaagtgaaagaacagaatctacttgtctacattcagattaaacctctccctcatctatagacctcataattattattcaagagtgctttcattgattgttttcataacaaaagactttaaaacaaagcttccctccggtggcctcattttattggatttcttgacttcaaaatcaataaggcatatttcctacatgtgcactaattagaaatgcaacatgcctaaagtactgtcttaaaaaaaacaaacaaacacattcctaatgcacaacagcctcctaaaggatcttgagccctttgaaatcaattccagagtggtacataaaaggtatgccccagggttagggctacaactgttagatgcactaagtgtggggaactccaagagtctgtactttttatttccttagcatccaaaatctctgaatttcaacagaacaaaacaatattacattttagaacaaaaggtaaatatcattagcatgttgtaattcaaactttataagcttgagtatttgaagttctctttattaaacctttagatagccatcttattgatgtttttgaaaaatgatcaaattgagcctcccccaaaaatgatgagttttatgaattctttatgaaaagattcaaacaaaattaattaaattaaaaaatgtgtttactctagccagagcaaccaaaattaaacatgtttcctcacacatacaaccaaaatgaaagcagcaaaaaaggtaaaaaaaaaaattactttaaccaatatgaaatatgaaaacaaaggaaaacaacagattctacttatatttaggtcttacaatgtccttctgatcatgaatagctggtcaaatctaatctccctcttaaaaaaagcaaaaagtcataattcaatttctgacttacctgaaaagtaatattgtacatgagaattccacaagatgactttatgaccctgacaacataccatttagttattttataacatgtcagttcatactaaaagctcaccacaatggcacacattttcaaaattgcagctacagagaaagaacagaaatgccccatggtcagttactctatgtagcaatgccttctacttaaggacattttgtaccatataaaaagtatgccaaaatggagacccatcttatataagcccagcatgaaggttacctacatattttttaaaagccatagaactaaattagtcaaattgaagtcaaagaagaagctaatctaatatatgagacaacagaaaagctttcactgaatcaccagaacaagaataaccttcagctacaaggcatcaactttaagcaaccacggcagaagtaatgtgcccttcacatacactttgaaagtgacagaggcttctgttgctgcaagtccagtgagcctatgggtccatcccattccataatattgtaaaacagctcaactgtatatgaattctcgtaaggtctgatatttttaaaaagcagagaacaaaaagagaatggcaaaggtagtagaattctcatcaacctcaatgtgaagccaaaaaattcccatttcttctttgttctctgttcagctagaaataaataaaagcctgcttatcagaataaataaaatgaaaccaaagtccttgaaaaacactatattcatttttctgtaaatcaataaatacacttaggaaaacaaatagtatgtaactggggaatttcagcttcttctgtgtctcctagttttccattctgtcataatccttgaagagaattttaaaaagtctctgctagaatctttaaatctaaccatccaagttcattatttatcaatattttcttaaagtttctccaggaacactagctaaatacctattaaccctacttaactgtttcttattacacatgttaaatatcctctctataggaaatagatgacttttctcccctggcttcaaaacaccaccctcctgcttctccccaacaatttagaattcaagaaacaaatggaagcaagcaacaaaacattagtaacattagaagtatcccatacacatggactgagaacacatttggggacatggtgggcagactagcaatttgctgtggaattacacagcaaaaaaagaaaagatggaaaagccacaaacactcatcttcactcatctttcatagcaagagattaatagatactatttgaggttgaatgcaatttctcattcatggaaaaatatgtaaacttaaccatgtaaaaagcctcccaacctcattcataataagagaaatgcgaattaagtccgggcgcagtggctcatgactgtaatcccaacactttgggaggccgaggcggtggatcatgaggtcaggagatcgagaccatcctggctaacacagtgaaaccccatctctactaaaaatacaaaatattagccaggcatggtggtgggtgcctgtagtcccagctattcgagaggctgagacaggagaatggcttgaacccgggaggcagagcttgcagtgagccaagatcgcgccactgcactccagcctgggcgacagagcaagactccgtctcaaaaaaaaaaaaaaagagaaatgcaaattaaaatacattgagatattctttctcacctttcagattggcaaataccaaaatttttataacaaactgttagtaaggctgcagagaaacaaatactcttataccttgcttgtggatatttaaaacattatccctatggagggcaaatatgcaatacatgtatatgtatatgtatgtatttaaactttgacccagcaattcagtttttaggactctaccacaaatataaaaataaaaagtgatgtattcccaaggcaattaattgcagcaattttactaaaacaaaaaaaaaagagagagagagaaaaggaaggaagaaagagaaaaaggagggagggagggagggaagaaagaaggaaggaaggaagggaagaaagtcaggaagttaggcagggaggaagggaggcagggagggaatgttggccctttcttcacatcacatacaaaaacttacttgaaatggatcacagagctaaaggtaggacctaaagctattaaacttctagaagaaaacataggaaaaaaatcattgtaaccttggcaaagtcttcttagatgcaacaccaaaagcatgatccataaacgaaaaagttgataaactggacttcatgaaaattcaaacttcgtgaaaatacaaaccatagacggggacaaagtattttgaaaatctacatatgacaaaggtcttgtatccaggaaataaaaagaacccttagaactcaataattaaatgaaaaacaactcaactctttaaatgggcaaaaaaaaaattgaaaagacatcttaccaaagaaaatatatacatggcaaataagcacatgaaaaatgttcaacatcattagtcactagagaaatgcaaattaaagccaaaatatgtactcctccacacatgctagaatggctaaaatttgaaagattataaatactggagctagcaaagatgagaaacaactggaaatctcacacattgctagcaaaaacgtaaactggtacagccactttagagaaaagcttggaagtgtcttataaagttaaacatatacccactctatagctcagcaattccactccttaggtatttagccaagagaaataaacacttatgtccatatagatacctgtatgcaaacattcatggtggccttactcataagacagtcatccccccaatccttgggggatatgttccaagacccccagtggatacttgaaacctgggatagtaccaaaccctatatatactatgctttttcctattcaacacacatataataaagtttataaattaggcacagtaagagattaacaacaataacataataaaatagaatgattttagcaatatattgcaataaaagttatgtgaatgtgctcactcattctctctcgcaaaatatcttattttgtgtcatatttttgaaccatgggtagctgaaactgctaaaagtgaaaccatggataagaggggactactgtagtcagaaactagaaacaactcaaattttcatctacaagtgaatggataaacaatctgtggcacaagaataccatcacatgttatgcaagaagaaagaatgaaccaagtatacatgcaatgacatgaacgaatatcaaaagcgttttgctgagtgagaatcagacataaataagtacacactatatgattccatttatataacatttttgaaaggacaaaaatacagggacaaaaaacagattggtagttgccagatgccaacagttgatgtaatcagttgactgcagaagggcacaaagaaactttttagcatgttggggatattctatttgattgtggcggtgatggttctataactgtatatggttgtcagaactcatcaaactgtaaactttaaaggagtgaatttaatatggtatatataagttatttctcggtaaatttgacttttaaaaacatcttttgtgttcatctcttatcccagtggcacagaaatatttctacattatttcattcactatataattacaagtttccactgatatcctttggctccaggagctcttccttaagttctctgaattaatactttcaaaagttgattcactttttcgaagtgtcttggcccttcttgtacatctgtcaatttacagtatttggtgcctaaaccctacctaacttcttaatagtattcattcccaggcttcacacctgtgtgttcaggttattctcaatatcatcctgtgcatctgatcagttatgtgttatatatttgatttataatttttctggcaagaactctaagtcaacctatctatgtgtttacaaaactacaaaaacaagagctttcagtatttgtttttgtactgctttaaaaaaaaatttctttttatttttctttgtgtgtgtgtgtgtgtgttaaagctagctgaggttttattttggaccaaaaaaaaaagcaattgaattgttttgtagctggaggcatgggcaagtgcggtccccagtcagtaaactctcccgtgggtgggctgaggggctagggctgagcctcaggtgggtctcctcttccctgtgctcctctgcacaacggcctccctcccaggatctggggcagccgcaggaggggcaggctgggaggggctgccgcagctgttgacttgggcaggacgtcagaggactcggacaccagcttcccatcgcgggtctcggtcttcttcacaaccacagccctggtgaatcatttcttattgaccttacttttaacaacgaataaaaaagagccaaatgactgtccctggctcatcatgttaatatcagaagacaacactgaaaatccttcgcaaattttaactactaccctcttgtcttttttcaattctgctctctgacagcagcgagtttctaagctagttcacttagacaagcccagtttagtgagtacaaggcccagagtccagaatcttcaacatagtaggtgtcctgcgagtatgtgaagatgaaagtacattataaagtcctgtctctggtttccttctttctacccaacaactttttttacaagttagatcaatccagttaattttgaccttactgaagttgaaattcaagttaaatttactgctagattaaaagtgtgaaaagaaggaaagtagctaatcccatttacaacaatttattttttaaaattgtaggactagtattcatacatttatacaaaattgctaaatatattttattttaaacattgtcttgatcatgtctgttctattatgtagatattttatcttatttagatcactctggtgtttccaaaaaactaagcttctttaatctctcttctgaactaaccaaatttttttctgaacatttggggccacatttactttcacataagttagtgtgtgggttaaaagggcagcatttcttcactatttttcaccaaaacacgagtgacatttaaagcatatttaatatttataatctaatatactctcctcattccagactgccaccaaggtaagagaaggcaactggtttgtatgaaactccaccataagatttctgaaaccctatattttctctctcatctatccataatacaccagagttatcattgagaattgctgcatttattttattgttttttttcttactcctggctctgttttatatcccacacttgttttctttcttctttcactccacatttaatttatcctatcttgaatttcatgtagccttataagtcaccttaaatcctttctagaacaagacaaggaataaataaagagtcattctaggtatctgaaaaagcaatcttttctcatttaccttagataaagccttacaactttaacttcttgctgcctcttagctatgctctaccgtattgaatacacaagtatcaaaaatcatgagtttctccttttttgctttaccaattctctgtttaaaaatatttaagtctgcgcacaaaaactacagggaaaaatccatgcacaatttaagtttaaaagcccataacttttaattaaaagcaattaaattatttgcacaaataacctactcgctgtacaatttttgtgtctaaagtatgtaaagtttctagtgccttgcatacagttactcaatcattatagtaatagctcagttacagagtaggagtttttaaatgagctgatgtaagactactatagcttgggtattggcacatgagaatctgttttagtgctatttttaaaaccactaataaacagcagactcgagcctctgctcaattgaatctgcctgagttgtgaaagaaaaaatgtgtaagagaaccacatttttatctaaatctgaaatgcctgctaatatactcggaaaagtagacatttaaaattggagctttcataaaatagtctagagtttagtgttactaaaacgaaaattagttataaaagtaaaaattgcacaacataatagtttctattcatcccattttatagaaataatgtcctttcatttcccccaaagttatctaaccgagcaacagataatctataattactaggatttgccttatagcaaagtttgatttttaaaagtttgacactccactcacctactgcaggacagagtattgcccatatacagatactaaaccaattgtctaagcaatttcttgtatttagaaattcagtgccactatcatggctcacaatttggcttatgatgcatctgtaagcaaacagcctgacaagcaccctagtgtatttcaggatgactgacaggacacagtggcccaagcaagaaggggggatgggtgctcttaaagcaacatgccagtgaagggtaacatcaaacagcagaatcagacctgaaattctatttttcagatttacaatgaaataataatacattacccactatcaacttctaaatacaacttgcatggtcattatgtacccaaaacactgtaaatcccaaagtagaatttttgagaatttgtaaaagtagaaagaaaaaatataaaacaggcatgttatatgatacttccctgaagcgatcaagctttcaggttacttaagaatatgcctgttatttttaacagaaattaaatcaggctatccacagaaaagccattctttcttttccttataatatcaacttttattttagattcaggaagtacttgtacaggtttgttatatgggtatactacatgatgctgacatttagggtataattgatcccgttacccaggtagtgtccagtggtggggtgagaaaagcagttcttatctcaccttcatatatttgtcaatagctcttacaacagtaatttaggaataactaatgaaggtaatttaaatatcttgaattaatctgaattgttattgaggataggggccagagattcacgtattttccccctactgcattccttccctatgacctacttcatgattaaaatatagaccaaaagattcagaaattctacttatagatatttctacattaatttcactttagaaaacattttagtaacatattggcttcattcttcacatttacaattttttcctatattatttcacaatactctgcactgctcaatccttttataatagagcaatcatccatattttaaaaacaaacaaacaaaaaagccaagtcactcatttttaaacacaattcctcatttagccagcagagggtattattagattctgaaagcccacatattgcacccaatgacatgtatttttatacttcagctaggaactgggacacatcatctcaactttccttagtaaatgtgcttagaaatatcccattttattttgcccatataaatttgacttttagagcccagattaatgcttctcatctgtatcacactaccattatttcctcctctatctgctccaacagctgcatcctctgaaaaaaagcactagaagaccaagaagtggcagaattaccaagaagaagcagaattgggttcaatcatcagaaagacttcccacaatcctaaatttttctgggacaaacaaatgaacaacaatcttacataaagattctaagctccattagaaaatcgaaaacaaatcctgaagaaaacagaactaaattacaggataaaatctctcttcaaaattatatgacatttgtaacctctttaactccctgtttaatatttgctaaattttcattatatattagaagccacagactaattttaaagatatacttcctgttattacagcattaatatatttctcataaacatgcggtattatgactaacaaagttcccttacaatttataggttctttatttcacaacttaacactcacttagtgtggaaagacatggacagcaatttgcctgatttattctaaaaataaaaattttactatctaattagctaaaatcattaacttccacaaatttatcttggctgaagataaaaaattttctgtttctttgatgcaattatatcacaaacatcaagttaactaagttaactatggcaaaagtgaaaaagcaatttcaaagagcaatctctttttcctgctctcagatttgccactaatggcacatcctctatgctaaagtactaaattttccaaagagaaaataaatgttaattctcttcctcaattgtcattcaaaataaaaaattataggttattttcctttaaaggggaattctatttctaataataaaaacaagcattgggttcttcattgaaagaaactgctctataagatcgtctctcatactcaaatgtggcagtttctttcctcatgtaataactaacaatagccaggtaaatatcatattttacatttggaaataaaataggatacctcttaattatattcttttatgaaattttatatcttcaattttctaaacagatacattcgctgtaatataaaatagatacctgggcttttttctcaaattaacttataggataacccactattcagaataaaactgaaaagtcagttttgccagtaatttgcttatcctttttgccaatcatccacacattttggaatatgtatataaataattttgttattgttgttgtttctagttacccacttaattctactttacttttcagctctgagtttggtacctgacacaggctctcctgaactatgtctcactcaatggtttttggttttcgcaggtgccttaagaacctacatctaaaggccttattagcctcaattctatttgtagattaaaaaaaattaaggataacgcttaggggtagggagagattgaataagcagtgaatagatactacttacttaaaatactcctttttacttttagcaaaaatgcctccatacactatatgctgtatctgaattttcaatatattttatataggcaatagtccccccttatagacaaggtatgtgttccaagacccatagtgaattcctgaaaccacagatagttctgaaccctatatatgtttttcctatacctgcaaactatgataaagtttaatttataagttaggcaagaaattaacaataataattataaaatagagcaattataacaatatgcttgcatcagaactcttgcgctttggggctaggccacgacagtccatttgaaaatctagatggcctctaggagtgactaatgggcaggcagcatatacagcaggacatgctggacaaaaagatgattcgtgtcctgattgagacataacaggataacacaagatctcattgtgctactcagaatggcacacacttaaaacttgtggattggttatttctggaatttccatttcatattttcagaccagggttgaccttgagtatctaaaaccacagaaaatgcaaccacagataaggggcctactgtgtttcttttttttttttttttttttttttgagacggagtctcacactgtcacccgggctggagtgcaatggcgtgatctcggcttactgcaacctccgcctccccggttcaagtgaatctcctacctcagcctcccgagcagctgggattacaggcactcgccaccatgcccggctaattttttgtatttttagtagagatggggtttcactatgttggccaggctagtctcgaactcctgaccttgtgatctgcccgcctcggcctcccaaagggcctattgtatttcatttatcttcaaaacaacttattattcccctaaattacagcagtgggctcttagcaggtaatattcacaccaattgacaggtatagtgcaagctcggactctgacataggttaggtatgctaagtttgaggtgcagtggcatatgcaaatagttatgtcccatgagcaactggaaatgcagaatccatgaactttggagaaaaattatgcctagagatacagatatagtaacctgtccatccatgttacactctaatccataagagtagatgagctctcccaagattaactatagaaggaatgaggcagccacattacaaaacaagtacagtgaagaatatgatgagaagaaatgtcataataagaatagtaagaaatgcaaaacaaactgggttcaaattcaaactcactttaccctctttggcctcatccacaatgaccccaatttaccctgttttcctgatgtgaaatgagacctataaaacttctatgaagagtaattacttataaaattacacatagaatataatggaatgctaattaccatgccaaataattcatttatcaattattgttattttgtggaaagatacttttctctttgtgaaattctgcttttcaaaaccaaaatgccattgaattttagagggctgctgtgaaacacatcaaacagattgcccctttgatttttaaatggatagagaatgattatgtccacacagctttatttagcaaattgaatccatgccatcaatggaagtcttctactccatccacgttaataatttataattggatagcaagaaaacctggtactgaaatggaaatatgtttagagcttcttccaaagttgcaacatgcttaataaattaaagggacactaacacatattaataaactgagtattttttggaagagtgggtatagaatggttaaagatagaataccgaactaaacacaaacaaatgacactaagaaaaaatagaaacctctgtgtcttgttcccacataagacttgtggagttgtgccaacctgcttcattccagagcagagagccactcagtcactgaggctatattagaaagagaggaaggaaatccttttctcccacactctctgtttccaaagataataacagaaaactagagagtgatggatttcactactaagcagccatgtctattttactcatgtctttcattgactctctaagtctagttctactgattttgcataatagaacaaaagaaatatatgtacaaaaacaaaatcaattttgcaaaacttgtaatatccctaaattttccaaaatataactgctatagtcactaaattaaaactataacatcattcctattaggtcatcaattgtattcaaaagaatgaagcttatcacagagaaaggtaaaataattaaattcagtcatagagccaatgaatcacacttcttttacttcaaatgataaccctgccaaatcaaacagtctgagtaacccacacacacacatcccaagccaatccacttttatccccctgggtcttgggtgcacagaattagactgacacaatcaatcatggtcctaactggtggactagtctatgaaaagcctgttttattttttgttttcatagtctatattccctgttctcagttccattcccctctctgcttcttatggtagttaatgggtacatttccaattaaacttccgtaactttttttacatatgctatatacgtctacaagaatatataactttatgtgtatggatgtttaaatttacacaaataatattgtatttcccatctctttctacttctatctctctgtgtctgtttcattgtgtggttttgtttttttgtttgtttgtttgttttttggtctatctatgttggactataaagatgtggtaaacattgcatgtttgctcactcagcacatagtcccaaccttattctcccttatctttctctgctatggaggcaggacatttgatttcccagccttctttgcaactcagaatggcatgtgaaagaattctggccaatgagacggtaaagcttttgctttccctatcaaaaggacatcagcatccttgccatgtcttccttaacctgactgtggtaaggtgcctggaaataaaacaatcttactgcaaagctgaagaggaaggatgacagagcagaactatagaaagaacttgggcccttgatgacatccgttattaacttcttttttcttaattttattattattatactttaagttttagggtacatgtgcacaatgtgcaggtttgttacatgtctatacatgtgccatgttggtgtgctgcacccattaactcgtcatttagcattaggtatatctcctaatgctatccctccccgctccccccaccccacaacagtccctgaagtgtgatattccccttcctgtgtccaagtgttctcattgttcaattcccacctatgagtgagaacatgcggtgtttggttttttgtccttgcgatagtttgctgagaatgatggtttccagtttcatccatgtccctacaaaggacatgaactcatcattttttatggctgcatagtattccatggtgtatatgtgccacattttcttaatccagtctatcgttgttggacatttgggttggttccaagtctttgctattgttaatagtgccacaataaacatacgtgtgcatgtgtctttatagcagcatgatttataatcctttgggtatatacccagtaatgggatggctgggtcaaatggtatttgtagttctagacccctgaggaatcgccacactgacttccacaatggttgaactagtttacagtcccaccaacagtgtaaaattgttcctatttctccacatcctctccagcacctgttgtttcctgactttttgatgatcgccattctaactggtgtgagatggtatctcattgtggttttgatttgcatttctctgatggccagtgatgatgagcattttttcatgtgtctttggctgcataaatgtcttcttttgagaagtgtctgttcatatccttcgcccactttttggtggggttgtttgtttttttcttgtaaatttgtttgagttcattgtagattctgggtattagccctttgtcagatgagtaggttgcgaaaattttctcccattttgtgggttgcctgttcactctgatggtagtttcttctgctgtgcagaagctcttgagtttaattagatcccatttgtcaattttggcttttgttgccattgcttttggtgttttagacatgaagtccttgcccatgcctatgtcctgaatggtatcgcctaggttttcttctagggtttttatggttttaggtctaacatgtaagtctttaatccatcttgaattaatttttgtataaggtgtaaggaagggatccagtttcagctttctacgtagggctagccagttttcccagcaccatttattaaaaagggtatcctttccccattgcttgtttctctcaggtttgtcaaagatcagatggttgtagatatgaggcattatttctgagggctctgttctgttccattggtcgatatctctgttttggtaccagtatcatgctgttttggttactgtagccttgtagtatagtttgaagtcaggtagtgtgatgcctccagctttgttcttttggcttaggattgacttggcgatgcgggctcttttttggttccatatgaactttaaagtagtttttcccaattctgtgaagaaagtcattggtagcttgatggggatggcattgaatctataaattaccttgggcagtatggccattttcacgatattgattcttcctacccatgagcatggaatgttcttccatttgtttgtgtcctcttttatttcattgagcagtggtttgtagttctccttgaagaggtccttcacatcccttgtaagttggattcccaggtattttattctctttgaagcaattgtgaatggtagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtgtttgcccattcggtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatgttgaaccagccttgcatcccagggatgaagcccacttgatcaaactaaatctattatattagttaagaactcatttttatcacataacaagaagtctagaggtaagaagttaataacggacgtccgttattaacttcttacctctagacttcttgttatgtgataaaaatgagttcttaactaatataatagatttagtttgttcctttattttccattgtgtagcattctatcacatgcatttataaatatattttgtgtccatatcactaatcaagcacgtttcggtaatagccaactctttgctgtaggagacaatgctgtaataaacattctcatacatgtctctttgtgtgcctatgcaagagtccctctggtgtatacattctgttatgggctaaattgtatctcctcaaaattcctgtgttaaagtcctaaaccctagtacctcactcacgatatgactgtatttggagataggtccgttaaagaggtgattaggttaaaatgaggctgttaggatgggccctaattcagtcatactggtgtccttctaagaagaggaaattaggacatagagaagaaaagacatcaggaatgtgcacatagaggggcaaccatgtgagaaaggtggtcatctgcaagccaaggaaagaggcctcagaagaaaccaaacctgccaacaccttgatcttggacttatagcctccagaactgtgaaaaaataaatttctcttgcttaaagatcccagtctgtggtattttactctggcagtcctagcaaactaatacaattcagaagtagaatttctgggtcagaatgtgtgttcagtttcaataagtattgtcaaattggtctccaaaaaacaccaccagcagagaatgtaggttcacatgtccccacctcctcaccaaaacaagatattacatgacattttaactcccatcaacatgggacatgcaaaggagatatcacatcactattgttttgatttgcacttctgattaccagtgtaaatgctaatctctttttagttgattagtcagccattcaaatatcctttctatgaattgcttacttgtattcttcacctgtttttctcctaggttgcctgttcatttccttactgacttcaaagaattccctatatattgtaaatataatcttttgtcagtaatattccttgaaaatatcctctccctgcttcatatgtccctctttgtctaggataccttcccttgaacattgtaacatctgtatatgaaagttccattttcttcatatccttacacattctaggttattgccatacattaatatctaccaatttaatgagtagataaagtatcccattgttgttttaatgtgtctttacccagtaactagtgaagaaaactaagtttcttttgacttatttatgggtcattctagttttcttttctgtgaattaccttttcacatatcattgaccctattggattgttcgttttttgattatcttttccttattaattttttggagtttttaataaaatcttatgataaatgacttttgttaaatgatgtatgagtcaactattttgacaataacaccatataaaaaaaactaccactgaggtttagaactcagtggcctaagaaaacatttattatttcttgtggattttcaggttggctaaagattggctaattcagaatggacctggcttagcttgccccaggctatagttttgggatccagatctgctccacatttttctcatcctccttggacaagtaggccacttggagcatattcttctcatgaacagaaacacaagatgggcaaatggaaacattgagtacctcttaaggtgaaggctcaaagttggcactctgccttttctgcccacattctaatgggcaaagcaagttatatggccaagtctaacttttctgcccacattccgacaggcaaaacaagtcatatggccaagtctaacattaatggagcagggaaatacactctgcctctagcaggaggaattgcaaagacacatggcaaaggggatggatatagggagcaagaggattgggaaacaacaatgcaatccactttatatggatgaatgtaaacataccctgtcaactggtagtttttgtttctttttattgttttttcagtcttttaattaattaatttttgcattaatgtaataatttcagttttttactttatggctatgttttgggagtcttatttaagaaattatgtcctatcctaagatcataaatatattctatattttcctctagaatgcaatcatagggatcaataaccaatatattttaaattagcatatgcctaaatgtaagattatatcatataaactaaaggccgaggcacccaagttaagtaatcaaaattaaaaatatttacccaaggatggctacttatttcaggttaattttttagcttggtctttaaaatatattaatgatacaggctggcaaagaagagaaagacccaggaattataagaaatcacaaaacttgattgtcttttataaacagatctttattaatctaagcagtataggtatattcaaaaatgcaaagcacaagaacacagaaaaatatatacaatcttctgaggtcatgccactggaaaaggaaaaaagaaactttcacagaactgaacaattataaaatgatatatgttatgatgtcatatttgtaaaatatatgtgtatatgtggtaatagcagggtccacttcaatagttttgggtaaaaatgaggtcattactattaatttttcaagctaaaaccacttcccaattgccagactggcagggaatccagtatctctcttgtctctcaaattgttcaaaaactctgggggcatcttcattcacatgccacagagaaagaaaggcagagaagtggattagaatacaagtgggctttgttgaaggatgctggtgctctgttcctggtacacagtttactgatggaagctgactccccatagttcagtgagaccctttctcctgctgcactctagctgttgctgtggatccagtgagaggccacaatgatttaagacaagcataccattccggcaaatgtatggcacagaacccatgccttcaacgttttaatttaccaagcctagtggctgagtcaggagggccttccagtcagttacacatgtgccagaaacaaacacttctagggtaacataggccacaaggggggttctagtttaagggtctttggtgttctttctcactagcaaattttagtcagtactaatttgatgcaggggtcagaagaactcttcctaacaacagatacattgtaaaaggaaagagtccaggttttcagtcttctcctgtttgaaggctcccagattctacaaatttcctccagtctccccagtgttgaccagccctgcagctgaaacaagactagaaagggcaagctttctcaagttagaaaaagacccttttacgctagtatctgagacacaaaatgataaggatctcattaatgatttccaaacactggaggaaaattttcccttaccttaaggttcacagataaaatacaaaatgcccactttgactttcagataaacaaagaataattttttggcataagtatgccctatgcaatatttgggacatacttacacacgcacgcatgcacacacacatatgtgctgtttccttggaatttaaatcaagagtgtgtcctgtatttttatttactaaatctggccactttaccttatctacttcatgaattataaacaaggaaaaagggagctgaaactcacttgtgtctaaatttgcaacaacctcacatcccacccatgtatcctcacatcctatcaaagacttggggctggcacaaccaatcaaaaagtcagcttgcacccccttacttcaaagaagctgcttttcaggtagccaggggtgtttcctagacacctcctagcaatacatttctaactacactcagccagaagattttgagtcgcagaaatgcagcacaggatgagaggggacaaggaaagaatgacatattgtactctggtatgagaaagccccaaaagagaaggcagacataagaaaaacacagacagaagggtgctctggagattaggttttatgtgtctcttttagaaaggtgaatcgaattgcttcagattatctagggttaaattcacctccaagtagaggaacaaataataggagtaggagaagagttgccccgatgcaaatgtacctcctgtagcccagaaacttaacaagatacttgtccttcactttaagatttgagagaataattctgtagaatcaaaactaatactgattgagctcaaaggctacacatacctcatttctgacaaacaccaggactaaatataaatcttatgtatttcaaaaataacagaaaaaaacaaaatttaaaaatcgtgtaacataaaagaggaagacactttcttaaagatgtaagggaaaattatcaccaagacaaaagaaaatttagaatatatctcttctgtgttctcagtgaaatacccaaaaatgtaaattctaggaaagaagtgatggaaaggctaaaaagaaaagaaagttgactgaagtgacaggtcaagataaaaagagacctggcaaagatttaaacatccaagaatttggcaaaagaaaaagacaatgaagtaattaaaatctgaatcattcctctcctttatctcctgcctctctaccagcagcttcatcattcagagggcaaaagaagcaaagaatggaactgctaccctggatttaattattaccaacaaagaatgatacgttagggaagtgaaagtgacaggaaccttggggaaaattgaacatatcaccttagagttcattacagtaaagaaagaaaacacaaagcaaagtaagacaagtatcttagattgcttagcagttgagagaaaatataagaatgtcccagagccacagactttaaatgaaaaataggtcaaaaaacttaagccattactacatcacacagatggtatacaaggagccttctaaagagctgagatgtttaaagaacacacaaaagaaggaagaaggtaaaggttaggatgaacacatcactgtagtatcagtctattagaaaagtagtgtaaacctaggatgagcaaagacttaaacaacacaaaaacttttaaggttgtgtttgatgatggaagtagataaaaaaggtacaagtctcctcctcccccagacagatttcatattaacaagtaatagagagaaagcaaaataacaatatttttactttgctttcatcttgtctcccaaggagaatggtctttaaaataaaaagattgtaccaacaatcttgagatgaaattgataaacgagaaaggagaaaagatagtaagagaatgcttaacaatttagataaatgaccatttctgggtatattccattaaagcagggtttctcatcttcagtgctattgacatttgaggctggataactctttatggttgggggctttcctgtgtgttgtaaaatgtttagcagcatccctggcttctacccactagatgccaaaagaacctgccccctagttatgacagccaaaaatgtctccagacattgccaaatgtcctctgagaagcaaaagcaccctgagttgagaaccactattttacagagcactgaaaaacatgcacatattatcacagaattcttgctggcatttggcatactaatggaaaatgagagtggtaacagaatattgggaattcacaaatgttttcccatatatcagaaaggtagaatttaaaaagtaaaaccaaattctatcttggtctctagaaaagtatcaaaatattattaattagaaaagagaacaatgattttttgctacattggtataggttcattaggagccactcatagtaaactaacttaattttcttctcttcctttttttaaaaaaatcattgctaaaagataaaattggtttcactcaaacattttttaaatcttttgtgaaattttctttgccaagataaagaaatgtgagctatctcatacactgttggtcaaagtgaatattggtaaaatctctttgaaaagcattctggcagtatccacaaaattttatatgcacgaattattgaacaaagtaatgccacttctagggatctgaacatacgaacaaagatgtatatcacaaactgcagaattgtttgtagcaacaaaaggtagaaacaacctaaatgtgcattaataagggactggttaaataaattgtcatatattctttcattggtctgacttttaattattattagtgggtcagaaaagccttaaaaaatatatagaatctaattggatgtcaattgagtaacagtaggagagatattaaaaatatttaacaaccagcatggctcaggccccaagcaatcagagcttaggctggagctgtcttggaagcttcatcctgtgccaagtgtttacctttcagttgctgggtctaggaaaggtccagggggtctcaagcagaggccaagtgaaggaaaatcactggtaagggtaagggagaagtacaaaagcatttcatattttaacaatttgtatgcctcactagggactatcagtcctcactaacagataaaacattaaaataactcagaataacatggagcaataaattgactgaaatagaacccagatttcaccaatcaatcatggcttgggtgagattttagaacgtcacaggaatcagatccttctaggaaagctgcgatggggcttccagtgtccagcccaaaagcaccaaacggtagaaaccagtacttctgtatcactgtccaatcttcccagctgcattgtctttgtttctctggctctcatggagaatctatgaactacctaatgtcatttatgaaactcttgttgcttaaaccagctaaagtagactttagttataatcaaaaaccctggctaaggtaccctttactaaaataaatatgcatatataactttttactttaagaaagttaatttttataaatgactttttaaaaaagatatgtggactgattagttacagatctgaggaaacacctggttgaagaaataaatccaaaagagcagtatagagatctagatcccaaaagcccatatgaatattagctgtgtatcaaccaccggaggcacttcttaaaaatacaaatgtggacccaaatcaatggctcactttcttacacataataactaattttaaaatatgatggaaggaaagagaccgtttatgataccaataaaaattttttaaatactgatatgaaaacaactttaaaactctactgagggttgtaaaagaagaattaagtatattaaaaagtgatgtataggcaaattgaacattacagaagtgttaattctccctgttaaatgtccacagaccacttgagaacttgataaaatgttaaaattcatctagaaataaatattatgtgattacatctaggaaaatcctgaaaggacagaaaagaatatggagaaggattattccttccagttattaaaacatattatgaaatgaagttattttaaaagtagggattggaaaaaataggaacaaatattaatagaacaggaaagacagctgagaaatggactccaatataaacttagcttatgataaatacggcttttcaaattatcaggaaaaaaggtgattcttaaataaattataatgatcaactgaataaacatttaggagaaaaattaaaaataaagcttactccctgctcactcttttgcccaaattcaattccagatgtagcaagaattttaaagttctgaaagtatgaatatataagtttatgtataataaatgtataataactaagtggaaatttttatgtataatacatttttaaagtatgtataataaatttataataattaagcagaaagccctttctaagcaaaactcaaaacccagaagctataaaggaagaggtttaaaattttgactacaaaaatattttgttttctatataattcaaaaataaaacaaaagtcataaaataaacaacaaattatggggaaatacctggaacatattaaacaggcaaaaagctaatttgcttaatttactatggtgggataaaaagaagaactcagccaggcgtggtggctcatgcctgtaatcccagcactttgggaggttgagggagatggatcacaaggtcacaagatcaagaccatgctggctaacacagtaaaaccccatctctactaaaaacacaaaaaaattagccaggcgtggtggtgggcacccgtaatcgcagctactcgggaggctgaggcaggagaattgcttgaacccaggaggcagaggttgcagtgagccgagattgcgccattgcactccaacctgggtgacaagagcaaaaccccgtctcaaaaaaaaaaaaaaaaaatttagcccagcgtggtggtgggcgcctatagtcccagctacttgggaggctgaggcaggagaatggtgtgaacacacgaggcggagcttgcagtgagctgagatggcaccactgcactctagcctgggtgacagagcgagactctatctcaaaaaaaaaaaaagactcaatagaaaaaattgggcaagtatttgtaaaggcaatttatgtaaaaagaagggcaatgggttaataagtacttagaaattgttcaactatacttataattaattaaatgcaaatcaaataaaacaagatattattttcaccaagcagccaaaattgaaaatttttgatatggtatcatcagtgctgtttaagtgttaggaacataagctcttagtatacactgttgaaggggtataaactgatatgaacttcttgaagagaaatatgacaatacatctcaaattataaattatgtgtactcttgaatatttccaattaaatgtaatacttatgaaattttaaaataaacattcccattgatacagcaattccacttccatgaacgtattctaaggatacactcaaaaagtacaccaggatatatgaacaagcatattcattgcacacagcaacaggacaaacaaacaacaaatactgaaaactacaaacatgtccatcaattcagaatgggctaaataaattctgctacatacacagagtaaaacacgacaaagctgctggaaagaatgaggcaggtctattagaactgctatgcatctgtcttaaccaaatataactgtcttaagcgggaagaagatacaagatcaacctgcataacattatgccttttttttcttgacccaaattagggttctgtcaattagcaagcagaggagaatacatggatattgcataggcaaccaacagtgtctatcacagactatttgattcttaagattcctttgtaatcccacattgggaaaatagaaattgcagagtctaacagaaaagcaagttaatcctgcaaattcccatgaaaacatgacccatgagcttcagccctggactaagaacccaggatctcttctggtgaatctcagagaagttggtttatgtattactctgtcttcacccccatccacaaaaacacacacattagaaaggaaacatcatgaggacagggtctatttttggttcactggtatttatctccagactaagaactatgtctggcacacaagtcatatagaatgaatgaatgaattccaaaccaacattagagtagacccagtgtagcccttcagcaatcctgcctctcagttattctgtgggctcctcaatgagctaactctgggcctctttgaactgatgccacccctagaggcctcatcaactgagaattggtaattcatttattacccagttaattgtataccttcatcccaattctctgccttcatgcatataggtaagagtgtgtccagaattggttccttctggtgggttcttgatctcactgacttcaagaacgaagccacagacactcgtggtgagtgttaccactcttaaagatgttgtgtccagagtttgttcctttagatgtgtccagagtttcttccttccggtgggttcacggtcttgctgacttcaggagtgaagccacagaccttctcagtgagtgttacagctcttaaaggcggcatatccggagtggtttgttcctcccgatgggttcacggtctcgctcacgtcaggaatgaagccgcagaccctcgtggtgagtattacagctcataaaggtaatgcgaacccaaagagtgagcaacagcaaaatttattgtgaagagcaaaagaacaaagcttccacagcatggaaggggacctgagcgggttgccgctgctggctcaggtggccagcttttattcccttatttggccccacccacatcctgctgattggtccattttacagagcgctgattggtccgttttacagagtgctgattggtccgtttttacagagtgctgattggcacgtttacaaacctttagctagacacagagcactgactggtgcgtttttacagactgctgattggtgcatttacaaacctttagctagacacagagtgctgattggtgcatttttgcagagtgctgattggtgcatttacacatctttagccagacacagagcactgatttgtgcgtttttacagagtgctgactggtgcgtttacaaacctttagctagacacagagtgctgactgatgcgtttacaacctttagctagacagaaaattctccaagtccccacccaacccagaagcccagccggcttcatctctcaatcccccctctaaacaggacaccccaactgcttttgggaattgggcgatgaccgctctagctacttcctgctggataggggcaaagaaggggcctgccctgcagttctagtttcctccagaggggatctctttaggccagtgaaagggccagcgggtcactccaggggtcctcagtagaagttgttagttgagctcatttggggttccatttgtaagaccatctgtaacttgatggccttgattctagaggaaacaaatttgacgaagaggttaaaaatacagggcccgaaggtgagtaatagcaagattgctgtcatgggacctagaaaagggagaagccatgttgcccaactccagaggttggtataagagtttgaaaggtgttgtctgatttcagaagccttttcctgtaaacgctgggcggcatcttgtactatccctgactggttagtgtaaaagcaacactcttccgctaagaaggtgcaaagtcctcctttctcagcagtgaggaggtctaagcctcggcagttttggagagtcactgctgccgaagagtctatttgggattgtagagtaaggatagattttgttatttcttgcaaactgtctgagaaatcctttgagagtgtgtggtagtaggataatacatgttactccgttaacttttagcaaactttacttttgttgaaaaccttgtaagtttgggattttaattattctttgctattaataaaccctcgttcagtccatattaacttagaattggtatagatggctccttcctgattctgtaagtactttaaggtttagctgagtgcaaacagcttgcacatttaagcagaccaattattaggcaattttcctaactctgcttctacaagagtttccttatcacttactgaacacccattgtctttttcccttaatcgcccaggaggaaccatctatcgtcctgtcctgaagggagttcctcctaggtctggttggacctttgtatggtaattaattatgatttagatcccctgttaggaaacttgctgtgttaaggattttagataggaaggctatgggttgtcagtggcctcagtgctttcgggctacacccttgtttacactgacaacaaggtggtatttgagtgttatagggttacagagaagaccttcaattatcaattataggtttttaatttaccctggcttttaaaggaatagggtacactgttttttctttactacttctatctctctctttctccctctttgatttcttcatctgtctgtctctttctctctgactccctctttgtctcttcctctttccttgtttgactttctgtctctctgtatcttcctctctctgtctctctctttgactccttctttgtctctgtctcttcctctgtctccttctctttgtctatctgtttcttcctctctctctttccttctgtctttgactttgtctctctctttctttctctccatcttttctctctggtggttttggcagtcttatactccttgggtttttgcattgtatgcaataactccagggtttccttgtgatatttaatgggggttcccccagaggttaggaactccctttctttccatattgcagcatgggcatgtaggattagataagcatacttgctatctgtatacacatttattcttcttccctttcccagttctaaggcttgggtaagtgccactagttctgctaactgggtgctggtccctgggggaagaggcttagtttcaagtactgttactatggcataacctgcccttcgtatcccattctccacaaatgaactttcatcggtatataggttaaggtcaggattagctaaggggacttctaagagatcatcttgggtggcataagtctggactataacctgttggtagccatgcttgaccagctcctcatcctctggtagaaaagtggcagggctgagggccacacatgtatgcacttgaagcactggtccctcaaggagtagcgcctggtatctaagcaggcggttgtctgataaccataaacttcctttggcacctagtatgccatttacattgtgagtagtccagacagtgagatcctttccttgtattattttgatagcctctgacactaagacagccaccgccacaactacctgtaaacagtgaggccagacttttgctactatatcaatttccttacttaggtatgtcactgattgtggggttgtcccatgagtctgagtaaggaccccaagagctattcctgctctctttgtgatgtataaagaaaagttttgtcctgtgggaaggcttaaggatggaccttgagtttgttccttccaatgcccagacttcagggttgattccctcctcaagcaggggacaacaaatgggtaacttgttccccatattcatagataatagctccagctttggctaatatgtccctccctaataagggtgtgggactttcagacacaacaagaaaggcatgtgaaaagagcaaagtctcccagttacaactgaggaggtgggagaaatacctggttacaggccatcccaggattcctcagatggtaacggaccttgaggacagctgtccaggacaggagattaacactgagaaggccatgccagtgtccaggaggaaatcaatttcctggccctcaatggttaaacatacccggggctcagtgagggtgatgacatgagctggcacttgccccgggcatcctcagtcctgttgttggatcatctggttgggggcttctggcccagagaaccattgtactctggggcagtgagccttccagtgattgcctccgcatagtggacatgggtgagggagcagcttatttctagtaggacaatcttttttaaagtgtccttgcaaaccatactgaatacaagccctaccaggtgattgacctgctctattttctgtcctctctgaaccaccaaggtttgtttgtctgagggccatgactaaggctgtggcctttctctgatcttgcttttctttttgggcctgtttctcttggtccctattatagaacaccgaggttgccaggtttaataatgcctccagattttgttcagggcgcaaggctcgcttttggagctttctcctgatatctgtggctgattaggtaataaacttatcttttagaatcaattgaccctcgagtgggtcgggtgacaggagagtatattttcttaaggcctcccatagctgttcgaggaaggcagaaggattttcttcctttccctgagttacggtggacatcattgaataattcacaggctttttcctaattctccttagtccttctaaaacacaggtcaacagatgtttgcaactccagtccccatgatctgagtcgaggtcccagtggggatccatactggggatggcttgctgaccagtagggaatttgcccctttcttcgactgtcattctatcatttacttgactaagataccaggtatctccaaactctcgggctgcaactaaagccacattcttttcattaaaggccagagtttgacctaatagcatgatatctctccaagtgaggtcaaaggtttgccctagaccctgtaagacatctatatacctaacaggatcatctgaaaacttccccagatctgccttgatctgctttaaatcagagagggagaaggggacatgtacccgggttgggccaaattcccctccccctacagcttgaaggggacataaatgatagctcaggggtttttgtggtcctttggagatttctttgtttgtttccttctgggtgggggagattagaggaggcttatcattaataggaaggggagctatagggaggctaggatatggaggtaagctgagaggtcctcctgtgggatgtaaattgcaagttttgcatagttgtgtattctccttcaatgaaaagaaagcttggacataaggtatttcactccatttgccttccttcttacagaaaaagtcaagctgcaggataggattgtactttatacttccttcaggtggccatctttcccatcagagagagaatattggggccaggccatagtgcagaaaaaagttagctgcctctttttcagggtttgcaggtcaaattggtcccaatggcttaggatgcatttcaagggtgagcctgttgatgcctgagtgtttcccatctgaaagacaaaaccacccttggtcttggtttgtttctacccctccccaagaacccacaatagtccctggaccctgctgattggaatagttgcacttactgatgcagcaacagaaacacctcttgcccaagaacccgcaacggtccctggaccctgctgatcagaatagttgtgctcaccgacgcagcatcagaaacactagttttcctcttagaccaaaaagaggaccgaggaaggtcagatttagtggcccttactgatgcattctcaaaaacctgcattcttgcctgtcctcttagaccacaaagaggaccaagaaaaattggatttagtggcccttaccgatgcattctcaaaaagctgttagagtcctaagcattatcctgttagtattgggaccttaccactgtcctataaagatgttatgccccaaaaatgaactggacggacataccctgagagagggaaaggatctccagagttggaagagtgatgctttttgtcctcacttatatgaataggaaagataccatttccgaagctccccatatcctagcttcaggaatagcttttgttaggcctgcttgtctgaagagggatcctaaaattccagatagtcccttgcccagatgggactttgggcaaaaattatgtctttctgattggtgagcccgggtgcctaaagaaggtaaaagagtcctgaagtttatactagaaatcattcttataggagaaactagaaaagcaccagagacagggagtgctttttagaagtggactagcctcagagaagagaggcgagaggaagtttgtctgacaggcattaggacccaggaggcaagggtcaggagataggatagatgggcaagtctcgcttgggtgacatgattttgagagttccactcatggccgcagggtcaaccaacttgttgttgggaccccggagctgaatggctttcctctctgtcaaccctcggctcagcctggaagtaccattaaagtggaagctggctccaggcaaaccaacattcccaactccatagagtcagggattgttagagagccctatcccagaaagcctggcacctgtgtctttagtccagcggccgcgctagttgcttttagctgaccgacaggtgcccagtatttacccccagaattctaaggaaaaacaggacagaatagcaagcaaaaggggtctgatggtactcatcacttggcaataggcgagagtcccatctgggttgccaaaatgtgtccagaattggttgcttctggtgggttcttggtctcgctgacttcaagaatgaagccgcagaccccacggtgactgttaccactcttaaagatggtgtgtctggagtttattccttcagatgttcatatgtgtccggagttactcccttccggtgggttcgtggtcttgctgacttcaggagtgaagccacagaccttcacagtgagtgttacggctcttaaaggcagcacgtctggagttgtttgttcctcccagtgggttcatgatctggctgacttcaggaatgaagccacagaccctcacggtgagtgttacagctcataaaggtagtgcggacccaaagagtgagcagcagcaagatttattatgaagagtgaaagaacaaagcttccacagtgtggaaggggacccgagcaggttgccactgctggctcaggtagccagcttttattctcttatttggcccccaccatgtcctgctgattggtccattttacagagtgctgattggtccattttacagagtgactggttctgtttttacagagtcctgattggtgcatttacaaacctttagctagacacagagcgctgattggtgcatttttgcagagtgctgattggtgcgtttacaaacctttagctagactagacacagagcactgattggtgcatttacaatcccttagctattcagaaaagttctccaagtccccacctgaccctgaagcctagccagcttcacctctcaagaggagataaatgtttatacagtgtaacttaagcaacgctactcaaactgcaggtctgcgatgagaaaaggagcttgtaccagaatgtaagttaatgagtgcttccttcatctagaaagtcttgctacagcctctccctctccctctccgtctctgtctccctctccccacggtctccctctccctctctttccacggtctccctctgatgccgagccgaagctggacggtactgctgccatctcggctcactgcaacctccctgcctgattctcctgcctcagcctgccgagtgcctgcgattgcaggcgcgcgccgccacgcctgactggttttcgtatttttttggtggagacggggtttcactgtgtcggccgggctggtctccagctcccaaccacgagtgatccaccagcctcggcctcccaaggtgctgggattgcagatggagtctcgttcactcagtgctcaatggtgcccaggctggagtgcagtggcatgatctcggctcactacaacctccacctcccagcagcctgccttggcctcccaaagtgccgagattgcagcctctgcctggccaccaccccgtctgggaagtgaggagcatctccgcctggccgcccatcatctgggatgtgaggagcccctctgcctggctgcccagtctggaaagtgaggagcgtctctgcctggccgccatcccatctaggaagtgaggagcgcctcttcccggccaccatcacatctgggaagtgaggagcgtctctgcccggccgcccatcgtctgagatgtggggagcacctctgccctgccgccccgtccgggatgtgaggagcgtctctgcccggtcgccccgtctgagaagtgaggagaccctctgcctggcaaccgccccgtctgagaagtgaggagcccctccgcccggcagccgccccatctgagaagtgaggagcccctccacccagcagccaccccgtctgggaagtgaggagtgtctccgcccggcagccacctcgtccgggagggaggtgggggggtcagccccccgcctggccagccgccccgtccaggaggtgaggggcgcctctgcccggccgcccctactgggaagtgaggagcccctctgcctggccagctgccccgtccgggagggaggtgggggggtcagccccccgcccggccagccaccccgtccgggagggagggaggtaggggggtcagccccccacccggccagccgccccatccgggaagtgaggggcgcctctgcccggccgcccctactgggaagtgaggagcccctctgcccggccagccgccccgtccgggagggaggtgggggggtcagccccccgcccggccagctgccccctccgggagggaggtggggggtcagccccctgcccggccagccgccccctctgggaggtgaggggtgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtgggggaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtatccactcagggttgaatggattaagggcggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaaaaaaaaaaagtcttgctacaaagtgcttagggtgtagctgatttactttcaggcacaagcctcttatctcgtttcatagattagttaaaaattgggaacttctaattacattttgaacagtgctaatttaaagtaggggcctccattgttcaagttccagtatttgagagactttctttgcactaaacattgccttctccttcaaatcaatttccccattgccaggaggcatctgaagcagaaaatcatcctggttaggataatgaaaggcaaagaaaagaggtggggagggtgccaaataaacttgacctaatcttccattttgcacacaggaactcaaagtcacctatcatatgctagaagctagtgattaaattggttacagattactcgctgaatcccaggcaaaaataatgtggttaaaaacagtatttaagcatgtgaaaaatcagatgtatcggctaacagtcctgttcaccttcaaaaattctgcagcctcaattatctgtcactttccattagatttgcaactttgctaaactccggagttccaccccgctgtaccatctcacttaaaatccagtatccaaacaagaatcagaaaatcacactttttaaatctctagactagcattcccatgagccaatgatccataaataaacactattttcaagttttcattacaaagcgcataatttctcttcaggccagtttgggttgccaacttctcttcttaaatcttaatcccttctattccaaaaaaaatagaaacatgcaaacagaagttcatggggaatagagaatgaaactcccatccttctgtagctatggtttttctctaaatattattactgaataataaaaacttcacaatttaaaaagttttttaatacaggaagaatatattatttgataattcataactctacctctcacttcacaccacataatattgatatctctaatctctccactttgattacttgggaccagtaaccacttccaataattagttgtatttatcactaattccttagctttcttccttctactctatttacacaacatggttctcaaactcaacaatgacagaattaaaacttatcttctctgactcctaccatagccacgcctaattccattctcatgttttccctatagaaaaacccaatactgaattgctcctctagcatgtgccctctatcccttttctttctagtctgttgcctacagattttctccaaatacttctaatttctccaaagattcacaataagtaaagaatttattcttcctattcctatttctttgtcacagttgtatcataaaagtcatataaatcactatgtctacatggtcttctaataaagttacttatacattctgttattttcatgtgcaaagtaacgtaagtgatcaacaatactatctatcggtttcaggcagagctgaagtattttcaactctgacatgtagctttgttgatatctgtaaaagtttattgagtggaaattttgtaggtaggagagattccatccttctaaacactaagtattttggtatctatgtgcctgataacaatgttttgcacatcatagacaataaatatatcatttggtagactaggaattttacaatgctttaaaagaataacagtaaaaacacatcttaaatatcacaacttttaccttcaaacatagtgttctctaatccaacacttctacagttagaaacagagattaaggaaattatcttaaacatatctacaacatacatatacacataagtaaataaatacacaaagatgtttaccatagcatctagatgttcagcaatgattaataaaattatattcattcacttgaacaaatgttacacaaatttaaaataacaccactgtagaataggtaatattctgtggaaaatgttttggtatatggttaaatgaaaaagcaaggttccaaattttatctatactattattgcaattatttttaaagccatctagaaaaaaaaagactagaaggaaacacatcaatgaaattacaggaaatatttttctgtgctttcaaaattcctacgatgaacatttaatgcttttataatgaaaaaaagttttaccaatctttactcaaataggaagatttagactatgtgtaggaggtaacaaatgggaataactttgtctatactgtctgtattttaggtttctccatttaacaaacttgtcctatggttctactgagataattttttataatggacaatgaaattttaatagcacactcaaatatgccattcaaatctgaccatggataatctgaatcttcaaatcacaactattctcaatatgttgagctttcaatctgtctaaaaagctagccacaaacccagaaccaatgcaaacttgaaatcctgctttttccactttgttttaagcaaatcattgcattctcacgttatctccagagatcttagtaggcacatatcagtgactcaaaacctctacagtaaatgaactttctgatgtctaaccccaatttcttcttgtttccatttgaactcatttcttttatttgtcttccgtgtaactgacagcagctgctcacaatcattcagatcccattagatagtgaccttttctttacatgattgatcattacatctcatgatcattccatacagtgattttcatttgactataactggtcatcaaacagttctgagagcattcctcaacctcttaatattccttccaattataaaacaaatagacattaaattcagaaattaatgctttttgccattatctcacttgaaacatcttccatttactatgaattagcttttggttgaaagtaaaatcccttcaaacatattccatctttgcttccttttccccactcccatgccaaagcacaagcatccaggccatatcttatcttttcctgcacagtatccaatcggctttttatagccagaaactctctgaatgcaaagcacgaccttggctaccagcttcccctggcaatagttcgaaagttatttataactttaaaattagcgtgaaagcctacgtttctcataactagtcaaaacattcctatttcatacaataatgtgatcttcctcagttcagaagaaaaccccaaattttaaacctatgattataactaagacacaggaattcaatgcagaaatgagaattcgctgaagttcagctcttctctttacaaacttgattcttacctttctgtttcttcctataaagtaaatgggcttaaaattcagctcccgtagggaattttccaaaaagagctttgtgggggacggaaaaaggcttcttggtggtcacagagttacagagtaccaaattgagaggcagatgacagtggggcagtcaatttcgctgagcgttgttcacccaggataagaaagaaa

SEQ ID NO: 281 - DNA, 53007 bp, Homo sapiens
atttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcgggtaagtggtgcgtcggctccggccccgagacccagcagcgggcgacgcggcgcaggaggtggaggtggaggcaggaggcggagcggagccgggtgcggtggagcagcagaggccgagcggagccgtgggcggcgggccgggaccccggggccgggccaaggactggcggggcagccgcgagttcacctgacgcggcccctcgctcggcgcccccgaggccgccggctcgccgccccacgcccgcttcgtgcgctcagctgccccgggacccgcctgcctcctcgcgaacttgggacgagttggaaaatcctccctgagagagccgtgcggctcaggggagcggtttaactcggaaaaggaaaaggaatccagaagtaaggacctcggatttgagtgcccccagcgcctctgccccactttacgagcgcagtttagacgaaagcggacgcagcccgttttcccccaaaacctgggccggagggcctcgcagctgagtcattcggtcccgggcgcgggcagtctccggagtgggaagggcagagccgcgaccgctctcggaaggcgcattttcccttctgcctgagtcttgcctttttagggccatctggtaaggtttccagagcctgttgaatctggggaataaacacattattaaacatactttttttttttgagacggagtcttgctgttacccaggctggaatgcaggggcatgatctcggctcactgcagcctctgcctcctgggttcaagcgattctcttgcctcagcctcccgagtagctgggattacaggcatgcgccaccacgcctgctaatttttgtatttttagtagagatggggttttaccatgttggtcaggctggtctcgaactcctgaccttccacccacctcggcctcccaaagtgctgggattacaggcgtgagccgccgcgcctggcctcagcatgtttcttgatcctgttgcgttttatttgtatatcagatacctgagtttgaaatcacttaggggtttcctgcatgctgctcagtgaagcagcggtgagtttgtaatcacattttaagaaattgggacttacagggccagtctcaaagtgtcactgaaattgaaagagctcctttaacactgtggcttacgtacgtgactcagtttcctttctacttaatttgccgggcagatgagggtgtacctttcccttgaaacaaagatctagattgaacagtgagaggtccgctgtgaacattgcatcagattacatgaataaaccacgctgttttttatttgttgtttttttgttttttgctttgagcgccacgtttttttcctagtctttttttttttttttttgagacggggtctcgctctgtcgcccaggctggagtgcagtggtccgctctcagctcactgcaagctccgcctcctgggttcacgccattctcctgcctcagcctcctgagtagctgggactacaggcgcccgccaccacgcctggctaattttttgtatttttagtagaaacggggtttcacagtgttagccaggatggtctcgatctcctgacctcgtgatccgcccgcgtcggcctcccaaagtgctgggattacaggcatgagccaccgctcccggcctttttttcctagtcttgattctttttttggataaactttcccttcctaagtcatagtagtcttaaagtctttcaatctaaagtaatttttttcccaaaggaaggcaaattgcacacaatatgttttggccaataaatgctaagtattaaaactgatgtttaaagaactatgtattgatcccaacacagctttaacaaatatattaaaatggttttgatcctgaatgagtaaacacttaaagcattgtcagtattcacacaactttggcgaatctgtaaatagatgaatataacacttactttcccagtgaattggtgatggatatggaatcattttggtgattgcgaagttgtaattacggtgatgttttgtgtacatattttggtgacagtatatgaataaatttttattgaatgcgtaaacataggacatttttatttttagtctttttgtttttgcattgtccctgaaagttaatgaaatttacttcttcttcctgaattttaaactctggaatccatagttaataggctgtattccagtttcctactcaggtgagtcactgcctaatcaaaatacaaaatcttgcttagggttatgaccatttcatgaaaagtagggaagagttttgaattattaacatatataaggaatcctgactgaatctttaccaacatagacatatatttctgatcctttttctcccaagttgtattccctgcaaattaagtattgggccagaagattgagctaggtttattgtttaagtggatgttcttactgaaaagctctcaaatgtcctgttccttttagatagacttcttaaaataaaactgaacagtgcaaacacttaatagctgaacgattgagagacgttattttttagagcagttttacaaccattgatatttttatatttccttaccaacattgattgataaggaaataagcctgaaataccgaattttattgtttctacttaagtaaatggatggattccatatgtaaaagtcagctttgaaaatagttattattgtacattgaatacagttttgatattatcaacacaggaacttaaaaatccagtttaggccgggcatggtggctcacgcctgtaatcccagcattttgggaggctgaggcaggcggatcgcctgaggtcaggagttcaagaccagcctaaccaacatgaagaaaccccgtctctactaaaaatacaaaattagccgggcatggtggcccatgcctgtaattgtggctacttgggaggctgagactggagaattgcttgaaccccggaggcggagggtgcagtgagccaagatcaagccattgcattccagcctgggcaacaagagccaaactcagtctcaaaaaaaaaaaaaaaaaaaaaaattttttttggaaaaatgtatctcattacacaataggtagaaatgaacattttaaataattatgttaataatctccttttagacaatacattttaaatgtcttttgcaatgggaactccacaataaagactgtgctgttcttaagaataaatgcttttactcataggttttcattttctgatactgtatatccagtagagaataagcaagaacaaagaagaaaacctaaggatatcattagtggaaatttttcttgatactacttatggaaatgccttaagtcttactgcactgaataatgatgttttgttcaatgatggaccacatatatcccataagattataatggagctgaagaattcctgttacctagttatgtcctagctgtcctaatgtcagagggcagagtattaccttttctatgtttaggtatgtttagacacacaaatacattccactgtgttctaatcgtctgcagtatatagtacagtaacatgctgtacaggttttgtagcctaggagcaacaggctatcccatttggcataggtgtgtagtcggttgtgccatctaggtttgtttaagagcagtttacaatgttcgcagaatgaagttgcctaatatttctaagaatgtatccccattattaagtgaagcataactaattcagttatagcaaggtttacaaagtaaaatgatatctatttgcacatttcatgacaggccttcctaggagtgatagaggaaattactggcaacgtgtgtgtgaagtagtttttataagtagaggaaatgcataggctataaaactatatggtagttttgcttaaagactgcttaaataaccatctcgttggtcaggaaggatgcttacctctaagaaaaccttactagcaactcatcctcttgtcagacttttttgaagcctctcagatctccacaaatgagaaacatctttgtgcatgttttctaaacagtagtataaccaggccatttaaatatcaagatactaataaaatcctgtgaacgtttaagagtggagctaatgtgatgctaatattttccctgagaatttcacaaaataaactcagtgtctttaaagttatcttagtaaaggtttttttttgtgtgtttttttaaacatagcagacttaaatcatccaacttagaatagcaaaatagcagatagttttgtttatattcttaatctcaatttttttattgatagcacaaaaaatgatttttttttggcttagaaatgtttttaactggaatttatatcttagcactgattatggtgaaagtatccactttggaattatgacaactgtatcacacataaagacccacattactgaatatgggtgcttggaatgtttttactcttaaaatttctggaggagtaaaattaggcatgtttctgcacttagaaagatacaggttttgttcagatgtgtaagataggaccaatctaggtaagtaaaataatggtaaaattcttttttctgatcttaagctaattcaggtagtttatctcctttgtcagatttactatctagtagttaatacatttatacttaatacgtagatatgtgttttcagatgtacttaatgtgcagtaaagaagcatgctattgaaaacaaaacaaaacaaccttacagtgattctagtcaagcaagtaactccttcaaaagtttaaaaatttggtttcacattggccgggtgcggtggctcacgcctgtaatcccagtgctttgggaggccgaggcgggcaaatcaggagaccagcctgaccaaacatggtgaaaccccgtctctactaaaaatacaaaaattagctgggcatggtggctcgcgcgtgtaatcccagctactcaggagactgaggcaggagaatcgcttgaacccgggagttggaggttgcagtgagccgagatcgtgctactgcactccatcctgggtgatagagcgagacttgagtctcaaaaaaaaaaaaaaaagaaaaaaaaattggtttcacatgaagtggtggtggcgggggagggaggtgtttgaaaggatggagacaggccatgattatttgaatttcacttttcatttcctcctcagcagcccattctgtagttcatttactgtgaaatggccaaaagcaggcagcatgtgggaaatgaattgaaaaagagacacttactgaatagctagtcctttagtgattttagtaaagagttaagattacttaaataataacaggtgtctcaggcaattaaattggagtagccgtgaatctatattagagagcctcgtgaatttatgtataattcatgtttgaaatattaaagacatttacaagtgtttggaatatttatttacgagtatccctcttggctattctgtttttacatgaaagcgtaaagattattttttgaaagttactgttactttgcttcataaagagtataagaccaatggtgtaatttcatggtactgctttctcccattgtttttcctgtactcatcttcccctaaaatgcataaccatagtctcatccccgtcaattgcagctatatggctgtttggaattatttctcttataactagtcccaccttctcttaattttttaatcgacttggttgagaaggaccaactttacaatatgagcttcatattctcctttatctttcaaactttattgctcttgctacttaaattacagttaacctatggatatctacttttgcaaagaactaaaaccttgcttcatcacagaaccaaataaacagattgtatttctctgttctctttctcttcctgcttctgtaaaaggtatgataccttttgttccacattcttttctttttcttttgagtatgctagttgcagtgctttcaggttttcttattctttttcttttttagcctttcttttagaaaccatctcaataatgcataatttacagtttacatttttgggtttttgaaagtggagtaagaacttagattgtttggcaagtgtcttataaagaattcttaatttaatatttcccgtaagtcatagttatctccaattgtaatatctagtccaaaagcagatttttttttttttttttgagacagagtctcactgtgtcacccaggttggagtgcaatggagcaatctcggctcactgcagccttcgcctcccagattctcctgcctcagcctcccaagtagctgggattacaggtgcctgccaccgtgcctggctaatttctgtattttttgcagagatagggttttaccatgttggccaggctggtctcgaactcctgacctcatgtaatccactcaacttggcctccgaaaatgctgggattacaggcgtgagccatggcgcctgtccaaaagcagtttgttttaaagcagaaaaagcaaaactgtgtttattgtctttccaaagcattcaacttagtcttcagagaaacagttctctttttgaatcatttaatctacttagtcatttcatctaatgtacagtttaacaaaattacaaaattgcaacaagtgtggctggcacaatcaggtttggtgacaaacacaactaactcttggtaagcacccctccctgttggagtgaacataagtgcctgggcacactagagaactgtggtgggcattagctatactgtaggcttcacaggagtggagaacactgttaatatggagagctggaaattggttaagtaaactttggtattctagtaaacttgcccaagaagtttaattcttatatatacctagtttttccagaaaagttacattaaggtattaatttaaccacagcaggtaaaagttttttgtttttttttttttttcaagacagctctgttgccctggctggagtgcaatggtgctatctcggctcactgcaatttccgcctcctgagttcaagtgattctcttgcctcagcctccagagtagctgggattataggtgcacatcaccatgctggctcatttttgtaattttttcttttttaaatgagagtctcgctctgttgcccaggctggagtgcaggggcgcgatcttggctcactgcaacctctgcctcttgggttcaagcagttctcctgcctcaccctcccaaggagctgggattacaggcgcatgccaccacgcctggctactttttgtatttttagtagagacagggtttcgccatgttggccagactggtcttgaactcttgacctcaggcgatctgcccgcctcagccttccagagtgctgggattacaggggtgagccacagcgcctggcctcaacatttttaagtgttaatttaatactatcttttctctatcagcatattgtatttgtttgcttatattatatgagcattttccaacatttgctttattaccctctctgtaatatataatcccatattcagatttcaccatttgttcccaaaatgtcctttatagcataatcaacatattttaaatatcatttgtatagaaagctatatattgaaggataccgacagcagtgaaattgagcctggcatgatggctcaagcctgtaatcccagcactttgggaggccgaggcaggcggatcacttgaagtcaggggttcgagaccagcctggccaaaatggtgaaacaccatctctactaaaaatacaaaaattagccgagcatggtggcatgcgcctgtaatcccagctactcaggaggctgaggcatgagaactgcttgaacctgggacgtggattttgcagtgagctgagatggtgccactgcactccagcctgggcgacagagcaagactcagtctcaaaaaaaaaaaaaaggaaagaaaaattaattgaagctgttgcaccacagggtgaatggagcaacatactggtgaaagtaaggtgaatgccaactgttgtttttgtaatcatacctaataaagtttttatcagtgtgttagatggccttcaaaatatggcagagaaatccataaccaggcaaaataattttgggtctcatttcttcttataagttattacttgcctataacaaactaatctaaaatatgcctttctgctctaaaagctaaagcttaagagtcccttggcagatgggacttttaaattattcctgtagaaaattggtagtatataagtgttttaatttattatgtgttttaatttattcctgtagaaaattattcctgtagaaaatcggtagtatataagtgttacagctcttagaatttgtctagcaggctctccggtttttgccagaatgcccaccaccccccgaaaaaagaaagttggtagattggtagtatacaggatatatcagtatcctttgggtgtttaggtataaggagatctgcttagaaattataactggagagctgagtacagtggctcatgcctgtaatcccaacactttgggaggctatggtgggaggattgcttgaagctaggaatttgagacctgggcaacatagtgatacctatttctggaaaaaaaaaaaaaaaaaaaaaagagagacattaaaaaaaaatgagacaaagaagatagaacaaaaggctagataatttggaagaaaagcatgaaagtaatgtcataaagaattcaaagaggacaaagtttcaaatagagggggaaatgctgtaggggtattgaggaagatggggactagaaagcatccttttagatttggcaagcaggcaagcgttcattggtgaccttgtggagaatagttggaatgaagtaagtctctgatcatcctgagtcagggtcaagtttatcttgtcattattcgggtatgaggctagtttttctctttggtatcttgtggctcccatggccggaagttggtgctttcttcagtgctagttacctctaggaagaggaagcgggcggctgttcctggacttctctgaatacctttttctagttttaaagttttgaaccacaagaatgtattacttattcagcaaataaaacatttccaagtgaaatacagaaattggccttttttctatgatatagtgctgtgattatcattattgttcaagtgctattattattttgttgacatatctgcccccgcctttagattgcaggctcctggagagctgtctcctgcagtgccccagtgtctagtatgagggggtggcatctaatgggttatacagttgttaaggagcataagatgtccctacgtaaaatgctagtgtagcatacaatgaggtttgatgtcagaatggcatcagttctgctttttgttcctcttgtgaggagcctgttcaaatgccctactgtctcttgtccctatgctgggggcacatggtagcagtagtaaccatcgccttagtgcccttagtgaggtttgataaacctgcctgctgcctacagttccaaatttgaccaggattatatgacatcatttagaagaacccttaggagggaactctgaaagcaatgtgtctgtctaagcactgctgttgctggcagaggtatctagaggttacttagggatgagcacgattgttttctccagctctaaaagaaattaaggactctcagttttttttttttttttttttgggactctgtctcaaaagagtttaggtctgtgaatggtcttgctctgtcacctaggctggagtacagaggtgcaaacatggcccattgcagcctcaactttccgcgctcaagtgattctcccacctcagcctcctgagtagctgggagtccaggcctgtgccaccatacctggtcagttttcttgtagagacaaggtctcactgtgttgccaaggcttgtctcaaactcctggattcaagcaaacctgctacctcagcctcccgcagtgctgggattacaggtgtgagccaccatgtctggctcaaatgttcttttgtctttttctttgccagttttacttctttccacatgtcaaatatatatttttaaagatattagtaaaaaataaagagagtttaattgctacagtgtctaaactaggttttttaatggattgaaggctatcagaaggacgttttgaataaacttattttgtttggagtttaattttttaacaaaaacccaagttggaatttaaggtaaatgaaaacttttttgcattggagtgaaatataaggaaataataaattcattaattttattaagtgatcattaacttcttaaaaatagagctgatacctatgagctatacttagtattagatgatttagatagcactgctttctcttcagtagaaaataatcagaaaaatagtttatcatttaagttttgtcaatttttttccctaggaagataagaaaaatacagtagaagtaagattgacaaaaaaccgtacagggctgtttttagctttctagtcttttggttttttttggtgggggggagttattttttatttttagttttatagaaattagaatattcttcctggccttgttttgagaggttttaatttaaataaaatttaatttgagagtttttgaagtgaaatgttacgatctcccaattcaacattataattttactgcaggataaataaagaaaacaggaaaggaggaaagcattgattacaaatatcttaacaatgagcaaatgtgcaaggaaaaaatatattaagacaaatccaaggtaggtagatgtacgtttttctgttcttttgaaaattctacttagcttaaagttcatgatgaataaattgatatatagatgtacacatacatgtatgtatgtatatatattctattataatatatactcaaattattcagccattcacttaaggcaccatctactgtgtaccatgctgggcactgtaggagatgtgtcggtatgtcagttgacttatgctaagtactagtcttttcgtttagaaagtagaccaatatgaggatgtcgatagttaagtggaattgtagaattcgaagaatccccagggttttattcttcctcccggcctttcggccatacttgtacttaaccttataaaacagaagaaagtctctaccaacgttttaaaaatatccaaatagaatttttcaagttttcttttgattactttcagagacattctgtttcgttagttggatgtagtcctaaagagaaaattgattttccactttttgtaaagttatttaaaataatagaaacaactttaataacttccttttccaattggattctatttttagaagagatgaaaaattttttcaagggtagtgcacttcctctgcaatgtaatttgtctttgaaaattggatacaactaaaattttagaatttttttttttttttttttggagacagagtctcactgttacccaggctggtgtgcaatggcacaatcttggctcagtgcaacctctgcctcccaggttcaagggattctcctgcctcagccacctgagtagctgggattacagggtgccaccatacccggctaatttttttaattttatattaaaacaatttattactaaaaaaaattttttttaggccgggtgcagtggcttaatctgtaatcccagcactttgagaggccaaggtaggagaattgcttgaggccaggtgttaaagaccagcctggggaaaaaaaaagagaaaagggaagaagaccagcctgggtaacatagcaagatcctgtctcttagaaaaaaaattgttttaatggagggtcctattttttaaaaaaacaatagatatattaatattttattaatttggatcccagtatattcaaaacaggttgggataatatttgcttttctatcaaagtttgctaaataatataaaggagatttcagagaaatatttaacttcaaaagaaaataatcctgctattattagttgtttgtaaatttaaatatctccattttagcaattttttttttttttgagacacagtgtcactgtgtccaggctggattgtagtggcacaatcttggctcactgcaacctctgtctccaaggttcaagtgattcttgtgcctcagcctccgagtagctgggattataggtgcgtgccgccacacccagctaatttttgtattattagtagagatggagtttcaccatattgaccaagctggcctcaaactcctgacctcaggtgatccacctgcctagccctcccaaagtgctgggattacaggcatgagccaccatgcccagccaccattttagcaaatttttacctgttttttagaattgtggaaccaaatatttgccagtattttgcttgttgttaatttatagtgcttagtggacttgtttgttttcgtttttattgttttatccttacatgtttttatttttaattattttgtaattcataattgcccattggttcttttctctctaaaaaggattattgtttaagattaaaatactacatagttaattaaagactattagttttagtacaactatgtttatttaatattatcacaactatgtttaatacagaaggtgagatttgggaaaatatgttctatgagacatctcttcaattttaatgtatttagctataaattatatagtgaataatgtaagattataatggactctataaattctatctggagcagctgtggctgatttatagatgttaatgttgtatgtacatcatttacagctgagtttggggtcctgcatttctgctgagatagtgcctgaaaaatgcctggtacagtgcttgacccatgttgagcactgaaatgttagttgaatcttctgcactgagtcctgtataggagttgggttttagtgggtttaggaggttgtactggagggcataaatctgcagatttggatataaatctgcagaataaactggcttgaaatagcatatctattttaaattgctagtgttgaccttttttgtagatgatttttaccttcaaaaaaataattttagtatcaaacttgtactaaacggcatgaactgaacaccgtgctaggtactctggcagaatacaaatggaataaaattacagtccatacatttggtatgaaagagaaagcatatctgagtgagattgcgacaacaattgcagcatactccaaaacacatcatcatcgtaaaatgttgtccaaactgtaattcgcagggcactggctgtggaaggaaccctggagtcacagtcacaacacctctttttcatccctcatcatgctacctattatgttccctgtaaaagtcccttaatctctctgaacgttatttttattattataataacacctgacagttgcacagtcttccaggataattgattaattggtttatttagcatatactgtactaggcactgggaatgcatggaaatctataagatgggatccctgtccctgagttgctcacgctggtgtgtgaatacatgtattatatgctacacaagtgttataacagacttgtaaatgctttgggaactcaaaagagaataactaattctgcccatggctattagaataggcctttgaaagttggtgtcctcgaaccaggccttgacagactagtgagaatttgccagttggacaaagaagggtaaagggcatttcaggaagaggggagattagatgtaaaagattaaaactgggagagtaagatatgtacttgaaaaaatgtctgattaggaggctggcatgcagcgtgttggaaagagtagagggactggagataaggctgtaggactaaaatgggtcacattgtgaaagagattgaatggcagtgtggtttagtaatggagtgtatggactttggaaaaagaccttggttgaaaacctggctatgccacttaatacgttcatggtaagatcaaattcttaacctccctgagtctccttttccttatttctaaaagaagaactaattattttttattttttgagacagtctcactctgttgcccaggctggaagaactgatgatagtgatcttatagagttgttaatcaaaactaccaggcacttaccacatggtaaactctcaataaatgatggttatagttatgagaattagaagtttggattttatcctgtagtcaataggaagctactgaagagttttaagcaaagaagtattttaagcagaaatacatgttttagaaacataactattggcatggattggagccaggagttagagtggtggctgtggaaaggtagagaaggagacttaattgttctttagaaggtagaatcatcatacctggtgatgatgctgtgtggaatgacagagagggagtttcaggggtttctggcttgaacaactcgttggatgatggggtcccatttcctgagatagggaactcgggtagaaagtttgtggaggaagaagaggagtttagttctggacccactgattttgaggttcctgcaggacatgtgtttggagatgttaaacagggatttgcatattggattttggaattgagaagagacgtctggcctagagtcatgggtttaaatctggcacttgaatccagagaaacagaccatatgaagtagggagagatttgagagtgaggcaagaaagctaagcagagtcccgaagacatgccatgttgaagattaacattgaggaagagaaggaattgtcaggggagcttgtggaggaattgtcagcgaatcagatgagaagaggaaaatgtagtatcagaacgctgagacagtgttcaagaaggaagatgttgtcaacggtttgaatgctgctgagggatcaaacaaaaggtaggacttaaaatgtacgttggatttagtgacagagattagttaccatttctagagacgttttagaggtagaaacctctctaaacttgggggtatctaggagtatgtgggatgtgaagtaacggagatagtagtgttggcaattctttcaaatatttcagcagtgagaaggggaagagaggttcaagggaatagctcgagagatttctgatccagtggatttgtggctatgtgtataagttgtgagatgggagagacgtgaatgtgtttaagtctttacaggaaaaaactgttagagggggagagaataattgatagtataatcccctggggcatgggctccaaacaacagatacaggtattttaagagtagggaggaggcaggaggcaagggaacatggtgagtgtagatgtcaatagctttgttgatttggttgtgggaagttgatggagttctcattagagacaggaggcaagggctttcattgaatgcagtcagtatagaaacgcagggattgagaagagggagaacatttgaaacagttgttgagaatgggagagtagtaagccaaggaggcaaactccatcagtttgccgcccatttgaggttgaaaaccaagaatttaatagctatatttatatttttagagatggggtcttgctctgtcacccaggctggagtgcagtggcacgattatggcgcactgcagtcttgacctcctgagctcaagtgatccttccatctcaccctcctgagtagctgggactacaggtgcccatcactacgcccagctaacttttttgttttctatgtggagacggggtctcactatgttgcccagtctggtctcaaactcctaggctcatgtgatccttctgccttggccccccagagtgttgggattacaggcgtgagcccctgtgcttggcctcaatagcttattctgtcttataatttcattcagtattgttcatctgccttggtgcaggcatagaggagatgaagagttggttttatccaagattggtacttactaagaatatacagcaatggcacaatcttggcttactgcaacctccaactcccaggttcaagcaattctcctgcctccacctcccaagtagctgggattacaggcgcctgccaccacacctggctaatttttgtatttttagtagagacggggtttcaccatgttggccaggctggtctttaactcttgacctcgtgatctgcctgccttggcctcccaaagtgctgggattacagacgtgagccaccgtgccgggctgggaaacagtaattaaaatgagaagccatgttagctgaatagggtgggaagtgaagaaagggggaggcagatgggcagagagaaagtggtgtggagatctcagtgtgttggaataacaagtgtgatgggagtggtcaagggagagggtaagatgggaggataggatgttgtaggcagagtggaatgttggaattaattttttcagagctggaccaatttgcacattggcaatgtccagggtgtggccagacactccagtagatagctgaagtggcataaagtaagtcattgatctgaggcatctgggtaagggataggtcttcttttgagtgttgaacatagacagaatggtgaagaggaaagcttttacatcaggggccagagtcttcagtttacatcctggaggtgagtagatgattatcttatggatgggttcaggatggtacacctgatgaccttgagcctcagttgaacaagggtttttacgagggagtaaaggaggtacaggtgggaagcaacagtggggaacaaagcagatggccagtcaacatgctgaccttgattgggtgtgggaagatgagcagtactctcttgagaggacagcagagaggctttgggagttccagatagcatattgctggaatttggaaggagaacaggagtgagggattgtattatggagggaaaggaagcactagttatgagagtgaagatgaaatatggaaggagcttatatcttagtgatttgagtgtgattctggcatgggtgcaggggcattgaagtttagttgtggcttaggaaaaggcccattgtctgtgatttattgtcttcagagtggatagcagcaactgtgtggaacagcagctcaactgctttgtccagtgtggtgatgggaggttacagtggacagtgcccagtgctaaattatggtaaggaggaggagttgggatggctgctgaccttccatctctgcctttctccctaaggctcaacgcctcatggtatcctgactgatgtttagctttgtggggttgctttttgtggttgatctcattctgactgattatatatagacacacgattctagctttggagcctgaatggatgatgatactcttgactaaaagaagaaataaaagagaggggtcaggtgtccatgaaaaccccaggttgagatgctcagtaggagggaggtgtgtgtaaatacagatttgggagccatctgcatataggattgaagaaaccatagtattcatagtattggaaaattctgtagtattgacaaagggaaaagggcaaaggactgaactctctgggaaatgcccccagagaaaaatggaccagttaagatgattgcatgagatggtacgttatcaagacattttcatgtataaaacattttgaaatctgtcttttatcatatctcaaaaattgaggcctgaatagtttatctttttaatcattaaaactttttttttttttgatgggagacttcttggattctacagtgtgtacccctctgtccttaaagtatactgaacataattagcctttttttcatgactcaggatagttattataaatatcagttattgagttgtaacttccaggctgggcatggtggccatgcctgtaatcctagcactttgggagactgaagcgggctgatcacttgaggccaggagttggagaccagcctggccaacatggttaaaccccgtgtctactaaaaataaaaaaaattagccgggtgtggtggcgcgtgcctgtaatcccagatacttgagaggctgaggcgggagaatcgcttgaacccaggaggcggaggttgcagtgagtccagatcgcgccactgcactccagcctgggtgacagagcaagacactgtctcaaaaaaaaaaaaaaaaaaaaggtattattcctaatttaattccatgcagcctttccagccctatttgtaccagtcctactctgtctcttccccactaaatctaattatccccctttccctcacccagattttctactccaatcacctattctgtttcccagatatcctctgtactttcctccctctcatagtcgacctgtcctttctacctggtgaaatcctactcacccttcaatatacgactcatatgaccacattctctggcagacttggtcattctcttatgttttccagagcatttcatggatcacatatatcacatgattcaagaaattacggccagttgcaatggctcacgcctagtaatcccagcactttgggaggccaaggcaggcagatcacctgaggtcaggagttgaagaccagcgtggccaacatggcgaaaccccgtctcttctaaaaatacaaaatagctgggcatgggggcatgcgtcagtaatcccagctacgtgggaggctaaggccagagaactgctggaacctgggaggcagaggttgcagtgagccgagatgcctctgcactccagcctgggttgacagagtgagactctgcctcaaaaaaaaaaaaaaaaaaaaaaagaaattactttacttgtgatttactttaattactgacctgccaataaactgtgtttctcaaattttagtacatattggaattgtttgcatataagaagttaaattctcaagaaagtttgattcactaggtttggggttgagcctaagcttctgcattttttacaacaaatacttctcgttaattctgatgcgagttgtccaaggaccataatttgagaaaccaacaaccatgtagttaatggattccatcagggcaagggccatgacttatctgcttttgtattttcagggcctgccatgtagactatgctaaatgaatgtttctagaatgaaatatagtttactggggaaggcctttcggcatataatttttgagttgagacccaagttgttgcagaatcttaagaaaggttttgcctttcaaaggtgtaaaaaatagcacaagacaacatttcccaggtggtttccaaaatactcctgctagggcatgctttgtgggaaaagggtttgtttggtagtcagatacttttagaaaatgctgtctgttggacctgtgcccttcacccttctcaagacacactagcagattgaagcttttgagatgttctgtgggaaagaaacccttttaatctttaaaacgttttgacaaagcattttccctaccctttttccccagataatgcctttttagaacctgcagaactaatgtcctgaggtattttctttggaaactgctcacataaccaaaagtataacagtaggaattaacacttcatgtgtgatgatgacctataattacctagaattggagaggccactctgggaagttataagaaaagagataaaggattaggcaatattaagggaaagacatttttctatggtaggctcgacgtttgtattttggtataattgctctaaattgtcctggtcagttataagtattaaaataactgtagtatagatgatagcagacaggtttgagcatggaaggattggatttgggtaacggctactggaatgcaaaaggcagtaggaagtcaaagacagtagatgaaggatctgtagaatctggtaactaattaaatctggaaaaacaacttggatgttttaattcaaagatctaagtggtctatatactttttggatgtatagttagactaaggtgaaaaagaaacattgtattattgacagctgaaaagatgtgtaacagcagggagtagtttctataagttttttgggtttttttttttttttttttttttttttaagacggagtctcgctctgtcgcccaggctggagtccactggcgcaatctcggctcactgcaagctctgcctcctgggttcacgccattctcctgcctcagcctcccgagtagctgggactacaggcgcctaccacggtggcgcccggctaatttttcgtatttttagtagagacggggtttcaccgtgttagccaggatggtctcgatctcctgacctggtgatccgcccgcctcagcctcccaaagtgctgggattacagacgtgagccaccgtgcccggcctctataggtttttaaattttagttttgtttattttgtttatattttaacaggataaaatttattataatatagtttgccttctaaaaagagtccatatagaaatcactaacttaaactgaattcatacacaaacttcaaatcacatcagaagtttttcctggaaaaattaggtcctcttttttcaataattggggcttgtttatcagaaacgacttagtgataacaaagcaagacacatttttgtattattatacatttaatttagacgatggggaaattccttcacactacctcataacataaagcaggtttattaggccttaagaatcatagaatatttatacttttcatgtaaaatagaaaacctaattttccagccattcatgctaaacagcagggttaaagtaatgatcaggaagactttatacgttttaaaataaggtagttttcatgagacattttgcagtgctcccttggtaatgttcatattcagtgagcagaaaagaaaagatgagagagttaggactctactattgaacctgtttcttgaagaaaacaaaaaccagatagtacaattggatgtcagaaatgattattagaaagctaggtaaaaacagtacaggttgagtatcccttatctgaaatgcttgggaccagaattgtttcagaatttggaattttttggattttagaatattcgcatatacatatgagttaccttggggatgagagccaggtctagacacgagattcatttatgtttcatatacaccttatagtctaaaggtaattttatacaatatttttaatgattttgtacaggatacaaagttttgagccatagcatgaggtcacatgtggaattttccttttgtggcatcatgtaaatgctcagaaagtttcagattttggagcatttcagattttggatttttggattagggatgttcaacctgtatttccaaatacttaagatagggccttaatttgtcttcctttttattgtcttttcagacaaatgaccatggaaacagttgaatcccagcatgatggaagtataacagcttctttgacagagagcaagtctgctcatgtgcagactcagactggccaaaattcaatccctgctttagctcaggtaggcaataggcaggcaccgttgaaagtcaaaatatatggaaatgagaattaggtgcagattctgttttcttgccattgatcttaaattttccatgttccctggttatcagccattcttgcttatttgattgtgaagaaaagatacgtgttgtaattagccttgcattttaacagacattcagcagtgccccatctccattgccaccaccactatggaaggaaaaacaaaaacccttcctgaatatgtaatcctcaaagtatgatttgagagggttgctaattcgaaattgatacagttctgatgtccttagctgttaagatgacagaaatcttaccattttccccgtatatatttgtcttaatcattactttcttttcagttaggtctcgaactttgaattggtttcattcagaggtcaccagtatcagttagtacctgtttctagatcctaaaatttatttctgagatatctattaaaaatatagtaaaaataaacacatttgttagttcatcaaatatttattgaatgtctgctgtgtctaattattccggatgcatgtggatatgtagtttcaggacttaaatatcccatggtttggtagggtagacagatattttagcaataattccagtagggtaagaagtgctgtaagatactatgtagaaaatgaataaggcctacagaagagggagcagccagctgactaggagtgctttatatatctcctttgagctaggcacaaaggatgagtaggagtctgccaggttgataaggtgaggaagcatattctaggcagagcgaagagtgtgcacagaggcacagagccagagcatgggatgttcagggaactatgggtattgagtttaactggagccaggtgtctgggctgggcagtccagctggtaaaggtaagtagaggatcgtatacatttcagggtttagagtacactgtactctaaatagtattgaaatattttcaggtgcccaccgtattttcagttttgacactagtagccatgtggaggtggaattgaaagtcagtgagtcggaactgaagacaccatcagggtgcctggtggagtcaaagtagcgtgagatacagagcagtggtgagacctttgtggtacattaaagggagaataaaaaggacctggtggttgactggaaggcccaggggaaacaccaggcacttcttgggttatattaggccagactggtgtgagagctctcctttcctgtgcacccagcctgcttttctttcctctttaaagctgccaacacccactcgttccctgcaggttttctgcggtattctgtagagctgtatctccctagcaacaccttttgttacactgagagacaggcatttaggttaggccaggccttttgcttaaacacacacacacacacacacacacacacacacacacacacacacacacacccttgttaaaaaaaatgcatgttcattgtagaaaataaatattaaaatgaagaatataaaaactatccataatcttaacatccagagatttaatcattgttaacattttggtgtagctcctttagtctttttgtctgtgtgaatagaatagaaagcatatactttttctcatgattttgggattttccagaatctttagagctatggtttctggtcagtaattctgccctttgctgaagttgtagttgaaagcactttcttttttttttggtagagacaagttctcactatattgcccaggctggtctcaaactcctgtgctgaagcagtccttgcacctcagcttcccaaagtgctggaattacaggtgtgagcttcttgtacccagcctgaaagtacattttcttccttctgactctacttccttctaggtgggtcccggctcactaagttctacagatgccttttgccccagaattctggggctgaagtcccagcaatagatttccattatctaaatatggtaatttgcaattctgaggaccttcaggctgggcgacagccacctctgtgagcctcactcagaaattgccaacaggtggccaggtgcagtggctcatatctgtaatcccagtactttgggaggccaaagcaggtggatcgcttgaggccaggagtccgagaccagcctggccaacatgaagaaaccctgtctctactaaaaatacaaaactaggtggttatggtggcacacgcctgtagtcgcagctgctcgggaggctgaggcacgagaatcacttgaacccaggaggctgaggttgcagtgagccaagttggagccacttcactccggcctgggtgacagagtgagaccctgtctcaaaaaaaaaaagtgttgccaacaggttaagtaatgtggagtctgaaaagtagtcttaggtttctgagggcttgaaagtgttgccaacaggttaagtaatgtggagtctgaaaagtagtcttaggtttctgagggcttggaattgaataggagaccagtggacagaaactaggttttagtaggttatagaataagtaagaggaggggaagtggaagttggaagtatagactcttttaagaaatttgtcttgaactaatagagaaagatgggtttgtgaaacaaaggggtgagaactgggatgtgagaaatttgggaatgttttgaataaaatggaacattatagagacttgtgagaaggcagaatcaaggaactagaaaaagcctgtgtttacgtttgtaatgcttctttaaaaatctcaaataatgttgtatgctaataaatattgatagttattaaatctggatagtaaattcttggagttttgctgtttttctattttatattgttagaagtatttttttgttgttgtttttgttttgtttcgttttgtttttttgagacagagtctcactatgtcacccaagctggaatgcagtggtgcaatctcggctcactgcaacctctgctcactgcatcctccacctcccgggttccaatgattattatgcctcagcctcccgagtagctgggattacaggcatgtgccaccacgcccaactgatttttgtgtttttagtagagagggttatgccatgttggccaggctggttttgaactcctgacctcaagcagtccacctgctttgatctcctgaagtgctgggattactggtgtgagccactgcacctggcctgtttgaagtatttgatcaaactgaaactatggtttttatctttcacatgctagaaatatagagattaagaagtaatctgtatgccgacttatggattattttagttaactaagaattatcctccatgccatgcatggatcatgattttttgaagaattagaagacaattcttagcagtcagaattttctgaacataattactcattaaagttcttgtgacaccagcagctgttcgtttatgagtattgttactatcatacaatagtatatgtcttacaaggagtaggaaatcaagctgaactctattaaccctatgatgtatgccaaaagtgactgactcttctgaatttctgatggcttcatatttacttgccacttgtctcatttttcttcagacttgaggattgtaaatttccatatgttttagatttaaacttagttgtgaataaagaggaatttctgacactcaccttccttgtttatatgatcagattatcagtaaacagtgtgggaacaaaaggcgtaagcagaacgttcagtgggtttgattctttgcatctaaggtcatttgatactggttgttttgattgtcctggcctttccagagcttctgctaatcaagaatatactatgaaaatcatcagagacctagcaactgttgagcttggttttggctgtcaggcccctgttctgctgatggattgaggtgaggtgcaggtacaccaggggacactggagttttgcttttctgttttataactttgtagtaataaatggagcctttctcttctgtttgaaaacaaaatcacggtggtggtaatgtcaaaaagttggaagcaggagttgccatcaacaaatcctagtacggcaaataactggaagttaaatgttgtcttggctttcttcttgcctaaattatttttatgctgatttatttttaatggaagctggtatcttatttattaagtacgtgtgttgatatacaggactagactcgctggattctggtaaaactgttgataataagttggagagtccattttaaataacctggccaggaggaaatcttttccagaaatcaaaatggtgaaaagcaaaaatattgtatgtacaatacaagtagttttaaaatagtgacacttacatcctccggaaataatattgtttttaaatgggtaatgggaagttaaaacttcttttgttgtgaaagacttcaaacatacataagagtagaagaatgattccacatatatataaagttagtaattattaagattttgctagaccaggcatggtggctcatgcctataatcccagcactttgggaggctgaggcaagaggattgcctgagcccaggagttcaagaccagcttgagagcttgtctctttaataaaaaataaattaatacaacaaaaatttttgccaggtgtgatggcatgcccttgtagtcccagctacttgggagactgagaccagtggattgcttgagcccaggagctcaaggctgtagtgcactgtgatcatgcctatgaataaccactgcactccagcctgacgacatagcgagaccttgtctcaataaaattaaaaaaaaagattttgtagcacttgcctcatctatcttctttttttcttcttgtcgctgaagtattttaagctgctcagcagatctcagacatcatgtcattttactcctacttacttctgggtatacaactcttaaaacattatggacattttcttatataacaaaatgtcattatacctagttaagtataattaatatgcaatccatattcatttcacaaatgtatgatctactctgaaggcagtagagtggacaccttgaacttttcttgttcctagactcttgggaattggtaacactgccatgaagacctaggtgggtaaggtcattcagatggagccagtggaaaggatgtaccttaaaactgactttctgaagtataattctccatagctgctgctgaagcctggaggcctcgactctgaaagctaaataactcttctttataaatgactacttctcaaggtttcagcaaagatagaagggaaagatgaaaggagcagtatgctaggagtcaaaaggggggaaggaaactctggagattgtcaaggtcagcaaactgcctcgagagaattagttctgatataacacttaacctctccaaggacctctgtatttttggaaacaaggagacactagggaggcagagaaagccgctagggaatgttgttcagagattatactctcctaatcaagctgaactctgttaaccctatgatgtttgccaaaagtgactgactcttctgaatttctgatggcttcatatcttatcctttcttatcttttccattctaagtgcacaatgtgtaaggagtccctcggaataaagcagccctggcatgccatcggggattgaagtaggaacgatttaacaagggatacttggaaatgttgtcatgtgcgagttgtaaattttcttttttaatctggtggaaaattggaatggcatttctctgttttgcccagctatgccaaaaatcttcttggtcccacataggcctaggaaggatgtagatggcaatcacaaaacaaacaaaaaatgagcaaacaaatagaagacctcaagcaacattttctcttgttaataggttagcaacctcatatttgtatattaaagagatctgcattatgttaggttgatttcatataatttcagctaagtagatctagtttaaggtcagtgttttattgaatcttgtattttagcttcagtatattaatttccttagctgagggactcctactgaaggagaaaagtgttcctgttaaaattttgaaataaaagtttctgttttactgtagattttttcactattgctccttatttttatgtattctttcccctggctgtttttcatggttcatattttatctgttacacagaacatttgtattctgttagaattatctataaaaatgaacaaaggatggaagaaaaaggaagagagtaatttttttcaataaatgctaaatctgtattataaaatgttccttagtcatccaattcagaaaaacccactgctttgaaccgtaactcattattgaaggtaattcaaggttcagaggccataataaaaagtaactggtgaactgttaatattagtaaccaacttttttcaacttcaacaagaatttgttatgtatctgtactcatattttgataattttgtatataatagctagtatatttctttaaaagtttgtttttggctttagaatacgcttttatgttttcatcccagtagtgtattaaaggtgacagtactttgctttaaataaattttgatgttgcagaggtaatttcaggaagtataaagcaatcagagtcaaatttcagaaaaattttggttttataattacaataaaaatgcatacaaatttattttagtgtttgagagactgttaaagatttttttgtaatttgtaatgattatgaggtttggatactcgtagaaaatgttcaagttccctttcttagttttactaatgggtagtttgtcactagcagtaatgaaaaaataactgagtataaatacagttactccttttgcctttttctgtatgattttctttagtaaaagagtaagctgagaggacggaaaaatggggagtcattttttaatgggtatggagtttcagatttgcaagatgaaaaagttctgtagatctgattaacaataatgtgaatatacttaacactacaaactacacttaaacagtgaatatgttatgtgtcttttaccacaataaaagataatgaataacaaaaaaaataggctagacattgaaatttgaaaaaagaaacattaattttatagtttcttttttgagtaagacttagggattcttttcttttcttttcttttctttttttttttgtagagatgggagtctcgctctgtcacctaggctggagtgcagtggcacaatgtcagctaactgcaacctccacctcccaggttcaagtgattctcttgcctcaggttcccgagagctgggactacaggcgcgtgccaccacacctggctaattgtttttgtagttttagtagagatggggtttcaccgtgttagccaggatgatcttgatctcctgaccttgtgatccacccgcctcagcctcccaaagtgctgggattacaggcatgagccactgcgcctggcctcttctttctttctttcttttttttttttgagacagagtcttgccctgttgcccaggctggagtgcagtggcgcgatctcggctcactgcaacgtccacctcccgggttcacaccattctcctgcctcagcctccttagtagcagagactacaggcgcccgccaccacacctggctaattttttgtatttttagtagagatggagtttcactgtggtagccaggatggtctcaatctcctgacctcgtgatccatccacctcagcctcccaaagtgctaggattacaggcgtgagccacagttcccggccacctcttttcttttctttttttttttaagaaacagagtctcactctgtcacccaggctggagtgcagtgatatgatcgtgactcactgcagcctcagtctcctgggctcaagtgatactcctgcctcagtctcctggagtaactagaactacaggtgcatactgccatgcctggctaacttgtaagttttttgtagagatggggtctcactgtcttgttcaggctggtctcgaactcctggcctcaagtgatcctccctcttcagtctcccaaaatgttggcattacaggtgtgagccactatgttcagccagagactattttctttcccttattttatcgtttgttattataacccttgtaaatcccagactattaagaattatatttggaaaacagaggctttgggaaatttctgcttcattgcatagttgtgacgatatcttcatagtgctctccacaaatgtggatttttgtagccctatcagagataaaactgtagtggttttcttaaaaggtataggggagaaaagcctggttatggtaatgaatgtattaggtagagacaatgttagatgaagaaaacagacatagttcaggaaaaacacatgtctttaaacaggtttcattcagaagtagacctctattttggcagataataactattttcctttaaaacaatgcatataaagatgcaacaacaacaacaaaaactacaggtcaatatccctgatgaacataggtacaaaaatccttaacaaaatactagcaaaccaaattcaacaacatattaaaaagatcattaacagtgatcaagtaccattcatcccagggatgcaaggatgtttcaacatatgcaaatcagtaaacctgataaatcacatcaacagaatgaaggaaaaagaccatatcatcatctcaatacatgcataaaaaacatttgaaaaattcattatttccttattataaaaactctcaacaaattacataaagaagggatgtacctcagtgcaacaaaggcagtatatgacacacccacaactaacatcatgctgaatggggaaaggttgaaagctttttctctaagatctggaataagataaggataccaggccaggtgtggtggctcacacctgtaatcccagcactttgggaggttgaggcaggcggatcgctggagcccaagagttaagagaccagcctgggcaacatggtgaaagcctgtctctaccagaaaatatacaaatattagccgggcatggtggcacacacctgtaagtcccagctacttgggaggctgaggtgggaggatggcttgaggctgggaggcacaggttgcaatgagccaagatcatgcccctgcactccagcccaggttgcagagccagaccctgtctcaaaaaaaaaaaaaaaaaaaaagtcacagatgcccatttttgccacttctatttagcattgtactcaaagtcctagccagagcaattaggcaaaagaaagaaaaggcaactgaattggaaaggaagaagtcaacttttccctgttcatagatgacatgatcttacatatgaaaacctttaaaaaaaggaacaaaaattagaaaaccttaaagatgccaccagaaaaacctgttagatctaatacatgaattcactgaagttgcaggatatgaaatcaacttataaaaaccagtattgtttttatgtactaatagtgaactacctggaaaaaatatcaagaaaactctatttacaatagctatgaaaaaaatacttagaaataaatttaagcaaggaggtgaaatatctgtacattgaaaactataaaaaacattgatgagagaaattgaaggagacacaagtaaatgttcatggattggaagaattagtattgttaaaatgtccatactacccaaagcggtctacagatttagtgcaatccctatcagaaatatcaatgacattcttcacaaaaatagggaaaaacaatccccaaatttatacaggaccacaaaagaccccaaatagcgaaaggaatattgaaccaaaagaatgaagctggaaccactgccatggccagtccattgcagggtatcctgcagctgctacagaccgagaagcaggctgctgagaaggtttccaaggcccacaggcagatgaaccgggggctgaagcaggccaaagaagtagcttaggctgaaattgaacagtgccgcctgcagagggtaaaaagagttcaaggcgaacgaagctgaagcactgaagtggagaaggaggcccaggagaaaagatgatcaccctccagacctacttccagcagaacaaggatgaagtcttgaataacctcttggcctttgtctgcaacatccggccagaaatctgtgaaaactgctgcataaatgggtaggagaagaaaaaagcacctgttctatgaattggcattttagatgctctcatggaatatgaagcttcaacatagctcaagttatattcttaaggcattaaattatttctgtatattatataataggtccctccactttttggagagtagcaaatatagtgttttttttttgttgttttgtttgttttttttttttttttacagacttagaacttatctaaagatttcatgtttcttagaaaattaattggtatatgttgtctatttttatatgccttttggttcaagcaacatatatatcagtgttgacattttctttcttagatctaattaaacaaaaccaattttttttgaagaaagaaagtgattaaataatttttccccctaatgcattcttgaattcatcagggctttatctatgaaaaagtagtaaatagttatttgtaacctatgtgaagcaacattcagccttaatctattcctgctaatgattagaacaacaatattggtatagttgtttgggttgcttttagtttctcttaatcatgtttactagatgatagaacttaagaacttgttacatcttattacttggtgtatgataatcatttgaaagtcaagactctttgtcatgcaggaaaaaaaaaagaacaaagctgaaggcatcacactacctgacttcaaaatatactatagagctatagtaattaaaactgcatggtaccagcatgaaaacagatacattgatcaatggaacagaatataaagtccagaaataaaaccatgcatttacttacaccaacttatattcaacaaaaatggcaggaccacacaatggggaaagggccatttctttaataaatgatgttgggaaaactagatatttacacagaagaatgaaattaggcccttgtctctcaccataaacaaaaatcaactcttgaaaatggattaaatataagacccaaaactatgaaactactacaaggaaacaggaaactccttgacattagtctggccgatgagttttttgatacaaccttaaaagcacaggcaacaaaagcaaaaatggacaaacagtattacgtcaaactataaagcttccccacagcaaaggaaacattccacagggtgaagaagggacctacagaatgggagaaaatatttgcaaactatacatctgataaggggttaatatccgaaacacagaaggactcaaacaactcaatagtaagaaaacaacctgattttctaaaaatgtgcagaagacccgaatagatttttctcaaaagaagacataaaaatggccaagtacagtcattcatcacttaacaacaggtctacattttgagaaatgtgttgttaggcaatttcatcttttttttttcccttatgatccaacagaaccaatggtgtggtgatttcatctttgtgcaaacatctagagtgtacttacacaaacctggatggtatagcccactacatacctaagctgtatggtacagcctgttattcctgggctgcaaacctgtataggatgcgattatactgaatactacaggcaattggagcacaataataagtatttgtgtatctaaacataggaaaggtacagtaaaaatacggtatcaaagataaaaatggcacatctgtatagggcacaaaaccatagtggagcttgcaggactggatgttgtcctgggtgtgccagcgagtgggcagtgagggaatgtgaaggcctaggacattattgtacactactgtagactgtctttttttttaatagaattttgttcttttgcccaggctggagtacagtggcacaatcatagttcactgcagcctcaaactcctgggctcaagtgatcctcctgtctcagcctctcgagtaactgggactacaggcacatgccaccatgcccagctaacttattttatttttttgctattgtagacttgataaacattgtacacttaggttacactaaattcataaaacatcatttcttcaatgaactgtagcttactgtaagttttttactttttgacttttgtaataacacttagcttaaaacacaaacatattacacagctgcataaaaatgttttcttctatgcttatgctgtgtaaaccttttctgtgtttgaaattttttattttttttatttttaaacttttttgttaaaaactgagacacaaacacacatgttggcctaggcctgtatagtgtcaggatcatctgtattgctgtcttccaccttcatatcctgtcccattggaaggttctcagggaaagaacactcatggagctgtcatctcttatgacagtgccttcttctggatactcgctgaaagacctgcctgaggctgttttacagttaactttttaaaataacttgaagtaaaataataataaaaagtatggtaaatacataaaccagtaacagtcatttttttattatcaagcatatgtactgtacataattgcattgctatgcttttatttaattatttatgagacagggtctcactctgttgcccatgctggtgtgtggtgatgtgatctcggctcactgcaacctccgcctcctgggttaaagctattcgcgtgcctcagcctcccgagtatgggattacagtcgtgcatcaccatgcctggctaatttttgtattttcagtacaaaatttctctactaaaaatacaaaaataagcagatgtggtggcaggcgcctgtaatcgcagctacttgggaggctgaggcaggagaattgcttaaacccagaggcggaggttgcagtgagccgagatggtcccagtggactccagcctgggcaacacagcaagactccatctcaaaaacaaaaaataaaaaaaattagccaggagtggtgttgtgcacctgtaatcccagttactcagaggctggggcaggagaatcacttgaacccgggaggcagaagttgcagtgagtcgagatcacaccactgcactccagcctgggcaacagagtgagactgtctcaccaaaaaaaaaaagctcgacatcattaatcatcagggaattgcaaatcaaaactacaatgagatatcaccttcctcttgttaggttggttattatcaaaatgacaaaagataacagatgttggcaagaatatggagaaaagggaacacttatacactgacggtgggaatgtaaatttgtatagccatatggaaaacagtatggaggttcctccagatatgaaaaatagaagtaccagatgatccagcaatttcattactgggtatctatccaaaggagatgaaagcagtgtgtggaagagatatctgcacttccatatttattgcagcactatgcataatggccaagatacggaatcagcctcggtgttcatcagtggatgaatggataaagaaagtatggtatgtatacacaatggaatactattcaaccataaaaaagaatgaagtgtcatttgcaacaagatggaggaatctggaagtcattctgttaagtgaataagccaggcccagaaagacacatactgcatgctctcactcatgtgtggagtctaaaaagttctcatagaattagagggaagaatggtggttaccagaggtgggggtgcttaggcagagggaaggatggggaaatgttggtccaagaatatataattacagttaggaggaatgagttcaagagagctatcatacagcatggtgactatagttaaggacaatgtattgttgaaaaatgcagagatagttgaatgttaataatgttctcaccacaaaaacaactatgtgaggtaatgctattattaattagctagatttaactattacataatgtatatatactccaaaacatcatgttgtacatgataaatgcaattttttctgtcaattcaaaatgtaaagtaagaacatttaaaaggtacatctccaacctccacatgctttccttgcccagtctttctctcctgcttgtctctctccctgtcagtatgagacaccctctctaggaagccgctgtcatcctttacaaagaaggagtccagaatctaaaatcttacacagcctgcttcaggcagtactgaagcctggacttctcagaggccacagtagaggccagttgtagcaaatttggttgaaaaagcaagaattatttttaagtttttctaaccacctgagctccatttgcccagttgtgagattaaacactttcttcgggcaccagcaaatcatggccaccagaaaataaaatcaaatacaaaataataattaatgggagaggagcagtggctcatgcctgtaatcccagcactttgggaggccaagtcaggaggattacttgagcccaggagttcaagaccagcctgggtcaaggtaagactccatctctacaaaaaaaaaaattagccaggcatggtggcacttgcctgtagtgctatctactcaggaggctaagatgggaggatctcttgagccctggaggttgattgaagctgcagtgattcgtgatcatgccaccgcactccagcctgggtgacagagcaagaccctgtctcaacgcaacaaaaaacaaaaataaaaaaaaatagagaacaaaaatattaaatgtgtgcgtatttactattggatatggtaatataccatggtaggtattgcctttgtaagttggtctcccctgtcttttgttcctagagctttctcattttctcatctccaagggcttgtttactgcttcatacataaaaagaggccaggtatgatggctcatgcctgtaatcccaacactttgggaggccgagatgagatgattgcttgagcacaggagttcgagaccagcctgtacaacatagggagaccatgtctctatgaaaaattaaaaacttaggccaggtgcagtggctcacgtgtaatcccagcactttgggaagctgaggcagtcagatcacctgaggtcaggagttcaagaccagcctggccaacaacatggtaaaaccttgtctctattaaaaatacaaaaagtagccaggcatggtggtgggcacctgtaatcccagctactcgggaggctgaggcgggagattcgcttgaacccgggaggcggaggttgcagtgagccaagatcacaccactgcgctccagcctgggcgacaagagtgaaactccgtctccaaaaaacaaaaaacaaacaaaaaaaaacaattagttgagtgtggtgacatgtgcttgtagttcaaattactcaggaggctgaggtgggaggatcgcttgagcctgggaagctgcactgcactctagcctgggtgacagcaagaacctatctcaaaaaaaaaaaaacaaaaaaagagccctaatttatacatgtattctcagtttgaattaaatttagcttgtttacttaaaagtagtgttgaaggtatttttcatactatattttaatactagattaaagttgatactaattttatgcagttttaagtattaagactaatcatttgacctttgctttctttacctaaaacatggaaaatactgatttcatagattaaatgagatgatttgtgtgaagcacaagcacagagtttggcatctggtcaatgtgcaataaatgcttgcttttatcctcatagtgaccttccttgatcttaaaatggtagtaattaggctttaagatgaaatggcttatgctggttttaaaatatattgtattcggaatcctttgtaaagtaacaaaaatctacaatgcttagtaggcctccaaagggtatagaggagaaaagctaattttttatagttttataagcaaagttccggtatgtcaggagcttgcttaaaattatatgttttatgcttcttaatttaggtactttagatttctcctagatattttaaaacattgctggccactttgggcataaaaatctaaaatataatctgtaactatttcagatttcatggtaagaccaaactgcattataatttttgtaaggagctaaactcttagactttactatttatgtactctgaccattggactggaactgaaaacaacttaaagatgcaatttggcctggctgtgttaaattagtctgctttgcattgctataaaggaatacctggctggggcagtggcccatgcctgtaatcccagcactttgggagcctgagttgggtggattatttgagctcaggagttcgagacgagcctggccaacatggtgaaaccctgtctctacaaaaaaatacaaaaatcagctgggcatggtggcaggcgcctgtaatcccagctacgccggaggctgaggcaggagaatcacttgaaacttgaacccggaaggcagaagttgcagtaagccagattgcaccactgctctccagcctgggccacagagcgaggctccatctcaaaaaaaaaaaaaaaaaaaaaagaaaaggaaaaagaaatacttgaggctggataatatataaagaaaagaagtttgttttggctcacggttctgcaggctgcacaagaagcatggcaccagtatctgcttctagggaagcctccagaagcttcaaatcatggcagcaggagaagggggagccagggtatcacatggagagagagggagcaagagagaggggaagtgccacactcttcaacaaccagctctcagaactaccagagcgagaactcatgaccattcatgagggatcccccatgacccaaacacctcccacaaggccccacctccaacattgaggattatatttcaacatgagattgggagcggataagcatccaaactgtatcacgttttgtcaaaatgattctgattttgacatctacttttatgtaattcttctttcctgttgcataaaaagcctttttttggcttagaatcttactgcaaattctttatgtgtatttattattttgaaatacatttggctagtaaattatgatcagtttcagtcttactgaaaccaaatacgagattggctttcaaaagttccttccagagctaaaagagtttgacttctataaaggtcatgtccatttttatagtactttaatatatatattattataataagtgaaacatatctcatattggttagaatataaaatgatgccccaaatactataaataggaaatccaagatactgtacagattagctagaaaaaaaaaagtttagctagggcactgttctcaaaggataaagaaccctaattttaatttaagtgcttactggaagcattatcaaaatagattatttaaacccttctggataattaagaatgactgaattataacacttgctttgctttcaagaagtgaattttttagaaacatgaaatttgaccatttacgtttacagtatcagaaacaatgatccttttcccccttttcaattcagattatggatttcagcttatgcgctatacataaaaaaaaggattggaggcaacaacaacatctctttagaagataatggatagtaaatatagaaataataatcatacttggcttatctctttgtaacaaatattttcaacatatattcttaaggtaaaatttaaatgcattgaatttgcaatttgttagccacactatcttaaaaacaaaacaaaaaaaacagctaggccagacacagtggctcacacctgttatctcagcactttgggaggccaaggcgggtagattacctgaggccaggagtcgagatcagcctgacaacatggtgaaactccgtctctactaaaattacaaaaattaactgggtgtggtgacaggcacctgtaatcccagctacttgggaggctgaggcaggagaatcgattcaacccaggaggtggatggaggttgcggtgagcccagatcacgccacttccctccagcctgggcgacagaacaagagtctgtatcaaaaaaaaaaaaaaattaccagggtgtggtggcgggcacctgtaatcccagccactcgggagtttgaggctggaggattgcttgagcctggaaggtggaggttgcagtgagccaacattgtgccactgaaccgcagcctgagcaacagagctgaactctgtctccaactcaaaacaaaaaacaccttcatgggaaggaagtcactcaagataaccgaaatgaagaccaactacatttttcattttgtgtttgtcttactcagcacaatcaaatatgacttttaaaaattaaagtgggccgggcacggtggctcacacctgtaatcccagcactttgagaggccaaggtggatggatcacctgaggtcaggagttcaagaccagcctggcagagatggtaaaccctgtctttactaaaaatacaaaaatcagccagacgtggtggcacatgcctataatcctagctatttgggtggctaaggcaggagaattgcttgaacccaggaggtggaggttgcagtgagccgagatcgcaccactgcactccatcctgggtgacagagcaagactccgtctcagtggggggaaaaaaaattaaagtggaatattttacatctttattcaggtatttgatttataatattcttattattttcagctttaaaacatttgaaatattctaatattctcttaaatgctttttcccctatagaacagacttttgagaatcctgtcttaatacataaatatcaagatagttttcaacttcttgcttagcttgttagtgtatttttattgtagtccttaaactaggtagtacagagatttgatttttcaggagcagagttgatagagcagtctgctatattgtgaattcacattttaaaatcctttattgtcttgaatgcaggcctagtagctttgtgacatgtgcagctatactatgacatcataaaccccatcgtgagggaacctagctacgggtcagagctagtccactaggtgctaatcaaatgctgtgttacaacactgtgaggttttcccagttataagtgtcactattagggttttttttaattgcaaagccaaataaggctgtcaattgcatcatcttaccttatttcttcagattaagtactgtttatagtgggatttttggtggatgtggtggcatcagcataatctatgtttcaggcgtcctatagaagaggattattcttcaggggatgtggaagaaaaggtaaatgatgtctgctataagtaccttcacacttttaaagccttgtgaaaagaggggtaaaaattgtgaaatataaaataacatccattttatgttttagttttttgttcttgcgatagtttactgagaatgatgatttccaatttcatccatgtccctacaaaggacatgaactcatcctttttttatggctgcatagtattccatggtgtatatgtgccacattttcttaatccagtctgtcattgttggacatttgggttggttccaagttgtagcagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcgccattctaactggtgtgagatggtatcttattgtggtttagatttgcatttctctgatggccagtgatgagcattttttcatgtgtctgttggctgcataaatgtcttcttttgagaagtgtctgttcatatccttcgcccactttttgatggggtggtttggttttttccttgtaaatttgtttgagttcattgtagattctggatattagcccattgtcagatgagtagattgcaaaaattttttcccattctgtaggttgcctcttcactttgatcgtagtttcttttgctgtgcagaagctctttagtttaattagatcccatttgtcaattttggctttgttgccattgctttttgtattttagacatgaagtccttgcccatgcctatgtcctgaatggtattgcctaggttttcttctagggtttttatggttttaggtctaacatttaagtctttaatccgtcttgaattaatttttgtacaaggtgtaaggaagagatctggtttcagctttttacatatggcaaaccagttttcccagcaccattaattaaatagggaatcctttccccatttcttgtttttgtcaggtttgtcaaagatcagatggttgtagatgtgtggtattacttctgagggctctgttctgttccatcggtctgtatctttgttttggtaccagtaccatgctgttttggttactgtggccttgtagtatagtttgaagtcaggtaacgtgatgcctccagctttgttcttttggtttaggattatcttggcaatgtgggctctttttgggttccatatgaactttaaagtcgttttttccatttctctgaagaaagtcattggtagcctgattgggatggcattgaatctataaattaccttgggcagtatggccgttttcaccatattgattcttcctgttcatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctgtttgtctgttactggtgtataagaatgcttgtgatttttgcacattgattttgtatcctgagactttgctgaagttgcttatcagcttaaggagattttgagctgagacgatggggttttctaaatatacaatcatgtcatctgcaaacagggacaatatgacttcctcttttcctaattgaataccctttatttctttctcctgcctgattgccctggccagaactgccaacactgttgaataggagtggtgagagagggcatccctgtcttgtgccagttttcaaagggaatgcttcccatttttgcccattcagtatgatattggctgtgggtttgtcataaatagctcttattattttgagatacgtcccatcaatacctaatttattgagagtttttagcatgaagggctgttgaattttgtcaaaggccttttctgcatctattgagataatcatgtggtttttgtctttgtttctgtttatatgctggattacgtttattgatttgcatgtgttgaaccagccttgcatcccaggaatgaagcccatttgatcatggtggagaagctttttttttttttttgagatggagtctcgctcttttgcccaagctggagtgcagtggcatgatcttcgctcactgcaagctccatctcctgggttcacgccattctcctgcttcagcctccctagtagctgggactacaggcacccgccaccacacccggctaattttttttgtattttttagtagaaacggggtttcaccatgttagccaggatggtctctatctcctgaactcgtgatccgcctgcctcaggctctgaaagtgctgggattacaggcgtgagccactgtgtctggccggataagctttttgatgtgctgctggattcagtttgccagtattttactgaggatttttgcatcgatgttcatcagggatattgttctaaaattctctttttttgttctgtctctgccaggctttggtatcaggatgatgctggcctcataagatgagttagggaggattccctgtttttctattgattggaatagtttcagaaggaatggtaccagctcctccttgtacttctggtagaattcggctgtgaatccatctggtcctggactttttttggttggtaggctattaattattgcctcaatttcagagcctgttattggtctattcaggaattcaacttcttcctggtttagtcttgggagggtgtatgtgtccaggaatttatccatttcttctagattttctagtgtatttgcatagaggtgtttatagtattctctgatggtagtttgtaattctgtggggtcggtggtgatatcccctttatcatgttttattgcatctatttgattcttctctcttttcttctttattggagtttaacctattaactctaccagtataattataaggttgacgctcttgcttataagttttggcctaaccagtgagaatgtagaatgatagttctccagatataagagttttcttttttaaaaggagacatttgaattctacctccagatgcgtcatttatgcaggttctcagcctttattttagcattttaatgaaaaaattgtctcatgagcttttggcctgcctagagtttggacatatggaagtttccttgtagttacagaatctgtataacctatctccagaattgtaaggatatggtttatgttagcgggtacaagttctttttctgcagcaggtattcttaaccaagcctttttttttttttttttttttttttgttaaggcacagtctcgctctgtcatccaggctggagtgcggtggcatgatctcagctcactgcaacctcgaactcctgggttcaagaaattctcatgcctcagcctcatgagtagctgggattacaggtgcgcacaaccacacccggctaatttttgtatttttagtagagagagggtttcaccatattggccaggctggtcttgaactcctgacctcaggtaatccacctgcctcggcctcctgaagtgctgggattacagtcatgaggacttagccatttttgatagagttattgtttaattaaaattctgataattgtacttgaaagatgattaaagcaatgtaaaggatgatttatgcctatcagatgcccatgaatctttgttgaattgtttttctgttctccataataatctgatttctttgaagctgggcatttccccacaaaaaatgaatgtggacaccacctgccatctcaacccacaggtctagtttgtgagaatacttgtaggacccctgggtttcccccgctatagtttcaagtacattgtcttcagataccttattctatgtacttggaaaaaagagtaaaacattgagagccactgggatctgacaagctttgggagctccttaattctaaaaagaaaattattttgatttgagaaaatgtaatatcttcagaaatttccaccacccagctatgtgactgcatttttaaaaaaggaaaggaacagaggaaaatcaagtcactctaccctccttacttacctgtggcttgtccctacacatggtggtgggtgggagaagtggtggtggagtactgggtcctccagagagctcagtttggaatctggaactaaagatcatgtcccaatttcctgagctgatgggatagaagctggtcaatgaagtcttctttttgtgttaatttttttcctttgttttcttttgttttatgtagttataaagcataatttctattttgccagtctctgacacatgggctctgtcagggttactggatatgtttattttgtctctgctgctctactggagctgaaatctcagcctgtctgagcagttctttaagctgaaagccagggtgtaggggctagattagtgtggaatagctgttttcaaagtgtggtgtgcagaaccctgggggtgactctgagacattttcatgaggcttgctaggtcaaaaccattttcacggtgatgctaagatgttgtttttctttttctctgttttgatatccacactgatggtgcaaaaacagtggtggtgggggagtggtaaattgttgggtgccttaactcaagtcagtgacacaaactgtgttagtattaactgtattcttcactgccatccacttgcagtttttttttttttaagtcagttttacttaagaatatctttgatgaagcagtaaaaattaccattgcattaaatcttgactctgagtacatgctgttttgatattctgtgtcctgaagtgggacagctgcagaaagcacccccccgctgcgtcctgacgacccatggtgttcttaaggaaaagcacgtgtgttatttgagtgccaagatgaattagctgcctgtttttccacagaacgtcattttcttcaaaagaatgactaatttccaaatgatggctattcaaacttgaagacatttcctcaaaaacaaatgaagtgagcttgtcagttcaagggaaacaactcatggtgtttattgtcacaagcttttaagccaaaactttgaattttggaaaatctgcatctgccattgtgagcttgacaatattcatagttttctgatcaaactggttatactttaatgaaatgtgatttataatactgtgtcatgaaatgtgtccacgtttggaagatctcctgaactcagtgagccagtattttccaaatgaatacttcaggatgttacaaaatcttacgtgggtaagagattcatccaaagtacaagacagatcaatggattttaatgtaactgatactgtctcagattgtatgttgcaattaatccttaagagacaatcagttgtcaagttttggtgtatccatgaagaatatccatgattttctacagaagctattataatattcctccctttttctaacacgagtctttgtgaggcccagattttcttcacataccaactaaagcaacatactgcaacagattcagtgtagaagtagatatgagaatctggctatcttcagttaaacctgacattaaaataatttgtaaaaatgtaaaacagtgctactcttctgatttttttgaaaatgtaatcatttttcataaaatgttatttatggtagcacatacttattattttaaaataagttactatttttaaaatttctgttttaatttccagtatgttaaatatcaacatatataaccagtggtgtgcacagctggcttgtaccagtgaaaaccaattgtataatctttatccggctttgtgttcaatgtcatccattggcagcttgaaatcagccatagtaggagtacttacatcacagaagtgagcaaacgctacaagtcagtgttcctccttcttaagatctagttaagtgtttaccagccctctactgaatatcaatcacagaaacaaaagctctttgaggtcatcagtaatttttaagagtgtaaagatgccctgagactaaaatatttgagaattagttgtgaggagaaagagttatcttttgagagttagtcactatagaggtgtataattcatacagagttgccttttgtgccggaaacatttgtagaataaatccaatgttttaaaacttgcagttgttaaatctactggttccataatgggaggatgtttttcttttccctggaatctaaactagatgataatactctgggggtaggtgagctgaattttccctgtgggctacatattggttgcctctgtcctggtttcacactatctgtccaactgttatctaggtttagatcaagccttcactcaagctctggcatctacataaagccctcacttactgtttgggcccatactgatctttctattctgtactcctgtgatattcatggcctctaaaatggagcaattcgttctgtactatttggtgtgccattgtttcttaggtgctagttttattaattctattttctaatagtgcacctagtacaaggctcaacacctaggttctcttacacggataaaacatgttttaacttttggattgccagagaagttagttttccaagggaatgatgatgtaaataaatcttagttatttgttataaacccagtttttaataattcttttcagatattaatataagttggaaatcattggtgttcctcaaagtgaagtcacacacaaagtcttccttgaaaaaattgttttagatgctgtggttctactaccactcatgatagacactggtgacttatttccaaggtctttgactcttgagtaagtcataatgaatggtgaatcttagtaaaatgaggcaaagtttctgcaattatgctagcctataggacagagttgtttactaattagaaaacctggcaggttttgagtccagaggagtggttagtatcgtgtttttctggtagggatctctgttgaaggaactcagggaagtagtgaggagatggctgttgtgctgatctctgcccaaagttaagtgatagttctggcctctctggatgctttagctagggagaggaaaagtgtccagaggcctcatcagccttcaaggcatgagctttctctgggtcagagacaccaggggcttgaaaggtcctggaatttcttcggcctatgcctttttagttattatgagggcataacagtgactgtgatttttatcagtctagagacaaagcatcagctcacatccagagtaacactagaatatcatatgtcacacatttaataaaaataattcactggccaggtacagtggctcacgcctgtaatcccagcactttgggaggccaaggtgggcagatcacaaggtcaggagatcgagaccatcctggctaatgggtgaaaccccgtctctactaaaaatacaaacaattagctgagcgtggtggcgggcacctgtagtcccagctactcaggaggctgaggcaggagaatggcttgaacctgggaggtagagcttgcagggagccaagatcacgccactgcactccagcctgggcagcagagcaagactccgtctcaaaaaaaaaagaaccatagttaagttctatctccaatttctctgaagaagttagagggtagtttatactctggcctaagaaaggcttcactgttagtaggcgtgaggtcgtagtgaggtagtttaactgctttagaactttgtgcttggaacattcttagccaccgaagtatgggcaccaaaagcgataaggagcatgtgttccttaataaatgtcacatcagaaaatgactgttccaggacagtaaccacctcccgatggtaagtatcctagatagtttgtcatttctcagcagcaggaaaaagagaagtaggccagtcatattagtgagtggtattacttaaaaatagcaaaaacaataacaaaaaaggtccagctttaatcctcaatggtgatcattttggcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggttagcttccttcctgaatggttttgtctttgactttcttgagccatttttttcctctttcactaattcatttatcatttttctttatgaagtgcttatacgcaaatctttttattagatatttggaggaatctcttctccttgcgtaaggtgctctgtgtcctgctaggtacgtaggtttcacttcagagctgcagctttgttgccaacttttcatttggggactgagtaattgcagatgagcagttcatgtcttcttcactttgttgttctgtgttcaaactcagatttatttagcaatgctccccaagggtgctgaaaaatattttgagggtgcatcagagaagatgtgtgataaacacagtaatataaagattatagtgctgatgctgttttctttttttttcttcttttttttttttttttgagacagagtctcgctttgtcgcccaggctggagggcagtggcatgatctcgggccattgcaagctccacctcccgggttcacgccattctcctgcctcagcctcccgagtagctgggactacaggcgcccgccaccatgcgtggctaattttttttgtatttttagtagagatggggtttcaccgtgttagccaggatggtcttgatctcctgacctcgtgatccgcctgtctcggcttcccaaagtgctgggattacaggcgtgagccactgcgcccagccagtgctgatgctgttttcatgaataatcaccttagtaggtagatataaatttataatcaccttagtaggtagatataaatttattttaaattcggtatacataattcttggtaagatgatattattaatgtatccctctcgattaaaccttggcttttgtagatatgattattattgtggttgtgatccagagatgtattttacccttaacatttcttgaagttaaaacattttttccatcaatagatgtaaattattaaatatgcattttttaaagtatgcatcttaattactgaatttatttttgttcatttttaaggtcagttattatcctttaaatgctgaaattatttgaacctaattgatgacaaaaaaaaaaatctgtgaggaaaatggagacacgtatacatagtatagtccttttcttgcgtgttcaagtagtttatcacagtagaatgataagagtggcgacaagatacctgatgtgacaaattcacatacattaaaagcttgattatctttgtggcatgggtattttctcctgtgtttcccagaagtgtaagaataattctcatcattatctttttttcctgtgatggcccctgattccaagagtttctaattctttctgacactaattataaaacaagaaagtctttccaacctcttctttgttttatgacttttattgaggtccacatatttctacttagttttaacctggctggtattggaagaaagtattgtctattattattatttattatttaatagagacagaattctcagtatgttacccaggtttgtgttgaggccctggcctcaagtgatcctcttgcctcagtctttcaaagtgctgggattacagatgtgagccacagcacccggctgaaagaaagtattctgttatattcagtagactttgtttggattttgttaagtgaacgatttaattgtccttgtagaaagaggtgccagtggatcttgtcctagaatacttacgtgttggatcatggtcaagccacttaatctctgtgcatgaactttaattttcacctttctaaaataggtaaattaatagcctacctcacctaagggagttgttatgattctatgacagatgtgtgacagcccggtgtaaaatgataaatatttaatatttggtggtgatatatgattatctgaggcaacaacatttttctcagtcctgttgattgggtgtgtgtgcttatgtgtggggcgttcatgagcaaaaacacgagtcatatgtggaggtgaatatacacctccgtgtacttcgggaagtatatattcttgcttgcattgttgatattttaataagctcttttgattttgtccaaatcaatttcccatgtaattataatatgaagtgagttttgtaaactctgctaccctaggccctcaaagtattaataattgactgaatatatcaaaatcagtcatgttgttgaagagattcattattttagttttctgacttctttaataatcatatcactgtattattacttgacttgaaaaatgaaatcatgcttaaaactctgatctttctcttaaggagaaatgctttatttggatcttcaagacccaccgccaccaagccctaacttactccttgtaatagaaatcctgattttacccaggcttgcttactgacttgcttatctacttaaatattctgtcttgggcctatctgatggctaatgtgaagacccagctcacgccagcgccagctgtgagagtgtgggaacagcagtgtgatccgggagctctcttctgcgttggcccctcgctggctccctcctggattcgtaggagcactttcaggttgaggagcttaggtcttgggtattttacattttgttctttcctgcaatgcctcatttgacatcccaaccactctttccctagtatttctgtagtatagagtacccgtaacattcctttccacacacatttgttttataactgaaatgtttgcgtctgcgcttcctttcttgagccagactccttcagtgcagattcactgtgttctattgctcagttgcttccacagctcctggctcagtgctgcacacacagactcttagcctcaattttttgaatgagggaaaagagcatatattttatgatacatttcagaaaatcttgtattataggtagcagcaattgcagagacagatgaatctgcagaatcagaaggtgtaattgattctcataaacgtagagaaatcctttcacgaagaccctcttataggtaagttaaccaagtttcctaatgtaaagatactttttccaaaatggtagaataattatacatcaaatcaattcttcctttatagcttttctgttttaagacttattcatgtatcttagtgacttaccttgttaaattgtattttaggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcacattca

SEQ ID NO: 282 - DNA, 86118 bp, Homo sapiens
atttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcgggtaagtggtgcgtcggctccggccccgagacccagcagcgggcgacgcggcgcaggaggtggaggtggaggcaggaggcggagcggagccgggtgcggtggagcagcagaggccgagcggagccgtgggcggcgggccgggaccccggggccgggccaaggactggcggggcagccgcgagttcacctgacgcggcccctcgctcggcgcccccgaggccgccggctcgccgccccacgcccgcttcgtgcgctcagctgccccgggacccgcctgcctcctcgcgaacttgggacgagttggaaaatcctccctgagagagccgtgcggctcaggggagcggtttaactcggaaaaggaaaaggaatccagaagtaaggacctcggatttgagtgcccccagcgcctctgccccactttacgagcgcagtttagacgaaagcggacgcagcccgttttcccccaaaacctgggccggagggcctcgcagctgagtcattcggtcccgggcgcgggcagtctccggagtgggaagggcagagccgcgaccgctctcggaaggcgcattttcccttctgcctgagtcttgcctttttagggccatctggtaaggtttccagagcctgttgaatctggggaataaacacattattaaacatactttttttttttgagacggagtcttgctgttacccaggctggaatgcaggggcatgatctcggctcactgcagcctctgcctcctgggttcaagcgattctcttgcctcagcctcccgagtagctgggattacaggcatgcgccaccacgcctgctaatttttgtatttttagtagagatggggttttaccatgttggtcaggctggtctcgaactcctgaccttccacccacctcggcctcccaaagtgctgggattacaggcgtgagccgccgcgcctggcctcagcatgtttcttgatcctgttgcgttttatttgtatatcagatacctgagtttgaaatcacttaggggtttcctgcatgctgctcagtgaagcagcggtgagtttgtaatcacattttaagaaattgggacttacagggccagtctcaaagtgtcactgaaattgaaagagctcctttaacactgtggcttacgtacgtgactcagtttcctttctacttaatttgccgggcagatgagggtgtacctttcccttgaaacaaagatctagattgaacagtgagaggtccgctgtgaacattgcatcagattacatgaataaaccacgctgttttttatttgttgtttttttgttttttgctttgagcgccacgtttttttcctagtctttttttttttttttttgagacggggtctcgctctgtcgcccaggctggagtgcagtggtccgctctcagctcactgcaagctccgcctcctgggttcacgccattctcctgcctcagcctcctgagtagctgggactacaggcgcccgccaccacgcctggctaattttttgtatttttagtagaaacggggtttcacagtgttagccaggatggtctcgatctcctgacctcgtgatccgcccgcgtcggcctcccaaagtgctgggattacaggcatgagccaccgctcccggcctttttttcctagtcttgattctttttttggataaactttcccttcctaagtcatagtagtcttaaagtctttcaatctaaagtaatttttttcccaaaggaaggcaaattgcacacaatatgttttggccaataaatgctaagtattaaaactgatgtttaaagaactatgtattgatcccaacacagctttaacaaatatattaaaatggttttgatcctgaatgagtaaacacttaaagcattgtcagtattcacacaactttggcgaatctgtaaatagatgaatataacacttactttcccagtgaattggtgatggatatggaatcattttggtgattgcgaagttgtaattacggtgatgttttgtgtacatattttggtgacagtatatgaataaatttttattgaatgcgtaaacataggacatttttatttttagtctttttgtttttgcattgtccctgaaagttaatgaaatttacttcttcttcctgaattttaaactctggaatccatagttaataggctgtattccagtttcctactcaggtgagtcactgcctaatcaaaatacaaaatcttgcttagggttatgaccatttcatgaaaagtagggaagagttttgaattattaacatatataaggaatcctgactgaatctttaccaacatagacatatatttctgatcctttttctcccaagttgtattccctgcaaattaagtattgggccagaagattgagctaggtttattgtttaagtggatgttcttactgaaaagctctcaaatgtcctgttccttttagatagacttcttaaaataaaactgaacagtgcaaacacttaatagctgaacgattgagagacgttattttttagagcagttttacaaccattgatatttttatatttccttaccaacattgattgataaggaaataagcctgaaataccgaattttattgtttctacttaagtaaatggatggattccatatgtaaaagtcagctttgaaaatagttattattgtacattgaatacagttttgatattatcaacacaggaacttaaaaatccagtttaggccgggcatggtggctcacgcctgtaatcccagcattttgggaggctgaggcaggcggatcgcctgaggtcaggagttcaagaccagcctaaccaacatgaagaaaccccgtctctactaaaaatacaaaattagccgggcatggtggcccatgcctgtaattgtggctacttgggaggctgagactggagaattgcttgaaccccggaggcggagggtgcagtgagccaagatcaagccattgcattccagcctgggcaacaagagccaaactcagtctcaaaaaaaaaaaaaaaaaaaaaaattttttttggaaaaatgtatctcattacacaataggtagaaatgaacattttaaataattatgttaataatctccttttagacaatacattttaaatgtcttttgcaatgggaactccacaataaagactgtgctgttcttaagaataaatgcttttactcataggttttcattttctgatactgtatatccagtagagaataagcaagaacaaagaagaaaacctaaggatatcattagtggaaatttttcttgatactacttatggaaatgccttaagtcttactgcactgaataatgatgttttgttcaatgatggaccacatatatcccataagattataatggagctgaagaattcctgttacctagttatgtcctagctgtcctaatgtcagagggcagagtattaccttttctatgtttaggtatgtttagacacacaaatacattccactgtgttctaatcgtctgcagtatatagtacagtaacatgctgtacaggttttgtagcctaggagcaacaggctatcccatttggcataggtgtgtagtcggttgtgccatctaggtttgtttaagagcagtttacaatgttcgcagaatgaagttgcctaatatttctaagaatgtatccccattattaagtgaagcataactaattcagttatagcaaggtttacaaagtaaaatgatatctatttgcacatttcatgacaggccttcctaggagtgatagaggaaattactggcaacgtgtgtgtgaagtagtttttataagtagaggaaatgcataggctataaaactatatggtagttttgcttaaagactgcttaaataaccatctcgttggtcaggaaggatgcttacctctaagaaaaccttactagcaactcatcctcttgtcagacttttttgaagcctctcagatctccacaaatgagaaacatctttgtgcatgttttctaaacagtagtataaccaggccatttaaatatcaagatactaataaaatcctgtgaacgtttaagagtggagctaatgtgatgctaatattttccctgagaatttcacaaaataaactcagtgtctttaaagttatcttagtaaaggtttttttttgtgtgtttttttaaacatagcagacttaaatcatccaacttagaatagcaaaatagcagatagttttgtttatattcttaatctcaatttttttattgatagcacaaaaaatgatttttttttggcttagaaatgtttttaactggaatttatatcttagcactgattatggtgaaagtatccactttggaattatgacaactgtatcacacataaagacccacattactgaatatgggtgcttggaatgtttttactcttaaaatttctggaggagtaaaattaggcatgtttctgcacttagaaagatacaggttttgttcagatgtgtaagataggaccaatctaggtaagtaaaataatggtaaaattcttttttctgatcttaagctaattcaggtagtttatctcctttgtcagatttactatctagtagttaatacatttatacttaatacgtagatatgtgttttcagatgtacttaatgtgcagtaaagaagcatgctattgaaaacaaaacaaaacaaccttacagtgattctagtcaagcaagtaactccttcaaaagtttaaaaatttggtttcacattggccgggtgcggtggctcacgcctgtaatcccagtgctttgggaggccgaggcgggcaaatcaggagaccagcctgaccaaacatggtgaaaccccgtctctactaaaaatacaaaaattagctgggcatggtggctcgcgcgtgtaatcccagctactcaggagactgaggcaggagaatcgcttgaacccgggagttggaggttgcagtgagccgagatcgtgctactgcactccatcctgggtgatagagcgagacttgagtctcaaaaaaaaaaaaaaaagaaaaaaaaattggtttcacatgaagtggtggtggcgggggagggaggtgtttgaaaggatggagacaggccatgattatttgaatttcacttttcatttcctcctcagcagcccattctgtagttcatttactgtgaaatggccaaaagcaggcagcatgtgggaaatgaattgaaaaagagacacttactgaatagctagtcctttagtgattttagtaaagagttaagattacttaaataataacaggtgtctcaggcaattaaattggagtagccgtgaatctatattagagagcctcgtgaatttatgtataattcatgtttgaaatattaaagacatttacaagtgtttggaatatttatttacgagtatccctcttggctattctgtttttacatgaaagcgtaaagattattttttgaaagttactgttactttgcttcataaagagtataagaccaatggtgtaatttcatggtactgctttctcccattgtttttcctgtactcatcttcccctaaaatgcataaccatagtctcatccccgtcaattgcagctatatggctgtttggaattatttctcttataactagtcccaccttctcttaattttttaatcgacttggttgagaaggaccaactttacaatatgagcttcatattctcctttatctttcaaactttattgctcttgctacttaaattacagttaacctatggatatctacttttgcaaagaactaaaaccttgcttcatcacagaaccaaataaacagattgtatttctctgttctctttctcttcctgcttctgtaaaaggtatgataccttttgttccacattcttttctttttcttttgagtatgctagttgcagtgctttcaggttttcttattctttttcttttttagcctttcttttagaaaccatctcaataatgcataatttacagtttacatttttgggtttttgaaagtggagtaagaacttagattgtttggcaagtgtcttataaagaattcttaatttaatatttcccgtaagtcatagttatctccaattgtaatatctagtccaaaagcagatttttttttttttttttgagacagagtctcactgtgtcacccaggttggagtgcaatggagcaatctcggctcactgcagccttcgcctcccagattctcctgcctcagcctcccaagtagctgggattacaggtgcctgccaccgtgcctggctaatttctgtattttttgcagagatagggttttaccatgttggccaggctggtctcgaactcctgacctcatgtaatccactcaacttggcctccgaaaatgctgggattacaggcgtgagccatggcgcctgtccaaaagcagtttgttttaaagcagaaaaagcaaaactgtgtttattgtctttccaaagcattcaacttagtcttcagagaaacagttctctttttgaatcatttaatctacttagtcatttcatctaatgtacagtttaacaaaattacaaaattgcaacaagtgtggctggcacaatcaggtttggtgacaaacacaactaactcttggtaagcacccctccctgttggagtgaacataagtgcctgggcacactagagaactgtggtgggcattagctatactgtaggcttcacaggagtggagaacactgttaatatggagagctggaaattggttaagtaaactttggtattctagtaaacttgcccaagaagtttaattcttatatatacctagtttttccagaaaagttacattaaggtattaatttaaccacagcaggtaaaagttttttgtttttttttttttttcaagacagctctgttgccctggctggagtgcaatggtgctatctcggctcactgcaatttccgcctcctgagttcaagtgattctcttgcctcagcctccagagtagctgggattataggtgcacatcaccatgctggctcatttttgtaattttttcttttttaaatgagagtctcgctctgttgcccaggctggagtgcaggggcgcgatcttggctcactgcaacctctgcctcttgggttcaagcagttctcctgcctcaccctcccaaggagctgggattacaggcgcatgccaccacgcctggctactttttgtatttttagtagagacagggtttcgccatgttggccagactggtcttgaactcttgacctcaggcgatctgcccgcctcagccttccagagtgctgggattacaggggtgagccacagcgcctggcctcaacatttttaagtgttaatttaatactatcttttctctatcagcatattgtatttgtttgcttatattatatgagcattttccaacatttgctttattaccctctctgtaatatataatcccatattcagatttcaccatttgttcccaaaatgtcctttatagcataatcaacatattttaaatatcatttgtatagaaagctatatattgaaggataccgacagcagtgaaattgagcctggcatgatggctcaagcctgtaatcccagcactttgggaggccgaggcaggcggatcacttgaagtcaggggttcgagaccagcctggccaaaatggtgaaacaccatctctactaaaaatacaaaaattagccgagcatggtggcatgcgcctgtaatcccagctactcaggaggctgaggcatgagaactgcttgaacctgggacgtggattttgcagtgagctgagatggtgccactgcactccagcctgggcgacagagcaagactcagtctcaaaaaaaaaaaaaaggaaagaaaaattaattgaagctgttgcaccacagggtgaatggagcaacatactggtgaaagtaaggtgaatgccaactgttgtttttgtaatcatacctaataaagtttttatcagtgtgttagatggccttcaaaatatggcagagaaatccataaccaggcaaaataattttgggtctcatttcttcttataagttattacttgcctataacaaactaatctaaaatatgcctttctgctctaaaagctaaagcttaagagtcccttggcagatgggacttttaaattattcctgtagaaaattggtagtatataagtgttttaatttattatgtgttttaatttattcctgtagaaaattattcctgtagaaaatcggtagtatataagtgttacagctcttagaatttgtctagcaggctctccggtttttgccagaatgcccaccaccccccgaaaaaagaaagttggtagattggtagtatacaggatatatcagtatcctttgggtgtttaggtataaggagatctgcttagaaattataactggagagctgagtacagtggctcatgcctgtaatcccaacactttgggaggctatggtgggaggattgcttgaagctaggaatttgagacctgggcaacatagtgatacctatttctggaaaaaaaaaaaaaaaaaaaaaagagagacattaaaaaaaaatgagacaaagaagatagaacaaaaggctagataatttggaagaaaagcatgaaagtaatgtcataaagaattcaaagaggacaaagtttcaaatagagggggaaatgctgtaggggtattgaggaagatggggactagaaagcatccttttagatttggcaagcaggcaagcgttcattggtgaccttgtggagaatagttggaatgaagtaagtctctgatcatcctgagtcagggtcaagtttatcttgtcattattcgggtatgaggctagtttttctctttggtatcttgtggctcccatggccggaagttggtgctttcttcagtgctagttacctctaggaagaggaagcgggcggctgttcctggacttctctgaatacctttttctagttttaaagttttgaaccacaagaatgtattacttattcagcaaataaaacatttccaagtgaaatacagaaattggccttttttctatgatatagtgctgtgattatcattattgttcaagtgctattattattttgttgacatatctgcccccgcctttagattgcaggctcctggagagctgtctcctgcagtgccccagtgtctagtatgagggggtggcatctaatgggttatacagttgttaaggagcataagatgtccctacgtaaaatgctagtgtagcatacaatgaggtttgatgtcagaatggcatcagttctgctttttgttcctcttgtgaggagcctgttcaaatgccctactgtctcttgtccctatgctgggggcacatggtagcagtagtaaccatcgccttagtgcccttagtgaggtttgataaacctgcctgctgcctacagttccaaatttgaccaggattatatgacatcatttagaagaacccttaggagggaactctgaaagcaatgtgtctgtctaagcactgctgttgctggcagaggtatctagaggttacttagggatgagcacgattgttttctccagctctaaaagaaattaaggactctcagttttttttttttttttttttgggactctgtctcaaaagagtttaggtctgtgaatggtcttgctctgtcacctaggctggagtacagaggtgcaaacatggcccattgcagcctcaactttccgcgctcaagtgattctcccacctcagcctcctgagtagctgggagtccaggcctgtgccaccatacctggtcagttttcttgtagagacaaggtctcactgtgttgccaaggcttgtctcaaactcctggattcaagcaaacctgctacctcagcctcccgcagtgctgggattacaggtgtgagccaccatgtctggctcaaatgttcttttgtctttttctttgccagttttacttctttccacatgtcaaatatatatttttaaagatattagtaaaaaataaagagagtttaattgctacagtgtctaaactaggttttttaatggattgaaggctatcagaaggacgttttgaataaacttattttgtttggagtttaattttttaacaaaaacccaagttggaatttaaggtaaatgaaaacttttttgcattggagtgaaatataaggaaataataaattcattaattttattaagtgatcattaacttcttaaaaatagagctgatacctatgagctatacttagtattagatgatttagatagcactgctttctcttcagtagaaaataatcagaaaaatagtttatcatttaagttttgtcaatttttttccctaggaagataagaaaaatacagtagaagtaagattgacaaaaaaccgtacagggctgtttttagctttctagtcttttggttttttttggtgggggggagttattttttatttttagttttatagaaattagaatattcttcctggccttgttttgagaggttttaatttaaataaaatttaatttgagagtttttgaagtgaaatgttacgatctcccaattcaacattataattttactgcaggataaataaagaaaacaggaaaggaggaaagcattgattacaaatatcttaacaatgagcaaatgtgcaaggaaaaaatatattaagacaaatccaaggtaggtagatgtacgtttttctgttcttttgaaaattctacttagcttaaagttcatgatgaataaattgatatatagatgtacacatacatgtatgtatgtatatatattctattataatatatactcaaattattcagccattcacttaaggcaccatctactgtgtaccatgctgggcactgtaggagatgtgtcggtatgtcagttgacttatgctaagtactagtcttttcgtttagaaagtagaccaatatgaggatgtcgatagttaagtggaattgtagaattcgaagaatccccagggttttattcttcctcccggcctttcggccatacttgtacttaaccttataaaacagaagaaagtctctaccaacgttttaaaaatatccaaatagaatttttcaagttttcttttgattactttcagagacattctgtttcgttagttggatgtagtcctaaagagaaaattgattttccactttttgtaaagttatttaaaataatagaaacaactttaataacttccttttccaattggattctatttttagaagagatgaaaaattttttcaagggtagtgcacttcctctgcaatgtaatttgtctttgaaaattggatacaactaaaattttagaatttttttttttttttttttggagacagagtctcactgttacccaggctggtgtgcaatggcacaatcttggctcagtgcaacctctgcctcccaggttcaagggattctcctgcctcagccacctgagtagctgggattacagggtgccaccatacccggctaatttttttaattttatattaaaacaatttattactaaaaaaaattttttttaggccgggtgcagtggcttaatctgtaatcccagcactttgagaggccaaggtaggagaattgcttgaggccaggtgttaaagaccagcctggggaaaaaaaaagagaaaagggaagaagaccagcctgggtaacatagcaagatcctgtctcttagaaaaaaaattgttttaatggagggtcctattttttaaaaaaacaatagatatattaatattttattaatttggatcccagtatattcaaaacaggttgggataatatttgcttttctatcaaagtttgctaaataatataaaggagatttcagagaaatatttaacttcaaaagaaaataatcctgctattattagttgtttgtaaatttaaatatctccattttagcaattttttttttttttgagacacagtgtcactgtgtccaggctggattgtagtggcacaatcttggctcactgcaacctctgtctccaaggttcaagtgattcttgtgcctcagcctccgagtagctgggattataggtgcgtgccgccacacccagctaatttttgtattattagtagagatggagtttcaccatattgaccaagctggcctcaaactcctgacctcaggtgatccacctgcctagccctcccaaagtgctgggattacaggcatgagccaccatgcccagccaccattttagcaaatttttacctgttttttagaattgtggaaccaaatatttgccagtattttgcttgttgttaatttatagtgcttagtggacttgtttgttttcgtttttattgttttatccttacatgtttttatttttaattattttgtaattcataattgcccattggttcttttctctctaaaaaggattattgtttaagattaaaatactacatagttaattaaagactattagttttagtacaactatgtttatttaatattatcacaactatgtttaatacagaaggtgagatttgggaaaatatgttctatgagacatctcttcaattttaatgtatttagctataaattatatagtgaataatgtaagattataatggactctataaattctatctggagcagctgtggctgatttatagatgttaatgttgtatgtacatcatttacagctgagtttggggtcctgcatttctgctgagatagtgcctgaaaaatgcctggtacagtgcttgacccatgttgagcactgaaatgttagttgaatcttctgcactgagtcctgtataggagttgggttttagtgggtttaggaggttgtactggagggcataaatctgcagatttggatataaatctgcagaataaactggcttgaaatagcatatctattttaaattgctagtgttgaccttttttgtagatgatttttaccttcaaaaaaataattttagtatcaaacttgtactaaacggcatgaactgaacaccgtgctaggtactctggcagaatacaaatggaataaaattacagtccatacatttggtatgaaagagaaagcatatctgagtgagattgcgacaacaattgcagcatactccaaaacacatcatcatcgtaaaatgttgtccaaactgtaattcgcagggcactggctgtggaaggaaccctggagtcacagtcacaacacctctttttcatccctcatcatgctacctattatgttccctgtaaaagtcccttaatctctctgaacgttatttttattattataataacacctgacagttgcacagtcttccaggataattgattaattggtttatttagcatatactgtactaggcactgggaatgcatggaaatctataagatgggatccctgtccctgagttgctcacgctggtgtgtgaatacatgtattatatgctacacaagtgttataacagacttgtaaatgctttgggaactcaaaagagaataactaattctgcccatggctattagaataggcctttgaaagttggtgtcctcgaaccaggccttgacagactagtgagaatttgccagttggacaaagaagggtaaagggcatttcaggaagaggggagattagatgtaaaagattaaaactgggagagtaagatatgtacttgaaaaaatgtctgattaggaggctggcatgcagcgtgttggaaagagtagagggactggagataaggctgtaggactaaaatgggtcacattgtgaaagagattgaatggcagtgtggtttagtaatggagtgtatggactttggaaaaagaccttggttgaaaacctggctatgccacttaatacgttcatggtaagatcaaattcttaacctccctgagtctccttttccttatttctaaaagaagaactaattattttttattttttgagacagtctcactctgttgcccaggctggaagaactgatgatagtgatcttatagagttgttaatcaaaactaccaggcacttaccacatggtaaactctcaataaatgatggttatagttatgagaattagaagtttggattttatcctgtagtcaataggaagctactgaagagttttaagcaaagaagtattttaagcagaaatacatgttttagaaacataactattggcatggattggagccaggagttagagtggtggctgtggaaaggtagagaaggagacttaattgttctttagaaggtagaatcatcatacctggtgatgatgctgtgtggaatgacagagagggagtttcaggggtttctggcttgaacaactcgttggatgatggggtcccatttcctgagatagggaactcgggtagaaagtttgtggaggaagaagaggagtttagttctggacccactgattttgaggttcctgcaggacatgtgtttggagatgttaaacagggatttgcatattggattttggaattgagaagagacgtctggcctagagtcatgggtttaaatctggcacttgaatccagagaaacagaccatatgaagtagggagagatttgagagtgaggcaagaaagctaagcagagtcccgaagacatgccatgttgaagattaacattgaggaagagaaggaattgtcaggggagcttgtggaggaattgtcagcgaatcagatgagaagaggaaaatgtagtatcagaacgctgagacagtgttcaagaaggaagatgttgtcaacggtttgaatgctgctgagggatcaaacaaaaggtaggacttaaaatgtacgttggatttagtgacagagattagttaccatttctagagacgttttagaggtagaaacctctctaaacttgggggtatctaggagtatgtgggatgtgaagtaacggagatagtagtgttggcaattctttcaaatatttcagcagtgagaaggggaagagaggttcaagggaatagctcgagagatttctgatccagtggatttgtggctatgtgtataagttgtgagatgggagagacgtgaatgtgtttaagtctttacaggaaaaaactgttagagggggagagaataattgatagtataatcccctggggcatgggctccaaacaacagatacaggtattttaagagtagggaggaggcaggaggcaagggaacatggtgagtgtagatgtcaatagctttgttgatttggttgtgggaagttgatggagttctcattagagacaggaggcaagggctttcattgaatgcagtcagtatagaaacgcagggattgagaagagggagaacatttgaaacagttgttgagaatgggagagtagtaagccaaggaggcaaactccatcagtttgccgcccatttgaggttgaaaaccaagaatttaatagctatatttatatttttagagatggggtcttgctctgtcacccaggctggagtgcagtggcacgattatggcgcactgcagtcttgacctcctgagctcaagtgatccttccatctcaccctcctgagtagctgggactacaggtgcccatcactacgcccagctaacttttttgttttctatgtggagacggggtctcactatgttgcccagtctggtctcaaactcctaggctcatgtgatccttctgccttggccccccagagtgttgggattacaggcgtgagcccctgtgcttggcctcaatagcttattctgtcttataatttcattcagtattgttcatctgccttggtgcaggcatagaggagatgaagagttggttttatccaagattggtacttactaagaatatacagcaatggcacaatcttggcttactgcaacctccaactcccaggttcaagcaattctcctgcctccacctcccaagtagctgggattacaggcgcctgccaccacacctggctaatttttgtatttttagtagagacggggtttcaccatgttggccaggctggtctttaactcttgacctcgtgatctgcctgccttggcctcccaaagtgctgggattacagacgtgagccaccgtgccgggctgggaaacagtaattaaaatgagaagccatgttagctgaatagggtgggaagtgaagaaagggggaggcagatgggcagagagaaagtggtgtggagatctcagtgtgttggaataacaagtgtgatgggagtggtcaagggagagggtaagatgggaggataggatgttgtaggcagagtggaatgttggaattaattttttcagagctggaccaatttgcacattggcaatgtccagggtgtggccagacactccagtagatagctgaagtggcataaagtaagtcattgatctgaggcatctgggtaagggataggtcttcttttgagtgttgaacatagacagaatggtgaagaggaaagcttttacatcaggggccagagtcttcagtttacatcctggaggtgagtagatgattatcttatggatgggttcaggatggtacacctgatgaccttgagcctcagttgaacaagggtttttacgagggagtaaaggaggtacaggtgggaagcaacagtggggaacaaagcagatggccagtcaacatgctgaccttgattgggtgtgggaagatgagcagtactctcttgagaggacagcagagaggctttgggagttccagatagcatattgctggaatttggaaggagaacaggagtgagggattgtattatggagggaaaggaagcactagttatgagagtgaagatgaaatatggaaggagcttatatcttagtgatttgagtgtgattctggcatgggtgcaggggcattgaagtttagttgtggcttaggaaaaggcccattgtctgtgatttattgtcttcagagtggatagcagcaactgtgtggaacagcagctcaactgctttgtccagtgtggtgatgggaggttacagtggacagtgcccagtgctaaattatggtaaggaggaggagttgggatggctgctgaccttccatctctgcctttctccctaaggctcaacgcctcatggtatcctgactgatgtttagctttgtggggttgctttttgtggttgatctcattctgactgattatatatagacacacgattctagctttggagcctgaatggatgatgatactcttgactaaaagaagaaataaaagagaggggtcaggtgtccatgaaaaccccaggttgagatgctcagtaggagggaggtgtgtgtaaatacagatttgggagccatctgcatataggattgaagaaaccatagtattcatagtattggaaaattctgtagtattgacaaagggaaaagggcaaaggactgaactctctgggaaatgcccccagagaaaaatggaccagttaagatgattgcatgagatggtacgttatcaagacattttcatgtataaaacattttgaaatctgtcttttatcatatctcaaaaattgaggcctgaatagtttatctttttaatcattaaaactttttttttttttgatgggagacttcttggattctacagtgtgtacccctctgtccttaaagtatactgaacataattagcctttttttcatgactcaggatagttattataaatatcagttattgagttgtaacttccaggctgggcatggtggccatgcctgtaatcctagcactttgggagactgaagcgggctgatcacttgaggccaggagttggagaccagcctggccaacatggttaaaccccgtgtctactaaaaataaaaaaaattagccgggtgtggtggcgcgtgcctgtaatcccagatacttgagaggctgaggcgggagaatcgcttgaacccaggaggcggaggttgcagtgagtccagatcgcgccactgcactccagcctgggtgacagagcaagacactgtctcaaaaaaaaaaaaaaaaaaaaggtattattcctaatttaattccatgcagcctttccagccctatttgtaccagtcctactctgtctcttccccactaaatctaattatccccctttccctcacccagattttctactccaatcacctattctgtttcccagatatcctctgtactttcctccctctcatagtcgacctgtcctttctacctggtgaaatcctactcacccttcaatatacgactcatatgaccacattctctggcagacttggtcattctcttatgttttccagagcatttcatggatcacatatatcacatgattcaagaaattacggccagttgcaatggctcacgcctagtaatcccagcactttgggaggccaaggcaggcagatcacctgaggtcaggagttgaagaccagcgtggccaacatggcgaaaccccgtctcttctaaaaatacaaaatagctgggcatgggggcatgcgtcagtaatcccagctacgtgggaggctaaggccagagaactgctggaacctgggaggcagaggttgcagtgagccgagatgcctctgcactccagcctgggttgacagagtgagactctgcctcaaaaaaaaaaaaaaaaaaaaaaagaaattactttacttgtgatttactttaattactgacctgccaataaactgtgtttctcaaattttagtacatattggaattgtttgcatataagaagttaaattctcaagaaagtttgattcactaggtttggggttgagcctaagcttctgcattttttacaacaaatacttctcgttaattctgatgcgagttgtccaaggaccataatttgagaaaccaacaaccatgtagttaatggattccatcagggcaagggccatgacttatctgcttttgtattttcagggcctgccatgtagactatgctaaatgaatgtttctagaatgaaatatagtttactggggaaggcctttcggcatataatttttgagttgagacccaagttgttgcagaatcttaagaaaggttttgcctttcaaaggtgtaaaaaatagcacaagacaacatttcccaggtggtttccaaaatactcctgctagggcatgctttgtgggaaaagggtttgtttggtagtcagatacttttagaaaatgctgtctgttggacctgtgcccttcacccttctcaagacacactagcagattgaagcttttgagatgttctgtgggaaagaaacccttttaatctttaaaacgttttgacaaagcattttccctaccctttttccccagataatgcctttttagaacctgcagaactaatgtcctgaggtattttctttggaaactgctcacataaccaaaagtataacagtaggaattaacacttcatgtgtgatgatgacctataattacctagaattggagaggccactctgggaagttataagaaaagagataaaggattaggcaatattaagggaaagacatttttctatggtaggctcgacgtttgtattttggtataattgctctaaattgtcctggtcagttataagtattaaaataactgtagtatagatgatagcagacaggtttgagcatggaaggattggatttgggtaacggctactggaatgcaaaaggcagtaggaagtcaaagacagtagatgaaggatctgtagaatctggtaactaattaaatctggaaaaacaacttggatgttttaattcaaagatctaagtggtctatatactttttggatgtatagttagactaaggtgaaaaagaaacattgtattattgacagctgaaaagatgtgtaacagcagggagtagtttctataagttttttgggtttttttttttttttttttttttttttaagacggagtctcgctctgtcgcccaggctggagtccactggcgcaatctcggctcactgcaagctctgcctcctgggttcacgccattctcctgcctcagcctcccgagtagctgggactacaggcgcctaccacggtggcgcccggctaatttttcgtatttttagtagagacggggtttcaccgtgttagccaggatggtctcgatctcctgacctggtgatccgcccgcctcagcctcccaaagtgctgggattacagacgtgagccaccgtgcccggcctctataggtttttaaattttagttttgtttattttgtttatattttaacaggataaaatttattataatatagtttgccttctaaaaagagtccatatagaaatcactaacttaaactgaattcatacacaaacttcaaatcacatcagaagtttttcctggaaaaattaggtcctcttttttcaataattggggcttgtttatcagaaacgacttagtgataacaaagcaagacacatttttgtattattatacatttaatttagacgatggggaaattccttcacactacctcataacataaagcaggtttattaggccttaagaatcatagaatatttatacttttcatgtaaaatagaaaacctaattttccagccattcatgctaaacagcagggttaaagtaatgatcaggaagactttatacgttttaaaataaggtagttttcatgagacattttgcagtgctcccttggtaatgttcatattcagtgagcagaaaagaaaagatgagagagttaggactctactattgaacctgtttcttgaagaaaacaaaaaccagatagtacaattggatgtcagaaatgattattagaaagctaggtaaaaacagtacaggttgagtatcccttatctgaaatgcttgggaccagaattgtttcagaatttggaattttttggattttagaatattcgcatatacatatgagttaccttggggatgagagccaggtctagacacgagattcatttatgtttcatatacaccttatagtctaaaggtaattttatacaatatttttaatgattttgtacaggatacaaagttttgagccatagcatgaggtcacatgtggaattttccttttgtggcatcatgtaaatgctcagaaagtttcagattttggagcatttcagattttggatttttggattagggatgttcaacctgtatttccaaatacttaagatagggccttaatttgtcttcctttttattgtcttttcagacaaatgaccatggaaacagttgaatcccagcatgatggaagtataacagcttctttgacagagagcaagtctgctcatgtgcagactcagactggccaaaattcaatccctgctttagctcaggtaggcaataggcaggcaccgttgaaagtcaaaatatatggaaatgagaattaggtgcagattctgttttcttgccattgatcttaaattttccatgttccctggttatcagccattcttgcttatttgattgtgaagaaaagatacgtgttgtaattagccttgcattttaacagacattcagcagtgccccatctccattgccaccaccactatggaaggaaaaacaaaaacccttcctgaatatgtaatcctcaaagtatgatttgagagggttgctaattcgaaattgatacagttctgatgtccttagctgttaagatgacagaaatcttaccattttccccgtatatatttgtcttaatcattactttcttttcagttaggtctcgaactttgaattggtttcattcagaggtcaccagtatcagttagtacctgtttctagatcctaaaatttatttctgagatatctattaaaaatatagtaaaaataaacacatttgttagttcatcaaatatttattgaatgtctgctgtgtctaattattccggatgcatgtggatatgtagtttcaggacttaaatatcccatggtttggtagggtagacagatattttagcaataattccagtagggtaagaagtgctgtaagatactatgtagaaaatgaataaggcctacagaagagggagcagccagctgactaggagtgctttatatatctcctttgagctaggcacaaaggatgagtaggagtctgccaggttgataaggtgaggaagcatattctaggcagagcgaagagtgtgcacagaggcacagagccagagcatgggatgttcagggaactatgggtattgagtttaactggagccaggtgtctgggctgggcagtccagctggtaaaggtaagtagaggatcgtatacatttcagggtttagagtacactgtactctaaatagtattgaaatattttcaggtgcccaccgtattttcagttttgacactagtagccatgtggaggtggaattgaaagtcagtgagtcggaactgaagacaccatcagggtgcctggtggagtcaaagtagcgtgagatacagagcagtggtgagacctttgtggtacattaaagggagaataaaaaggacctggtggttgactggaaggcccaggggaaacaccaggcacttcttgggttatattaggccagactggtgtgagagctctcctttcctgtgcacccagcctgcttttctttcctctttaaagctgccaacacccactcgttccctgcaggttttctgcggtattctgtagagctgtatctccctagcaacaccttttgttacactgagagacaggcatttaggttaggccaggccttttgcttaaacacacacacacacacacacacacacacacacacacacacacacacacacccttgttaaaaaaaatgcatgttcattgtagaaaataaatattaaaatgaagaatataaaaactatccataatcttaacatccagagatttaatcattgttaacattttggtgtagctcctttagtctttttgtctgtgtgaatagaatagaaagcatatactttttctcatgattttgggattttccagaatctttagagctatggtttctggtcagtaattctgccctttgctgaagttgtagttgaaagcactttcttttttttttggtagagacaagttctcactatattgcccaggctggtctcaaactcctgtgctgaagcagtccttgcacctcagcttcccaaagtgctggaattacaggtgtgagcttcttgtacccagcctgaaagtacattttcttccttctgactctacttccttctaggtgggtcccggctcactaagttctacagatgccttttgccccagaattctggggctgaagtcccagcaatagatttccattatctaaatatggtaatttgcaattctgaggaccttcaggctgggcgacagccacctctgtgagcctcactcagaaattgccaacaggtggccaggtgcagtggctcatatctgtaatcccagtactttgggaggccaaagcaggtggatcgcttgaggccaggagtccgagaccagcctggccaacatgaagaaaccctgtctctactaaaaatacaaaactaggtggttatggtggcacacgcctgtagtcgcagctgctcgggaggctgaggcacgagaatcacttgaacccaggaggctgaggttgcagtgagccaagttggagccacttcactccggcctgggtgacagagtgagaccctgtctcaaaaaaaaaaagtgttgccaacaggttaagtaatgtggagtctgaaaagtagtcttaggtttctgagggcttgaaagtgttgccaacaggttaagtaatgtggagtctgaaaagtagtcttaggtttctgagggcttggaattgaataggagaccagtggacagaaactaggttttagtaggttatagaataagtaagaggaggggaagtggaagttggaagtatagactcttttaagaaatttgtcttgaactaatagagaaagatgggtttgtgaaacaaaggggtgagaactgggatgtgagaaatttgggaatgttttgaataaaatggaacattatagagacttgtgagaaggcagaatcaaggaactagaaaaagcctgtgtttacgtttgtaatgcttctttaaaaatctcaaataatgttgtatgctaataaatattgatagttattaaatctggatagtaaattcttggagttttgctgtttttctattttatattgttagaagtatttttttgttgttgtttttgttttgtttcgttttgtttttttgagacagagtctcactatgtcacccaagctggaatgcagtggtgcaatctcggctcactgcaacctctgctcactgcatcctccacctcccgggttccaatgattattatgcctcagcctcccgagtagctgggattacaggcatgtgccaccacgcccaactgatttttgtgtttttagtagagagggttatgccatgttggccaggctggttttgaactcctgacctcaagcagtccacctgctttgatctcctgaagtgctgggattactggtgtgagccactgcacctggcctgtttgaagtatttgatcaaactgaaactatggtttttatctttcacatgctagaaatatagagattaagaagtaatctgtatgccgacttatggattattttagttaactaagaattatcctccatgccatgcatggatcatgattttttgaagaattagaagacaattcttagcagtcagaattttctgaacataattactcattaaagttcttgtgacaccagcagctgttcgtttatgagtattgttactatcatacaatagtatatgtcttacaaggagtaggaaatcaagctgaactctattaaccctatgatgtatgccaaaagtgactgactcttctgaatttctgatggcttcatatttacttgccacttgtctcatttttcttcagacttgaggattgtaaatttccatatgttttagatttaaacttagttgtgaataaagaggaatttctgacactcaccttccttgtttatatgatcagattatcagtaaacagtgtgggaacaaaaggcgtaagcagaacgttcagtgggtttgattctttgcatctaaggtcatttgatactggttgttttgattgtcctggcctttccagagcttctgctaatcaagaatatactatgaaaatcatcagagacctagcaactgttgagcttggttttggctgtcaggcccctgttctgctgatggattgaggtgaggtgcaggtacaccaggggacactggagttttgcttttctgttttataactttgtagtaataaatggagcctttctcttctgtttgaaaacaaaatcacggtggtggtaatgtcaaaaagttggaagcaggagttgccatcaacaaatcctagtacggcaaataactggaagttaaatgttgtcttggctttcttcttgcctaaattatttttatgctgatttatttttaatggaagctggtatcttatttattaagtacgtgtgttgatatacaggactagactcgctggattctggtaaaactgttgataataagttggagagtccattttaaataacctggccaggaggaaatcttttccagaaatcaaaatggtgaaaagcaaaaatattgtatgtacaatacaagtagttttaaaatagtgacacttacatcctccggaaataatattgtttttaaatgggtaatgggaagttaaaacttcttttgttgtgaaagacttcaaacatacataagagtagaagaatgattccacatatatataaagttagtaattattaagattttgctagaccaggcatggtggctcatgcctataatcccagcactttgggaggctgaggcaagaggattgcctgagcccaggagttcaagaccagcttgagagcttgtctctttaataaaaaataaattaatacaacaaaaatttttgccaggtgtgatggcatgcccttgtagtcccagctacttgggagactgagaccagtggattgcttgagcccaggagctcaaggctgtagtgcactgtgatcatgcctatgaataaccactgcactccagcctgacgacatagcgagaccttgtctcaataaaattaaaaaaaaagattttgtagcacttgcctcatctatcttctttttttcttcttgtcgctgaagtattttaagctgctcagcagatctcagacatcatgtcattttactcctacttacttctgggtatacaactcttaaaacattatggacattttcttatataacaaaatgtcattatacctagttaagtataattaatatgcaatccatattcatttcacaaatgtatgatctactctgaaggcagtagagtggacaccttgaacttttcttgttcctagactcttgggaattggtaacactgccatgaagacctaggtgggtaaggtcattcagatggagccagtggaaaggatgtaccttaaaactgactttctgaagtataattctccatagctgctgctgaagcctggaggcctcgactctgaaagctaaataactcttctttataaatgactacttctcaaggtttcagcaaagatagaagggaaagatgaaaggagcagtatgctaggagtcaaaaggggggaaggaaactctggagattgtcaaggtcagcaaactgcctcgagagaattagttctgatataacacttaacctctccaaggacctctgtatttttggaaacaaggagacactagggaggcagagaaagccgctagggaatgttgttcagagattatactctcctaatcaagctgaactctgttaaccctatgatgtttgccaaaagtgactgactcttctgaatttctgatggcttcatatcttatcctttcttatcttttccattctaagtgcacaatgtgtaaggagtccctcggaataaagcagccctggcatgccatcggggattgaagtaggaacgatttaacaagggatacttggaaatgttgtcatgtgcgagttgtaaattttcttttttaatctggtggaaaattggaatggcatttctctgttttgcccagctatgccaaaaatcttcttggtcccacataggcctaggaaggatgtagatggcaatcacaaaacaaacaaaaaatgagcaaacaaatagaagacctcaagcaacattttctcttgttaataggttagcaacctcatatttgtatattaaagagatctgcattatgttaggttgatttcatataatttcagctaagtagatctagtttaaggtcagtgttttattgaatcttgtattttagcttcagtatattaatttccttagctgagggactcctactgaaggagaaaagtgttcctgttaaaattttgaaataaaagtttctgttttactgtagattttttcactattgctccttatttttatgtattctttcccctggctgtttttcatggttcatattttatctgttacacagaacatttgtattctgttagaattatctataaaaatgaacaaaggatggaagaaaaaggaagagagtaatttttttcaataaatgctaaatctgtattataaaatgttccttagtcatccaattcagaaaaacccactgctttgaaccgtaactcattattgaaggtaattcaaggttcagaggccataataaaaagtaactggtgaactgttaatattagtaaccaacttttttcaacttcaacaagaatttgttatgtatctgtactcatattttgataattttgtatataatagctagtatatttctttaaaagtttgtttttggctttagaatacgcttttatgttttcatcccagtagtgtattaaaggtgacagtactttgctttaaataaattttgatgttgcagaggtaatttcaggaagtataaagcaatcagagtcaaatttcagaaaaattttggttttataattacaataaaaatgcatacaaatttattttagtgtttgagagactgttaaagatttttttgtaatttgtaatgattatgaggtttggatactcgtagaaaatgttcaagttccctttcttagttttactaatgggtagtttgtcactagcagtaatgaaaaaataactgagtataaatacagttactccttttgcctttttctgtatgattttctttagtaaaagagtaagctgagaggacggaaaaatggggagtcattttttaatgggtatggagtttcagatttgcaagatgaaaaagttctgtagatctgattaacaataatgtgaatatacttaacactacaaactacacttaaacagtgaatatgttatgtgtcttttaccacaataaaagataatgaataacaaaaaaaataggctagacattgaaatttgaaaaaagaaacattaattttatagtttcttttttgagtaagacttagggattcttttcttttcttttcttttctttttttttttgtagagatgggagtctcgctctgtcacctaggctggagtgcagtggcacaatgtcagctaactgcaacctccacctcccaggttcaagtgattctcttgcctcaggttcccgagagctgggactacaggcgcgtgccaccacacctggctaattgtttttgtagttttagtagagatggggtttcaccgtgttagccaggatgatcttgatctcctgaccttgtgatccacccgcctcagcctcccaaagtgctgggattacaggcatgagccactgcgcctggcctcttctttctttctttcttttttttttttgagacagagtcttgccctgttgcccaggctggagtgcagtggcgcgatctcggctcactgcaacgtccacctcccgggttcacaccattctcctgcctcagcctccttagtagcagagactacaggcgcccgccaccacacctggctaattttttgtatttttagtagagatggagtttcactgtggtagccaggatggtctcaatctcctgacctcgtgatccatccacctcagcctcccaaagtgctaggattacaggcgtgagccacagttcccggccacctcttttcttttctttttttttttaagaaacagagtctcactctgtcacccaggctggagtgcagtgatatgatcgtgactcactgcagcctcagtctcctgggctcaagtgatactcctgcctcagtctcctggagtaactagaactacaggtgcatactgccatgcctggctaacttgtaagttttttgtagagatggggtctcactgtcttgttcaggctggtctcgaactcctggcctcaagtgatcctccctcttcagtctcccaaaatgttggcattacaggtgtgagccactatgttcagccagagactattttctttcccttattttatcgtttgttattataacccttgtaaatcccagactattaagaattatatttggaaaacagaggctttgggaaatttctgcttcattgcatagttgtgacgatatcttcatagtgctctccacaaatgtggatttttgtagccctatcagagataaaactgtagtggttttcttaaaaggtataggggagaaaagcctggttatggtaatgaatgtattaggtagagacaatgttagatgaagaaaacagacatagttcaggaaaaacacatgtctttaaacaggtttcattcagaagtagacctctattttggcagataataactattttcctttaaaacaatgcatataaagatgcaacaacaacaacaaaaactacaggtcaatatccctgatgaacataggtacaaaaatccttaacaaaatactagcaaaccaaattcaacaacatattaaaaagatcattaacagtgatcaagtaccattcatcccagggatgcaaggatgtttcaacatatgcaaatcagtaaacctgataaatcacatcaacagaatgaaggaaaaagaccatatcatcatctcaatacatgcataaaaaacatttgaaaaattcattatttccttattataaaaactctcaacaaattacataaagaagggatgtacctcagtgcaacaaaggcagtatatgacacacccacaactaacatcatgctgaatggggaaaggttgaaagctttttctctaagatctggaataagataaggataccaggccaggtgtggtggctcacacctgtaatcccagcactttgggaggttgaggcaggcggatcgctggagcccaagagttaagagaccagcctgggcaacatggtgaaagcctgtctctaccagaaaatatacaaatattagccgggcatggtggcacacacctgtaagtcccagctacttgggaggctgaggtgggaggatggcttgaggctgggaggcacaggttgcaatgagccaagatcatgcccctgcactccagcccaggttgcagagccagaccctgtctcaaaaaaaaaaaaaaaaaaaaagtcacagatgcccatttttgccacttctatttagcattgtactcaaagtcctagccagagcaattaggcaaaagaaagaaaaggcaactgaattggaaaggaagaagtcaacttttccctgttcatagatgacatgatcttacatatgaaaacctttaaaaaaaggaacaaaaattagaaaaccttaaagatgccaccagaaaaacctgttagatctaatacatgaattcactgaagttgcaggatatgaaatcaacttataaaaaccagtattgtttttatgtactaatagtgaactacctggaaaaaatatcaagaaaactctatttacaatagctatgaaaaaaatacttagaaataaatttaagcaaggaggtgaaatatctgtacattgaaaactataaaaaacattgatgagagaaattgaaggagacacaagtaaatgttcatggattggaagaattagtattgttaaaatgtccatactacccaaagcggtctacagatttagtgcaatccctatcagaaatatcaatgacattcttcacaaaaatagggaaaaacaatccccaaatttatacaggaccacaaaagaccccaaatagcgaaaggaatattgaaccaaaagaatgaagctggaaccactgccatggccagtccattgcagggtatcctgcagctgctacagaccgagaagcaggctgctgagaaggtttccaaggcccacaggcagatgaaccgggggctgaagcaggccaaagaagtagcttaggctgaaattgaacagtgccgcctgcagagggtaaaaagagttcaaggcgaacgaagctgaagcactgaagtggagaaggaggcccaggagaaaagatgatcaccctccagacctacttccagcagaacaaggatgaagtcttgaataacctcttggcctttgtctgcaacatccggccagaaatctgtgaaaactgctgcataaatgggtaggagaagaaaaaagcacctgttctatgaattggcattttagatgctctcatggaatatgaagcttcaacatagctcaagttatattcttaaggcattaaattatttctgtatattatataataggtccctccactttttggagagtagcaaatatagtgttttttttttgttgttttgtttgttttttttttttttttacagacttagaacttatctaaagatttcatgtttcttagaaaattaattggtatatgttgtctatttttatatgccttttggttcaagcaacatatatatcagtgttgacattttctttcttagatctaattaaacaaaaccaattttttttgaagaaagaaagtgattaaataatttttccccctaatgcattcttgaattcatcagggctttatctatgaaaaagtagtaaatagttatttgtaacctatgtgaagcaacattcagccttaatctattcctgctaatgattagaacaacaatattggtatagttgtttgggttgcttttagtttctcttaatcatgtttactagatgatagaacttaagaacttgttacatcttattacttggtgtatgataatcatttgaaagtcaagactctttgtcatgcaggaaaaaaaaaagaacaaagctgaaggcatcacactacctgacttcaaaatatactatagagctatagtaattaaaactgcatggtaccagcatgaaaacagatacattgatcaatggaacagaatataaagtccagaaataaaaccatgcatttacttacaccaacttatattcaacaaaaatggcaggaccacacaatggggaaagggccatttctttaataaatgatgttgggaaaactagatatttacacagaagaatgaaattaggcccttgtctctcaccataaacaaaaatcaactcttgaaaatggattaaatataagacccaaaactatgaaactactacaaggaaacaggaaactccttgacattagtctggccgatgagttttttgatacaaccttaaaagcacaggcaacaaaagcaaaaatggacaaacagtattacgtcaaactataaagcttccccacagcaaaggaaacattccacagggtgaagaagggacctacagaatgggagaaaatatttgcaaactatacatctgataaggggttaatatccgaaacacagaaggactcaaacaactcaatagtaagaaaacaacctgattttctaaaaatgtgcagaagacccgaatagatttttctcaaaagaagacataaaaatggccaagtacagtcattcatcacttaacaacaggtctacattttgagaaatgtgttgttaggcaatttcatcttttttttttcccttatgatccaacagaaccaatggtgtggtgatttcatctttgtgcaaacatctagagtgtacttacacaaacctggatggtatagcccactacatacctaagctgtatggtacagcctgttattcctgggctgcaaacctgtataggatgcgattatactgaatactacaggcaattggagcacaataataagtatttgtgtatctaaacataggaaaggtacagtaaaaatacggtatcaaagataaaaatggcacatctgtatagggcacaaaaccatagtggagcttgcaggactggatgttgtcctgggtgtgccagcgagtgggcagtgagggaatgtgaaggcctaggacattattgtacactactgtagactgtctttttttttaatagaattttgttcttttgcccaggctggagtacagtggcacaatcatagttcactgcagcctcaaactcctgggctcaagtgatcctcctgtctcagcctctcgagtaactgggactacaggcacatgccaccatgcccagctaacttattttatttttttgctattgtagacttgataaacattgtacacttaggttacactaaattcataaaacatcatttcttcaatgaactgtagcttactgtaagttttttactttttgacttttgtaataacacttagcttaaaacacaaacatattacacagctgcataaaaatgttttcttctatgcttatgctgtgtaaaccttttctgtgtttgaaattttttattttttttatttttaaacttttttgttaaaaactgagacacaaacacacatgttggcctaggcctgtatagtgtcaggatcatctgtattgctgtcttccaccttcatatcctgtcccattggaaggttctcagggaaagaacactcatggagctgtcatctcttatgacagtgccttcttctggatactcgctgaaagacctgcctgaggctgttttacagttaactttttaaaataacttgaagtaaaataataataaaaagtatggtaaatacataaaccagtaacagtcatttttttattatcaagcatatgtactgtacataattgcattgctatgcttttatttaattatttatgagacagggtctcactctgttgcccatgctggtgtgtggtgatgtgatctcggctcactgcaacctccgcctcctgggttaaagctattcgcgtgcctcagcctcccgagtatgggattacagtcgtgcatcaccatgcctggctaatttttgtattttcagtacaaaatttctctactaaaaatacaaaaataagcagatgtggtggcaggcgcctgtaatcgcagctacttgggaggctgaggcaggagaattgcttaaacccagaggcggaggttgcagtgagccgagatggtcccagtggactccagcctgggcaacacagcaagactccatctcaaaaacaaaaaataaaaaaaattagccaggagtggtgttgtgcacctgtaatcccagttactcagaggctggggcaggagaatcacttgaacccgggaggcagaagttgcagtgagtcgagatcacaccactgcactccagcctgggcaacagagtgagactgtctcaccaaaaaaaaaaagctcgacatcattaatcatcagggaattgcaaatcaaaactacaatgagatatcaccttcctcttgttaggttggttattatcaaaatgacaaaagataacagatgttggcaagaatatggagaaaagggaacacttatacactgacggtgggaatgtaaatttgtatagccatatggaaaacagtatggaggttcctccagatatgaaaaatagaagtaccagatgatccagcaatttcattactgggtatctatccaaaggagatgaaagcagtgtgtggaagagatatctgcacttccatatttattgcagcactatgcataatggccaagatacggaatcagcctcggtgttcatcagtggatgaatggataaagaaagtatggtatgtatacacaatggaatactattcaaccataaaaaagaatgaagtgtcatttgcaacaagatggaggaatctggaagtcattctgttaagtgaataagccaggcccagaaagacacatactgcatgctctcactcatgtgtggagtctaaaaagttctcatagaattagagggaagaatggtggttaccagaggtgggggtgcttaggcagagggaaggatggggaaatgttggtccaagaatatataattacagttaggaggaatgagttcaagagagctatcatacagcatggtgactatagttaaggacaatgtattgttgaaaaatgcagagatagttgaatgttaataatgttctcaccacaaaaacaactatgtgaggtaatgctattattaattagctagatttaactattacataatgtatatatactccaaaacatcatgttgtacatgataaatgcaattttttctgtcaattcaaaatgtaaagtaagaacatttaaaaggtacatctccaacctccacatgctttccttgcccagtctttctctcctgcttgtctctctccctgtcagtatgagacaccctctctaggaagccgctgtcatcctttacaaagaaggagtccagaatctaaaatcttacacagcctgcttcaggcagtactgaagcctggacttctcagaggccacagtagaggccagttgtagcaaatttggttgaaaaagcaagaattatttttaagtttttctaaccacctgagctccatttgcccagttgtgagattaaacactttcttcgggcaccagcaaatcatggccaccagaaaataaaatcaaatacaaaataataattaatgggagaggagcagtggctcatgcctgtaatcccagcactttgggaggccaagtcaggaggattacttgagcccaggagttcaagaccagcctgggtcaaggtaagactccatctctacaaaaaaaaaaattagccaggcatggtggcacttgcctgtagtgctatctactcaggaggctaagatgggaggatctcttgagccctggaggttgattgaagctgcagtgattcgtgatcatgccaccgcactccagcctgggtgacagagcaagaccctgtctcaacgcaacaaaaaacaaaaataaaaaaaaatagagaacaaaaatattaaatgtgtgcgtatttactattggatatggtaatataccatggtaggtattgcctttgtaagttggtctcccctgtcttttgttcctagagctttctcattttctcatctccaagggcttgtttactgcttcatacataaaaagaggccaggtatgatggctcatgcctgtaatcccaacactttgggaggccgagatgagatgattgcttgagcacaggagttcgagaccagcctgtacaacatagggagaccatgtctctatgaaaaattaaaaacttaggccaggtgcagtggctcacgtgtaatcccagcactttgggaagctgaggcagtcagatcacctgaggtcaggagttcaagaccagcctggccaacaacatggtaaaaccttgtctctattaaaaatacaaaaagtagccaggcatggtggtgggcacctgtaatcccagctactcgggaggctgaggcgggagattcgcttgaacccgggaggcggaggttgcagtgagccaagatcacaccactgcgctccagcctgggcgacaagagtgaaactccgtctccaaaaaacaaaaaacaaacaaaaaaaaacaattagttgagtgtggtgacatgtgcttgtagttcaaattactcaggaggctgaggtgggaggatcgcttgagcctgggaagctgcactgcactctagcctgggtgacagcaagaacctatctcaaaaaaaaaaaaacaaaaaaagagccctaatttatacatgtattctcagtttgaattaaatttagcttgtttacttaaaagtagtgttgaaggtatttttcatactatattttaatactagattaaagttgatactaattttatgcagttttaagtattaagactaatcatttgacctttgctttctttacctaaaacatggaaaatactgatttcatagattaaatgagatgatttgtgtgaagcacaagcacagagtttggcatctggtcaatgtgcaataaatgcttgcttttatcctcatagtgaccttccttgatcttaaaatggtagtaattaggctttaagatgaaatggcttatgctggttttaaaatatattgtattcggaatcctttgtaaagtaacaaaaatctacaatgcttagtaggcctccaaagggtatagaggagaaaagctaattttttatagttttataagcaaagttccggtatgtcaggagcttgcttaaaattatatgttttatgcttcttaatttaggtactttagatttctcctagatattttaaaacattgctggccactttgggcataaaaatctaaaatataatctgtaactatttcagatttcatggtaagaccaaactgcattataatttttgtaaggagctaaactcttagactttactatttatgtactctgaccattggactggaactgaaaacaacttaaagatgcaatttggcctggctgtgttaaattagtctgctttgcattgctataaaggaatacctggctggggcagtggcccatgcctgtaatcccagcactttgggagcctgagttgggtggattatttgagctcaggagttcgagacgagcctggccaacatggtgaaaccctgtctctacaaaaaaatacaaaaatcagctgggcatggtggcaggcgcctgtaatcccagctacgccggaggctgaggcaggagaatcacttgaaacttgaacccggaaggcagaagttgcagtaagccagattgcaccactgctctccagcctgggccacagagcgaggctccatctcaaaaaaaaaaaaaaaaaaaaaagaaaaggaaaaagaaatacttgaggctggataatatataaagaaaagaagtttgttttggctcacggttctgcaggctgcacaagaagcatggcaccagtatctgcttctagggaagcctccagaagcttcaaatcatggcagcaggagaagggggagccagggtatcacatggagagagagggagcaagagagaggggaagtgccacactcttcaacaaccagctctcagaactaccagagcgagaactcatgaccattcatgagggatcccccatgacccaaacacctcccacaaggccccacctccaacattgaggattatatttcaacatgagattgggagcggataagcatccaaactgtatcacgttttgtcaaaatgattctgattttgacatctacttttatgtaattcttctttcctgttgcataaaaagcctttttttggcttagaatcttactgcaaattctttatgtgtatttattattttgaaatacatttggctagtaaattatgatcagtttcagtcttactgaaaccaaatacgagattggctttcaaaagttccttccagagctaaaagagtttgacttctataaaggtcatgtccatttttatagtactttaatatatatattattataataagtgaaacatatctcatattggttagaatataaaatgatgccccaaatactataaataggaaatccaagatactgtacagattagctagaaaaaaaaaagtttagctagggcactgttctcaaaggataaagaaccctaattttaatttaagtgcttactggaagcattatcaaaatagattatttaaacccttctggataattaagaatgactgaattataacacttgctttgctttcaagaagtgaattttttagaaacatgaaatttgaccatttacgtttacagtatcagaaacaatgatccttttcccccttttcaattcagattatggatttcagcttatgcgctatacataaaaaaaaggattggaggcaacaacaacatctctttagaagataatggatagtaaatatagaaataataatcatacttggcttatctctttgtaacaaatattttcaacatatattcttaaggtaaaatttaaatgcattgaatttgcaatttgttagccacactatcttaaaaacaaaacaaaaaaaacagctaggccagacacagtggctcacacctgttatctcagcactttgggaggccaaggcgggtagattacctgaggccaggagtcgagatcagcctgacaacatggtgaaactccgtctctactaaaattacaaaaattaactgggtgtggtgacaggcacctgtaatcccagctacttgggaggctgaggcaggagaatcgattcaacccaggaggtggatggaggttgcggtgagcccagatcacgccacttccctccagcctgggcgacagaacaagagtctgtatcaaaaaaaaaaaaaaattaccagggtgtggtggcgggcacctgtaatcccagccactcgggagtttgaggctggaggattgcttgagcctggaaggtggaggttgcagtgagccaacattgtgccactgaaccgcagcctgagcaacagagctgaactctgtctccaactcaaaacaaaaaacaccttcatgggaaggaagtcactcaagataaccgaaatgaagaccaactacatttttcattttgtgtttgtcttactcagcacaatcaaatatgacttttaaaaattaaagtgggccgggcacggtggctcacacctgtaatcccagcactttgagaggccaaggtggatggatcacctgaggtcaggagttcaagaccagcctggcagagatggtaaaccctgtctttactaaaaatacaaaaatcagccagacgtggtggcacatgcctataatcctagctatttgggtggctaaggcaggagaattgcttgaacccaggaggtggaggttgcagtgagccgagatcgcaccactgcactccatcctgggtgacagagcaagactccgtctcagtggggggaaaaaaaattaaagtggaatattttacatctttattcaggtatttgatttataatattcttattattttcagctttaaaacatttgaaatattctaatattctcttaaatgctttttcccctatagaacagacttttgagaatcctgtcttaatacataaatatcaagatagttttcaacttcttgcttagcttgttagtgtatttttattgtagtccttaaactaggtagtacagagatttgatttttcaggagcagagttgatagagcagtctgctatattgtgaattcacattttaaaatcctttattgtcttgaatgcaggcctagtagctttgtgacatgtgcagctatactatgacatcataaaccccatcgtgagggaacctagctacgggtcagagctagtccactaggtgctaatcaaatgctgtgttacaacactgtgaggttttcccagttataagtgtcactattagggttttttttaattgcaaagccaaataaggctgtcaattgcatcatcttaccttatttcttcagattaagtactgtttatagtgggatttttggtggatgtggtggcatcagcataatctatgtttcaggcgtcctatagaagaggattattcttcaggggatgtggaagaaaaggtaaatgatgtctgctataagtaccttcacacttttaaagccttgtgaaaagaggggtaaaaattgtgaaatataaaataacatccattttatgttttagttttttgttcttgcgatagtttactgagaatgatgatttccaatttcatccatgtccctacaaaggacatgaactcatcctttttttatggctgcatagtattccatggtgtatatgtgccacattttcttaatccagtctgtcattgttggacatttgggttggttccaagttgtagcagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcgccattctaactggtgtgagatggtatcttattgtggtttagatttgcatttctctgatggccagtgatgagcattttttcatgtgtctgttggctgcataaatgtcttcttttgagaagtgtctgttcatatccttcgcccactttttgatggggtggtttggttttttccttgtaaatttgtttgagttcattgtagattctggatattagcccattgtcagatgagtagattgcaaaaattttttcccattctgtaggttgcctcttcactttgatcgtagtttcttttgctgtgcagaagctctttagtttaattagatcccatttgtcaattttggctttgttgccattgctttttgtattttagacatgaagtccttgcccatgcctatgtcctgaatggtattgcctaggttttcttctagggtttttatggttttaggtctaacatttaagtctttaatccgtcttgaattaatttttgtacaaggtgtaaggaagagatctggtttcagctttttacatatggcaaaccagttttcccagcaccattaattaaatagggaatcctttccccatttcttgtttttgtcaggtttgtcaaagatcagatggttgtagatgtgtggtattacttctgagggctctgttctgttccatcggtctgtatctttgttttggtaccagtaccatgctgttttggttactgtggccttgtagtatagtttgaagtcaggtaacgtgatgcctccagctttgttcttttggtttaggattatcttggcaatgtgggctctttttgggttccatatgaactttaaagtcgttttttccatttctctgaagaaagtcattggtagcctgattgggatggcattgaatctataaattaccttgggcagtatggccgttttcaccatattgattcttcctgttcatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctgtttgtctgttactggtgtataagaatgcttgtgatttttgcacattgattttgtatcctgagactttgctgaagttgcttatcagcttaaggagattttgagctgagacgatggggttttctaaatatacaatcatgtcatctgcaaacagggacaatatgacttcctcttttcctaattgaataccctttatttctttctcctgcctgattgccctggccagaactgccaacactgttgaataggagtggtgagagagggcatccctgtcttgtgccagttttcaaagggaatgcttcccatttttgcccattcagtatgatattggctgtgggtttgtcataaatagctcttattattttgagatacgtcccatcaatacctaatttattgagagtttttagcatgaagggctgttgaattttgtcaaaggccttttctgcatctattgagataatcatgtggtttttgtctttgtttctgtttatatgctggattacgtttattgatttgcatgtgttgaaccagccttgcatcccaggaatgaagcccatttgatcatggtggagaagctttttttttttttttgagatggagtctcgctcttttgcccaagctggagtgcagtggcatgatcttcgctcactgcaagctccatctcctgggttcacgccattctcctgcttcagcctccctagtagctgggactacaggcacccgccaccacacccggctaattttttttgtattttttagtagaaacggggtttcaccatgttagccaggatggtctctatctcctgaactcgtgatccgcctgcctcaggctctgaaagtgctgggattacaggcgtgagccactgtgtctggccggataagctttttgatgtgctgctggattcagtttgccagtattttactgaggatttttgcatcgatgttcatcagggatattgttctaaaattctctttttttgttctgtctctgccaggctttggtatcaggatgatgctggcctcataagatgagttagggaggattccctgtttttctattgattggaatagtttcagaaggaatggtaccagctcctccttgtacttctggtagaattcggctgtgaatccatctggtcctggactttttttggttggtaggctattaattattgcctcaatttcagagcctgttattggtctattcaggaattcaacttcttcctggtttagtcttgggagggtgtatgtgtccaggaatttatccatttcttctagattttctagtgtatttgcatagaggtgtttatagtattctctgatggtagtttgtaattctgtggggtcggtggtgatatcccctttatcatgttttattgcatctatttgattcttctctcttttcttctttattggagtttaacctattaactctaccagtataattataaggttgacgctcttgcttataagttttggcctaaccagtgagaatgtagaatgatagttctccagatataagagttttcttttttaaaaggagacatttgaattctacctccagatgcgtcatttatgcaggttctcagcctttattttagcattttaatgaaaaaattgtctcatgagcttttggcctgcctagagtttggacatatggaagtttccttgtagttacagaatctgtataacctatctccagaattgtaaggatatggtttatgttagcgggtacaagttctttttctgcagcaggtattcttaaccaagcctttttttttttttttttttttttttgttaaggcacagtctcgctctgtcatccaggctggagtgcggtggcatgatctcagctcactgcaacctcgaactcctgggttcaagaaattctcatgcctcagcctcatgagtagctgggattacaggtgcgcacaaccacacccggctaatttttgtatttttagtagagagagggtttcaccatattggccaggctggtcttgaactcctgacctcaggtaatccacctgcctcggcctcctgaagtgctgggattacagtcatgaggacttagccatttttgatagagttattgtttaattaaaattctgataattgtacttgaaagatgattaaagcaatgtaaaggatgatttatgcctatcagatgcccatgaatctttgttgaattgtttttctgttctccataataatctgatttctttgaagctgggcatttccccacaaaaaatgaatgtggacaccacctgccatctcaacccacaggtctagtttgtgagaatacttgtaggacccctgggtttcccccgctatagtttcaagtacattgtcttcagataccttattctatgtacttggaaaaaagagtaaaacattgagagccactgggatctgacaagctttgggagctccttaattctaaaaagaaaattattttgatttgagaaaatgtaatatcttcagaaatttccaccacccagctatgtgactgcatttttaaaaaaggaaaggaacagaggaaaatcaagtcactctaccctccttacttacctgtggcttgtccctacacatggtggtgggtgggagaagtggtggtggagtactgggtcctccagagagctcagtttggaatctggaactaaagatcatgtcccaatttcctgagctgatgggatagaagctggtcaatgaagtcttctttttgtgttaatttttttcctttgttttcttttgttttatgtagttataaagcataatttctattttgccagtctctgacacatgggctctgtcagggttactggatatgtttattttgtctctgctgctctactggagctgaaatctcagcctgtctgagcagttctttaagctgaaagccagggtgtaggggctagattagtgtggaatagctgttttcaaagtgtggtgtgcagaaccctgggggtgactctgagacattttcatgaggcttgctaggtcaaaaccattttcacggtgatgctaagatgttgtttttctttttctctgttttgatatccacactgatggtgcaaaaacagtggtggtgggggagtggtaaattgttgggtgccttaactcaagtcagtgacacaaactgtgttagtattaactgtattcttcactgccatccacttgcagtttttttttttttaagtcagttttacttaagaatatctttgatgaagcagtaaaaattaccattgcattaaatcttgactctgagtacatgctgttttgatattctgtgtcctgaagtgggacagctgcagaaagcacccccccgctgcgtcctgacgacccatggtgttcttaaggaaaagcacgtgtgttatttgagtgccaagatgaattagctgcctgtttttccacagaacgtcattttcttcaaaagaatgactaatttccaaatgatggctattcaaacttgaagacatttcctcaaaaacaaatgaagtgagcttgtcagttcaagggaaacaactcatggtgtttattgtcacaagcttttaagccaaaactttgaattttggaaaatctgcatctgccattgtgagcttgacaatattcatagttttctgatcaaactggttatactttaatgaaatgtgatttataatactgtgtcatgaaatgtgtccacgtttggaagatctcctgaactcagtgagccagtattttccaaatgaatacttcaggatgttacaaaatcttacgtgggtaagagattcatccaaagtacaagacagatcaatggattttaatgtaactgatactgtctcagattgtatgttgcaattaatccttaagagacaatcagttgtcaagttttggtgtatccatgaagaatatccatgattttctacagaagctattataatattcctccctttttctaacacgagtctttgtgaggcccagattttcttcacataccaactaaagcaacatactgcaacagattcagtgtagaagtagatatgagaatctggctatcttcagttaaacctgacattaaaataatttgtaaaaatgtaaaacagtgctactcttctgatttttttgaaaatgtaatcatttttcataaaatgttatttatggtagcacatacttattattttaaaataagttactatttttaaaatttctgttttaatttccagtatgttaaatatcaacatatataaccagtggtgtgcacagctggcttgtaccagtgaaaaccaattgtataatctttatccggctttgtgttcaatgtcatccattggcagcttgaaatcagccatagtaggagtacttacatcacagaagtgagcaaacgctacaagtcagtgttcctccttcttaagatctagttaagtgtttaccagccctctactgaatatcaatcacagaaacaaaagctctttgaggtcatcagtaatttttaagagtgtaaagatgccctgagactaaaatatttgagaattagttgtgaggagaaagagttatcttttgagagttagtcactatagaggtgtataattcatacagagttgccttttgtgccggaaacatttgtagaataaatccaatgttttaaaacttgcagttgttaaatctactggttccataatgggaggatgtttttcttttccctggaatctaaactagatgataatactctgggggtaggtgagctgaattttccctgtgggctacatattggttgcctctgtcctggtttcacactatctgtccaactgttatctaggtttagatcaagccttcactcaagctctggcatctacataaagccctcacttactgtttgggcccatactgatctttctattctgtactcctgtgatattcatggcctctaaaatggagcaattcgttctgtactatttggtgtgccattgtttcttaggtgctagttttattaattctattttctaatagtgcacctagtacaaggctcaacacctaggttctcttacacggataaaacatgttttaacttttggattgccagagaagttagttttccaagggaatgatgatgtaaataaatcttagttatttgttataaacccagtttttaataattcttttcagatattaatataagttggaaatcattggtgttcctcaaagtgaagtcacacacaaagtcttccttgaaaaaattgttttagatgctgtggttctactaccactcatgatagacactggtgacttatttccaaggtctttgactcttgagtaagtcataatgaatggtgaatcttagtaaaatgaggcaaagtttctgcaattatgctagcctataggacagagttgtttactaattagaaaacctggcaggttttgagtccagaggagtggttagtatcgtgtttttctggtagggatctctgttgaaggaactcagggaagtagtgaggagatggctgttgtgctgatctctgcccaaagttaagtgatagttctggcctctctggatgctttagctagggagaggaaaagtgtccagaggcctcatcagccttcaaggcatgagctttctctgggtcagagacaccaggggcttgaaaggtcctggaatttcttcggcctatgcctttttagttattatgagggcataacagtgactgtgatttttatcagtctagagacaaagcatcagctcacatccagagtaacactagaatatcatatgtcacacatttaataaaaataattcactggccaggtacagtggctcacgcctgtaatcccagcactttgggaggccaaggtgggcagatcacaaggtcaggagatcgagaccatcctggctaatgggtgaaaccccgtctctactaaaaatacaaacaattagctgagcgtggtggcgggcacctgtagtcccagctactcaggaggctgaggcaggagaatggcttgaacctgggaggtagagcttgcagggagccaagatcacgccactgcactccagcctgggcagcagagcaagactccgtctcaaaaaaaaaagaaccatagttaagttctatctccaatttctctgaagaagttagagggtagtttatactctggcctaagaaaggcttcactgttagtaggcgtgaggtcgtagtgaggtagtttaactgctttagaactttgtgcttggaacattcttagccaccgaagtatgggcaccaaaagcgataaggagcatgtgttccttaataaatgtcacatcagaaaatgactgttccaggacagtaaccacctcccgatggtaagtatcctagatagtttgtcatttctcagcagcaggaaaaagagaagtaggccagtcatattagtgagtggtattacttaaaaatagcaaaaacaataacaaaaaaggtccagctttaatcctcaatggtgatcattttggcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggttagcttccttcctgaatggttttgtctttgactttcttgagccatttttttcctctttcactaattcatttatcatttttctttatgaagtgcttatacgcaaatctttttattagatatttggaggaatctcttctccttgcgtaaggtgctctgtgtcctgctaggtacgtaggtttcacttcagagctgcagctttgttgccaacttttcatttggggactgagtaattgcagatgagcagttcatgtcttcttcactttgttgttctgtgttcaaactcagatttatttagcaatgctccccaagggtgctgaaaaatattttgagggtgcatcagagaagatgtgtgataaacacagtaatataaagattatagtgctgatgctgttttctttttttttcttcttttttttttttttttgagacagagtctcgctttgtcgcccaggctggagggcagtggcatgatctcgggccattgcaagctccacctcccgggttcacgccattctcctgcctcagcctcccgagtagctgggactacaggcgcccgccaccatgcgtggctaattttttttgtatttttagtagagatggggtttcaccgtgttagccaggatggtcttgatctcctgacctcgtgatccgcctgtctcggcttcccaaagtgctgggattacaggcgtgagccactgcgcccagccagtgctgatgctgttttcatgaataatcaccttagtaggtagatataaatttataatcaccttagtaggtagatataaatttattttaaattcggtatacataattcttggtaagatgatattattaatgtatccctctcgattaaaccttggcttttgtagatatgattattattgtggttgtgatccagagatgtattttacccttaacatttcttgaagttaaaacattttttccatcaatagatgtaaattattaaatatgcattttttaaagtatgcatcttaattactgaatttatttttgttcatttttaaggtcagttattatcctttaaatgctgaaattatttgaacctaattgatgacaaaaaaaaaaatctgtgaggaaaatggagacacgtatacatagtatagtccttttcttgcgtgttcaagtagtttatcacagtagaatgataagagtggcgacaagatacctgatgtgacaaattcacatacattaaaagcttgattatctttgtggcatgggtattttctcctgtgtttcccagaagtgtaagaataattctcatcattatctttttttcctgtgatggcccctgattccaagagtttctaattctttctgacactaattataaaacaagaaagtctttccaacctcttctttgttttatgacttttattgaggtccacatatttctacttagttttaacctggctggtattggaagaaagtattgtctattattattatttattatttaatagagacagaattctcagtatgttacccaggtttgtgttgaggccctggcctcaagtgatcctcttgcctcagtctttcaaagtgctgggattacagatgtgagccacagcacccggctgaaagaaagtattctgttatattcagtagactttgtttggattttgttaagtgaacgatttaattgtccttgtagaaagaggtgccagtggatcttgtcctagaatacttacgtgttggatcatggtcaagccacttaatctctgtgcatgaactttaattttcacctttctaaaataggtaaattaatagcctacctcacctaagggagttgttatgattctatgacagatgtgtgacagcccggtgtaaaatgataaatatttaatatttggtggtgatatatgattatctgaggcaacaacatttttctcagtcctgttgattgggtgtgtgtgcttatgtgtggggcgttcatgagcaaaaacacgagtcatatgtggaggtgaatatacacctccgtgtacttcgggaagtatatattcttgcttgcattgttgatattttaataagctcttttgattttgtccaaatcaatttcccatgtaattataatatgaagtgagttttgtaaactctgctaccctaggccctcaaagtattaataattgactgaatatatcaaaatcagtcatgttgttgaagagattcattattttagttttctgacttctttaataatcatatcactgtattattacttgacttgaaaaatgaaatcatgcttaaaactctgatctttctcttaaggagaaatgctttatttggatcttcaagacccaccgccaccaagccctaacttactccttgtaatagaaatcctgattttacccaggcttgcttactgacttgcttatctacttaaatattctgtcttgggcctatctgatggctaatgtgaagacccagctcacgccagcgccagctgtgagagtgtgggaacagcagtgtgatccgggagctctcttctgcgttggcccctcgctggctccctcctggattcgtaggagcactttcaggttgaggagcttaggtcttgggtattttacattttgttctttcctgcaatgcctcatttgacatcccaaccactctttccctagtatttctgtagtatagagtacccgtaacattcctttccacacacatttgttttataactgaaatgtttgcgtctgcgcttcctttcttgagccagactccttcagtgcagattcactgtgttctattgctcagttgcttccacagctcctggctcagtgctgcacacacagactcttagcctcaattttttgaatgagggaaaagagcatatattttatgatacatttcagaaaatcttgtattataggtagcagcaattgcagagacagatgaatctgcagaatcagaaggtgtaattgattctcataaacgtagagaaatcctttcacgaagaccctcttataggtaagttaaccaagtttcctaatgtaaagatactttttccaaaatggtagaataattatacatcaaatcaattcttcctttatagcttttctgttttaagacttattcatgtatcttagtgacttaccttgttaaattgtattttaggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcacattcagtcttgtgcattttaatggaccgttaattctgtgctttttgctctgattaaagcactagtttttttcccaaaagaagagtgtttgatacgtaaaaagcaagagctagaaagaaaagaaaaaggaggagaaaggttagggatatcacatatcctaagctagccccttaggtactggaataatgtgatattcctgtcctttctgaagtataaattgtccatggaagttgtctaaatcaatttcccatgtaattataatatgaagtaaagtgagttttgtaaactctgctaccctaggtcctcaaagtaattgaacaaatatattgacagcagtcatgttgttgaagagattcataattttagttttctgactttaaaaagagctacttaggtactggaatatatgtgatattaaataatgtgtttatccaaataaggtattaagattttagatatattctttgtttttcctttaaaaagtagcaataccaagaaaaaaaaactcaagtcttaatttaagtcctgactactaaaacaagctataatctttaatgtatgagaagactttatatagtcattatttttgtggagctttttagagtttttcttgtagcagtggtagatttgcagtagtaaactattaaatacattctctgttggtaattgaggggaactcctaccatgatacctagcagatccggggtgtagtgtattcacacgtttgacagggcacccagtagacttgtccaaagtcagtgttaggaaaagaaaatccccaccatctgtaagaaatagaccttgaggtttacattgtcatttttttattacttctctcgtttacatgctcttttgtctggcacactgggaatctctggtgggttttagaactgtaaaactgaatatgccagctgatgagcctctacagcacagcacgcaggttatgagagtgctgagtgcctcgtccccccgtccccagaggggctgggcagaagctgctggcgcctcctggctggtcagccctggccttgagcagctccatccactcaccccagtgggctgtacacatgtcatcatgttctgtttgtgtaatgacagggaaaaggttggaagtgactgctgaaatgacactaagacttctcaaagtgttgggaaccactaagatgctgtcatcgtaacatttctctggcatatgctaatgctacttaggacttctgatagaagcagtgattcctttacaagttgatagggaagcagatgctgtagggttaacttgtctagattattagctgaaaatttgaaattgtgaaaatgtatggggttgaagctggagaggatgtggaaggaaccatctttgtgccatttgcaaactcaatgatcagagcaagaagctttattaaattcacatctcaggttttagtctttgaagtgggaataatactaaattgccaaactctggggttcctgtgaagacaaaggagataatgggtaaaagtagggggaaaaagacatgctactattggcatgaaacagagaaattaagttaggtgtaccattgtctcattcatgttcattgaactttccctccagccagccccaatggcttcattccctgtgtccttggtacctgctcacagcagggggctggccttaaacctcactctgtgtgtctgtgggggggatgagaggagcagagtcaggaattttggttgagaactagaaaactgcatctgtagaaattagatcttaggccaggtgtgatggctcccacctgtaatcccagcactttgggaggtctaggcaatgagggttgcttgaggccaggactttgagaccagtctgggcaatagagtgagaccctgtctctacaaaagaattttaaaaattagcagggtgtggtggtatgcgctcatcccagctactcaggaggctgaggtgggaggattctctgagcccaggagtttgaggctgcagtgagttatgattgcaccactgcactgtccaacctgggcagcagagtgagactctgtctcaaaacaacaaacaaaaaaaacacatctgtctatttgccacataagaggtcatggactatttcttactttggtttcttaatttgagtctatacagtatgatcctagaaattattctgatgagaagttatagttctgtatgtacagtctgcaggtaaaaattgccatttgttcacacaatgtgaatttcttttgttaaaaatgcattttggggacatttagtgaaatatatgtagataattctttgagaagtgaatactaacaacattcaaactttttagaagacgtttactttaattggagggtaaacatacttacacacacaacatccatttttattgatcttattttttatagaactaacttagcagatattaatgctttaatgttgtagcagaatgtctagaaatggaaacaattgccagtttcctttggtttttgaatagaggaacgtattttattagaatttctggagattttcctatttttttccttccctttgagctgtaaattttttttaatgctctttcataaccttttattataaaaaaaaattttaggtttaattgttcagcttttatccatggatggctttctcccaaactttgcttttatttctttttttccaatattttattagttatttttaatttggaataatgagttagctggtgtttaaaagaactaaatgtgtatcaaagttgaagaaataaagtatattcaagttttcccatatacaagcagttacatttttaatagttgaaagatatttggcagaagttggccttattatattgacttactattatcacaaaaactaaaaagtgaaagttggaataggctgctccctggggagtaggaaaaagcataaaatagacagggatccattattacaacaccaagtaagtgagctgtacctgcagaatcctcactggaagtacagatcttagtgataggtgtgttgcataacagttgagctggtcgaagaaagtcttttatttcagaagcatatacccgagagatggcgggagagagacagccttagaattaacaaagaatgttacttgctgcatgagacagttaagataggcagtaaatgagtgaatttgtaaaagcaaccgaggaaattaaaatgtttgaagcttcctaattcattaaatttcctcttgaaacaaaggttacttaaatcctccatcctactatacccaacctcttcctgtaccaattaaagactatcacccaagacttcagtttttttcccacaaatggcccttgtctctgcttgtgcctattgtattttacgaggaatcttattagagtattaactcatctttctggaattcttatacatgaaaggtaagtgggtcaatctaaactgcaccattatgaaaagaaaaatatgaactttgtggactccttataagaattcagaattctcaggaggctcacgaataagcaccaattcaacttcttcataaagggaattagaacataataggcttacacattcgaaagttaatccagttgcagttcttaatagtgacgttgtttacatttctctaaggcaactgtttcaaaattttttaaggcactacttaatgtaactctggcttttaaactttgatgttgctattgttgttatagcatgatttagtcttccttctgctataatgcacctcttggcttttaaggtacaagtactcataggtgctctcttatggtcactctgaatttaaacctgagaattcattggaacaaaggtctgtttgctgctgtttttaaagttaatgcagtgagatttcatttatgaatctttggattgcaatttggaacaagagtggttttaaatataaacatttacatgtgtatgtattttaattagctcatgtgtataaatttaggattagaagtatataacatgggccgggcgtgatggttcacgcctgtaatcccagcactttgggaggctgaggtgggcggatcacctgaggtcaggcattcgagaccagcctggccaacatggtgaaaccccatctctactgaaaatacaaaattagccgggtgtggtggtgcacacttgtaatcccagctactttggaggctgaggcaggagaatcgcttgaacccagcaggtggaggttgcagtgagctgagatcacacgattgcacttcagcctgggcgagaagagtgaaagtccatctcaaaataaatgaacaaataaataaataagaagtgtataacatcgccaggcttggtggtttgtgcctgtagtcccagctactcagaaggctgaggcagaaggattgcttgagcctagcagtttaagaccagctagaccaatatcaggatgtggggcaacacagcaagaccccatctcttaaataaatagctaaaatagaagatatgtctaaattcattcagttaatttcatcttattttttctatcttgatttatgtttattgaaagcacatgttatgctatccttgactattttgaaacctaaacagttttctcctcaaatctctgaatacagacaggcccacgtaaaacctatttccaggatcctgaggcactgggaaattttgtttattgtcagatgagagagaacattttcaatgggaaggtcctctgtcatttgataacaacaaaatcaagagcacctttggcataaaaatgaaaatgaggctgacgtgcctgacttaatcagtagaaatgttttctcactagagccagtgtgtgaggggtgtgtgtgtgtgtttgtttagcttttgttttccatatctaattatataatgacttccccagaaaataaaatgagaaacagattcttgatgtgtcagctgttcatattgtgaaaacaaagttttttgatcagaactgtggggaaacattactgaaaagaaaaaaggaaacgagtaaagcaaaaagaaagagaaaaaaggaagtaaaggtctttgttatctacctatttaggggttcttaccctgaggcagctactctcacctcagattgacttgatcgttatttaaaagcttgataatttggtgttgaaaaactaggttctatgattggaatttgaaaccatacctcatttaactctcctagattcacagggggcttaagttttttataatatcatctgtcatgaggaaatgatagccattcattcattcattcattcattcattcattctattttttgagtggctgctctgttctaggctttgtacttcttttttttttttttttgagacggagttttgctcttgtccaggctggtgtgcaatggtgcaatctctgctcaccgcaacccccgcctcccagattcaagcgattctcctccctcagcctcccgaggagctgggattgcaggcatgcaccaccacgcctggctaatttcttgtatttttagtagggacggggtttctccttgttggtcaggctggtcttgaactcctgacctcaggtgatccaccaacctcggcctcccaaagtgctgggattacagatgtgagccaccgcgcccggcctaggctttgtacttctaatacactgtggttacctgaccttgggctgctctttctaaagcactatttctgtgacatcaaactaattatcaactgaaaaatacacattcaaatatatgaaaacatacacaatttactcatgtctagccacaaggggccaagaaagcagtgtcttttgacattttcatacttgtaagaagttagttagatctctctcaaacccttttactatgagggctgaatcctgagacccatgaaatctttggaaagccatggtttaaaaataccctgtttttaaagtgtgtacagaaaataactgctctaggtgagccagataaagtgctgttacatcagggtgtctcaacctcagttctattgacattctgtaactgactcttcagtttctgccacactggcctgtcagtgaaataaaacacagagaacgcagcatgtggaagtctttttaaaaatgttaatctatcttcctgtgtagacactggcaccttaggtgaaagaagtgaaaatttgttgttgttactctttccataattctcataggtttgtcctatcaggttatcgcctaagtgcttttttgcctagatgcctttaaaaacgtttggaaatgacttgaaaatattcagagtgtattttaaacactactgttacgctactgtaaggtatttacattgatgtatagatgtcatgttattctggtgatgtgtttttaaaatcttcattgtaaagcctagttagctagtttatatgtgattttttaaaaagcatagcctctggtaccatttaatatctactgtttgaagcatgcagttggaatctttatgttaaaatatacagacctttcagatattttaaataatacttgtctattagagtgaaattttgaaacaaaacgtttgatcagttattctttggaagcttcaagtcaattaatatgttaacttttaaacatgactggcagatctcagtatttaaaggaaatctacttcctatttgttgccattagctgtagttacttgagatacttggtagaggtaaatattgtagcacaaatccttttagtaacagttactttttaaggacctttgcaacttgacaatttatatttcaggattctcctgacatagacaaaatggcaaaggttacagttttctagactttagctttataaccaaaatatgtttttatatatatttatatataaatatataatatatgtaaattatatagttatatataacatatgacatatataattataataaatatatattaaaaattttggtcatatatacaacatatataactatatataattatatatagttataattatatatagttatatataatatataacaaattatatataacataattatgttatatataattgtacataacatatatacatatataggtatatatacgtatatatgttatatataattatatattatatataaaatataaataattataaaaatataataattattaaaatatatgttatatataaatacaatataaattatatatataaatatataatttatatattatatgtgatatatattatatattatatataatataatatataatatatatcacatataatatatattatatataattaatatatataattaatataataatatatataatatataatatatatgatatatattatataaatatataaatatattaatatattaatatataatatatataatatatattatatattaatattaatatataaatatattaatatataatatatattatatatttatatatataaaatatataattatatataacatatataattatatgtatgttggtttttttttttagatggagtctctgttgcccaggctggagtgcagtgccgcaatctcagctcactgcaacctccaactcccgggttcaagtgattctcctgtctcagcctcccgagtaactgggactacagacacctgccaccacacctggctaatttttgtatttttagtagaggcggggtttcaccatattgatcaggctggtctcaaactcctgacctcaggtgatctgcctaccttggcctcccaaagtcctaagtttacaggcgtgagccactgcaccttgcctatatatttcttaaaaactactttcttttgatgacaaatcagaaaagtagttagctgaatgaaggtagaaattcattttaattgcaatattaaatgggaatttttcttttcttttcttttctttttttagagacagggttttcctgtgttgcccaggctggccttgaactcctgggctcaagtgatcctcctgccttggcctcccaaagtgctgggatcacaggcatgagccaccacacctggccttaaatgggaattttaaatggtagaagaatggtgtttataaggaaaaacatctgagagaatggagaaaaccaggaagctggactctccctgtctccttctccactcttcctcttgagtgatgtagtcagctggatgctaaggaggaggaacactccatgggctctatgaatctcaaacatttctgaatataaaatattttcaagtgtttataagcttttcctagagtatcgtcccatgacgaagctgatcttccttctcaattcagcatagaaaataagggtaacctgagaaagaagcaatggtaataaatagacccagagtatattcttccaataggggattattaaaaataaatcttgaaattctctaatatttcttttctttttctgttaagttgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaaggtatattttattaatctaatacatttagaatacctatggattactatatcacaccattgagtggtgattttatagttttttgaaatagatcgaaggtagatggtggggggttgggaggcacttaaaaaggcttacagaagaaatattttaatacattaaacagcaaattaagttttatcatttttcgccttttagcaggttttactggctctggagaaaggccaaattcagagtagcatgatagaaaaagagagatagaaacatgaatgaattttttttttttttttttgagatggagtctcgctctggcgcccaggctggagtacaatggcgtgatctcggctcactgcaacctgtctcctgggttcaagtgattcttctgcctcagcttcccggggagctgggattacaggcatgagccaccacgcctggctaatttttgtatttttagtagagacggggtttcaccatgttgggcaggctggtctcaaactcctgacctcagatggagtcgtcctgacctcaggtggaggcctcagcctcctaaagtgctgggattacagacgtgagccaccgcacccggccacatgaatgaatttttaaattaattagatatccttcatttgggggttgcaaatgttgtacctaatagatttctattacctaatctatgacaatttaagtattcaggctatgatgccccaaatttgtttttttccctagctgttactttcaagtctaatttctaggcaactcatttcaaaacaaatgctgactttgggttttttgtttttttttgtttgtttgtttttttgactgactgttcttagttgtttgaattctgaagtatccattctagctcttatggaagctgtcagtaatgaaataaaagttgagatgtagccctaagcttttagggttacctgagatttcaactggatttgcgttatacattattttaattcagttgtgcctatgataactgtaatagatgtatttaatacagctttcaaaactcctgtgttttaattgaattctattcctcttggtccattcgcttaggatttaggatatagcactattttttaaaaatttgcttgcttgtttgtttgtttgtttatttatttatttatttatttatttttgagacagagtctcgctctgttgcccaggctggagtgcagtggcgcgatctcggctcactgcgacctccgcctcccaggttcaagcaattcttctgcctcagcctcccgagtagctgggactacaggtgcataacgccatgcccggctaatttattgtattttagtagagacggggtttcaccgtattgcccaggctggtcgtgaactcctgagctcaggcagtccacccaccttggcctcccaaagtgctgggattacaggcagcactaacgttaaggaaagtaaaatcagttattttagttcgaatgtcttgcaggtatgataagcatattataattgatgagtctcttgataattatactcaggtattttgggggttaatgtggactatggtaaaagtgtgtgaagaactgaggtggtggcatttatggagtaaaaaatgcatagtacaaacccagtactttaatgttttcttgaaatgtaaaatgaaagccacctgttctattccccccatactcatggaccatatttatgtctaggtgaataatcttaaagaataattatttcttctcattttatctttgttacatggaagaatctactgcaaacaacagagttttgagaatttttaatgttttacacaatatgcacgtaagtttgtgccttggggtttttaagaattttcttccacaagtcacaaagatttttttccacattttcttctatttgctttatggttttacctttcacatttatgtctttaatgtatctgggcttcacttctgtatatagtatttggtgggaattcatttttaacttttttctccgtatatggagccactcccaagggtttgttgtttcctcactggtgtatggggcagccttaattagacagtgggtttgcttttgcacctggatctggccagtcttctgtctgattcatctttttctgaatcccagcgccatacatgtttgttatctcataaaacaagttccccttgtcttttttctcagtttgatacagagttagttttttgtgcacgattattctttcatatgcatttggaataagtttgagtttctaaatagtagtagtaataataataataataaaaccaatgatgagactgcattaattttttttttcttgagatggagtctcgctctgttgccctgcctggagtgcagtggcacgatggctcactgcaagctccacctcccgggttcacgccattcttctgcctcagcctcccaagtagctgggactacaggcgcctgccaccatgtccgactaatttttttgtatttttagtagatacagggtttcaccatgttcgccaggatggtctcgatctcctgacctcatgatccgcccacctcagcctcccgaagtgctgggattacaggcatgagccaccatgcccagccaagactgcatttaatttagggagagctgaagtcttcataatgttaagttgacctatcccaaaccatagaaagtcttgtttattcagatctcattttacttcttttaacagttgaacatttttctttttatttatttatttatttattatactttaagttttagggaacagttgaacatttttcttcacggagatcttgcatattctttctttagttggttcctaagtactttatgggttttgttgccattacaatggtaccttattttgtattgtattttctaattgttgctggtgtagagaaatacggattattttaagtcgatcttttatctattaactttgctgaactctaattacttctaataatttactgattctttgtgattcggtctgtgatcctatgtgaatgtttatacaaatagtgatgttttgtttcctcccttccaatctttattcctgttttctttttctctttttttcttttccttaaataatcatggccaggagctccagtttaaacacagcaaggccagtgggcattcttgtcttcctgaacttagtggcagtgttccctgccctccttctcccttcatctcactgaagggccctgtcagcttctttgtggattctcagtgcctgtcttggctgatgcctcagcagtatttaacactgtcgacttctgcttcctccacttcctgagactgtgtcctccttgctcttctctctctgctgcttctctgtcagtcctgttgctgggctaagcttcccctgcccctgtcctgagtgtttcagtgatcctcaggctcactcccccaccctcttcctgctgagctccctccctgaaggactccctcccacgctggcttcagttcactgtgactatgtcctgactccagctggttccttagatggccacacatacctctgactcctaaaatccactcttcctatcttcagtgattgaccactactatccttgatgccagaaacctaggtgttgtccagtattcttcccagtctccattcaaagtcactgtgtagattcttctgcctggctgagccatgaatgcttctgccactccacagccctctgtcctggccctggccctggcctgggtgctatccctctgacccaggctacccctgtgggctacagtctccggcagccaccggaagctggctattgtggaacagctttctgatcctcctaatcatgccagaggcagcagctcccttcttggctcagttttttgggaattgttcctgaaagttcagctaaactcttcattcctcacagtgattctgggagccactgatagttcttaaaaacagcagtttcttgcccccaacatctccattactgcattgcacttgttttgttttgtttcgttttgttttgttttgagacagagtctcactctcttggccaggctggaacacagtgatgtgatcttagctcactgcaacctctgtctcctgggctcaagcatttctcctgcctcagcttcccgagtagctgggattacaggcatgtaccaccatgcccagctaatttttgtatttttagtagagacggggttacaccatgttggccaggctggtcttgaactcctgagtttaggtaatccgtccatctcggcatcctaaagtgctacgattataggcatgagccaccacacctggtgtctggggtctttttaataagggcactaatcctgttcacaagggtgtcaccctcatgacctcatcacctctcagaggttccacctccaaatactattgcattggaggtgaggatttcaacagaggaaattgggtggggatacaaacattcagtctatagcatccactcaaaagcatccatcaatgtctgtgacctgttagacaaagctccaaatctttcatgtggcccaaatctttgcttgatccaagccttgcattctttaatagctgcctacctctccacttctccctcttttgtaatacagctctttctttcatttcctgggataggccatgccctctctccctccagggccttcttcacacataccgattgcctgataagaatacgttccccgaggaagccttgcccatcctccacatctggcttaggcaaccttctgtgagttcctactgtacttccttaggcacatatcatgttgtgttgtggctctctgtcttgctagatggtaagttctatttggacaaatacctagcacagaccctggcatgtgataaatgttcagtaagcatttaccaaatgaaagtgaactgttcttcctctgaaaatgtgatttgttctgtgtgctgattgacttgagattaactggtccagggaatacattaaaactactaagagcagtaatcaactaagcaacccatttcccttctttctttccttccttgccttttttttcacaccaatatttattgagcatctatgtgccaatttaaagaaatgctgacataaaaatcaatttcttattgattttctgaaatttgaaataaaatttactaatagcattcttggacccaaaccctcaggtgtgactgggacagcaaagagtccctgctggagccccagattgaggttgatgtctaggtgaccatccagggttccttactcagccaagatatcttcagctgaattgaaaccctaaccccattgtcaggtatcctggagaattactagaaacatggacactccctgaaactttacctcctgagcatctgaggtgtaaagtccttacctttactggaagatgattaaattaaatacagctaaaatgtggtgggatgtcctttcattgacataaggttgggttgaattctaatcatacaagggaaagggctttgggtgcggtggctcacacctgtaatcccagcactttgggaggctgaggtgggtggatcacctgagatcaggagttcgagaccagcctggccaacatggtgaaaccccgtctctactaaaaatacaaaaattagccaggcatggtgggcacctgtaatcccagctacttgggaagctgaggcaggagaatcatttgaacccaggaggcggaggttgcagtgagccaagattgcacctttgtactccagcctgggggagaatagcgagacttcatctcaaaaaaaaaaaaaaaaaaaaaaaaaaagacaaaaggtctcagtggcatgtcacttatttttttgcagtggaaatgccaataatttttttccaggctatggtctgttctatggttgaacattcgcccatttttgtgtctaaccttataatcactgaatttcctataatgatccagctctctatgtgccaagccttcattaagtgatccaaataaaatttgacatttaaaaaaaatgtacaaatagtaattttgatttatttatgaattttaaaaatcccaaatgtcttttcagggggttttaatctgggaaaataaggtattagattgaatcacatgaaactgctatttttgtaggccagaaagttcaaatatcagcaagttcatgtgattcaatctagtagttatgggagaatactacataatacttgctccattggcacagtgaatttttaaaatttaattatctactccctttaagtgaaagtagcaaattctgtatcaccttaggaagagttggattttttgatggtgtagcaaatggctcagcaaataaaaatgttaagtgaacacaggtggctggatatttcttggtgagtttagaagtgactatgaaatatggtatttctttgctgatagtcaatgtgttttttttttttttaaatctccaagtgttttttctcttatgagttaggaaattatgttgggtttattctcccttagtttacctagaagccttggacacaacaataataaagaagtagccctgtaagatacaatcatgtaacttttaatgctaaaagagacattattattattattattattattatttgctagagcccacctcaaacagatttctatgtaaaaatgagaaacaagagcattaagatggtttattacaggaagagtttttatagggcttgggtttcagtgagctcgcctgtgacaaagcaaattgatggcagtgataggctagtgatgtcattgtgatgtcagtcctcctgcttatcctgcacatgcttgctaatttggaacactttatgttgaactgtggtagaggaaacaagacagttctgtctgcagaagcccattatggctgtaactggagatgacacaggtaagaatgttaaagaggggttttcagttaattgtgcagattgttttgaagtttaggaagtattcaggaacatctgagtgtttcagaaagtgttactctcctagtcacttaggtgtaagactttttttgaaatatacatctatatattcagctcactttgttagggcatcttagtgtgattgtttctttgctcaatattctattgcttgcttgactgaggcactaatcctctcttcctccctctatcctccctcccctcctccccactcttcccctcctcttctcttcccctctcctccatctctgtgtctctctttcatatgcataccattctgccctactaaaataagctgttacttcataggcaacctgttgcaaattcaatctagccgcagattaaacatacagtatataccgttcatgttctgatttcattactgtggacaaatgcagctccaaacagaataggaaaaacccgcgtgttatggatgtttgtgtgcctacttgtttctttcctcctgtatttaaaatggtctgttcagctaattgagttcaaaaggctgatgtcattacatttcctggaatcgtatttcagcaggggaagtggaaaagttaaaactccaagcgagctgcacattgacgtcagctccgagtcatgttgtgatttagtcagttcctttccgctttgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctggtgagaaatggattatgtattgtataagctggcgggttctttactcttactccatcctcttactccatctataggaacttgcgattcagagctcctctagtgttcagtcagggaagtgcttgtcttttacttgttctcccagcctctggtatttaaatttgtaatcggtaatttttcactaggtttgcttttctcagtaacaaagagtgattttggaagacttagttactaataacctttgtgtgcttgcagtgttgtttattcagtggtcttgtttgtaatacagtactgaatttgcagttgaattaagagttttaaacaacttcactacaatttagctcttcgaagttaatgggtctcagccctctttgtggataggaacattggattgtcttgagtaagtaaaacctgtattacattgtttttaaaactgtcttgaggaactatttttttctcgaagttttgtgaagttctagagatgctatagactgcagaactcaaatgatgaatttattataagacatagatgaacttaaaatcatctcaaacactgcatgtcatatgattcttagaaccagaaggcacttttgtacatatattttctaaaaattattggttaatatctttctttaccaagcctttcattcctattacccctttgacttgtctaagcataagactcataacaaaaaataaataaaatgatgtgaaaacgctgtgtacttttttttttttttttttttttgagacggggtctcgctctgtcgcccaggctggagtgcagtggcgcgatcttggctcactgcaagctccgcctcccaggttcacgccattctcctgcctcagcctcctaagtagctgggactacaggcgcccgcctaattttttgtatttttaatagaggcggggtttcaccgtgttagccaggatggtctcgatttcctgacctcgtgatccgccctccttggcaatgctgtatacttttaaccactacatataaataaacaaacatttttgacatttgtttttacagaatgaacataacatccttgaaagtttttttcacagttttaccaataatgctacacatgattgattttccttttccaatttaaacttttcaaaatgctgaaactttaaaatgtcaaacaacttaaaacactttttcacaagacctgattttgcctttggaaatcatatttttaaaaatctggtcatttcttacagaatcagtgctatttgaaaaatgagtaataaattttatttcattttactttatttatttatttatttatttatttatttatttatttatttatttattttatgagacggagtctcgctctgtcgcccaggctggagtgcagtggctggatcttggctcactgcaagctcggcctcccgggttcacgccattctcctgcctcagcctcccgagtagctgggactacaggtgcccaccaccacgcccggctaattttgtttttttgtattttagtagagacggggtttcaccgtgttagccagaatggtctcgatctcctgacctcgtgatccgcctgcctcggcgtcccaaagtgctgggattacaggcgtgagccaccgcgctcggcctcattttactttatttttttaaagccagaagagcacagggttaagggacttttttgaaggtgtagtagagtagctttaggaaccagacctctgggctctcagttctgaggtaaccctatggatcggcagaccaagtagatctagattagtggcttgcaaacttttcaaccatgacccacgttaattatcacggcaaagtggacctatgtgtgtatgtaccctacatttatataaaacaagtttcagacataattcttatccttacaaaatatgatgtacccataattccttttctgtcctttttttaaaatgctattcttgacccatgaaatttgctttttgacccattaatggtctacagcttacagtttgaaaaactttgatctagaccaaaatcaggctcctagcactaatggctggcctggaaaagatattagcagcatttacctacaggatcatgaagtgaaatattaaaagcaaatgactggccgggcgcggtggctcacgtctgtaatcccagcactttgggaggccaaggcgggcggatcacaacctcaggagttcaagaccagcctggccaacatggtgaaaccccgtctctactaaaaatacaaaaattagccaggcgtggtggcacgcgcctgtaatctcagctactcgggaagctgaggcaagagaatggcttgaaaccgggaggcagagattgcaatgagccaacattgcaccactgcactccagcctgggtgacagaacgagactccatctcaaaaaaaaaaaaaaagtaaatgactatagtttatgggattatattattgattttgtggggcataatttacatttttattagaaattgcctttgttttattcataaactgattctgttaggagcataatttcctatcttttagactctgagtctgacgttgcattctgacgttgcattctggctggatttctgcattgtttaaaacaaactttccaacaaatttggaaaactagtgtcttagttaatatttgatgcatgagaataaggatatatatcacctttgtgaaaggaggctattagcaattatttttgcttaaaaatatttacataaaagaataatttcgaggctgggcgtggtggcttacgcctgtaatcccagcactttgggagaccgaggtgggctgatcacctgaggtcaggagttcaagaccagcctggccaacatggtgaaagcccatctccacaaaaatacaaaaattagccgggcgtggtggcatatgcctgtaatcccagctactcgggaggctgaggcggaagaatcacttgaacctgggaggtggaggttgcagtgagctgagatagtgccattgcactccagcctgggtgacagagcgagactccgtctcaacaacaacaaaaaagaataatttcatttaggtgtgacagcttcttgaagttggtaactgaacaagttataatcactttggaagtgaaaataacaaggcatttatctaccttaagattcagtaaaccaaatctgcagggtgaaattggaaattactcatgttattttcctactacttttgaaaaatgcataacgaaatgtaatttgggatatttatttcactttgccctgtttatatgaatatattaggcaaatatatttattcatttatattctaataaaatatactttgcatttatgtaaactttaaaataaaaaaatcacttaatgttacaaataaacatgaataccaactatagaaagtgctgtcaaagaaactatcagattgtgactgacacagaaacaggacatacaggttaagggatcaggtaggcctcactaggaaaccatgttcaaatgctaaaaaaggcagtttacaggcattctcactgatacatgcccaactacacccaggtcagactgggtaaatgacttccaagtttacaaagctagcaagtagtggacccgttcgagtcttcagaatcctcgggttctgctcatagcatattaatgtgactcctcaaaagtcacctgacattgacacatgaatgcagtgtcacgtgagtacatgctgctacacactgcttataaaacatataaaatgaggttaggttaatattattttaagtcgttaaaatggctttttttttttttttttttaagacagagtttcactcttgttgcccaggctggagtacagtggcgtgatcttggctcactgcaacctctgcctcccaggttcaagcgattcacctgcctcagcctcccaagtagctgagattacaagcacccaccaacacacccggctaattttgcatttttagtagagacagggtttcaccatttggtcaggctggtctcgaactcctgacctcaagcgatccacccgcctcagcctcccaaagtgctgggattacaggcatgagccaccacacccagcctaaaattgaattttttatagattattattactctcataggacagtagagcatatatttgctattatatggaacattaaatttcagtgttcgtaatttcccatcttttatatagactgacttatagattttcacatactgaactttaaaaggtcccttatgtataacttacttagctggattgtaataatttcataatgtatgcatatgtgaaagcatcacattatacactttgagtatatacagtttttgtcaattatacctcaaagctgaaaatattttggtgagttaattctatgtggtctatgtgttatagtgattgtagcaaatttgaaaatgatcagtgcttaaatagccatttttatgtagggtttaattttcacagagaagggaacgtttttggcagtgtgggataccaggcatggaggtgtaggatctgggtattaggagcaggtggtggtagacaggaagagaaccacagcagtggtggtgatgtcagcagcttaccagagctagggatagaagccccccacttagaagtgtgacatctaagttaacctctgctgcttacttaaaggtgtatttaggattagtgccatgctgtgaaatggcatatgaaaacaggaactctctatataaaaatgttttttattcagtctttgtgctcagtactacagatatcttaataaacaattgaataaaatcaccatcatttggggtgttgagaaatcgtttcactttggaagttaccaacataggtacttggctgggtttcttatttatttctttgtttcctactctcacttgtgggtttttttttcagttttcttcttcccagtctgatgagagtatatctttggccatttggggttctattataaatgattgcatacattgaaaaggatatcttacattatctttaatgtattctctaaaggaatataacgatatataattttataagtttttaataggcatattttttaacaaaataaggaataagagccataaatttggattccctgggtttgtcagaagggaaactccagggggaaatgtatttatggatgttatatgcgttttaactaatatacggtataagcataacttggaacgttgtctttcagaacttaaggaggggaagaggaagggaactaacatttgtggagtgcctgccatgtgccaggcactgtgctagacactttgacatacattgtagggtttattgtgagtattaaatgagatactgtatccccattttacagatgaggaaactgaacttgccccaagtcacatggctggtaagtggcagagctggactagaacccagactccaaaccccatgctttttctgctgtaccgtgtttaaagcttgcaaagagagatatgtagttaatgaccaaaattgagagttctaggaattttcttttcccatgaaatatttgatactgaacctaaaaaaaaaaaaatgctttcatgtcaggagctagatggaagcacatcataatgagaacgcctttgcttttaaaatgctatgttagacttatctaaagtgcatctaaggaaaatttaagaaataatgccttttatcaagaaaggccactttgaagagacacatcgcatcttgtagggctttccatgtcttagaggtaaaggtttagctataataatgtaagtttataagaaagactgcttattttaagcattctaaatgacagcaggcttgtgcaaaacccgaggaagttcaaattttacttcatacagcacacattaactcatgaaacacccattatatgccaagtatgtgctagattctaggggtttctggggttaaaaagatactatccctgatttgtcttaaagtttttgctttcctgagaataaagttagtgtacaaatatcttataatctttcttcaatcatgattgttaattccccactgataacccatatattttcaaaatatgaaaattctagaataaaaagtaatttagacactttcagtagttaaatgggacaggaagtggcctttataagaatacaggaatagcagtgtgtcatcagagaatgcaggatggtctttgaactgtgatccttggtgtcttatctgctttaaatttccactgagttcataatattggaaatttgaagctaactaagataaatactttttataacttgttttaaaattaaaacttgtgacatttagattttctcaaaacaagagattatctttgtatctttatttttttaagagacaaggtcttgctatgttgcccaggctggacttgaactcctgggctcaagtgatcctcatgcctcagcctctgaaggagctgagattacaggcatgagccactgtgcacagctgtctttgcccatatctttttaaatgtactttactaataagattatatttgagtatatggaatttgtccatcgaccattagaagtataccaccatatagatcctttgggatattatagaaatttatacaaattcctactaatttatactaactcctgtttctggcttgaactaatgcgcttgtcattttgattttattgagggaagtaaaatgaatatatgatacctctgaaaaattataataaaacccagtcacctaacatctcagaactaatacatctgaatatatcatccccttccaagttattttaaagtggtatttttttctgagctatcgctcaaaatgtttttaagaattcttattttggaactgccattatctttcatggtgccaaatttggtcccttgagggtggttgttgcttctggaaacaggcaagagttgtttggaagcatttctgataaatacaaggccaatgaatgaacgtctttttttgcttttttcctttttttttttcctgagacagggtcttactctgtcgctcaggctggagtgcagtagcataataacggctcactgtagcctcaacctcctgggctcacatgatcttcccacctaaggctctggaaccacagacgcacgccaccacacctggttaatttttgtatgtcttgtagagatcaggtttctccatgttgcccaggctggtcttgaactcctggactcaagtgaacctcctaccttggccttccaaaatgctgggattataggcgtgagccaccatgtctgcccttgaacttcattgttcacctgtgactattcccacccaccctttttttaaaaaaacaagttttttgtggccgggcgcagtggctcacgcctgtgatcccagcactttgggaggctgaggcaggtagatcacgaggttaggagttcgagaccagcctggccagaatggtgaaatctcatctctactaaacatacaaaaattagctgggagcggtggtgggcgtctgtaatcccagcaacttggaaggctgaggcaggagaatggcttcaacctgcgaggcggaggttgcagtgagccgagattgtgccactgcactctatcctgggtggcagcgtgagactctgtctcaaaataaaaataaaaagtaaaaagtttttttttttgttttttgtttttttttaaactagcttttgtatatatcatggaaccatcctgctctaacttcatattacaagaaaacagcaaacgtctacagaactagagtgtaatgagcccctctctacccattaattttactacacgtctgtgtgagcagtgtttggaaagaatgatcctagaccaaggtccatatccatgctgcctgcatgtgtcaacctggtgtcatgtaaacttctcattcgtcactggctattgttccaattttagaagacctaggtgaccaccagctgttctattgtttcagcctttattaccccataaccttcttccctggatgtgggtgaagagaaaaaagaggagagctatgttattctctgctccactccatctcttctgacaatacgatgaagatatgttaaacaatctattaagttagtttataactggcttaacgtgaccttgttaactatctcaaagctatacagttttgtacgactcattgagttgtctgtgtatacattattttgtatagtcacaaaaacaaatttaggacttttcccaagtttattcatatgctggtgatcattaatcacaattaggccaggcacagtggctcacgcctgtaatctcagcactttgggaggccaaggcaggcagatcacgaggtcgggagatcaagaccatcctgggcaacatggtgaaaccctgtttctactaaaaatacaaaaattagctgggcatgatggcgcgtgcctgtaatcccagctactcgggaggctgaggcaagagaatcacttgaaccagggagtagaaggttgcagtaagccaagattgcaccagtgcgctccagcctggtgtcagcaaaactacgtctcaaaaaaaaaaaaaaaaaaaaatcaattattccctatcaccaatgttttaaaattacatgtagaaggaaaaggcagtacaaccttataaacaatatttttattaattctatgaaaatctttaagtgagcttccttgaaagccatgtttttaactgttgtattctttcacctaattctcaagccttagaaggcagaaatctggcatatacccaaatagaagcacataaatcagttaatctttgtttaacttttttaaacaaagtttcagtgataatatcctatttagctgacaaagtatttgtctcccatgggtagcatttcacttcttattcattgggtataatacattttcatgaaatacagaaatgctgtgttttcctcttttgattggaatttagttcaggcaattgttatagaatttgataactttttaaaaaatcttttttcttgcacttagctttgagagagcatgtattttgtaatgtctcatcagagtgacaaactaactctggaccatacgttctcaatgttgaagcgttggtggtagaaatgttttatcactcgaatccatctgtcttttctaggaagctatgtttcttgcagtagacaaattttgaatataaattaggaaactttgagaacttacttttagtatttgatctgaatactaagtaaatattaaacgctgtattttaactgtatgattatactatgcttagacaatacttttaaatgaatatttacaaatgtattattttcctagaaacctaagaaagaaaaattatctttccccagagaaactaggtttaagcagagctttgctgggtttttattgttgttttttgttttttttactgaaactgcagtgagctcaattccttccagtgcttcagtgattttctagtaatgagaattgcacttaaagacattcagtgactgtttcaggcatgatatggagtataggaaaatctctaaactgaaacattcagaggatggagatattctgcttaatggaaatttttgcagtggtgtgctacagtcagctcctcctggcttgctagagcctattattaaattttcaggccgggcgtggtggctcacgcctgtaatcccaacactttgcgaggttgaggcaggcagatcacttgaggtcaggagttcaagaccagcctggccaacatggcaaaacaccatctctactaaaaatacaaaattagccaggtgtcgtggtgcacgcctgtaatcccagctacttgggaggctgaggtacaagaatcgcttgaactggggaggtggaggttacagtgagccaagattacaccactgcactccagcctggagccacttagtgagactctgtctaaaaaaaaaagccaggcgcgatggctcacacctgtaatcccagcactttgggaggccaaggtgggaggatcacgaggtcaggagattgagaccatcctggctaacacggtgaaaccccgtctctactaaaaatacaaaaaattagccaggcgtggtggcaggcgcctgtagtcccagctactcgggaggctgaggcaggagaatggcatgaacccaggaggcggagcttgcagtgagccaagatcgcgccactgcactccagcctgggcgacagagcgagactccgtctcaaaaaaaaaaaaatatgtgtgtgtataaatatgtatatatatacatgcatatatatatgcatatatacatacacatacacaatttacacattaaaaacattagtactcaaaactcataatttccaagtattttctctgtgctctgtgggtattggcatctgttttgtctgtatgctgtgctgcttaccacgtgtgtgtctttccaactctacgctcaggaaagtcaccttggtagcttgaaactggccatggtggaagtatttacatcgtgagaattactgaacactacacatcagggctttttcattgttttgtcctgaggactgtttcttaaatatttattagcacaccactgactttaagctaaatgagcatcttaagcttttgcctttgataaaaacctgtctaaaatgcattaggatgcttttctaccttaagtgtttagagcatgctaaatatcattgttctaagtgctgaagaagatctttaatacttgagattgctataatgctcagaataattatcttaaacattacaagatcacctcttatgagatgtcaaaagtatatcatttccagatcagttttatgtaaaatgccaaattatgaattctttatataagctcaaaatattttgttttactgcagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacaggtgaggtgttgcacagggaatcggtaacttctaggacactttttaaaaattacagttttcaccgggcgcagtggctcacgcctgtaatcccagcactttgggaggccaaggcaggcggatcacagggtcaggagatcaagaccatcctggctaacacggtgaaaccccatctctactaaaaaatacaaaaaaattcgccgggcgtggtggcaggtgcctgtagtcccagccacttgggaggctgaggcaggacaatggcatgaacctgggaggcggaggttgcagtgagccaagatcgtgccactgcactccagcctgggcgacagagcgagactccatctcaaaaaaataataaaacaatattaaatattaataaatgataataaaataatgataaaaataatatcaataaataaaaataaaaataaaaattacagttttcagctgggcgcagtggctcccgcctgtaatcccagcactttgggaggtcaaggcgggcagatcacaaggtcaagagattgagaccatcctggccaatatgacgaaaccctgtctctactaaaaatacaaaaattagctgggtgtggtggtgtgcacctgtaatcccagctactcgggaggctgaggcaagagaatcacttgaacccggaaggcggagcttgcagtgagctgaggtcgcgccactggactgcagcctgggtgacagtgagactccgtcttaaaaaaaaaaaattacagttttcataagccatttctcccaagttacatgttgtgtggcatttcatgtaggtttgtgctctgtgtgtgttattagattgtcttccagtcagaattcctggctgttaaactatttcatcagcaggagttacatccctatgttgtaagggtgatgtccaaaagatacagtaatttttaaaaataatgattaaaggactttgttagaaacaaagagctattttgtatttagtatttgctgtgaagtaggtgataagtcgaattttttagcttctctctgagaaaaatgaagtgtaagtgaggcgttacttttcgacattttctacatgtagtttccttttgtctattttttaactttttttcctctattacactgaaatacatatttaatctgataaattctagtcaagtgcaaatacaaaataacaaaaagaattaaaatcatccatggctctaaccacttaggatacctcctattatagtctatgtacttccagtcagctctcattttctctcactttttcttgctccatatctctgtcattttatttttaagcaacatattataaaatgctattttctaaaactttttaaaaatttaaacataaataaaattttatttaacttgtatattatttattggtttagtttttattatgaataatggtgcaaattaatctgattttcaaaaggaacagaattgtcttagagtttcccagtagtcttgtcaccttagtcctaatgtcaaataatgtcctcattgtgtgcagccaggacagagattcagcagtgttatcaagggcccagactcccgctcccggctgtgtcatcttcagcatgtatcattcattctcatgatcacagcgcggctactgaacctctaggcattgcctcagacaggaagaagggctagagccaaaaattggggctagctgaggtctggcccaactgcaaacctttcctggaagatcctcccagcaactttcacctacatttcattggctagaaataggtctttagtccctagctgtacaggattctgagaaaggtttattttcgctttctaaatctcagtttcagagcaagacaagagaaatgcagatgatacctggctgttaggttgctcattatctgtttagcagattttaagtgctttatttctactgtgtgtttaatgcttacatgagaataggtgattattatgcccagtttacagatgaggaccagaagttcagagatgttaaggaataagttggtcaagatcacatggcccaaactgggcagaaccaggatgggcaaccgggcagtctttattccagagcctgtcctctataccagcatcaggcatctcaaaaataccccatgataacctgcaaatttcacttcctggggaagtgtgaggctttagtcattcacagatagatctcttacatattttctttttattctttgattggcatctataatcgatatctcattatatcgtatttctgccaatccagcaacagtttttatttctttccagccttgtcagagtttcttccttgccttgcacttcctctccgtgctgaggatacacccagacacatgcaagcctgaaaaccgagctcactattaatagaagaaacaggtgttttccatggctgaggagtgcttaggaatgtaccatctactgatgtgatcggggaaagctttgtgcctgcaacattttgactctagtaatatgtgtgtctgtgcatgcacacacacacatgcacactcaaatgtagaagatgaagtatgagtatttataatagcttattaaagaaaatgtttaaacacccgcaacaccgctattaggtctttaaatttttcatttaatggtaaccatgttttgtaaaatgactatcttccttctaggtctagaatttaatataatttaatcatgaaaacgttggtattcataaatgaatttcagtgcctttgtggaaaagagttaaattatgtccccaaattggcaaatgtgtgtgtttggatttattcttaacttttccaattgcatcatttagattaaattagtcactataacattcttttcaattttacattttaaatttcttttgttaaccagctgagaagtctgagaactttgtatgttcacagggtgagtccattgttcctggctaggaagcaggggttgatcttttcctgcagttcatttggattgaaggttcttctttgctgactcttgcttccatagtgaaaacacagatatccactcagtgagagtcagctatcttaaaaaaaaaaaaaaaatcatgtatacatcacatgtggttcaggatgctagctggcattacagaaactggtgtttagacattcaacactgctttttttaacatatttgaatgatagtgtctgtttcagtgcaggcttttttgacatgaagggtgatctacctcaaaggcagttattctggaattgaatcctccaaaatgaggccaattaaagggtgtcttctacataggagttaagggaagtggttgccatccctcccaccctgaaaaaaagaaaaagagaaaatgttggctctatttattgttttggtggggttatgtatgaaaatgactaagtcaactcatctgtttgtgttgttgctttggctactggtctgttctttcattttgggcttatagtgctttaaaattcaatatattggatattaaatgcatgtgattaggaaacagtcttgaaatatgcccagagttactcagtagcttcttttttataattttaattgtggtggtctcacatttgtgggtttaaattgtctgagttattgagtgttgtattttgtagcccccttctttaattttcagaagcactgtccatttcatttcggtttataaaaatgcacatcttttgtttattgttatgatttatccatgtgtgttttctagccaataaactgtgtcttgcagtcatgattgatcttgttttactgagatttagttttgaagactaaaaatctccagtgttgatatttaaggtttttgaggattaattcttataatcatttttgatcgaataaaattaactcattatgtcggagtatgtgccttttgggagacaaaaataattaagagaattgaaaggatctataaatgtgtttgtagaaattccacttggggatgtggtcctattgtagtttactgaaaacagttgtgggcattgttaccagtggaatgtgtgccctaagaaaacaccatttgtgatgaatgctgggcgaactgtgttctcaaatcattcctgttgtctaatggttatcttacaaaaagcatgtgcctggttatgtttgttatgtggctttgtacagtccttacctaggatcgattggctgttgagttcggggggcagaagtgcactgacccactgtggattgtgttggaaggctgttcctgtagtcatttgccttgtgttgcttccagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccaca

SEQ ID NO: 283 - DNA, 86118 bp, Homo sapiens; identical to SEQ ID NO: 282

SEQ ID NO: 284 - DNA, 86118 bp, Homo sapiens; identical to SEQ ID NO: 282

SEQ ID NO: 285 - DNA, 86118 bp, Homo sapiens; identical to SEQ ID NO: 282

SEQ ID NO: 286 - DNA, 86118 bp, Homo sapiens; identical to SEQ ID NO: 282

SEQ ID NO: 287 - DNA, 86118 bp, Homo sapiens; identical to SEQ ID NO: 282

SEQ ID NO: 288 - DNA, 85502 bp, Homo sapiens
cgggacccgcctgcctcctcgcgaacttgggacgagttggaaaatcctccctgagagagccgtgcggctcaggggagcggtttaactcggaaaaggaaaaggaatccagaagtaaggacctcggatttgagtgcccccagcgcctctgccccactttacgagcgcagtttagacgaaagcggacgcagcccgttttcccccaaaacctgggccggagggcctcgcagctgagtcattcggtcccgggcgcgggcagtctccggagtgggaagggcagagccgcgaccgctctcggaaggcgcattttcccttctgcctgagtcttgcctttttagggccatctggtaaggtttccagagcctgttgaatctggggaataaacacattattaaacatactttttttttttgagacggagtcttgctgttacccaggctggaatgcaggggcatgatctcggctcactgcagcctctgcctcctgggttcaagcgattctcttgcctcagcctcccgagtagctgggattacaggcatgcgccaccacgcctgctaatttttgtatttttagtagagatggggttttaccatgttggtcaggctggtctcgaactcctgaccttccacccacctcggcctcccaaagtgctgggattacaggcgtgagccgccgcgcctggcctcagcatgtttcttgatcctgttgcgttttatttgtatatcagatacctgagtttgaaatcacttaggggtttcctgcatgctgctcagtgaagcagcggtgagtttgtaatcacattttaagaaattgggacttacagggccagtctcaaagtgtcactgaaattgaaagagctcctttaacactgtggcttacgtacgtgactcagtttcctttctacttaatttgccgggcagatgagggtgtacctttcccttgaaacaaagatctagattgaacagtgagaggtccgctgtgaacattgcatcagattacatgaataaaccacgctgttttttatttgttgtttttttgttttttgctttgagcgccacgtttttttcctagtctttttttttttttttttgagacggggtctcgctctgtcgcccaggctggagtgcagtggtccgctctcagctcactgcaagctccgcctcctgggttcacgccattctcctgcctcagcctcctgagtagctgggactacaggcgcccgccaccacgcctggctaattttttgtatttttagtagaaacggggtttcacagtgttagccaggatggtctcgatctcctgacctcgtgatccgcccgcgtcggcctcccaaagtgctgggattacaggcatgagccaccgctcccggcctttttttcctagtcttgattctttttttggataaactttcccttcctaagtcatagtagtcttaaagtctttcaatctaaagtaatttttttcccaaaggaaggcaaattgcacacaatatgttttggccaataaatgctaagtattaaaactgatgtttaaagaactatgtattgatcccaacacagctttaacaaatatattaaaatggttttgatcctgaatgagtaaacacttaaagcattgtcagtattcacacaactttggcgaatctgtaaatagatgaatataacacttactttcccagtgaattggtgatggatatggaatcattttggtgattgcgaagttgtaattacggtgatgttttgtgtacatattttggtgacagtatatgaataaatttttattgaatgcgtaaacataggacatttttatttttagtctttttgtttttgcattgtccctgaaagttaatgaaatttacttcttcttcctgaattttaaactctggaatccatagttaataggctgtattccagtttcctactcaggtgagtcactgcctaatcaaaatacaaaatcttgcttagggttatgaccatttcatgaaaagtagggaagagttttgaattattaacatatataaggaatcctgactgaatctttaccaacatagacatatatttctgatcctttttctcccaagttgtattccctgcaaattaagtattgggccagaagattgagctaggtttattgtttaagtggatgttcttactgaaaagctctcaaatgtcctgttccttttagatagacttcttaaaataaaactgaacagtgcaaacacttaatagctgaacgattgagagacgttattttttagagcagttttacaaccattgatatttttatatttccttaccaacattgattgataaggaaataagcctgaaataccgaattttattgtttctacttaagtaaatggatggattccatatgtaaaagtcagctttgaaaatagttattattgtacattgaatacagttttgatattatcaacacaggaacttaaaaatccagtttaggccgggcatggtggctcacgcctgtaatcccagcattttgggaggctgaggcaggcggatcgcctgaggtcaggagttcaagaccagcctaaccaacatgaagaaaccccgtctctactaaaaatacaaaattagccgggcatggtggcccatgcctgtaattgtggctacttgggaggctgagactggagaattgcttgaaccccggaggcggagggtgcagtgagccaagatcaagccattgcattccagcctgggcaacaagagccaaactcagtctcaaaaaaaaaaaaaaaaaaaaaaattttttttggaaaaatgtatctcattacacaataggtagaaatgaacattttaaataattatgttaataatctccttttagacaatacattttaaatgtcttttgcaatgggaactccacaataaagactgtgctgttcttaagaataaatgcttttactcataggttttcattttctgatactgtatatccagtagagaataagcaagaacaaagaagaaaacctaaggatatcattagtggaaatttttcttgatactacttatggaaatgccttaagtcttactgcactgaataatgatgttttgttcaatgatggaccacatatatcccataagattataatggagctgaagaattcctgttacctagttatgtcctagctgtcctaatgtcagagggcagagtattaccttttctatgtttaggtatgtttagacacacaaatacattccactgtgttctaatcgtctgcagtatatagtacagtaacatgctgtacaggttttgtagcctaggagcaacaggctatcccatttggcataggtgtgtagtcggttgtgccatctaggtttgtttaagagcagtttacaatgttcgcagaatgaagttgcctaatatttctaagaatgtatccccattattaagtgaagcataactaattcagttatagcaaggtttacaaagtaaaatgatatctatttgcacatttcatgacaggccttcctaggagtgatagaggaaattactggcaacgtgtgtgtgaagtagtttttataagtagaggaaatgcataggctataaaactatatggtagttttgcttaaagactgcttaaataaccatctcgttggtcaggaaggatgcttacctctaagaaaaccttactagcaactcatcctcttgtcagacttttttgaagcctctcagatctccacaaatgagaaacatctttgtgcatgttttctaaacagtagtataaccaggccatttaaatatcaagatactaataaaatcctgtgaacgtttaagagtggagctaatgtgatgctaatattttccctgagaatttcacaaaataaactcagtgtctttaaagttatcttagtaaaggtttttttttgtgtgtttttttaaacatagcagacttaaatcatccaacttagaatagcaaaatagcagatagttttgtttatattcttaatctcaatttttttattgatagcacaaaaaatgatttttttttggcttagaaatgtttttaactggaatttatatcttagcactgattatggtgaaagtatccactttggaattatgacaactgtatcacacataaagacccacattactgaatatgggtgcttggaatgtttttactcttaaaatttctggaggagtaaaattaggcatgtttctgcacttagaaagatacaggttttgttcagatgtgtaagataggaccaatctaggtaagtaaaataatggtaaaattcttttttctgatcttaagctaattcaggtagtttatctcctttgtcagatttactatctagtagttaatacatttatacttaatacgtagatatgtgttttcagatgtacttaatgtgcagtaaagaagcatgctattgaaaacaaaacaaaacaaccttacagtgattctagtcaagcaagtaactccttcaaaagtttaaaaatttggtttcacattggccgggtgcggtggctcacgcctgtaatcccagtgctttgggaggccgaggcgggcaaatcaggagaccagcctgaccaaacatggtgaaaccccgtctctactaaaaatacaaaaattagctgggcatggtggctcgcgcgtgtaatcccagctactcaggagactgaggcaggagaatcgcttgaacccgggagttggaggttgcagtgagccgagatcgtgctactgcactccatcctgggtgatagagcgagacttgagtctcaaaaaaaaaaaaaaaagaaaaaaaaattggtttcacatgaagtggtggtggcgggggagggaggtgtttgaaaggatggagacaggccatgattatttgaatttcacttttcatttcctcctcagcagcccattctgtagttcatttactgtgaaatggccaaaagcaggcagcatgtgggaaatgaattgaaaaagagacacttactgaatagctagtcctttagtgattttagtaaagagttaagattacttaaataataacaggtgtctcaggcaattaaattggagtagccgtgaatctatattagagagcctcgtgaatttatgtataattcatgtttgaaatattaaagacatttacaagtgtttggaatatttatttacgagtatccctcttggctattctgtttttacatgaaagcgtaaagattattttttgaaagttactgttactttgcttcataaagagtataagaccaatggtgtaatttcatggtactgctttctcccattgtttttcctgtactcatcttcccctaaaatgcataaccatagtctcatccccgtcaattgcagctatatggctgtttggaattatttctcttataactagtcccaccttctcttaattttttaatcgacttggttgagaaggaccaactttacaatatgagcttcatattctcctttatctttcaaactttattgctcttgctacttaaattacagttaacctatggatatctacttttgcaaagaactaaaaccttgcttcatcacagaaccaaataaacagattgtatttctctgttctctttctcttcctgcttctgtaaaaggtatgataccttttgttccacattcttttctttttcttttgagtatgctagttgcagtgctttcaggttttcttattctttttcttttttagcctttcttttagaaaccatctcaataatgcataatttacagtttacatttttgggtttttgaaagtggagtaagaacttagattgtttggcaagtgtcttataaagaattcttaatttaatatttcccgtaagtcatagttatctccaattgtaatatctagtccaaaagcagatttttttttttttttttgagacagagtctcactgtgtcacccaggttggagtgcaatggagcaatctcggctcactgcagccttcgcctcccagattctcctgcctcagcctcccaagtagctgggattacaggtgcctgccaccgtgcctggctaatttctgtattttttgcagagatagggttttaccatgttggccaggctggtctcgaactcctgacctcatgtaatccactcaacttggcctccgaaaatgctgggattacaggcgtgagccatggcgcctgtccaaaagcagtttgttttaaagcagaaaaagcaaaactgtgtttattgtctttccaaagcattcaacttagtcttcagagaaacagttctctttttgaatcatttaatctacttagtcatttcatctaatgtacagtttaacaaaattacaaaattgcaacaagtgtggctggcacaatcaggtttggtgacaaacacaactaactcttggtaagcacccctccctgttggagtgaacataagtgcctgggcacactagagaactgtggtgggcattagctatactgtaggcttcacaggagtggagaacactgttaatatggagagctggaaattggttaagtaaactttggtattctagtaaacttgcccaagaagtttaattcttatatatacctagtttttccagaaaagttacattaaggtattaatttaaccacagcaggtaaaagttttttgtttttttttttttttcaagacagctctgttgccctggctggagtgcaatggtgctatctcggctcactgcaatttccgcctcctgagttcaagtgattctcttgcctcagcctccagagtagctgggattataggtgcacatcaccatgctggctcatttttgtaattttttcttttttaaatgagagtctcgctctgttgcccaggctggagtgcaggggcgcgatcttggctcactgcaacctctgcctcttgggttcaagcagttctcctgcctcaccctcccaaggagctgggattacaggcgcatgccaccacgcctggctactttttgtatttttagtagagacagggtttcgccatgttggccagactggtcttgaactcttgacctcaggcgatctgcccgcctcagccttccagagtgctgggattacaggggtgagccacagcgcctggcctcaacatttttaagtgttaatttaatactatcttttctctatcagcatattgtatttgtttgcttatattatatgagcattttccaacatttgctttattaccctctctgtaatatataatcccatattcagatttcaccatttgttcccaaaatgtcctttatagcataatcaacatattttaaatatcatttgtatagaaagctatatattgaaggataccgacagcagtgaaattgagcctggcatgatggctcaagcctgtaatcccagcactttgggaggccgaggcaggcggatcacttgaagtcaggggttcgagaccagcctggccaaaatggtgaaacaccatctctactaaaaatacaaaaattagccgagcatggtggcatgcgcctgtaatcccagctactcaggaggctgaggcatgagaactgcttgaacctgggacgtggattttgcagtgagctgagatggtgccactgcactccagcctgggcgacagagcaagactcagtctcaaaaaaaaaaaaaaggaaagaaaaattaattgaagctgttgcaccacagggtgaatggagcaacatactggtgaaagtaaggtgaatgccaactgttgtttttgtaatcatacctaataaagtttttatcagtgtgttagatggccttcaaaatatggcagagaaatccataaccaggcaaaataattttgggtctcatttcttcttataagttattacttgcctataacaaactaatctaaaatatgcctttctgctctaaaagctaaagcttaagagtcccttggcagatgggacttttaaattattcctgtagaaaattggtagtatataagtgttttaatttattatgtgttttaatttattcctgtagaaaattattcctgtagaaaatcggtagtatataagtgttacagctcttagaatttgtctagcaggctctccggtttttgccagaatgcccaccaccccccgaaaaaagaaagttggtagattggtagtatacaggatatatcagtatcctttgggtgtttaggtataaggagatctgcttagaaattataactggagagctgagtacagtggctcatgcctgtaatcccaacactttgggaggctatggtgggaggattgcttgaagctaggaatttgagacctgggcaacatagtgatacctatttctggaaaaaaaaaaaaaaaaaaaaaagagagacattaaaaaaaaatgagacaaagaagatagaacaaaaggctagataatttggaagaaaagcatgaaagtaatgtcataaagaattcaaagaggacaaagtttcaaatagagggggaaatgctgtaggggtattgaggaagatggggactagaaagcatccttttagatttggcaagcaggcaagcgttcattggtgaccttgtggagaatagttggaatgaagtaagtctctgatcatcctgagtcagggtcaagtttatcttgtcattattcgggtatgaggctagtttttctctttggtatcttgtggctcccatggccggaagttggtgctttcttcagtgctagttacctctaggaagaggaagcgggcggctgttcctggacttctctgaatacctttttctagttttaaagttttgaaccacaagaatgtattacttattcagcaaataaaacatttccaagtgaaatacagaaattggccttttttctatgatatagtgctgtgattatcattattgttcaagtgctattattattttgttgacatatctgcccccgcctttagattgcaggctcctggagagctgtctcctgcagtgccccagtgtctagtatgagggggtggcatctaatgggttatacagttgttaaggagcataagatgtccctacgtaaaatgctagtgtagcatacaatgaggtttgatgtcagaatggcatcagttctgctttttgttcctcttgtgaggagcctgttcaaatgccctactgtctcttgtccctatgctgggggcacatggtagcagtagtaaccatcgccttagtgcccttagtgaggtttgataaacctgcctgctgcctacagttccaaatttgaccaggattatatgacatcatttagaagaacccttaggagggaactctgaaagcaatgtgtctgtctaagcactgctgttgctggcagaggtatctagaggttacttagggatgagcacgattgttttctccagctctaaaagaaattaaggactctcagttttttttttttttttttttgggactctgtctcaaaagagtttaggtctgtgaatggtcttgctctgtcacctaggctggagtacagaggtgcaaacatggcccattgcagcctcaactttccgcgctcaagtgattctcccacctcagcctcctgagtagctgggagtccaggcctgtgccaccatacctggtcagttttcttgtagagacaaggtctcactgtgttgccaaggcttgtctcaaactcctggattcaagcaaacctgctacctcagcctcccgcagtgctgggattacaggtgtgagccaccatgtctggctcaaatgttcttttgtctttttctttgccagttttacttctttccacatgtcaaatatatatttttaaagatattagtaaaaaataaagagagtttaattgctacagtgtctaaactaggttttttaatggattgaaggctatcagaaggacgttttgaataaacttattttgtttggagtttaattttttaacaaaaacccaagttggaatttaaggtaaatgaaaacttttttgcattggagtgaaatataaggaaataataaattcattaattttattaagtgatcattaacttcttaaaaatagagctgatacctatgagctatacttagtattagatgatttagatagcactgctttctcttcagtagaaaataatcagaaaaatagtttatcatttaagttttgtcaatttttttccctaggaagataagaaaaatacagtagaagtaagattgacaaaaaaccgtacagggctgtttttagctttctagtcttttggttttttttggtgggggggagttattttttatttttagttttatagaaattagaatattcttcctggccttgttttgagaggttttaatttaaataaaatttaatttgagagtttttgaagtgaaatgttacgatctcccaattcaacattataattttactgcaggataaataaagaaaacaggaaaggaggaaagcattgattacaaatatcttaacaatgagcaaatgtgcaaggaaaaaatatattaagacaaatccaaggtaggtagatgtacgtttttctgttcttttgaaaattctacttagcttaaagttcatgatgaataaattgatatatagatgtacacatacatgtatgtatgtatatatattctattataatatatactcaaattattcagccattcacttaaggcaccatctactgtgtaccatgctgggcactgtaggagatgtgtcggtatgtcagttgacttatgctaagtactagtcttttcgtttagaaagtagaccaatatgaggatgtcgatagttaagtggaattgtagaattcgaagaatccccagggttttattcttcctcccggcctttcggccatacttgtacttaaccttataaaacagaagaaagtctctaccaacgttttaaaaatatccaaatagaatttttcaagttttcttttgattactttcagagacattctgtttcgttagttggatgtagtcctaaagagaaaattgattttccactttttgtaaagttatttaaaataatagaaacaactttaataacttccttttccaattggattctatttttagaagagatgaaaaattttttcaagggtagtgcacttcctctgcaatgtaatttgtctttgaaaattggatacaactaaaattttagaatttttttttttttttttttggagacagagtctcactgttacccaggctggtgtgcaatggcacaatcttggctcagtgcaacctctgcctcccaggttcaagggattctcctgcctcagccacctgagtagctgggattacagggtgccaccatacccggctaatttttttaattttatattaaaacaatttattactaaaaaaaattttttttaggccgggtgcagtggcttaatctgtaatcccagcactttgagaggccaaggtaggagaattgcttgaggccaggtgttaaagaccagcctggggaaaaaaaaagagaaaagggaagaagaccagcctgggtaacatagcaagatcctgtctcttagaaaaaaaattgttttaatggagggtcctattttttaaaaaaacaatagatatattaatattttattaatttggatcccagtatattcaaaacaggttgggataatatttgcttttctatcaaagtttgctaaataatataaaggagatttcagagaaatatttaacttcaaaagaaaataatcctgctattattagttgtttgtaaatttaaatatctccattttagcaattttttttttttttgagacacagtgtcactgtgtccaggctggattgtagtggcacaatcttggctcactgcaacctctgtctccaaggttcaagtgattcttgtgcctcagcctccgagtagctgggattataggtgcgtgccgccacacccagctaatttttgtattattagtagagatggagtttcaccatattgaccaagctggcctcaaactcctgacctcaggtgatccacctgcctagccctcccaaagtgctgggattacaggcatgagccaccatgcccagccaccattttagcaaatttttacctgttttttagaattgtggaaccaaatatttgccagtattttgcttgttgttaatttatagtgcttagtggacttgtttgttttcgtttttattgttttatccttacatgtttttatttttaattattttgtaattcataattgcccattggttcttttctctctaaaaaggattattgtttaagattaaaatactacatagttaattaaagactattagttttagtacaactatgtttatttaatattatcacaactatgtttaatacagaaggtgagatttgggaaaatatgttctatgagacatctcttcaattttaatgtatttagctataaattatatagtgaataatgtaagattataatggactctataaattctatctggagcagctgtggctgatttatagatgttaatgttgtatgtacatcatttacagctgagtttggggtcctgcatttctgctgagatagtgcctgaaaaatgcctggtacagtgcttgacccatgttgagcactgaaatgttagttgaatcttctgcactgagtcctgtataggagttgggttttagtgggtttaggaggttgtactggagggcataaatctgcagatttggatataaatctgcagaataaactggcttgaaatagcatatctattttaaattgctagtgttgaccttttttgtagatgatttttaccttcaaaaaaataattttagtatcaaacttgtactaaacggcatgaactgaacaccgtgctaggtactctggcagaatacaaatggaataaaattacagtccatacatttggtatgaaagagaaagcatatctgagtgagattgcgacaacaattgcagcatactccaaaacacatcatcatcgtaaaatgttgtccaaactgtaattcgcagggcactggctgtggaaggaaccctggagtcacagtcacaacacctctttttcatccctcatcatgctacctattatgttccctgtaaaagtcccttaatctctctgaacgttatttttattattataataacacctgacagttgcacagtcttccaggataattgattaattggtttatttagcatatactgtactaggcactgggaatgcatggaaatctataagatgggatccctgtccctgagttgctcacgctggtgtgtgaatacatgtattatatgctacacaagtgttataacagacttgtaaatgctttgggaactcaaaagagaataactaattctgcccatggctattagaataggcctttgaaagttggtgtcctcgaaccaggccttgacagactagtgagaatttgccagttggacaaagaagggtaaagggcatttcaggaagaggggagattagatgtaaaagattaaaactgggagagtaagatatgtacttgaaaaaatgtctgattaggaggctggcatgcagcgtgttggaaagagtagagggactggagataaggctgtaggactaaaatgggtcacattgtgaaagagattgaatggcagtgtggtttagtaatggagtgtatggactttggaaaaagaccttggttgaaaacctggctatgccacttaatacgttcatggtaagatcaaattcttaacctccctgagtctccttttccttatttctaaaagaagaactaattattttttattttttgagacagtctcactctgttgcccaggctggaagaactgatgatagtgatcttatagagttgttaatcaaaactaccaggcacttaccacatggtaaactctcaataaatgatggttatagttatgagaattagaagtttggattttatcctgtagtcaataggaagctactgaagagttttaagcaaagaagtattttaagcagaaatacatgttttagaaacataactattggcatggattggagccaggagttagagtggtggctgtggaaaggtagagaaggagacttaattgttctttagaaggtagaatcatcatacctggtgatgatgctgtgtggaatgacagagagggagtttcaggggtttctggcttgaacaactcgttggatgatggggtcccatttcctgagatagggaactcgggtagaaagtttgtggaggaagaagaggagtttagttctggacccactgattttgaggttcctgcaggacatgtgtttggagatgttaaacagggatttgcatattggattttggaattgagaagagacgtctggcctagagtcatgggtttaaatctggcacttgaatccagagaaacagaccatatgaagtagggagagatttgagagtgaggcaagaaagctaagcagagtcccgaagacatgccatgttgaagattaacattgaggaagagaaggaattgtcaggggagcttgtggaggaattgtcagcgaatcagatgagaagaggaaaatgtagtatcagaacgctgagacagtgttcaagaaggaagatgttgtcaacggtttgaatgctgctgagggatcaaacaaaaggtaggacttaaaatgtacgttggatttagtgacagagattagttaccatttctagagacgttttagaggtagaaacctctctaaacttgggggtatctaggagtatgtgggatgtgaagtaacggagatagtagtgttggcaattctttcaaatatttcagcagtgagaaggggaagagaggttcaagggaatagctcgagagatttctgatccagtggatttgtggctatgtgtataagttgtgagatgggagagacgtgaatgtgtttaagtctttacaggaaaaaactgttagagggggagagaataattgatagtataatcccctggggcatgggctccaaacaacagatacaggtattttaagagtagggaggaggcaggaggcaagggaacatggtgagtgtagatgtcaatagctttgttgatttggttgtgggaagttgatggagttctcattagagacaggaggcaagggctttcattgaatgcagtcagtatagaaacgcagggattgagaagagggagaacatttgaaacagttgttgagaatgggagagtagtaagccaaggaggcaaactccatcagtttgccgcccatttgaggttgaaaaccaagaatttaatagctatatttatatttttagagatggggtcttgctctgtcacccaggctggagtgcagtggcacgattatggcgcactgcagtcttgacctcctgagctcaagtgatccttccatctcaccctcctgagtagctgggactacaggtgcccatcactacgcccagctaacttttttgttttctatgtggagacggggtctcactatgttgcccagtctggtctcaaactcctaggctcatgtgatccttctgccttggccccccagagtgttgggattacaggcgtgagcccctgtgcttggcctcaatagcttattctgtcttataatttcattcagtattgttcatctgccttggtgcaggcatagaggagatgaagagttggttttatccaagattggtacttactaagaatatacagcaatggcacaatcttggcttactgcaacctccaactcccaggttcaagcaattctcctgcctccacctcccaagtagctgggattacaggcgcctgccaccacacctggctaatttttgtatttttagtagagacggggtttcaccatgttggccaggctggtctttaactcttgacctcgtgatctgcctgccttggcctcccaaagtgctgggattacagacgtgagccaccgtgccgggctgggaaacagtaattaaaatgagaagccatgttagctgaatagggtgggaagtgaagaaagggggaggcagatgggcagagagaaagtggtgtggagatctcagtgtgttggaataacaagtgtgatgggagtggtcaagggagagggtaagatgggaggataggatgttgtaggcagagtggaatgttggaattaattttttcagagctggaccaatttgcacattggcaatgtccagggtgtggccagacactccagtagatagctgaagtggcataaagtaagtcattgatctgaggcatctgggtaagggataggtcttcttttgagtgttgaacatagacagaatggtgaagaggaaagcttttacatcaggggccagagtcttcagtttacatcctggaggtgagtagatgattatcttatggatgggttcaggatggtacacctgatgaccttgagcctcagttgaacaagggtttttacgagggagtaaaggaggtacaggtgggaagcaacagtggggaacaaagcagatggccagtcaacatgctgaccttgattgggtgtgggaagatgagcagtactctcttgagaggacagcagagaggctttgggagttccagatagcatattgctggaatttggaaggagaacaggagtgagggattgtattatggagggaaaggaagcactagttatgagagtgaagatgaaatatggaaggagcttatatcttagtgatttgagtgtgattctggcatgggtgcaggggcattgaagtttagttgtggcttaggaaaaggcccattgtctgtgatttattgtcttcagagtggatagcagcaactgtgtggaacagcagctcaactgctttgtccagtgtggtgatgggaggttacagtggacagtgcccagtgctaaattatggtaaggaggaggagttgggatggctgctgaccttccatctctgcctttctccctaaggctcaacgcctcatggtatcctgactgatgtttagctttgtggggttgctttttgtggttgatctcattctgactgattatatatagacacacgattctagctttggagcctgaatggatgatgatactcttgactaaaagaagaaataaaagagaggggtcaggtgtccatgaaaaccccaggttgagatgctcagtaggagggaggtgtgtgtaaatacagatttgggagccatctgcatataggattgaagaaaccatagtattcatagtattggaaaattctgtagtattgacaaagggaaaagggcaaaggactgaactctctgggaaatgcccccagagaaaaatggaccagttaagatgattgcatgagatggtacgttatcaagacattttcatgtataaaacattttgaaatctgtcttttatcatatctcaaaaattgaggcctgaatagtttatctttttaatcattaaaactttttttttttttgatgggagacttcttggattctacagtgtgtacccctctgtccttaaagtatactgaacataattagcctttttttcatgactcaggatagttattataaatatcagttattgagttgtaacttccaggctgggcatggtggccatgcctgtaatcctagcactttgggagactgaagcgggctgatcacttgaggccaggagttggagaccagcctggccaacatggttaaaccccgtgtctactaaaaataaaaaaaattagccgggtgtggtggcgcgtgcctgtaatcccagatacttgagaggctgaggcgggagaatcgcttgaacccaggaggcggaggttgcagtgagtccagatcgcgccactgcactccagcctgggtgacagagcaagacactgtctcaaaaaaaaaaaaaaaaaaaaggtattattcctaatttaattccatgcagcctttccagccctatttgtaccagtcctactctgtctcttccccactaaatctaattatccccctttccctcacccagattttctactccaatcacctattctgtttcccagatatcctctgtactttcctccctctcatagtcgacctgtcctttctacctggtgaaatcctactcacccttcaatatacgactcatatgaccacattctctggcagacttggtcattctcttatgttttccagagcatttcatggatcacatatatcacatgattcaagaaattacggccagttgcaatggctcacgcctagtaatcccagcactttgggaggccaaggcaggcagatcacctgaggtcaggagttgaagaccagcgtggccaacatggcgaaaccccgtctcttctaaaaatacaaaatagctgggcatgggggcatgcgtcagtaatcccagctacgtgggaggctaaggccagagaactgctggaacctgggaggcagaggttgcagtgagccgagatgcctctgcactccagcctgggttgacagagtgagactctgcctcaaaaaaaaaaaaaaaaaaaaaaagaaattactttacttgtgatttactttaattactgacctgccaataaactgtgtttctcaaattttagtacatattggaattgtttgcatataagaagttaaattctcaagaaagtttgattcactaggtttggggttgagcctaagcttctgcattttttacaacaaatacttctcgttaattctgatgcgagttgtccaaggaccataatttgagaaaccaacaaccatgtagttaatggattccatcagggcaagggccatgacttatctgcttttgtattttcagggcctgccatgtagactatgctaaatgaatgtttctagaatgaaatatagtttactggggaaggcctttcggcatataatttttgagttgagacccaagttgttgcagaatcttaagaaaggttttgcctttcaaaggtgtaaaaaatagcacaagacaacatttcccaggtggtttccaaaatactcctgctagggcatgctttgtgggaaaagggtttgtttggtagtcagatacttttagaaaatgctgtctgttggacctgtgcccttcacccttctcaagacacactagcagattgaagcttttgagatgttctgtgggaaagaaacccttttaatctttaaaacgttttgacaaagcattttccctaccctttttccccagataatgcctttttagaacctgcagaactaatgtcctgaggtattttctttggaaactgctcacataaccaaaagtataacagtaggaattaacacttcatgtgtgatgatgacctataattacctagaattggagaggccactctgggaagttataagaaaagagataaaggattaggcaatattaagggaaagacatttttctatggtaggctcgacgtttgtattttggtataattgctctaaattgtcctggtcagttataagtattaaaataactgtagtatagatgatagcagacaggtttgagcatggaaggattggatttgggtaacggctactggaatgcaaaaggcagtaggaagtcaaagacagtagatgaaggatctgtagaatctggtaactaattaaatctggaaaaacaacttggatgttttaattcaaagatctaagtggtctatatactttttggatgtatagttagactaaggtgaaaaagaaacattgtattattgacagctgaaaagatgtgtaacagcagggagtagtttctataagttttttgggtttttttttttttttttttttttttttaagacggagtctcgctctgtcgcccaggctggagtccactggcgcaatctcggctcactgcaagctctgcctcctgggttcacgccattctcctgcctcagcctcccgagtagctgggactacaggcgcctaccacggtggcgcccggctaatttttcgtatttttagtagagacggggtttcaccgtgttagccaggatggtctcgatctcctgacctggtgatccgcccgcctcagcctcccaaagtgctgggattacagacgtgagccaccgtgcccggcctctataggtttttaaattttagttttgtttattttgtttatattttaacaggataaaatttattataatatagtttgccttctaaaaagagtccatatagaaatcactaacttaaactgaattcatacacaaacttcaaatcacatcagaagtttttcctggaaaaattaggtcctcttttttcaataattggggcttgtttatcagaaacgacttagtgataacaaagcaagacacatttttgtattattatacatttaatttagacgatggggaaattccttcacactacctcataacataaagcaggtttattaggccttaagaatcatagaatatttatacttttcatgtaaaatagaaaacctaattttccagccattcatgctaaacagcagggttaaagtaatgatcaggaagactttatacgttttaaaataaggtagttttcatgagacattttgcagtgctcccttggtaatgttcatattcagtgagcagaaaagaaaagatgagagagttaggactctactattgaacctgtttcttgaagaaaacaaaaaccagatagtacaattggatgtcagaaatgattattagaaagctaggtaaaaacagtacaggttgagtatcccttatctgaaatgcttgggaccagaattgtttcagaatttggaattttttggattttagaatattcgcatatacatatgagttaccttggggatgagagccaggtctagacacgagattcatttatgtttcatatacaccttatagtctaaaggtaattttatacaatatttttaatgattttgtacaggatacaaagttttgagccatagcatgaggtcacatgtggaattttccttttgtggcatcatgtaaatgctcagaaagtttcagattttggagcatttcagattttggatttttggattagggatgttcaacctgtatttccaaatacttaagatagggccttaatttgtcttcctttttattgtcttttcagacaaatgaccatggaaacagttgaatcccagcatgatggaagtataacagcttctttgacagagagcaagtctgctcatgtgcagactcagactggccaaaattcaatccctgctttagctcaggtaggcaataggcaggcaccgttgaaagtcaaaatatatggaaatgagaattaggtgcagattctgttttcttgccattgatcttaaattttccatgttccctggttatcagccattcttgcttatttgattgtgaagaaaagatacgtgttgtaattagccttgcattttaacagacattcagcagtgccccatctccattgccaccaccactatggaaggaaaaacaaaaacccttcctgaatatgtaatcctcaaagtatgatttgagagggttgctaattcgaaattgatacagttctgatgtccttagctgttaagatgacagaaatcttaccattttccccgtatatatttgtcttaatcattactttcttttcagttaggtctcgaactttgaattggtttcattcagaggtcaccagtatcagttagtacctgtttctagatcctaaaatttatttctgagatatctattaaaaatatagtaaaaataaacacatttgttagttcatcaaatatttattgaatgtctgctgtgtctaattattccggatgcatgtggatatgtagtttcaggacttaaatatcccatggtttggtagggtagacagatattttagcaataattccagtagggtaagaagtgctgtaagatactatgtagaaaatgaataaggcctacagaagagggagcagccagctgactaggagtgctttatatatctcctttgagctaggcacaaaggatgagtaggagtctgccaggttgataaggtgaggaagcatattctaggcagagcgaagagtgtgcacagaggcacagagccagagcatgggatgttcagggaactatgggtattgagtttaactggagccaggtgtctgggctgggcagtccagctggtaaaggtaagtagaggatcgtatacatttcagggtttagagtacactgtactctaaatagtattgaaatattttcaggtgcccaccgtattttcagttttgacactagtagccatgtggaggtggaattgaaagtcagtgagtcggaactgaagacaccatcagggtgcctggtggagtcaaagtagcgtgagatacagagcagtggtgagacctttgtggtacattaaagggagaataaaaaggacctggtggttgactggaaggcccaggggaaacaccaggcacttcttgggttatattaggccagactggtgtgagagctctcctttcctgtgcacccagcctgcttttctttcctctttaaagctgccaacacccactcgttccctgcaggttttctgcggtattctgtagagctgtatctccctagcaacaccttttgttacactgagagacaggcatttaggttaggccaggccttttgcttaaacacacacacacacacacacacacacacacacacacacacacacacacacccttgttaaaaaaaatgcatgttcattgtagaaaataaatattaaaatgaagaatataaaaactatccataatcttaacatccagagatttaatcattgttaacattttggtgtagctcctttagtctttttgtctgtgtgaatagaatagaaagcatatactttttctcatgattttgggattttccagaatctttagagctatggtttctggtcagtaattctgccctttgctgaagttgtagttgaaagcactttcttttttttttggtagagacaagttctcactatattgcccaggctggtctcaaactcctgtgctgaagcagtccttgcacctcagcttcccaaagtgctggaattacaggtgtgagcttcttgtacccagcctgaaagtacattttcttccttctgactctacttccttctaggtgggtcccggctcactaagttctacagatgccttttgccccagaattctggggctgaagtcccagcaatagatttccattatctaaatatggtaatttgcaattctgaggaccttcaggctgggcgacagccacctctgtgagcctcactcagaaattgccaacaggtggccaggtgcagtggctcatatctgtaatcccagtactttgggaggccaaagcaggtggatcgcttgaggccaggagtccgagaccagcctggccaacatgaagaaaccctgtctctactaaaaatacaaaactaggtggttatggtggcacacgcctgtagtcgcagctgctcgggaggctgaggcacgagaatcacttgaacccaggaggctgaggttgcagtgagccaagttggagccacttcactccggcctgggtgacagagtgagaccctgtctcaaaaaaaaaaagtgttgccaacaggttaagtaatgtggagtctgaaaagtagtcttaggtttctgagggcttgaaagtgttgccaacaggttaagtaatgtggagtctgaaaagtagtcttaggtttctgagggcttggaattgaataggagaccagtggacagaaactaggttttagtaggttatagaataagtaagaggaggggaagtggaagttggaagtatagactcttttaagaaatttgtcttgaactaatagagaaagatgggtttgtgaaacaaaggggtgagaactgggatgtgagaaatttgggaatgttttgaataaaatggaacattatagagacttgtgagaaggcagaatcaaggaactagaaaaagcctgtgtttacgtttgtaatgcttctttaaaaatctcaaataatgttgtatgctaataaatattgatagttattaaatctggatagtaaattcttggagttttgctgtttttctattttatattgttagaagtatttttttgttgttgtttttgttttgtttcgttttgtttttttgagacagagtctcactatgtcacccaagctggaatgcagtggtgcaatctcggctcactgcaacctctgctcactgcatcctccacctcccgggttccaatgattattatgcctcagcctcccgagtagctgggattacaggcatgtgccaccacgcccaactgatttttgtgtttttagtagagagggttatgccatgttggccaggctggttttgaactcctgacctcaagcagtccacctgctttgatctcctgaagtgctgggattactggtgtgagccactgcacctggcctgtttgaagtatttgatcaaactgaaactatggtttttatctttcacatgctagaaatatagagattaagaagtaatctgtatgccgacttatggattattttagttaactaagaattatcctccatgccatgcatggatcatgattttttgaagaattagaagacaattcttagcagtcagaattttctgaacataattactcattaaagttcttgtgacaccagcagctgttcgtttatgagtattgttactatcatacaatagtatatgtcttacaaggagtaggaaatcaagctgaactctattaaccctatgatgtatgccaaaagtgactgactcttctgaatttctgatggcttcatatttacttgccacttgtctcatttttcttcagacttgaggattgtaaatttccatatgttttagatttaaacttagttgtgaataaagaggaatttctgacactcaccttccttgtttatatgatcagattatcagtaaacagtgtgggaacaaaaggcgtaagcagaacgttcagtgggtttgattctttgcatctaaggtcatttgatactggttgttttgattgtcctggcctttccagagcttctgctaatcaagaatatactatgaaaatcatcagagacctagcaactgttgagcttggttttggctgtcaggcccctgttctgctgatggattgaggtgaggtgcaggtacaccaggggacactggagttttgcttttctgttttataactttgtagtaataaatggagcctttctcttctgtttgaaaacaaaatcacggtggtggtaatgtcaaaaagttggaagcaggagttgccatcaacaaatcctagtacggcaaataactggaagttaaatgttgtcttggctttcttcttgcctaaattatttttatgctgatttatttttaatggaagctggtatcttatttattaagtacgtgtgttgatatacaggactagactcgctggattctggtaaaactgttgataataagttggagagtccattttaaataacctggccaggaggaaatcttttccagaaatcaaaatggtgaaaagcaaaaatattgtatgtacaatacaagtagttttaaaatagtgacacttacatcctccggaaataatattgtttttaaatgggtaatgggaagttaaaacttcttttgttgtgaaagacttcaaacatacataagagtagaagaatgattccacatatatataaagttagtaattattaagattttgctagaccaggcatggtggctcatgcctataatcccagcactttgggaggctgaggcaagaggattgcctgagcccaggagttcaagaccagcttgagagcttgtctctttaataaaaaataaattaatacaacaaaaatttttgccaggtgtgatggcatgcccttgtagtcccagctacttgggagactgagaccagtggattgcttgagcccaggagctcaaggctgtagtgcactgtgatcatgcctatgaataaccactgcactccagcctgacgacatagcgagaccttgtctcaataaaattaaaaaaaaagattttgtagcacttgcctcatctatcttctttttttcttcttgtcgctgaagtattttaagctgctcagcagatctcagacatcatgtcattttactcctacttacttctgggtatacaactcttaaaacattatggacattttcttatataacaaaatgtcattatacctagttaagtataattaatatgcaatccatattcatttcacaaatgtatgatctactctgaaggcagtagagtggacaccttgaacttttcttgttcctagactcttgggaattggtaacactgccatgaagacctaggtgggtaaggtcattcagatggagccagtggaaaggatgtaccttaaaactgactttctgaagtataattctccatagctgctgctgaagcctggaggcctcgactctgaaagctaaataactcttctttataaatgactacttctcaaggtttcagcaaagatagaagggaaagatgaaaggagcagtatgctaggagtcaaaaggggggaaggaaactctggagattgtcaaggtcagcaaactgcctcgagagaattagttctgatataacacttaacctctccaaggacctctgtatttttggaaacaaggagacactagggaggcagagaaagccgctagggaatgttgttcagagattatactctcctaatcaagctgaactctgttaaccctatgatgtttgccaaaagtgactgactcttctgaatttctgatggcttcatatcttatcctttcttatcttttccattctaagtgcacaatgtgtaaggagtccctcggaataaagcagccctggcatgccatcggggattgaagtaggaacgatttaacaagggatacttggaaatgttgtcatgtgcgagttgtaaattttcttttttaatctggtggaaaattggaatggcatttctctgttttgcccagctatgccaaaaatcttcttggtcccacataggcctaggaaggatgtagatggcaatcacaaaacaaacaaaaaatgagcaaacaaatagaagacctcaagcaacattttctcttgttaataggttagcaacctcatatttgtatattaaagagatctgcattatgttaggttgatttcatataatttcagctaagtagatctagtttaaggtcagtgttttattgaatcttgtattttagcttcagtatattaatttccttagctgagggactcctactgaaggagaaaagtgttcctgttaaaattttgaaataaaagtttctgttttactgtagattttttcactattgctccttatttttatgtattctttcccctggctgtttttcatggttcatattttatctgttacacagaacatttgtattctgttagaattatctataaaaatgaacaaaggatggaagaaaaaggaagagagtaatttttttcaataaatgctaaatctgtattataaaatgttccttagtcatccaattcagaaaaacccactgctttgaaccgtaactcattattgaaggtaattcaaggttcagaggccataataaaaagtaactggtgaactgttaatattagtaaccaacttttttcaacttcaacaagaatttgttatgtatctgtactcatattttgataattttgtatataatagctagtatatttctttaaaagtttgtttttggctttagaatacgcttttatgttttcatcccagtagtgtattaaaggtgacagtactttgctttaaataaattttgatgttgcagaggtaatttcaggaagtataaagcaatcagagtcaaatttcagaaaaattttggttttataattacaataaaaatgcatacaaatttattttagtgtttgagagactgttaaagatttttttgtaatttgtaatgattatgaggtttggatactcgtagaaaatgttcaagttccctttcttagttttactaatgggtagtttgtcactagcagtaatgaaaaaataactgagtataaatacagttactccttttgcctttttctgtatgattttctttagtaaaagagtaagctgagaggacggaaaaatggggagtcattttttaatgggtatggagtttcagatttgcaagatgaaaaagttctgtagatctgattaacaataatgtgaatatacttaacactacaaactacacttaaacagtgaatatgttatgtgtcttttaccacaataaaagataatgaataacaaaaaaaataggctagacattgaaatttgaaaaaagaaacattaattttatagtttcttttttgagtaagacttagggattcttttcttttcttttcttttctttttttttttgtagagatgggagtctcgctctgtcacctaggctggagtgcagtggcacaatgtcagctaactgcaacctccacctcccaggttcaagtgattctcttgcctcaggttcccgagagctgggactacaggcgcgtgccaccacacctggctaattgtttttgtagttttagtagagatggggtttcaccgtgttagccaggatgatcttgatctcctgaccttgtgatccacccgcctcagcctcccaaagtgctgggattacaggcatgagccactgcgcctggcctcttctttctttctttcttttttttttttgagacagagtcttgccctgttgcccaggctggagtgcagtggcgcgatctcggctcactgcaacgtccacctcccgggttcacaccattctcctgcctcagcctccttagtagcagagactacaggcgcccgccaccacacctggctaattttttgtatttttagtagagatggagtttcactgtggtagccaggatggtctcaatctcctgacctcgtgatccatccacctcagcctcccaaagtgctaggattacaggcgtgagccacagttcccggccacctcttttcttttctttttttttttaagaaacagagtctcactctgtcacccaggctggagtgcagtgatatgatcgtgactcactgcagcctcagtctcctgggctcaagtgatactcctgcctcagtctcctggagtaactagaactacaggtgcatactgccatgcctggctaacttgtaagttttttgtagagatggggtctcactgtcttgttcaggctggtctcgaactcctggcctcaagtgatcctccctcttcagtctcccaaaatgttggcattacaggtgtgagccactatgttcagccagagactattttctttcccttattttatcgtttgttattataacccttgtaaatcccagactattaagaattatatttggaaaacagaggctttgggaaatttctgcttcattgcatagttgtgacgatatcttcatagtgctctccacaaatgtggatttttgtagccctatcagagataaaactgtagtggttttcttaaaaggtataggggagaaaagcctggttatggtaatgaatgtattaggtagagacaatgttagatgaagaaaacagacatagttcaggaaaaacacatgtctttaaacaggtttcattcagaagtagacctctattttggcagataataactattttcctttaaaacaatgcatataaagatgcaacaacaacaacaaaaactacaggtcaatatccctgatgaacataggtacaaaaatccttaacaaaatactagcaaaccaaattcaacaacatattaaaaagatcattaacagtgatcaagtaccattcatcccagggatgcaaggatgtttcaacatatgcaaatcagtaaacctgataaatcacatcaacagaatgaaggaaaaagaccatatcatcatctcaatacatgcataaaaaacatttgaaaaattcattatttccttattataaaaactctcaacaaattacataaagaagggatgtacctcagtgcaacaaaggcagtatatgacacacccacaactaacatcatgctgaatggggaaaggttgaaagctttttctctaagatctggaataagataaggataccaggccaggtgtggtggctcacacctgtaatcccagcactttgggaggttgaggcaggcggatcgctggagcccaagagttaagagaccagcctgggcaacatggtgaaagcctgtctctaccagaaaatatacaaatattagccgggcatggtggcacacacctgtaagtcccagctacttgggaggctgaggtgggaggatggcttgaggctgggaggcacaggttgcaatgagccaagatcatgcccctgcactccagcccaggttgcagagccagaccctgtctcaaaaaaaaaaaaaaaaaaaaagtcacagatgcccatttttgccacttctatttagcattgtactcaaagtcctagccagagcaattaggcaaaagaaagaaaaggcaactgaattggaaaggaagaagtcaacttttccctgttcatagatgacatgatcttacatatgaaaacctttaaaaaaaggaacaaaaattagaaaaccttaaagatgccaccagaaaaacctgttagatctaatacatgaattcactgaagttgcaggatatgaaatcaacttataaaaaccagtattgtttttatgtactaatagtgaactacctggaaaaaatatcaagaaaactctatttacaatagctatgaaaaaaatacttagaaataaatttaagcaaggaggtgaaatatctgtacattgaaaactataaaaaacattgatgagagaaattgaaggagacacaagtaaatgttcatggattggaagaattagtattgttaaaatgtccatactacccaaagcggtctacagatttagtgcaatccctatcagaaatatcaatgacattcttcacaaaaatagggaaaaacaatccccaaatttatacaggaccacaaaagaccccaaatagcgaaaggaatattgaaccaaaagaatgaagctggaaccactgccatggccagtccattgcagggtatcctgcagctgctacagaccgagaagcaggctgctgagaaggtttccaaggcccacaggcagatgaaccgggggctgaagcaggccaaagaagtagcttaggctgaaattgaacagtgccgcctgcagagggtaaaaagagttcaaggcgaacgaagctgaagcactgaagtggagaaggaggcccaggagaaaagatgatcaccctccagacctacttccagcagaacaaggatgaagtcttgaataacctcttggcctttgtctgcaacatccggccagaaatctgtgaaaactgctgcataaatgggtaggagaagaaaaaagcacctgttctatgaattggcattttagatgctctcatggaatatgaagcttcaacatagctcaagttatattcttaaggcattaaattatttctgtatattatataataggtccctccactttttggagagtagcaaatatagtgttttttttttgttgttttgtttgttttttttttttttttacagacttagaacttatctaaagatttcatgtttcttagaaaattaattggtatatgttgtctatttttatatgccttttggttcaagcaacatatatatcagtgttgacattttctttcttagatctaattaaacaaaaccaattttttttgaagaaagaaagtgattaaataatttttccccctaatgcattcttgaattcatcagggctttatctatgaaaaagtagtaaatagttatttgtaacctatgtgaagcaacattcagccttaatctattcctgctaatgattagaacaacaatattggtatagttgtttgggttgcttttagtttctcttaatcatgtttactagatgatagaacttaagaacttgttacatcttattacttggtgtatgataatcatttgaaagtcaagactctttgtcatgcaggaaaaaaaaaagaacaaagctgaaggcatcacactacctgacttcaaaatatactatagagctatagtaattaaaactgcatggtaccagcatgaaaacagatacattgatcaatggaacagaatataaagtccagaaataaaaccatgcatttacttacaccaacttatattcaacaaaaatggcaggaccacacaatggggaaagggccatttctttaataaatgatgttgggaaaactagatatttacacagaagaatgaaattaggcccttgtctctcaccataaacaaaaatcaactcttgaaaatggattaaatataagacccaaaactatgaaactactacaaggaaacaggaaactccttgacattagtctggccgatgagttttttgatacaaccttaaaagcacaggcaacaaaagcaaaaatggacaaacagtattacgtcaaactataaagcttccccacagcaaaggaaacattccacagggtgaagaagggacctacagaatgggagaaaatatttgcaaactatacatctgataaggggttaatatccgaaacacagaaggactcaaacaactcaatagtaagaaaacaacctgattttctaaaaatgtgcagaagacccgaatagatttttctcaaaagaagacataaaaatggccaagtacagtcattcatcacttaacaacaggtctacattttgagaaatgtgttgttaggcaatttcatcttttttttttcccttatgatccaacagaaccaatggtgtggtgatttcatctttgtgcaaacatctagagtgtacttacacaaacctggatggtatagcccactacatacctaagctgtatggtacagcctgttattcctgggctgcaaacctgtataggatgcgattatactgaatactacaggcaattggagcacaataataagtatttgtgtatctaaacataggaaaggtacagtaaaaatacggtatcaaagataaaaatggcacatctgtatagggcacaaaaccatagtggagcttgcaggactggatgttgtcctgggtgtgccagcgagtgggcagtgagggaatgtgaaggcctaggacattattgtacactactgtagactgtctttttttttaatagaattttgttcttttgcccaggctggagtacagtggcacaatcatagttcactgcagcctcaaactcctgggctcaagtgatcctcctgtctcagcctctcgagtaactgggactacaggcacatgccaccatgcccagctaacttattttatttttttgctattgtagacttgataaacattgtacacttaggttacactaaattcataaaacatcatttcttcaatgaactgtagcttactgtaagttttttactttttgacttttgtaataacacttagcttaaaacacaaacatattacacagctgcataaaaatgttttcttctatgcttatgctgtgtaaaccttttctgtgtttgaaattttttattttttttatttttaaacttttttgttaaaaactgagacacaaacacacatgttggcctaggcctgtatagtgtcaggatcatctgtattgctgtcttccaccttcatatcctgtcccattggaaggttctcagggaaagaacactcatggagctgtcatctcttatgacagtgccttcttctggatactcgctgaaagacctgcctgaggctgttttacagttaactttttaaaataacttgaagtaaaataataataaaaagtatggtaaatacataaaccagtaacagtcatttttttattatcaagcatatgtactgtacataattgcattgctatgcttttatttaattatttatgagacagggtctcactctgttgcccatgctggtgtgtggtgatgtgatctcggctcactgcaacctccgcctcctgggttaaagctattcgcgtgcctcagcctcccgagtatgggattacagtcgtgcatcaccatgcctggctaatttttgtattttcagtacaaaatttctctactaaaaatacaaaaataagcagatgtggtggcaggcgcctgtaatcgcagctacttgggaggctgaggcaggagaattgcttaaacccagaggcggaggttgcagtgagccgagatggtcccagtggactccagcctgggcaacacagcaagactccatctcaaaaacaaaaaataaaaaaaattagccaggagtggtgttgtgcacctgtaatcccagttactcagaggctggggcaggagaatcacttgaacccgggaggcagaagttgcagtgagtcgagatcacaccactgcactccagcctgggcaacagagtgagactgtctcaccaaaaaaaaaaagctcgacatcattaatcatcagggaattgcaaatcaaaactacaatgagatatcaccttcctcttgttaggttggttattatcaaaatgacaaaagataacagatgttggcaagaatatggagaaaagggaacacttatacactgacggtgggaatgtaaatttgtatagccatatggaaaacagtatggaggttcctccagatatgaaaaatagaagtaccagatgatccagcaatttcattactgggtatctatccaaaggagatgaaagcagtgtgtggaagagatatctgcacttccatatttattgcagcactatgcataatggccaagatacggaatcagcctcggtgttcatcagtggatgaatggataaagaaagtatggtatgtatacacaatggaatactattcaaccataaaaaagaatgaagtgtcatttgcaacaagatggaggaatctggaagtcattctgttaagtgaataagccaggcccagaaagacacatactgcatgctctcactcatgtgtggagtctaaaaagttctcatagaattagagggaagaatggtggttaccagaggtgggggtgcttaggcagagggaaggatggggaaatgttggtccaagaatatataattacagttaggaggaatgagttcaagagagctatcatacagcatggtgactatagttaaggacaatgtattgttgaaaaatgcagagatagttgaatgttaataatgttctcaccacaaaaacaactatgtgaggtaatgctattattaattagctagatttaactattacataatgtatatatactccaaaacatcatgttgtacatgataaatgcaattttttctgtcaattcaaaatgtaaagtaagaacatttaaaaggtacatctccaacctccacatgctttccttgcccagtctttctctcctgcttgtctctctccctgtcagtatgagacaccctctctaggaagccgctgtcatcctttacaaagaaggagtccagaatctaaaatcttacacagcctgcttcaggcagtactgaagcctggacttctcagaggccacagtagaggccagttgtagcaaatttggttgaaaaagcaagaattatttttaagtttttctaaccacctgagctccatttgcccagttgtgagattaaacactttcttcgggcaccagcaaatcatggccaccagaaaataaaatcaaatacaaaataataattaatgggagaggagcagtggctcatgcctgtaatcccagcactttgggaggccaagtcaggaggattacttgagcccaggagttcaagaccagcctgggtcaaggtaagactccatctctacaaaaaaaaaaattagccaggcatggtggcacttgcctgtagtgctatctactcaggaggctaagatgggaggatctcttgagccctggaggttgattgaagctgcagtgattcgtgatcatgccaccgcactccagcctgggtgacagagcaagaccctgtctcaacgcaacaaaaaacaaaaataaaaaaaaatagagaacaaaaatattaaatgtgtgcgtatttactattggatatggtaatataccatggtaggtattgcctttgtaagttggtctcccctgtcttttgttcctagagctttctcattttctcatctccaagggcttgtttactgcttcatacataaaaagaggccaggtatgatggctcatgcctgtaatcccaacactttgggaggccgagatgagatgattgcttgagcacaggagttcgagaccagcctgtacaacatagggagaccatgtctctatgaaaaattaaaaacttaggccaggtgcagtggctcacgtgtaatcccagcactttgggaagctgaggcagtcagatcacctgaggtcaggagttcaagaccagcctggccaacaacatggtaaaaccttgtctctattaaaaatacaaaaagtagccaggcatggtggtgggcacctgtaatcccagctactcgggaggctgaggcgggagattcgcttgaacccgggaggcggaggttgcagtgagccaagatcacaccactgcgctccagcctgggcgacaagagtgaaactccgtctccaaaaaacaaaaaacaaacaaaaaaaaacaattagttgagtgtggtgacatgtgcttgtagttcaaattactcaggaggctgaggtgggaggatcgcttgagcctgggaagctgcactgcactctagcctgggtgacagcaagaacctatctcaaaaaaaaaaaaacaaaaaaagagccctaatttatacatgtattctcagtttgaattaaatttagcttgtttacttaaaagtagtgttgaaggtatttttcatactatattttaatactagattaaagttgatactaattttatgcagttttaagtattaagactaatcatttgacctttgctttctttacctaaaacatggaaaatactgatttcatagattaaatgagatgatttgtgtgaagcacaagcacagagtttggcatctggtcaatgtgcaataaatgcttgcttttatcctcatagtgaccttccttgatcttaaaatggtagtaattaggctttaagatgaaatggcttatgctggttttaaaatatattgtattcggaatcctttgtaaagtaacaaaaatctacaatgcttagtaggcctccaaagggtatagaggagaaaagctaattttttatagttttataagcaaagttccggtatgtcaggagcttgcttaaaattatatgttttatgcttcttaatttaggtactttagatttctcctagatattttaaaacattgctggccactttgggcataaaaatctaaaatataatctgtaactatttcagatttcatggtaagaccaaactgcattataatttttgtaaggagctaaactcttagactttactatttatgtactctgaccattggactggaactgaaaacaacttaaagatgcaatttggcctggctgtgttaaattagtctgctttgcattgctataaaggaatacctggctggggcagtggcccatgcctgtaatcccagcactttgggagcctgagttgggtggattatttgagctcaggagttcgagacgagcctggccaacatggtgaaaccctgtctctacaaaaaaatacaaaaatcagctgggcatggtggcaggcgcctgtaatcccagctacgccggaggctgaggcaggagaatcacttgaaacttgaacccggaaggcagaagttgcagtaagccagattgcaccactgctctccagcctgggccacagagcgaggctccatctcaaaaaaaaaaaaaaaaaaaaaagaaaaggaaaaagaaatacttgaggctggataatatataaagaaaagaagtttgttttggctcacggttctgcaggctgcacaagaagcatggcaccagtatctgcttctagggaagcctccagaagcttcaaatcatggcagcaggagaagggggagccagggtatcacatggagagagagggagcaagagagaggggaagtgccacactcttcaacaaccagctctcagaactaccagagcgagaactcatgaccattcatgagggatcccccatgacccaaacacctcccacaaggccccacctccaacattgaggattatatttcaacatgagattgggagcggataagcatccaaactgtatcacgttttgtcaaaatgattctgattttgacatctacttttatgtaattcttctttcctgttgcataaaaagcctttttttggcttagaatcttactgcaaattctttatgtgtatttattattttgaaatacatttggctagtaaattatgatcagtttcagtcttactgaaaccaaatacgagattggctttcaaaagttccttccagagctaaaagagtttgacttctataaaggtcatgtccatttttatagtactttaatatatatattattataataagtgaaacatatctcatattggttagaatataaaatgatgccccaaatactataaataggaaatccaagatactgtacagattagctagaaaaaaaaaagtttagctagggcactgttctcaaaggataaagaaccctaattttaatttaagtgcttactggaagcattatcaaaatagattatttaaacccttctggataattaagaatgactgaattataacacttgctttgctttcaagaagtgaattttttagaaacatgaaatttgaccatttacgtttacagtatcagaaacaatgatccttttcccccttttcaattcagattatggatttcagcttatgcgctatacataaaaaaaaggattggaggcaacaacaacatctctttagaagataatggatagtaaatatagaaataataatcatacttggcttatctctttgtaacaaatattttcaacatatattcttaaggtaaaatttaaatgcattgaatttgcaatttgttagccacactatcttaaaaacaaaacaaaaaaaacagctaggccagacacagtggctcacacctgttatctcagcactttgggaggccaaggcgggtagattacctgaggccaggagtcgagatcagcctgacaacatggtgaaactccgtctctactaaaattacaaaaattaactgggtgtggtgacaggcacctgtaatcccagctacttgggaggctgaggcaggagaatcgattcaacccaggaggtggatggaggttgcggtgagcccagatcacgccacttccctccagcctgggcgacagaacaagagtctgtatcaaaaaaaaaaaaaaattaccagggtgtggtggcgggcacctgtaatcccagccactcgggagtttgaggctggaggattgcttgagcctggaaggtggaggttgcagtgagccaacattgtgccactgaaccgcagcctgagcaacagagctgaactctgtctccaactcaaaacaaaaaacaccttcatgggaaggaagtcactcaagataaccgaaatgaagaccaactacatttttcattttgtgtttgtcttactcagcacaatcaaatatgacttttaaaaattaaagtgggccgggcacggtggctcacacctgtaatcccagcactttgagaggccaaggtggatggatcacctgaggtcaggagttcaagaccagcctggcagagatggtaaaccctgtctttactaaaaatacaaaaatcagccagacgtggtggcacatgcctataatcctagctatttgggtggctaaggcaggagaattgcttgaacccaggaggtggaggttgcagtgagccgagatcgcaccactgcactccatcctgggtgacagagcaagactccgtctcagtggggggaaaaaaaattaaagtggaatattttacatctttattcaggtatttgatttataatattcttattattttcagctttaaaacatttgaaatattctaatattctcttaaatgctttttcccctatagaacagacttttgagaatcctgtcttaatacataaatatcaagatagttttcaacttcttgcttagcttgttagtgtatttttattgtagtccttaaactaggtagtacagagatttgatttttcaggagcagagttgatagagcagtctgctatattgtgaattcacattttaaaatcctttattgtcttgaatgcaggcctagtagctttgtgacatgtgcagctatactatgacatcataaaccccatcgtgagggaacctagctacgggtcagagctagtccactaggtgctaatcaaatgctgtgttacaacactgtgaggttttcccagttataagtgtcactattagggttttttttaattgcaaagccaaataaggctgtcaattgcatcatcttaccttatttcttcagattaagtactgtttatagtgggatttttggtggatgtggtggcatcagcataatctatgtttcaggcgtcctatagaagaggattattcttcaggggatgtggaagaaaaggtaaatgatgtctgctataagtaccttcacacttttaaagccttgtgaaaagaggggtaaaaattgtgaaatataaaataacatccattttatgttttagttttttgttcttgcgatagtttactgagaatgatgatttccaatttcatccatgtccctacaaaggacatgaactcatcctttttttatggctgcatagtattccatggtgtatatgtgccacattttcttaatccagtctgtcattgttggacatttgggttggttccaagttgtagcagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcgccattctaactggtgtgagatggtatcttattgtggtttagatttgcatttctctgatggccagtgatgagcattttttcatgtgtctgttggctgcataaatgtcttcttttgagaagtgtctgttcatatccttcgcccactttttgatggggtggtttggttttttccttgtaaatttgtttgagttcattgtagattctggatattagcccattgtcagatgagtagattgcaaaaattttttcccattctgtaggttgcctcttcactttgatcgtagtttcttttgctgtgcagaagctctttagtttaattagatcccatttgtcaattttggctttgttgccattgctttttgtattttagacatgaagtccttgcccatgcctatgtcctgaatggtattgcctaggttttcttctagggtttttatggttttaggtctaacatttaagtctttaatccgtcttgaattaatttttgtacaaggtgtaaggaagagatctggtttcagctttttacatatggcaaaccagttttcccagcaccattaattaaatagggaatcctttccccatttcttgtttttgtcaggtttgtcaaagatcagatggttgtagatgtgtggtattacttctgagggctctgttctgttccatcggtctgtatctttgttttggtaccagtaccatgctgttttggttactgtggccttgtagtatagtttgaagtcaggtaacgtgatgcctccagctttgttcttttggtttaggattatcttggcaatgtgggctctttttgggttccatatgaactttaaagtcgttttttccatttctctgaagaaagtcattggtagcctgattgggatggcattgaatctataaattaccttgggcagtatggccgttttcaccatattgattcttcctgttcatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctgtttgtctgttactggtgtataagaatgcttgtgatttttgcacattgattttgtatcctgagactttgctgaagttgcttatcagcttaaggagattttgagctgagacgatggggttttctaaatatacaatcatgtcatctgcaaacagggacaatatgacttcctcttttcctaattgaataccctttatttctttctcctgcctgattgccctggccagaactgccaacactgttgaataggagtggtgagagagggcatccctgtcttgtgccagttttcaaagggaatgcttcccatttttgcccattcagtatgatattggctgtgggtttgtcataaatagctcttattattttgagatacgtcccatcaatacctaatttattgagagtttttagcatgaagggctgttgaattttgtcaaaggccttttctgcatctattgagataatcatgtggtttttgtctttgtttctgtttatatgctggattacgtttattgatttgcatgtgttgaaccagccttgcatcccaggaatgaagcccatttgatcatggtggagaagctttttttttttttttgagatggagtctcgctcttttgcccaagctggagtgcagtggcatgatcttcgctcactgcaagctccatctcctgggttcacgccattctcctgcttcagcctccctagtagctgggactacaggcacccgccaccacacccggctaattttttttgtattttttagtagaaacggggtttcaccatgttagccaggatggtctctatctcctgaactcgtgatccgcctgcctcaggctctgaaagtgctgggattacaggcgtgagccactgtgtctggccggataagctttttgatgtgctgctggattcagtttgccagtattttactgaggatttttgcatcgatgttcatcagggatattgttctaaaattctctttttttgttctgtctctgccaggctttggtatcaggatgatgctggcctcataagatgagttagggaggattccctgtttttctattgattggaatagtttcagaaggaatggtaccagctcctccttgtacttctggtagaattcggctgtgaatccatctggtcctggactttttttggttggtaggctattaattattgcctcaatttcagagcctgttattggtctattcaggaattcaacttcttcctggtttagtcttgggagggtgtatgtgtccaggaatttatccatttcttctagattttctagtgtatttgcatagaggtgtttatagtattctctgatggtagtttgtaattctgtggggtcggtggtgatatcccctttatcatgttttattgcatctatttgattcttctctcttttcttctttattggagtttaacctattaactctaccagtataattataaggttgacgctcttgcttataagttttggcctaaccagtgagaatgtagaatgatagttctccagatataagagttttcttttttaaaaggagacatttgaattctacctccagatgcgtcatttatgcaggttctcagcctttattttagcattttaatgaaaaaattgtctcatgagcttttggcctgcctagagtttggacatatggaagtttccttgtagttacagaatctgtataacctatctccagaattgtaaggatatggtttatgttagcgggtacaagttctttttctgcagcaggtattcttaaccaagcctttttttttttttttttttttttttgttaaggcacagtctcgctctgtcatccaggctggagtgcggtggcatgatctcagctcactgcaacctcgaactcctgggttcaagaaattctcatgcctcagcctcatgagtagctgggattacaggtgcgcacaaccacacccggctaatttttgtatttttagtagagagagggtttcaccatattggccaggctggtcttgaactcctgacctcaggtaatccacctgcctcggcctcctgaagtgctgggattacagtcatgaggacttagccatttttgatagagttattgtttaattaaaattctgataattgtacttgaaagatgattaaagcaatgtaaaggatgatttatgcctatcagatgcccatgaatctttgttgaattgtttttctgttctccataataatctgatttctttgaagctgggcatttccccacaaaaaatgaatgtggacaccacctgccatctcaacccacaggtctagtttgtgagaatacttgtaggacccctgggtttcccccgctatagtttcaagtacattgtcttcagataccttattctatgtacttggaaaaaagagtaaaacattgagagccactgggatctgacaagctttgggagctccttaattctaaaaagaaaattattttgatttgagaaaatgtaatatcttcagaaatttccaccacccagctatgtgactgcatttttaaaaaaggaaaggaacagaggaaaatcaagtcactctaccctccttacttacctgtggcttgtccctacacatggtggtgggtgggagaagtggtggtggagtactgggtcctccagagagctcagtttggaatctggaactaaagatcatgtcccaatttcctgagctgatgggatagaagctggtcaatgaagtcttctttttgtgttaatttttttcctttgttttcttttgttttatgtagttataaagcataatttctattttgccagtctctgacacatgggctctgtcagggttactggatatgtttattttgtctctgctgctctactggagctgaaatctcagcctgtctgagcagttctttaagctgaaagccagggtgtaggggctagattagtgtggaatagctgttttcaaagtgtggtgtgcagaaccctgggggtgactctgagacattttcatgaggcttgctaggtcaaaaccattttcacggtgatgctaagatgttgtttttctttttctctgttttgatatccacactgatggtgcaaaaacagtggtggtgggggagtggtaaattgttgggtgccttaactcaagtcagtgacacaaactgtgttagtattaactgtattcttcactgccatccacttgcagtttttttttttttaagtcagttttacttaagaatatctttgatgaagcagtaaaaattaccattgcattaaatcttgactctgagtacatgctgttttgatattctgtgtcctgaagtgggacagctgcagaaagcacccccccgctgcgtcctgacgacccatggtgttcttaaggaaaagcacgtgtgttatttgagtgccaagatgaattagctgcctgtttttccacagaacgtcattttcttcaaaagaatgactaatttccaaatgatggctattcaaacttgaagacatttcctcaaaaacaaatgaagtgagcttgtcagttcaagggaaacaactcatggtgtttattgtcacaagcttttaagccaaaactttgaattttggaaaatctgcatctgccattgtgagcttgacaatattcatagttttctgatcaaactggttatactttaatgaaatgtgatttataatactgtgtcatgaaatgtgtccacgtttggaagatctcctgaactcagtgagccagtattttccaaatgaatacttcaggatgttacaaaatcttacgtgggtaagagattcatccaaagtacaagacagatcaatggattttaatgtaactgatactgtctcagattgtatgttgcaattaatccttaagagacaatcagttgtcaagttttggtgtatccatgaagaatatccatgattttctacagaagctattataatattcctccctttttctaacacgagtctttgtgaggcccagattttcttcacataccaactaaagcaacatactgcaacagattcagtgtagaagtagatatgagaatctggctatcttcagttaaacctgacattaaaataatttgtaaaaatgtaaaacagtgctactcttctgatttttttgaaaatgtaatcatttttcataaaatgttatttatggtagcacatacttattattttaaaataagttactatttttaaaatttctgttttaatttccagtatgttaaatatcaacatatataaccagtggtgtgcacagctggcttgtaccagtgaaaaccaattgtataatctttatccggctttgtgttcaatgtcatccattggcagcttgaaatcagccatagtaggagtacttacatcacagaagtgagcaaacgctacaagtcagtgttcctccttcttaagatctagttaagtgtttaccagccctctactgaatatcaatcacagaaacaaaagctctttgaggtcatcagtaatttttaagagtgtaaagatgccctgagactaaaatatttgagaattagttgtgaggagaaagagttatcttttgagagttagtcactatagaggtgtataattcatacagagttgccttttgtgccggaaacatttgtagaataaatccaatgttttaaaacttgcagttgttaaatctactggttccataatgggaggatgtttttcttttccctggaatctaaactagatgataatactctgggggtaggtgagctgaattttccctgtgggctacatattggttgcctctgtcctggtttcacactatctgtccaactgttatctaggtttagatcaagccttcactcaagctctggcatctacataaagccctcacttactgtttgggcccatactgatctttctattctgtactcctgtgatattcatggcctctaaaatggagcaattcgttctgtactatttggtgtgccattgtttcttaggtgctagttttattaattctattttctaatagtgcacctagtacaaggctcaacacctaggttctcttacacggataaaacatgttttaacttttggattgccagagaagttagttttccaagggaatgatgatgtaaataaatcttagttatttgttataaacccagtttttaataattcttttcagatattaatataagttggaaatcattggtgttcctcaaagtgaagtcacacacaaagtcttccttgaaaaaattgttttagatgctgtggttctactaccactcatgatagacactggtgacttatttccaaggtctttgactcttgagtaagtcataatgaatggtgaatcttagtaaaatgaggcaaagtttctgcaattatgctagcctataggacagagttgtttactaattagaaaacctggcaggttttgagtccagaggagtggttagtatcgtgtttttctggtagggatctctgttgaaggaactcagggaagtagtgaggagatggctgttgtgctgatctctgcccaaagttaagtgatagttctggcctctctggatgctttagctagggagaggaaaagtgtccagaggcctcatcagccttcaaggcatgagctttctctgggtcagagacaccaggggcttgaaaggtcctggaatttcttcggcctatgcctttttagttattatgagggcataacagtgactgtgatttttatcagtctagagacaaagcatcagctcacatccagagtaacactagaatatcatatgtcacacatttaataaaaataattcactggccaggtacagtggctcacgcctgtaatcccagcactttgggaggccaaggtgggcagatcacaaggtcaggagatcgagaccatcctggctaatgggtgaaaccccgtctctactaaaaatacaaacaattagctgagcgtggtggcgggcacctgtagtcccagctactcaggaggctgaggcaggagaatggcttgaacctgggaggtagagcttgcagggagccaagatcacgccactgcactccagcctgggcagcagagcaagactccgtctcaaaaaaaaaagaaccatagttaagttctatctccaatttctctgaagaagttagagggtagtttatactctggcctaagaaaggcttcactgttagtaggcgtgaggtcgtagtgaggtagtttaactgctttagaactttgtgcttggaacattcttagccaccgaagtatgggcaccaaaagcgataaggagcatgtgttccttaataaatgtcacatcagaaaatgactgttccaggacagtaaccacctcccgatggtaagtatcctagatagtttgtcatttctcagcagcaggaaaaagagaagtaggccagtcatattagtgagtggtattacttaaaaatagcaaaaacaataacaaaaaaggtccagctttaatcctcaatggtgatcattttggcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggttagcttccttcctgaatggttttgtctttgactttcttgagccatttttttcctctttcactaattcatttatcatttttctttatgaagtgcttatacgcaaatctttttattagatatttggaggaatctcttctccttgcgtaaggtgctctgtgtcctgctaggtacgtaggtttcacttcagagctgcagctttgttgccaacttttcatttggggactgagtaattgcagatgagcagttcatgtcttcttcactttgttgttctgtgttcaaactcagatttatttagcaatgctccccaagggtgctgaaaaatattttgagggtgcatcagagaagatgtgtgataaacacagtaatataaagattatagtgctgatgctgttttctttttttttcttcttttttttttttttttgagacagagtctcgctttgtcgcccaggctggagggcagtggcatgatctcgggccattgcaagctccacctcccgggttcacgccattctcctgcctcagcctcccgagtagctgggactacaggcgcccgccaccatgcgtggctaattttttttgtatttttagtagagatggggtttcaccgtgttagccaggatggtcttgatctcctgacctcgtgatccgcctgtctcggcttcccaaagtgctgggattacaggcgtgagccactgcgcccagccagtgctgatgctgttttcatgaataatcaccttagtaggtagatataaatttataatcaccttagtaggtagatataaatttattttaaattcggtatacataattcttggtaagatgatattattaatgtatccctctcgattaaaccttggcttttgtagatatgattattattgtggttgtgatccagagatgtattttacccttaacatttcttgaagttaaaacattttttccatcaatagatgtaaattattaaatatgcattttttaaagtatgcatcttaattactgaatttatttttgttcatttttaaggtcagttattatcctttaaatgctgaaattatttgaacctaattgatgacaaaaaaaaaaatctgtgaggaaaatggagacacgtatacatagtatagtccttttcttgcgtgttcaagtagtttatcacagtagaatgataagagtggcgacaagatacctgatgtgacaaattcacatacattaaaagcttgattatctttgtggcatgggtattttctcctgtgtttcccagaagtgtaagaataattctcatcattatctttttttcctgtgatggcccctgattccaagagtttctaattctttctgacactaattataaaacaagaaagtctttccaacctcttctttgttttatgacttttattgaggtccacatatttctacttagttttaacctggctggtattggaagaaagtattgtctattattattatttattatttaatagagacagaattctcagtatgttacccaggtttgtgttgaggccctggcctcaagtgatcctcttgcctcagtctttcaaagtgctgggattacagatgtgagccacagcacccggctgaaagaaagtattctgttatattcagtagactttgtttggattttgttaagtgaacgatttaattgtccttgtagaaagaggtgccagtggatcttgtcctagaatacttacgtgttggatcatggtcaagccacttaatctctgtgcatgaactttaattttcacctttctaaaataggtaaattaatagcctacctcacctaagggagttgttatgattctatgacagatgtgtgacagcccggtgtaaaatgataaatatttaatatttggtggtgatatatgattatctgaggcaacaacatttttctcagtcctgttgattgggtgtgtgtgcttatgtgtggggcgttcatgagcaaaaacacgagtcatatgtggaggtgaatatacacctccgtgtacttcgggaagtatatattcttgcttgcattgttgatattttaataagctcttttgattttgtccaaatcaatttcccatgtaattataatatgaagtgagttttgtaaactctgctaccctaggccctcaaagtattaataattgactgaatatatcaaaatcagtcatgttgttgaagagattcattattttagttttctgacttctttaataatcatatcactgtattattacttgacttgaaaaatgaaatcatgcttaaaactctgatctttctcttaaggagaaatgctttatttggatcttcaagacccaccgccaccaagccctaacttactccttgtaatagaaatcctgattttacccaggcttgcttactgacttgcttatctacttaaatattctgtcttgggcctatctgatggctaatgtgaagacccagctcacgccagcgccagctgtgagagtgtgggaacagcagtgtgatccgggagctctcttctgcgttggcccctcgctggctccctcctggattcgtaggagcactttcaggttgaggagcttaggtcttgggtattttacattttgttctttcctgcaatgcctcatttgacatcccaaccactctttccctagtatttctgtagtatagagtacccgtaacattcctttccacacacatttgttttataactgaaatgtttgcgtctgcgcttcctttcttgagccagactccttcagtgcagattcactgtgttctattgctcagttgcttccacagctcctggctcagtgctgcacacacagactcttagcctcaattttttgaatgagggaaaagagcatatattttatgatacatttcagaaaatcttgtattataggtagcagcaattgcagagacagatgaatctgcagaatcagaaggtgtaattgattctcataaacgtagagaaatcctttcacgaagaccctcttataggtaagttaaccaagtttcctaatgtaaagatactttttccaaaatggtagaataattatacatcaaatcaattcttcctttatagcttttctgttttaagacttattcatgtatcttagtgacttaccttgttaaattgtattttaggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcacattcagtcttgtgcattttaatggaccgttaattctgtgctttttgctctgattaaagcactagtttttttcccaaaagaagagtgtttgatacgtaaaaagcaagagctagaaagaaaagaaaaaggaggagaaaggttagggatatcacatatcctaagctagccccttaggtactggaataatgtgatattcctgtcctttctgaagtataaattgtccatggaagttgtctaaatcaatttcccatgtaattataatatgaagtaaagtgagttttgtaaactctgctaccctaggtcctcaaagtaattgaacaaatatattgacagcagtcatgttgttgaagagattcataattttagttttctgactttaaaaagagctacttaggtactggaatatatgtgatattaaataatgtgtttatccaaataaggtattaagattttagatatattctttgtttttcctttaaaaagtagcaataccaagaaaaaaaaactcaagtcttaatttaagtcctgactactaaaacaagctataatctttaatgtatgagaagactttatatagtcattatttttgtggagctttttagagtttttcttgtagcagtggtagatttgcagtagtaaactattaaatacattctctgttggtaattgaggggaactcctaccatgatacctagcagatccggggtgtagtgtattcacacgtttgacagggcacccagtagacttgtccaaagtcagtgttaggaaaagaaaatccccaccatctgtaagaaatagaccttgaggtttacattgtcatttttttattacttctctcgtttacatgctcttttgtctggcacactgggaatctctggtgggttttagaactgtaaaactgaatatgccagctgatgagcctctacagcacagcacgcaggttatgagagtgctgagtgcctcgtccccccgtccccagaggggctgggcagaagctgctggcgcctcctggctggtcagccctggccttgagcagctccatccactcaccccagtgggctgtacacatgtcatcatgttctgtttgtgtaatgacagggaaaaggttggaagtgactgctgaaatgacactaagacttctcaaagtgttgggaaccactaagatgctgtcatcgtaacatttctctggcatatgctaatgctacttaggacttctgatagaagcagtgattcctttacaagttgatagggaagcagatgctgtagggttaacttgtctagattattagctgaaaatttgaaattgtgaaaatgtatggggttgaagctggagaggatgtggaaggaaccatctttgtgccatttgcaaactcaatgatcagagcaagaagctttattaaattcacatctcaggttttagtctttgaagtgggaataatactaaattgccaaactctggggttcctgtgaagacaaaggagataatgggtaaaagtagggggaaaaagacatgctactattggcatgaaacagagaaattaagttaggtgtaccattgtctcattcatgttcattgaactttccctccagccagccccaatggcttcattccctgtgtccttggtacctgctcacagcagggggctggccttaaacctcactctgtgtgtctgtgggggggatgagaggagcagagtcaggaattttggttgagaactagaaaactgcatctgtagaaattagatcttaggccaggtgtgatggctcccacctgtaatcccagcactttgggaggtctaggcaatgagggttgcttgaggccaggactttgagaccagtctgggcaatagagtgagaccctgtctctacaaaagaattttaaaaattagcagggtgtggtggtatgcgctcatcccagctactcaggaggctgaggtgggaggattctctgagcccaggagtttgaggctgcagtgagttatgattgcaccactgcactgtccaacctgggcagcagagtgagactctgtctcaaaacaacaaacaaaaaaaacacatctgtctatttgccacataagaggtcatggactatttcttactttggtttcttaatttgagtctatacagtatgatcctagaaattattctgatgagaagttatagttctgtatgtacagtctgcaggtaaaaattgccatttgttcacacaatgtgaatttcttttgttaaaaatgcattttggggacatttagtgaaatatatgtagataattctttgagaagtgaatactaacaacattcaaactttttagaagacgtttactttaattggagggtaaacatacttacacacacaacatccatttttattgatcttattttttatagaactaacttagcagatattaatgctttaatgttgtagcagaatgtctagaaatggaaacaattgccagtttcctttggtttttgaatagaggaacgtattttattagaatttctggagattttcctatttttttccttccctttgagctgtaaattttttttaatgctctttcataaccttttattataaaaaaaaattttaggtttaattgttcagcttttatccatggatggctttctcccaaactttgcttttatttctttttttccaatattttattagttatttttaatttggaataatgagttagctggtgtttaaaagaactaaatgtgtatcaaagttgaagaaataaagtatattcaagttttcccatatacaagcagttacatttttaatagttgaaagatatttggcagaagttggccttattatattgacttactattatcacaaaaactaaaaagtgaaagttggaataggctgctccctggggagtaggaaaaagcataaaatagacagggatccattattacaacaccaagtaagtgagctgtacctgcagaatcctcactggaagtacagatcttagtgataggtgtgttgcataacagttgagctggtcgaagaaagtcttttatttcagaagcatatacccgagagatggcgggagagagacagccttagaattaacaaagaatgttacttgctgcatgagacagttaagataggcagtaaatgagtgaatttgtaaaagcaaccgaggaaattaaaatgtttgaagcttcctaattcattaaatttcctcttgaaacaaaggttacttaaatcctccatcctactatacccaacctcttcctgtaccaattaaagactatcacccaagacttcagtttttttcccacaaatggcccttgtctctgcttgtgcctattgtattttacgaggaatcttattagagtattaactcatctttctggaattcttatacatgaaaggtaagtgggtcaatctaaactgcaccattatgaaaagaaaaatatgaactttgtggactccttataagaattcagaattctcaggaggctcacgaataagcaccaattcaacttcttcataaagggaattagaacataataggcttacacattcgaaagttaatccagttgcagttcttaatagtgacgttgtttacatttctctaaggcaactgtttcaaaattttttaaggcactacttaatgtaactctggcttttaaactttgatgttgctattgttgttatagcatgatttagtcttccttctgctataatgcacctcttggcttttaaggtacaagtactcataggtgctctcttatggtcactctgaatttaaacctgagaattcattggaacaaaggtctgtttgctgctgtttttaaagttaatgcagtgagatttcatttatgaatctttggattgcaatttggaacaagagtggttttaaatataaacatttacatgtgtatgtattttaattagctcatgtgtataaatttaggattagaagtatataacatgggccgggcgtgatggttcacgcctgtaatcccagcactttgggaggctgaggtgggcggatcacctgaggtcaggcattcgagaccagcctggccaacatggtgaaaccccatctctactgaaaatacaaaattagccgggtgtggtggtgcacacttgtaatcccagctactttggaggctgaggcaggagaatcgcttgaacccagcaggtggaggttgcagtgagctgagatcacacgattgcacttcagcctgggcgagaagagtgaaagtccatctcaaaataaatgaacaaataaataaataagaagtgtataacatcgccaggcttggtggtttgtgcctgtagtcccagctactcagaaggctgaggcagaaggattgcttgagcctagcagtttaagaccagctagaccaatatcaggatgtggggcaacacagcaagaccccatctcttaaataaatagctaaaatagaagatatgtctaaattcattcagttaatttcatcttattttttctatcttgatttatgtttattgaaagcacatgttatgctatccttgactattttgaaacctaaacagttttctcctcaaatctctgaatacagacaggcccacgtaaaacctatttccaggatcctgaggcactgggaaattttgtttattgtcagatgagagagaacattttcaatgggaaggtcctctgtcatttgataacaacaaaatcaagagcacctttggcataaaaatgaaaatgaggctgacgtgcctgacttaatcagtagaaatgttttctcactagagccagtgtgtgaggggtgtgtgtgtgtgtttgtttagcttttgttttccatatctaattatataatgacttccccagaaaataaaatgagaaacagattcttgatgtgtcagctgttcatattgtgaaaacaaagttttttgatcagaactgtggggaaacattactgaaaagaaaaaaggaaacgagtaaagcaaaaagaaagagaaaaaaggaagtaaaggtctttgttatctacctatttaggggttcttaccctgaggcagctactctcacctcagattgacttgatcgttatttaaaagcttgataatttggtgttgaaaaactaggttctatgattggaatttgaaaccatacctcatttaactctcctagattcacagggggcttaagttttttataatatcatctgtcatgaggaaatgatagccattcattcattcattcattcattcattcattctattttttgagtggctgctctgttctaggctttgtacttcttttttttttttttttgagacggagttttgctcttgtccaggctggtgtgcaatggtgcaatctctgctcaccgcaacccccgcctcccagattcaagcgattctcctccctcagcctcccgaggagctgggattgcaggcatgcaccaccacgcctggctaatttcttgtatttttagtagggacggggtttctccttgttggtcaggctggtcttgaactcctgacctcaggtgatccaccaacctcggcctcccaaagtgctgggattacagatgtgagccaccgcgcccggcctaggctttgtacttctaatacactgtggttacctgaccttgggctgctctttctaaagcactatttctgtgacatcaaactaattatcaactgaaaaatacacattcaaatatatgaaaacatacacaatttactcatgtctagccacaaggggccaagaaagcagtgtcttttgacattttcatacttgtaagaagttagttagatctctctcaaacccttttactatgagggctgaatcctgagacccatgaaatctttggaaagccatggtttaaaaataccctgtttttaaagtgtgtacagaaaataactgctctaggtgagccagataaagtgctgttacatcagggtgtctcaacctcagttctattgacattctgtaactgactcttcagtttctgccacactggcctgtcagtgaaataaaacacagagaacgcagcatgtggaagtctttttaaaaatgttaatctatcttcctgtgtagacactggcaccttaggtgaaagaagtgaaaatttgttgttgttactctttccataattctcataggtttgtcctatcaggttatcgcctaagtgcttttttgcctagatgcctttaaaaacgtttggaaatgacttgaaaatattcagagtgtattttaaacactactgttacgctactgtaaggtatttacattgatgtatagatgtcatgttattctggtgatgtgtttttaaaatcttcattgtaaagcctagttagctagtttatatgtgattttttaaaaagcatagcctctggtaccatttaatatctactgtttgaagcatgcagttggaatctttatgttaaaatatacagacctttcagatattttaaataatacttgtctattagagtgaaattttgaaacaaaacgtttgatcagttattctttggaagcttcaagtcaattaatatgttaacttttaaacatgactggcagatctcagtatttaaaggaaatctacttcctatttgttgccattagctgtagttacttgagatacttggtagaggtaaatattgtagcacaaatccttttagtaacagttactttttaaggacctttgcaacttgacaatttatatttcaggattctcctgacatagacaaaatggcaaaggttacagttttctagactttagctttataaccaaaatatgtttttatatatatttatatataaatatataatatatgtaaattatatagttatatataacatatgacatatataattataataaatatatattaaaaattttggtcatatatacaacatatataactatatataattatatatagttataattatatatagttatatataatatataacaaattatatataacataattatgttatatataattgtacataacatatatacatatataggtatatatacgtatatatgttatatataattatatattatatataaaatataaataattataaaaatataataattattaaaatatatgttatatataaatacaatataaattatatatataaatatataatttatatattatatgtgatatatattatatattatatataatataatatataatatatatcacatataatatatattatatataattaatatatataattaatataataatatatataatatataatatatatgatatatattatataaatatataaatatattaatatattaatatataatatatataatatatattatatattaatattaatatataaatatattaatatataatatatattatatatttatatatataaaatatataattatatataacatatataattatatgtatgttggtttttttttttagatggagtctctgttgcccaggctggagtgcagtgccgcaatctcagctcactgcaacctccaactcccgggttcaagtgattctcctgtctcagcctcccgagtaactgggactacagacacctgccaccacacctggctaatttttgtatttttagtagaggcggggtttcaccatattgatcaggctggtctcaaactcctgacctcaggtgatctgcctaccttggcctcccaaagtcctaagtttacaggcgtgagccactgcaccttgcctatatatttcttaaaaactactttcttttgatgacaaatcagaaaagtagttagctgaatgaaggtagaaattcattttaattgcaatattaaatgggaatttttcttttcttttcttttctttttttagagacagggttttcctgtgttgcccaggctggccttgaactcctgggctcaagtgatcctcctgccttggcctcccaaagtgctgggatcacaggcatgagccaccacacctggccttaaatgggaattttaaatggtagaagaatggtgtttataaggaaaaacatctgagagaatggagaaaaccaggaagctggactctccctgtctccttctccactcttcctcttgagtgatgtagtcagctggatgctaaggaggaggaacactccatgggctctatgaatctcaaacatttctgaatataaaatattttcaagtgtttataagcttttcctagagtatcgtcccatgacgaagctgatcttccttctcaattcagcatagaaaataagggtaacctgagaaagaagcaatggtaataaatagacccagagtatattcttccaataggggattattaaaaataaatcttgaaattctctaatatttcttttctttttctgttaagttgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaaggtatattttattaatctaatacatttagaatacctatggattactatatcacaccattgagtggtgattttatagttttttgaaatagatcgaaggtagatggtggggggttgggaggcacttaaaaaggcttacagaagaaatattttaatacattaaacagcaaattaagttttatcatttttcgccttttagcaggttttactggctctggagaaaggccaaattcagagtagcatgatagaaaaagagagatagaaacatgaatgaattttttttttttttttttgagatggagtctcgctctggcgcccaggctggagtacaatggcgtgatctcggctcactgcaacctgtctcctgggttcaagtgattcttctgcctcagcttcccggggagctgggattacaggcatgagccaccacgcctggctaatttttgtatttttagtagagacggggtttcaccatgttgggcaggctggtctcaaactcctgacctcagatggagtcgtcctgacctcaggtggaggcctcagcctcctaaagtgctgggattacagacgtgagccaccgcacccggccacatgaatgaatttttaaattaattagatatccttcatttgggggttgcaaatgttgtacctaatagatttctattacctaatctatgacaatttaagtattcaggctatgatgccccaaatttgtttttttccctagctgttactttcaagtctaatttctaggcaactcatttcaaaacaaatgctgactttgggttttttgtttttttttgtttgtttgtttttttgactgactgttcttagttgtttgaattctgaagtatccattctagctcttatggaagctgtcagtaatgaaataaaagttgagatgtagccctaagcttttagggttacctgagatttcaactggatttgcgttatacattattttaattcagttgtgcctatgataactgtaatagatgtatttaatacagctttcaaaactcctgtgttttaattgaattctattcctcttggtccattcgcttaggatttaggatatagcactattttttaaaaatttgcttgcttgtttgtttgtttgtttatttatttatttatttatttatttttgagacagagtctcgctctgttgcccaggctggagtgcagtggcgcgatctcggctcactgcgacctccgcctcccaggttcaagcaattcttctgcctcagcctcccgagtagctgggactacaggtgcataacgccatgcccggctaatttattgtattttagtagagacggggtttcaccgtattgcccaggctggtcgtgaactcctgagctcaggcagtccacccaccttggcctcccaaagtgctgggattacaggcagcactaacgttaaggaaagtaaaatcagttattttagttcgaatgtcttgcaggtatgataagcatattataattgatgagtctcttgataattatactcaggtattttgggggttaatgtggactatggtaaaagtgtgtgaagaactgaggtggtggcatttatggagtaaaaaatgcatagtacaaacccagtactttaatgttttcttgaaatgtaaaatgaaagccacctgttctattccccccatactcatggaccatatttatgtctaggtgaataatcttaaagaataattatttcttctcattttatctttgttacatggaagaatctactgcaaacaacagagttttgagaatttttaatgttttacacaatatgcacgtaagtttgtgccttggggtttttaagaattttcttccacaagtcacaaagatttttttccacattttcttctatttgctttatggttttacctttcacatttatgtctttaatgtatctgggcttcacttctgtatatagtatttggtgggaattcatttttaacttttttctccgtatatggagccactcccaagggtttgttgtttcctcactggtgtatggggcagccttaattagacagtgggtttgcttttgcacctggatctggccagtcttctgtctgattcatctttttctgaatcccagcgccatacatgtttgttatctcataaaacaagttccccttgtcttttttctcagtttgatacagagttagttttttgtgcacgattattctttcatatgcatttggaataagtttgagtttctaaatagtagtagtaataataataataataaaaccaatgatgagactgcattaattttttttttcttgagatggagtctcgctctgttgccctgcctggagtgcagtggcacgatggctcactgcaagctccacctcccgggttcacgccattcttctgcctcagcctcccaagtagctgggactacaggcgcctgccaccatgtccgactaatttttttgtatttttagtagatacagggtttcaccatgttcgccaggatggtctcgatctcctgacctcatgatccgcccacctcagcctcccgaagtgctgggattacaggcatgagccaccatgcccagccaagactgcatttaatttagggagagctgaagtcttcataatgttaagttgacctatcccaaaccatagaaagtcttgtttattcagatctcattttacttcttttaacagttgaacatttttctttttatttatttatttatttattatactttaagttttagggaacagttgaacatttttcttcacggagatcttgcatattctttctttagttggttcctaagtactttatgggttttgttgccattacaatggtaccttattttgtattgtattttctaattgttgctggtgtagagaaatacggattattttaagtcgatcttttatctattaactttgctgaactctaattacttctaataatttactgattctttgtgattcggtctgtgatcctatgtgaatgtttatacaaatagtgatgttttgtttcctcccttccaatctttattcctgttttctttttctctttttttcttttccttaaataatcatggccaggagctccagtttaaacacagcaaggccagtgggcattcttgtcttcctgaacttagtggcagtgttccctgccctccttctcccttcatctcactgaagggccctgtcagcttctttgtggattctcagtgcctgtcttggctgatgcctcagcagtatttaacactgtcgacttctgcttcctccacttcctgagactgtgtcctccttgctcttctctctctgctgcttctctgtcagtcctgttgctgggctaagcttcccctgcccctgtcctgagtgtttcagtgatcctcaggctcactcccccaccctcttcctgctgagctccctccctgaaggactccctcccacgctggcttcagttcactgtgactatgtcctgactccagctggttccttagatggccacacatacctctgactcctaaaatccactcttcctatcttcagtgattgaccactactatccttgatgccagaaacctaggtgttgtccagtattcttcccagtctccattcaaagtcactgtgtagattcttctgcctggctgagccatgaatgcttctgccactccacagccctctgtcctggccctggccctggcctgggtgctatccctctgacccaggctacccctgtgggctacagtctccggcagccaccggaagctggctattgtggaacagctttctgatcctcctaatcatgccagaggcagcagctcccttcttggctcagttttttgggaattgttcctgaaagttcagctaaactcttcattcctcacagtgattctgggagccactgatagttcttaaaaacagcagtttcttgcccccaacatctccattactgcattgcacttgttttgttttgtttcgttttgttttgttttgagacagagtctcactctcttggccaggctggaacacagtgatgtgatcttagctcactgcaacctctgtctcctgggctcaagcatttctcctgcctcagcttcccgagtagctgggattacaggcatgtaccaccatgcccagctaatttttgtatttttagtagagacggggttacaccatgttggccaggctggtcttgaactcctgagtttaggtaatccgtccatctcggcatcctaaagtgctacgattataggcatgagccaccacacctggtgtctggggtctttttaataagggcactaatcctgttcacaagggtgtcaccctcatgacctcatcacctctcagaggttccacctccaaatactattgcattggaggtgaggatttcaacagaggaaattgggtggggatacaaacattcagtctatagcatccactcaaaagcatccatcaatgtctgtgacctgttagacaaagctccaaatctttcatgtggcccaaatctttgcttgatccaagccttgcattctttaatagctgcctacctctccacttctccctcttttgtaatacagctctttctttcatttcctgggataggccatgccctctctccctccagggccttcttcacacataccgattgcctgataagaatacgttccccgaggaagccttgcccatcctccacatctggcttaggcaaccttctgtgagttcctactgtacttccttaggcacatatcatgttgtgttgtggctctctgtcttgctagatggtaagttctatttggacaaatacctagcacagaccctggcatgtgataaatgttcagtaagcatttaccaaatgaaagtgaactgttcttcctctgaaaatgtgatttgttctgtgtgctgattgacttgagattaactggtccagggaatacattaaaactactaagagcagtaatcaactaagcaacccatttcccttctttctttccttccttgccttttttttcacaccaatatttattgagcatctatgtgccaatttaaagaaatgctgacataaaaatcaatttcttattgattttctgaaatttgaaataaaatttactaatagcattcttggacccaaaccctcaggtgtgactgggacagcaaagagtccctgctggagccccagattgaggttgatgtctaggtgaccatccagggttccttactcagccaagatatcttcagctgaattgaaaccctaaccccattgtcaggtatcctggagaattactagaaacatggacactccctgaaactttacctcctgagcatctgaggtgtaaagtccttacctttactggaagatgattaaattaaatacagctaaaatgtggtgggatgtcctttcattgacataaggttgggttgaattctaatcatacaagggaaagggctttgggtgcggtggctcacacctgtaatcccagcactttgggaggctgaggtgggtggatcacctgagatcaggagttcgagaccagcctggccaacatggtgaaaccccgtctctactaaaaatacaaaaattagccaggcatggtgggcacctgtaatcccagctacttgggaagctgaggcaggagaatcatttgaacccaggaggcggaggttgcagtgagccaagattgcacctttgtactccagcctgggggagaatagcgagacttcatctcaaaaaaaaaaaaaaaaaaaaaaaaaaagacaaaaggtctcagtggcatgtcacttatttttttgcagtggaaatgccaataatttttttccaggctatggtctgttctatggttgaacattcgcccatttttgtgtctaaccttataatcactgaatttcctataatgatccagctctctatgtgccaagccttcattaagtgatccaaataaaatttgacatttaaaaaaaatgtacaaatagtaattttgatttatttatgaattttaaaaatcccaaatgtcttttcagggggttttaatctgggaaaataaggtattagattgaatcacatgaaactgctatttttgtaggccagaaagttcaaatatcagcaagttcatgtgattcaatctagtagttatgggagaatactacataatacttgctccattggcacagtgaatttttaaaatttaattatctactccctttaagtgaaagtagcaaattctgtatcaccttaggaagagttggattttttgatggtgtagcaaatggctcagcaaataaaaatgttaagtgaacacaggtggctggatatttcttggtgagtttagaagtgactatgaaatatggtatttctttgctgatagtcaatgtgttttttttttttttaaatctccaagtgttttttctcttatgagttaggaaattatgttgggtttattctcccttagtttacctagaagccttggacacaacaataataaagaagtagccctgtaagatacaatcatgtaacttttaatgctaaaagagacattattattattattattattattatttgctagagcccacctcaaacagatttctatgtaaaaatgagaaacaagagcattaagatggtttattacaggaagagtttttatagggcttgggtttcagtgagctcgcctgtgacaaagcaaattgatggcagtgataggctagtgatgtcattgtgatgtcagtcctcctgcttatcctgcacatgcttgctaatttggaacactttatgttgaactgtggtagaggaaacaagacagttctgtctgcagaagcccattatggctgtaactggagatgacacaggtaagaatgttaaagaggggttttcagttaattgtgcagattgttttgaagtttaggaagtattcaggaacatctgagtgtttcagaaagtgttactctcctagtcacttaggtgtaagactttttttgaaatatacatctatatattcagctcactttgttagggcatcttagtgtgattgtttctttgctcaatattctattgcttgcttgactgaggcactaatcctctcttcctccctctatcctccctcccctcctccccactcttcccctcctcttctcttcccctctcctccatctctgtgtctctctttcatatgcataccattctgccctactaaaataagctgttacttcataggcaacctgttgcaaattcaatctagccgcagattaaacatacagtatataccgttcatgttctgatttcattactgtggacaaatgcagctccaaacagaataggaaaaacccgcgtgttatggatgtttgtgtgcctacttgtttctttcctcctgtatttaaaatggtctgttcagctaattgagttcaaaaggctgatgtcattacatttcctggaatcgtatttcagcaggggaagtggaaaagttaaaactccaagcgagctgcacattgacgtcagctccgagtcatgttgtgatttagtcagttcctttccgctttgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctggtgagaaatggattatgtattgtataagctggcgggttctttactcttactccatcctcttactccatctataggaacttgcgattcagagctcctctagtgttcagtcagggaagtgcttgtcttttacttgttctcccagcctctggtatttaaatttgtaatcggtaatttttcactaggtttgcttttctcagtaacaaagagtgattttggaagacttagttactaataacctttgtgtgcttgcagtgttgtttattcagtggtcttgtttgtaatacagtactgaatttgcagttgaattaagagttttaaacaacttcactacaatttagctcttcgaagttaatgggtctcagccctctttgtggataggaacattggattgtcttgagtaagtaaaacctgtattacattgtttttaaaactgtcttgaggaactatttttttctcgaagttttgtgaagttctagagatgctatagactgcagaactcaaatgatgaatttattataagacatagatgaacttaaaatcatctcaaacactgcatgtcatatgattcttagaaccagaaggcacttttgtacatatattttctaaaaattattggttaatatctttctttaccaagcctttcattcctattacccctttgacttgtctaagcataagactcataacaaaaaataaataaaatgatgtgaaaacgctgtgtacttttttttttttttttttttttgagacggggtctcgctctgtcgcccaggctggagtgcagtggcgcgatcttggctcactgcaagctccgcctcccaggttcacgccattctcctgcctcagcctcctaagtagctgggactacaggcgcccgcctaattttttgtatttttaatagaggcggggtttcaccgtgttagccaggatggtctcgatttcctgacctcgtgatccgccctccttggcaatgctgtatacttttaaccactacatataaataaacaaacatttttgacatttgtttttacagaatgaacataacatccttgaaagtttttttcacagttttaccaataatgctacacatgattgattttccttttccaatttaaacttttcaaaatgctgaaactttaaaatgtcaaacaacttaaaacactttttcacaagacctgattttgcctttggaaatcatatttttaaaaatctggtcatttcttacagaatcagtgctatttgaaaaatgagtaataaattttatttcattttactttatttatttatttatttatttatttatttatttatttatttatttattttatgagacggagtctcgctctgtcgcccaggctggagtgcagtggctggatcttggctcactgcaagctcggcctcccgggttcacgccattctcctgcctcagcctcccgagtagctgggactacaggtgcccaccaccacgcccggctaattttgtttttttgtattttagtagagacggggtttcaccgtgttagccagaatggtctcgatctcctgacctcgtgatccgcctgcctcggcgtcccaaagtgctgggattacaggcgtgagccaccgcgctcggcctcattttactttatttttttaaagccagaagagcacagggttaagggacttttttgaaggtgtagtagagtagctttaggaaccagacctctgggctctcagttctgaggtaaccctatggatcggcagaccaagtagatctagattagtggcttgcaaacttttcaaccatgacccacgttaattatcacggcaaagtggacctatgtgtgtatgtaccctacatttatataaaacaagtttcagacataattcttatccttacaaaatatgatgtacccataattccttttctgtcctttttttaaaatgctattcttgacccatgaaatttgctttttgacccattaatggtctacagcttacagtttgaaaaactttgatctagaccaaaatcaggctcctagcactaatggctggcctggaaaagatattagcagcatttacctacaggatcatgaagtgaaatattaaaagcaaatgactggccgggcgcggtggctcacgtctgtaatcccagcactttgggaggccaaggcgggcggatcacaacctcaggagttcaagaccagcctggccaacatggtgaaaccccgtctctactaaaaatacaaaaattagccaggcgtggtggcacgcgcctgtaatctcagctactcgggaagctgaggcaagagaatggcttgaaaccgggaggcagagattgcaatgagccaacattgcaccactgcactccagcctgggtgacagaacgagactccatctcaaaaaaaaaaaaaaagtaaatgactatagtttatgggattatattattgattttgtggggcataatttacatttttattagaaattgcctttgttttattcataaactgattctgttaggagcataatttcctatcttttagactctgagtctgacgttgcattctgacgttgcattctggctggatttctgcattgtttaaaacaaactttccaacaaatttggaaaactagtgtcttagttaatatttgatgcatgagaataaggatatatatcacctttgtgaaaggaggctattagcaattatttttgcttaaaaatatttacataaaagaataatttcgaggctgggcgtggtggcttacgcctgtaatcccagcactttgggagaccgaggtgggctgatcacctgaggtcaggagttcaagaccagcctggccaacatggtgaaagcccatctccacaaaaatacaaaaattagccgggcgtggtggcatatgcctgtaatcccagctactcgggaggctgaggcggaagaatcacttgaacctgggaggtggaggttgcagtgagctgagatagtgccattgcactccagcctgggtgacagagcgagactccgtctcaacaacaacaaaaaagaataatttcatttaggtgtgacagcttcttgaagttggtaactgaacaagttataatcactttggaagtgaaaataacaaggcatttatctaccttaagattcagtaaaccaaatctgcagggtgaaattggaaattactcatgttattttcctactacttttgaaaaatgcataacgaaatgtaatttgggatatttatttcactttgccctgtttatatgaatatattaggcaaatatatttattcatttatattctaataaaatatactttgcatttatgtaaactttaaaataaaaaaatcacttaatgttacaaataaacatgaataccaactatagaaagtgctgtcaaagaaactatcagattgtgactgacacagaaacaggacatacaggttaagggatcaggtaggcctcactaggaaaccatgttcaaatgctaaaaaaggcagtttacaggcattctcactgatacatgcccaactacacccaggtcagactgggtaaatgacttccaagtttacaaagctagcaagtagtggacccgttcgagtcttcagaatcctcgggttctgctcatagcatattaatgtgactcctcaaaagtcacctgacattgacacatgaatgcagtgtcacgtgagtacatgctgctacacactgcttataaaacatataaaatgaggttaggttaatattattttaagtcgttaaaatggctttttttttttttttttttaagacagagtttcactcttgttgcccaggctggagtacagtggcgtgatcttggctcactgcaacctctgcctcccaggttcaagcgattcacctgcctcagcctcccaagtagctgagattacaagcacccaccaacacacccggctaattttgcatttttagtagagacagggtttcaccatttggtcaggctggtctcgaactcctgacctcaagcgatccacccgcctcagcctcccaaagtgctgggattacaggcatgagccaccacacccagcctaaaattgaattttttatagattattattactctcataggacagtagagcatatatttgctattatatggaacattaaatttcagtgttcgtaatttcccatcttttatatagactgacttatagattttcacatactgaactttaaaaggtcccttatgtataacttacttagctggattgtaataatttcataatgtatgcatatgtgaaagcatcacattatacactttgagtatatacagtttttgtcaattatacctcaaagctgaaaatattttggtgagttaattctatgtggtctatgtgttatagtgattgtagcaaatttgaaaatgatcagtgcttaaatagccatttttatgtagggtttaattttcacagagaagggaacgtttttggcagtgtgggataccaggcatggaggtgtaggatctgggtattaggagcaggtggtggtagacaggaagagaaccacagcagtggtggtgatgtcagcagcttaccagagctagggatagaagccccccacttagaagtgtgacatctaagttaacctctgctgcttacttaaaggtgtatttaggattagtgccatgctgtgaaatggcatatgaaaacaggaactctctatataaaaatgttttttattcagtctttgtgctcagtactacagatatcttaataaacaattgaataaaatcaccatcatttggggtgttgagaaatcgtttcactttggaagttaccaacataggtacttggctgggtttcttatttatttctttgtttcctactctcacttgtgggtttttttttcagttttcttcttcccagtctgatgagagtatatctttggccatttggggttctattataaatgattgcatacattgaaaaggatatcttacattatctttaatgtattctctaaaggaatataacgatatataattttataagtttttaataggcatattttttaacaaaataaggaataagagccataaatttggattccctgggtttgtcagaagggaaactccagggggaaatgtatttatggatgttatatgcgttttaactaatatacggtataagcataacttggaacgttgtctttcagaacttaaggaggggaagaggaagggaactaacatttgtggagtgcctgccatgtgccaggcactgtgctagacactttgacatacattgtagggtttattgtgagtattaaatgagatactgtatccccattttacagatgaggaaactgaacttgccccaagtcacatggctggtaagtggcagagctggactagaacccagactccaaaccccatgctttttctgctgtaccgtgtttaaagcttgcaaagagagatatgtagttaatgaccaaaattgagagttctaggaattttcttttcccatgaaatatttgatactgaacctaaaaaaaaaaaaatgctttcatgtcaggagctagatggaagcacatcataatgagaacgcctttgcttttaaaatgctatgttagacttatctaaagtgcatctaaggaaaatttaagaaataatgccttttatcaagaaaggccactttgaagagacacatcgcatcttgtagggctttccatgtcttagaggtaaaggtttagctataataatgtaagtttataagaaagactgcttattttaagcattctaaatgacagcaggcttgtgcaaaacccgaggaagttcaaattttacttcatacagcacacattaactcatgaaacacccattatatgccaagtatgtgctagattctaggggtttctggggttaaaaagatactatccctgatttgtcttaaagtttttgctttcctgagaataaagttagtgtacaaatatcttataatctttcttcaatcatgattgttaattccccactgataacccatatattttcaaaatatgaaaattctagaataaaaagtaatttagacactttcagtagttaaatgggacaggaagtggcctttataagaatacaggaatagcagtgtgtcatcagagaatgcaggatggtctttgaactgtgatccttggtgtcttatctgctttaaatttccactgagttcataatattggaaatttgaagctaactaagataaatactttttataacttgttttaaaattaaaacttgtgacatttagattttctcaaaacaagagattatctttgtatctttatttttttaagagacaaggtcttgctatgttgcccaggctggacttgaactcctgggctcaagtgatcctcatgcctcagcctctgaaggagctgagattacaggcatgagccactgtgcacagctgtctttgcccatatctttttaaatgtactttactaataagattatatttgagtatatggaatttgtccatcgaccattagaagtataccaccatatagatcctttgggatattatagaaatttatacaaattcctactaatttatactaactcctgtttctggcttgaactaatgcgcttgtcattttgattttattgagggaagtaaaatgaatatatgatacctctgaaaaattataataaaacccagtcacctaacatctcagaactaatacatctgaatatatcatccccttccaagttattttaaagtggtatttttttctgagctatcgctcaaaatgtttttaagaattcttattttggaactgccattatctttcatggtgccaaatttggtcccttgagggtggttgttgcttctggaaacaggcaagagttgtttggaagcatttctgataaatacaaggccaatgaatgaacgtctttttttgcttttttcctttttttttttcctgagacagggtcttactctgtcgctcaggctggagtgcagtagcataataacggctcactgtagcctcaacctcctgggctcacatgatcttcccacctaaggctctggaaccacagacgcacgccaccacacctggttaatttttgtatgtcttgtagagatcaggtttctccatgttgcccaggctggtcttgaactcctggactcaagtgaacctcctaccttggccttccaaaatgctgggattataggcgtgagccaccatgtctgcccttgaacttcattgttcacctgtgactattcccacccaccctttttttaaaaaaacaagttttttgtggccgggcgcagtggctcacgcctgtgatcccagcactttgggaggctgaggcaggtagatcacgaggttaggagttcgagaccagcctggccagaatggtgaaatctcatctctactaaacatacaaaaattagctgggagcggtggtgggcgtctgtaatcccagcaacttggaaggctgaggcaggagaatggcttcaacctgcgaggcggaggttgcagtgagccgagattgtgccactgcactctatcctgggtggcagcgtgagactctgtctcaaaataaaaataaaaagtaaaaagtttttttttttgttttttgtttttttttaaactagcttttgtatatatcatggaaccatcctgctctaacttcatattacaagaaaacagcaaacgtctacagaactagagtgtaatgagcccctctctacccattaattttactacacgtctgtgtgagcagtgtttggaaagaatgatcctagaccaaggtccatatccatgctgcctgcatgtgtcaacctggtgtcatgtaaacttctcattcgtcactggctattgttccaattttagaagacctaggtgaccaccagctgttctattgtttcagcctttattaccccataaccttcttccctggatgtgggtgaagagaaaaaagaggagagctatgttattctctgctccactccatctcttctgacaatacgatgaagatatgttaaacaatctattaagttagtttataactggcttaacgtgaccttgttaactatctcaaagctatacagttttgtacgactcattgagttgtctgtgtatacattattttgtatagtcacaaaaacaaatttaggacttttcccaagtttattcatatgctggtgatcattaatcacaattaggccaggcacagtggctcacgcctgtaatctcagcactttgggaggccaaggcaggcagatcacgaggtcgggagatcaagaccatcctgggcaacatggtgaaaccctgtttctactaaaaatacaaaaattagctgggcatgatggcgcgtgcctgtaatcccagctactcgggaggctgaggcaagagaatcacttgaaccagggagtagaaggttgcagtaagccaagattgcaccagtgcgctccagcctggtgtcagcaaaactacgtctcaaaaaaaaaaaaaaaaaaaaatcaattattccctatcaccaatgttttaaaattacatgtagaaggaaaaggcagtacaaccttataaacaatatttttattaattctatgaaaatctttaagtgagcttccttgaaagccatgtttttaactgttgtattctttcacctaattctcaagccttagaaggcagaaatctggcatatacccaaatagaagcacataaatcagttaatctttgtttaacttttttaaacaaagtttcagtgataatatcctatttagctgacaaagtatttgtctcccatgggtagcatttcacttcttattcattgggtataatacattttcatgaaatacagaaatgctgtgttttcctcttttgattggaatttagttcaggcaattgttatagaatttgataactttttaaaaaatcttttttcttgcacttagctttgagagagcatgtattttgtaatgtctcatcagagtgacaaactaactctggaccatacgttctcaatgttgaagcgttggtggtagaaatgttttatcactcgaatccatctgtcttttctaggaagctatgtttcttgcagtagacaaattttgaatataaattaggaaactttgagaacttacttttagtatttgatctgaatactaagtaaatattaaacgctgtattttaactgtatgattatactatgcttagacaatacttttaaatgaatatttacaaatgtattattttcctagaaacctaagaaagaaaaattatctttccccagagaaactaggtttaagcagagctttgctgggtttttattgttgttttttgttttttttactgaaactgcagtgagctcaattccttccagtgcttcagtgattttctagtaatgagaattgcacttaaagacattcagtgactgtttcaggcatgatatggagtataggaaaatctctaaactgaaacattcagaggatggagatattctgcttaatggaaatttttgcagtggtgtgctacagtcagctcctcctggcttgctagagcctattattaaattttcaggccgggcgtggtggctcacgcctgtaatcccaacactttgcgaggttgaggcaggcagatcacttgaggtcaggagttcaagaccagcctggccaacatggcaaaacaccatctctactaaaaatacaaaattagccaggtgtcgtggtgcacgcctgtaatcccagctacttgggaggctgaggtacaagaatcgcttgaactggggaggtggaggttacagtgagccaagattacaccactgcactccagcctggagccacttagtgagactctgtctaaaaaaaaaagccaggcgcgatggctcacacctgtaatcccagcactttgggaggccaaggtgggaggatcacgaggtcaggagattgagaccatcctggctaacacggtgaaaccccgtctctactaaaaatacaaaaaattagccaggcgtggtggcaggcgcctgtagtcccagctactcgggaggctgaggcaggagaatggcatgaacccaggaggcggagcttgcagtgagccaagatcgcgccactgcactccagcctgggcgacagagcgagactccgtctcaaaaaaaaaaaaatatgtgtgtgtataaatatgtatatatatacatgcatatatatatgcatatatacatacacatacacaatttacacattaaaaacattagtactcaaaactcataatttccaagtattttctctgtgctctgtgggtattggcatctgttttgtctgtatgctgtgctgcttaccacgtgtgtgtctttccaactctacgctcaggaaagtcaccttggtagcttgaaactggccatggtggaagtatttacatcgtgagaattactgaacactacacatcagggctttttcattgttttgtcctgaggactgtttcttaaatatttattagcacaccactgactttaagctaaatgagcatcttaagcttttgcctttgataaaaacctgtctaaaatgcattaggatgcttttctaccttaagtgtttagagcatgctaaatatcattgttctaagtgctgaagaagatctttaatacttgagattgctataatgctcagaataattatcttaaacattacaagatcacctcttatgagatgtcaaaagtatatcatttccagatcagttttatgtaaaatgccaaattatgaattctttatataagctcaaaatattttgttttactgcagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacaggtgaggtgttgcacagggaatcggtaacttctaggacactttttaaaaattacagttttcaccgggcgcagtggctcacgcctgtaatcccagcactttgggaggccaaggcaggcggatcacagggtcaggagatcaagaccatcctggctaacacggtgaaaccccatctctactaaaaaatacaaaaaaattcgccgggcgtggtggcaggtgcctgtagtcccagccacttgggaggctgaggcaggacaatggcatgaacctgggaggcggaggttgcagtgagccaagatcgtgccactgcactccagcctgggcgacagagcgagactccatctcaaaaaaataataaaacaatattaaatattaataaatgataataaaataatgataaaaataatatcaataaataaaaataaaaataaaaattacagttttcagctgggcgcagtggctcccgcctgtaatcccagcactttgggaggtcaaggcgggcagatcacaaggtcaagagattgagaccatcctggccaatatgacgaaaccctgtctctactaaaaatacaaaaattagctgggtgtggtggtgtgcacctgtaatcccagctactcgggaggctgaggcaagagaatcacttgaacccggaaggcggagcttgcagtgagctgaggtcgcgccactggactgcagcctgggtgacagtgagactccgtcttaaaaaaaaaaaattacagttttcataagccatttctcccaagttacatgttgtgtggcatttcatgtaggtttgtgctctgtgtgtgttattagattgtcttccagtcagaattcctggctgttaaactatttcatcagcaggagttacatccctatgttgtaagggtgatgtccaaaagatacagtaatttttaaaaataatgattaaaggactttgttagaaacaaagagctattttgtatttagtatttgctgtgaagtaggtgataagtcgaattttttagcttctctctgagaaaaatgaagtgtaagtgaggcgttacttttcgacattttctacatgtagtttccttttgtctattttttaactttttttcctctattacactgaaatacatatttaatctgataaattctagtcaagtgcaaatacaaaataacaaaaagaattaaaatcatccatggctctaaccacttaggatacctcctattatagtctatgtacttccagtcagctctcattttctctcactttttcttgctccatatctctgtcattttatttttaagcaacatattataaaatgctattttctaaaactttttaaaaatttaaacataaataaaattttatttaacttgtatattatttattggtttagtttttattatgaataatggtgcaaattaatctgattttcaaaaggaacagaattgtcttagagtttcccagtagtcttgtcaccttagtcctaatgtcaaataatgtcctcattgtgtgcagccaggacagagattcagcagtgttatcaagggcccagactcccgctcccggctgtgtcatcttcagcatgtatcattcattctcatgatcacagcgcggctactgaacctctaggcattgcctcagacaggaagaagggctagagccaaaaattggggctagctgaggtctggcccaactgcaaacctttcctggaagatcctcccagcaactttcacctacatttcattggctagaaataggtctttagtccctagctgtacaggattctgagaaaggtttattttcgctttctaaatctcagtttcagagcaagacaagagaaatgcagatgatacctggctgttaggttgctcattatctgtttagcagattttaagtgctttatttctactgtgtgtttaatgcttacatgagaataggtgattattatgcccagtttacagatgaggaccagaagttcagagatgttaaggaataagttggtcaagatcacatggcccaaactgggcagaaccaggatgggcaaccgggcagtctttattccagagcctgtcctctataccagcatcaggcatctcaaaaataccccatgataacctgcaaatttcacttcctggggaagtgtgaggctttagtcattcacagatagatctcttacatattttctttttattctttgattggcatctataatcgatatctcattatatcgtatttctgccaatccagcaacagtttttatttctttccagccttgtcagagtttcttccttgccttgcacttcctctccgtgctgaggatacacccagacacatgcaagcctgaaaaccgagctcactattaatagaagaaacaggtgttttccatggctgaggagtgcttaggaatgtaccatctactgatgtgatcggggaaagctttgtgcctgcaacattttgactctagtaatatgtgtgtctgtgcatgcacacacacacatgcacactcaaatgtagaagatgaagtatgagtatttataatagcttattaaagaaaatgtttaaacacccgcaacaccgctattaggtctttaaatttttcatttaatggtaaccatgttttgtaaaatgactatcttccttctaggtctagaatttaatataatttaatcatgaaaacgttggtattcataaatgaatttcagtgcctttgtggaaaagagttaaattatgtccccaaattggcaaatgtgtgtgtttggatttattcttaacttttccaattgcatcatttagattaaattagtcactataacattcttttcaattttacattttaaatttcttttgttaaccagctgagaagtctgagaactttgtatgttcacagggtgagtccattgttcctggctaggaagcaggggttgatcttttcctgcagttcatttggattgaaggttcttctttgctgactcttgcttccatagtgaaaacacagatatccactcagtgagagtcagctatcttaaaaaaaaaaaaaaaatcatgtatacatcacatgtggttcaggatgctagctggcattacagaaactggtgtttagacattcaacactgctttttttaacatatttgaatgatagtgtctgtttcagtgcaggcttttttgacatgaagggtgatctacctcaaaggcagttattctggaattgaatcctccaaaatgaggccaattaaagggtgtcttctacataggagttaagggaagtggttgccatccctcccaccctgaaaaaaagaaaaagagaaaatgttggctctatttattgttttggtggggttatgtatgaaaatgactaagtcaactcatctgtttgtgttgttgctttggctactggtctgttctttcattttgggcttatagtgctttaaaattcaatatattggatattaaatgcatgtgattaggaaacagtcttgaaatatgcccagagttactcagtagcttcttttttataattttaattgtggtggtctcacatttgtgggtttaaattgtctgagttattgagtgttgtattttgtagcccccttctttaattttcagaagcactgtccatttcatttcggtttataaaaatgcacatcttttgtttattgttatgatttatccatgtgtgttttctagccaataaactgtgtcttgcagtcatgattgatcttgttttactgagatttagttttgaagactaaaaatctccagtgttgatatttaaggtttttgaggattaattcttataatcatttttgatcgaataaaattaactcattatgtcggagtatgtgccttttgggagacaaaaataattaagagaattgaaaggatctataaatgtgtttgtagaaattccacttggggatgtggtcctattgtagtttactgaaaacagttgtgggcattgttaccagtggaatgtgtgccctaagaaaacaccatttgtgatgaatgctgggcgaactgtgttctcaaatcattcctgttgtctaatggttatcttacaaaaagcatgtgcctggttatgtttgttatgtggctttgtacagtccttacctaggatcgattggctgttgagttcggggggcagaagtgcactgacccactgtggattgtgttggaaggctgttcctgtagtcatttgccttgtgttgcttccagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccaca

SEQ ID NO: 289 - DNA, 85502 bp, Homo sapiens; identical to SEQ ID NO: 288

SEQ ID NO: 290 - DNA, 75177 bp, Homo sapiens
gataaataaagaaaacaggaaaggaggaaagcattgattacaaatatcttaacaatgagcaaatgtgcaaggaaaaaatatattaagacaaatccaaggtaggtagatgtacgtttttctgttcttttgaaaattctacttagcttaaagttcatgatgaataaattgatatatagatgtacacatacatgtatgtatgtatatatattctattataatatatactcaaattattcagccattcacttaaggcaccatctactgtgtaccatgctgggcactgtaggagatgtgtcggtatgtcagttgacttatgctaagtactagtcttttcgtttagaaagtagaccaatatgaggatgtcgatagttaagtggaattgtagaattcgaagaatccccagggttttattcttcctcccggcctttcggccatacttgtacttaaccttataaaacagaagaaagtctctaccaacgttttaaaaatatccaaatagaatttttcaagttttcttttgattactttcagagacattctgtttcgttagttggatgtagtcctaaagagaaaattgattttccactttttgtaaagttatttaaaataatagaaacaactttaataacttccttttccaattggattctatttttagaagagatgaaaaattttttcaagggtagtgcacttcctctgcaatgtaatttgtctttgaaaattggatacaactaaaattttagaatttttttttttttttttttggagacagagtctcactgttacccaggctggtgtgcaatggcacaatcttggctcagtgcaacctctgcctcccaggttcaagggattctcctgcctcagccacctgagtagctgggattacagggtgccaccatacccggctaatttttttaattttatattaaaacaatttattactaaaaaaaattttttttaggccgggtgcagtggcttaatctgtaatcccagcactttgagaggccaaggtaggagaattgcttgaggccaggtgttaaagaccagcctggggaaaaaaaaagagaaaagggaagaagaccagcctgggtaacatagcaagatcctgtctcttagaaaaaaaattgttttaatggagggtcctattttttaaaaaaacaatagatatattaatattttattaatttggatcccagtatattcaaaacaggttgggataatatttgcttttctatcaaagtttgctaaataatataaaggagatttcagagaaatatttaacttcaaaagaaaataatcctgctattattagttgtttgtaaatttaaatatctccattttagcaattttttttttttttgagacacagtgtcactgtgtccaggctggattgtagtggcacaatcttggctcactgcaacctctgtctccaaggttcaagtgattcttgtgcctcagcctccgagtagctgggattataggtgcgtgccgccacacccagctaatttttgtattattagtagagatggagtttcaccatattgaccaagctggcctcaaactcctgacctcaggtgatccacctgcctagccctcccaaagtgctgggattacaggcatgagccaccatgcccagccaccattttagcaaatttttacctgttttttagaattgtggaaccaaatatttgccagtattttgcttgttgttaatttatagtgcttagtggacttgtttgttttcgtttttattgttttatccttacatgtttttatttttaattattttgtaattcataattgcccattggttcttttctctctaaaaaggattattgtttaagattaaaatactacatagttaattaaagactattagttttagtacaactatgtttatttaatattatcacaactatgtttaatacagaaggtgagatttgggaaaatatgttctatgagacatctcttcaattttaatgtatttagctataaattatatagtgaataatgtaagattataatggactctataaattctatctggagcagctgtggctgatttatagatgttaatgttgtatgtacatcatttacagctgagtttggggtcctgcatttctgctgagatagtgcctgaaaaatgcctggtacagtgcttgacccatgttgagcactgaaatgttagttgaatcttctgcactgagtcctgtataggagttgggttttagtgggtttaggaggttgtactggagggcataaatctgcagatttggatataaatctgcagaataaactggcttgaaatagcatatctattttaaattgctagtgttgaccttttttgtagatgatttttaccttcaaaaaaataattttagtatcaaacttgtactaaacggcatgaactgaacaccgtgctaggtactctggcagaatacaaatggaataaaattacagtccatacatttggtatgaaagagaaagcatatctgagtgagattgcgacaacaattgcagcatactccaaaacacatcatcatcgtaaaatgttgtccaaactgtaattcgcagggcactggctgtggaaggaaccctggagtcacagtcacaacacctctttttcatccctcatcatgctacctattatgttccctgtaaaagtcccttaatctctctgaacgttatttttattattataataacacctgacagttgcacagtcttccaggataattgattaattggtttatttagcatatactgtactaggcactgggaatgcatggaaatctataagatgggatccctgtccctgagttgctcacgctggtgtgtgaatacatgtattatatgctacacaagtgttataacagacttgtaaatgctttgggaactcaaaagagaataactaattctgcccatggctattagaataggcctttgaaagttggtgtcctcgaaccaggccttgacagactagtgagaatttgccagttggacaaagaagggtaaagggcatttcaggaagaggggagattagatgtaaaagattaaaactgggagagtaagatatgtacttgaaaaaatgtctgattaggaggctggcatgcagcgtgttggaaagagtagagggactggagataaggctgtaggactaaaatgggtcacattgtgaaagagattgaatggcagtgtggtttagtaatggagtgtatggactttggaaaaagaccttggttgaaaacctggctatgccacttaatacgttcatggtaagatcaaattcttaacctccctgagtctccttttccttatttctaaaagaagaactaattattttttattttttgagacagtctcactctgttgcccaggctggaagaactgatgatagtgatcttatagagttgttaatcaaaactaccaggcacttaccacatggtaaactctcaataaatgatggttatagttatgagaattagaagtttggattttatcctgtagtcaataggaagctactgaagagttttaagcaaagaagtattttaagcagaaatacatgttttagaaacataactattggcatggattggagccaggagttagagtggtggctgtggaaaggtagagaaggagacttaattgttctttagaaggtagaatcatcatacctggtgatgatgctgtgtggaatgacagagagggagtttcaggggtttctggcttgaacaactcgttggatgatggggtcccatttcctgagatagggaactcgggtagaaagtttgtggaggaagaagaggagtttagttctggacccactgattttgaggttcctgcaggacatgtgtttggagatgttaaacagggatttgcatattggattttggaattgagaagagacgtctggcctagagtcatgggtttaaatctggcacttgaatccagagaaacagaccatatgaagtagggagagatttgagagtgaggcaagaaagctaagcagagtcccgaagacatgccatgttgaagattaacattgaggaagagaaggaattgtcaggggagcttgtggaggaattgtcagcgaatcagatgagaagaggaaaatgtagtatcagaacgctgagacagtgttcaagaaggaagatgttgtcaacggtttgaatgctgctgagggatcaaacaaaaggtaggacttaaaatgtacgttggatttagtgacagagattagttaccatttctagagacgttttagaggtagaaacctctctaaacttgggggtatctaggagtatgtgggatgtgaagtaacggagatagtagtgttggcaattctttcaaatatttcagcagtgagaaggggaagagaggttcaagggaatagctcgagagatttctgatccagtggatttgtggctatgtgtataagttgtgagatgggagagacgtgaatgtgtttaagtctttacaggaaaaaactgttagagggggagagaataattgatagtataatcccctggggcatgggctccaaacaacagatacaggtattttaagagtagggaggaggcaggaggcaagggaacatggtgagtgtagatgtcaatagctttgttgatttggttgtgggaagttgatggagttctcattagagacaggaggcaagggctttcattgaatgcagtcagtatagaaacgcagggattgagaagagggagaacatttgaaacagttgttgagaatgggagagtagtaagccaaggaggcaaactccatcagtttgccgcccatttgaggttgaaaaccaagaatttaatagctatatttatatttttagagatggggtcttgctctgtcacccaggctggagtgcagtggcacgattatggcgcactgcagtcttgacctcctgagctcaagtgatccttccatctcaccctcctgagtagctgggactacaggtgcccatcactacgcccagctaacttttttgttttctatgtggagacggggtctcactatgttgcccagtctggtctcaaactcctaggctcatgtgatccttctgccttggccccccagagtgttgggattacaggcgtgagcccctgtgcttggcctcaatagcttattctgtcttataatttcattcagtattgttcatctgccttggtgcaggcatagaggagatgaagagttggttttatccaagattggtacttactaagaatatacagcaatggcacaatcttggcttactgcaacctccaactcccaggttcaagcaattctcctgcctccacctcccaagtagctgggattacaggcgcctgccaccacacctggctaatttttgtatttttagtagagacggggtttcaccatgttggccaggctggtctttaactcttgacctcgtgatctgcctgccttggcctcccaaagtgctgggattacagacgtgagccaccgtgccgggctgggaaacagtaattaaaatgagaagccatgttagctgaatagggtgggaagtgaagaaagggggaggcagatgggcagagagaaagtggtgtggagatctcagtgtgttggaataacaagtgtgatgggagtggtcaagggagagggtaagatgggaggataggatgttgtaggcagagtggaatgttggaattaattttttcagagctggaccaatttgcacattggcaatgtccagggtgtggccagacactccagtagatagctgaagtggcataaagtaagtcattgatctgaggcatctgggtaagggataggtcttcttttgagtgttgaacatagacagaatggtgaagaggaaagcttttacatcaggggccagagtcttcagtttacatcctggaggtgagtagatgattatcttatggatgggttcaggatggtacacctgatgaccttgagcctcagttgaacaagggtttttacgagggagtaaaggaggtacaggtgggaagcaacagtggggaacaaagcagatggccagtcaacatgctgaccttgattgggtgtgggaagatgagcagtactctcttgagaggacagcagagaggctttgggagttccagatagcatattgctggaatttggaaggagaacaggagtgagggattgtattatggagggaaaggaagcactagttatgagagtgaagatgaaatatggaaggagcttatatcttagtgatttgagtgtgattctggcatgggtgcaggggcattgaagtttagttgtggcttaggaaaaggcccattgtctgtgatttattgtcttcagagtggatagcagcaactgtgtggaacagcagctcaactgctttgtccagtgtggtgatgggaggttacagtggacagtgcccagtgctaaattatggtaaggaggaggagttgggatggctgctgaccttccatctctgcctttctccctaaggctcaacgcctcatggtatcctgactgatgtttagctttgtggggttgctttttgtggttgatctcattctgactgattatatatagacacacgattctagctttggagcctgaatggatgatgatactcttgactaaaagaagaaataaaagagaggggtcaggtgtccatgaaaaccccaggttgagatgctcagtaggagggaggtgtgtgtaaatacagatttgggagccatctgcatataggattgaagaaaccatagtattcatagtattggaaaattctgtagtattgacaaagggaaaagggcaaaggactgaactctctgggaaatgcccccagagaaaaatggaccagttaagatgattgcatgagatggtacgttatcaagacattttcatgtataaaacattttgaaatctgtcttttatcatatctcaaaaattgaggcctgaatagtttatctttttaatcattaaaactttttttttttttgatgggagacttcttggattctacagtgtgtacccctctgtccttaaagtatactgaacataattagcctttttttcatgactcaggatagttattataaatatcagttattgagttgtaacttccaggctgggcatggtggccatgcctgtaatcctagcactttgggagactgaagcgggctgatcacttgaggccaggagttggagaccagcctggccaacatggttaaaccccgtgtctactaaaaataaaaaaaattagccgggtgtggtggcgcgtgcctgtaatcccagatacttgagaggctgaggcgggagaatcgcttgaacccaggaggcggaggttgcagtgagtccagatcgcgccactgcactccagcctgggtgacagagcaagacactgtctcaaaaaaaaaaaaaaaaaaaaggtattattcctaatttaattccatgcagcctttccagccctatttgtaccagtcctactctgtctcttccccactaaatctaattatccccctttccctcacccagattttctactccaatcacctattctgtttcccagatatcctctgtactttcctccctctcatagtcgacctgtcctttctacctggtgaaatcctactcacccttcaatatacgactcatatgaccacattctctggcagacttggtcattctcttatgttttccagagcatttcatggatcacatatatcacatgattcaagaaattacggccagttgcaatggctcacgcctagtaatcccagcactttgggaggccaaggcaggcagatcacctgaggtcaggagttgaagaccagcgtggccaacatggcgaaaccccgtctcttctaaaaatacaaaatagctgggcatgggggcatgcgtcagtaatcccagctacgtgggaggctaaggccagagaactgctggaacctgggaggcagaggttgcagtgagccgagatgcctctgcactccagcctgggttgacagagtgagactctgcctcaaaaaaaaaaaaaaaaaaaaaaagaaattactttacttgtgatttactttaattactgacctgccaataaactgtgtttctcaaattttagtacatattggaattgtttgcatataagaagttaaattctcaagaaagtttgattcactaggtttggggttgagcctaagcttctgcattttttacaacaaatacttctcgttaattctgatgcgagttgtccaaggaccataatttgagaaaccaacaaccatgtagttaatggattccatcagggcaagggccatgacttatctgcttttgtattttcagggcctgccatgtagactatgctaaatgaatgtttctagaatgaaatatagtttactggggaaggcctttcggcatataatttttgagttgagacccaagttgttgcagaatcttaagaaaggttttgcctttcaaaggtgtaaaaaatagcacaagacaacatttcccaggtggtttccaaaatactcctgctagggcatgctttgtgggaaaagggtttgtttggtagtcagatacttttagaaaatgctgtctgttggacctgtgcccttcacccttctcaagacacactagcagattgaagcttttgagatgttctgtgggaaagaaacccttttaatctttaaaacgttttgacaaagcattttccctaccctttttccccagataatgcctttttagaacctgcagaactaatgtcctgaggtattttctttggaaactgctcacataaccaaaagtataacagtaggaattaacacttcatgtgtgatgatgacctataattacctagaattggagaggccactctgggaagttataagaaaagagataaaggattaggcaatattaagggaaagacatttttctatggtaggctcgacgtttgtattttggtataattgctctaaattgtcctggtcagttataagtattaaaataactgtagtatagatgatagcagacaggtttgagcatggaaggattggatttgggtaacggctactggaatgcaaaaggcagtaggaagtcaaagacagtagatgaaggatctgtagaatctggtaactaattaaatctggaaaaacaacttggatgttttaattcaaagatctaagtggtctatatactttttggatgtatagttagactaaggtgaaaaagaaacattgtattattgacagctgaaaagatgtgtaacagcagggagtagtttctataagttttttgggtttttttttttttttttttttttttttaagacggagtctcgctctgtcgcccaggctggagtccactggcgcaatctcggctcactgcaagctctgcctcctgggttcacgccattctcctgcctcagcctcccgagtagctgggactacaggcgcctaccacggtggcgcccggctaatttttcgtatttttagtagagacggggtttcaccgtgttagccaggatggtctcgatctcctgacctggtgatccgcccgcctcagcctcccaaagtgctgggattacagacgtgagccaccgtgcccggcctctataggtttttaaattttagttttgtttattttgtttatattttaacaggataaaatttattataatatagtttgccttctaaaaagagtccatatagaaatcactaacttaaactgaattcatacacaaacttcaaatcacatcagaagtttttcctggaaaaattaggtcctcttttttcaataattggggcttgtttatcagaaacgacttagtgataacaaagcaagacacatttttgtattattatacatttaatttagacgatggggaaattccttcacactacctcataacataaagcaggtttattaggccttaagaatcatagaatatttatacttttcatgtaaaatagaaaacctaattttccagccattcatgctaaacagcagggttaaagtaatgatcaggaagactttatacgttttaaaataaggtagttttcatgagacattttgcagtgctcccttggtaatgttcatattcagtgagcagaaaagaaaagatgagagagttaggactctactattgaacctgtttcttgaagaaaacaaaaaccagatagtacaattggatgtcagaaatgattattagaaagctaggtaaaaacagtacaggttgagtatcccttatctgaaatgcttgggaccagaattgtttcagaatttggaattttttggattttagaatattcgcatatacatatgagttaccttggggatgagagccaggtctagacacgagattcatttatgtttcatatacaccttatagtctaaaggtaattttatacaatatttttaatgattttgtacaggatacaaagttttgagccatagcatgaggtcacatgtggaattttccttttgtggcatcatgtaaatgctcagaaagtttcagattttggagcatttcagattttggatttttggattagggatgttcaacctgtatttccaaatacttaagatagggccttaatttgtcttcctttttattgtcttttcagacaaatgaccatggaaacagttgaatcccagcatgatggaagtataacagcttctttgacagagagcaagtctgctcatgtgcagactcagactggccaaaattcaatccctgctttagctcaggtaggcaataggcaggcaccgttgaaagtcaaaatatatggaaatgagaattaggtgcagattctgttttcttgccattgatcttaaattttccatgttccctggttatcagccattcttgcttatttgattgtgaagaaaagatacgtgttgtaattagccttgcattttaacagacattcagcagtgccccatctccattgccaccaccactatggaaggaaaaacaaaaacccttcctgaatatgtaatcctcaaagtatgatttgagagggttgctaattcgaaattgatacagttctgatgtccttagctgttaagatgacagaaatcttaccattttccccgtatatatttgtcttaatcattactttcttttcagttaggtctcgaactttgaattggtttcattcagaggtcaccagtatcagttagtacctgtttctagatcctaaaatttatttctgagatatctattaaaaatatagtaaaaataaacacatttgttagttcatcaaatatttattgaatgtctgctgtgtctaattattccggatgcatgtggatatgtagtttcaggacttaaatatcccatggtttggtagggtagacagatattttagcaataattccagtagggtaagaagtgctgtaagatactatgtagaaaatgaataaggcctacagaagagggagcagccagctgactaggagtgctttatatatctcctttgagctaggcacaaaggatgagtaggagtctgccaggttgataaggtgaggaagcatattctaggcagagcgaagagtgtgcacagaggcacagagccagagcatgggatgttcagggaactatgggtattgagtttaactggagccaggtgtctgggctgggcagtccagctggtaaaggtaagtagaggatcgtatacatttcagggtttagagtacactgtactctaaatagtattgaaatattttcaggtgcccaccgtattttcagttttgacactagtagccatgtggaggtggaattgaaagtcagtgagtcggaactgaagacaccatcagggtgcctggtggagtcaaagtagcgtgagatacagagcagtggtgagacctttgtggtacattaaagggagaataaaaaggacctggtggttgactggaaggcccaggggaaacaccaggcacttcttgggttatattaggccagactggtgtgagagctctcctttcctgtgcacccagcctgcttttctttcctctttaaagctgccaacacccactcgttccctgcaggttttctgcggtattctgtagagctgtatctccctagcaacaccttttgttacactgagagacaggcatttaggttaggccaggccttttgcttaaacacacacacacacacacacacacacacacacacacacacacacacacacccttgttaaaaaaaatgcatgttcattgtagaaaataaatattaaaatgaagaatataaaaactatccataatcttaacatccagagatttaatcattgttaacattttggtgtagctcctttagtctttttgtctgtgtgaatagaatagaaagcatatactttttctcatgattttgggattttccagaatctttagagctatggtttctggtcagtaattctgccctttgctgaagttgtagttgaaagcactttcttttttttttggtagagacaagttctcactatattgcccaggctggtctcaaactcctgtgctgaagcagtccttgcacctcagcttcccaaagtgctggaattacaggtgtgagcttcttgtacccagcctgaaagtacattttcttccttctgactctacttccttctaggtgggtcccggctcactaagttctacagatgccttttgccccagaattctggggctgaagtcccagcaatagatttccattatctaaatatggtaatttgcaattctgaggaccttcaggctgggcgacagccacctctgtgagcctcactcagaaattgccaacaggtggccaggtgcagtggctcatatctgtaatcccagtactttgggaggccaaagcaggtggatcgcttgaggccaggagtccgagaccagcctggccaacatgaagaaaccctgtctctactaaaaatacaaaactaggtggttatggtggcacacgcctgtagtcgcagctgctcgggaggctgaggcacgagaatcacttgaacccaggaggctgaggttgcagtgagccaagttggagccacttcactccggcctgggtgacagagtgagaccctgtctcaaaaaaaaaaagtgttgccaacaggttaagtaatgtggagtctgaaaagtagtcttaggtttctgagggcttgaaagtgttgccaacaggttaagtaatgtggagtctgaaaagtagtcttaggtttctgagggcttggaattgaataggagaccagtggacagaaactaggttttagtaggttatagaataagtaagaggaggggaagtggaagttggaagtatagactcttttaagaaatttgtcttgaactaatagagaaagatgggtttgtgaaacaaaggggtgagaactgggatgtgagaaatttgggaatgttttgaataaaatggaacattatagagacttgtgagaaggcagaatcaaggaactagaaaaagcctgtgtttacgtttgtaatgcttctttaaaaatctcaaataatgttgtatgctaataaatattgatagttattaaatctggatagtaaattcttggagttttgctgtttttctattttatattgttagaagtatttttttgttgttgtttttgttttgtttcgttttgtttttttgagacagagtctcactatgtcacccaagctggaatgcagtggtgcaatctcggctcactgcaacctctgctcactgcatcctccacctcccgggttccaatgattattatgcctcagcctcccgagtagctgggattacaggcatgtgccaccacgcccaactgatttttgtgtttttagtagagagggttatgccatgttggccaggctggttttgaactcctgacctcaagcagtccacctgctttgatctcctgaagtgctgggattactggtgtgagccactgcacctggcctgtttgaagtatttgatcaaactgaaactatggtttttatctttcacatgctagaaatatagagattaagaagtaatctgtatgccgacttatggattattttagttaactaagaattatcctccatgccatgcatggatcatgattttttgaagaattagaagacaattcttagcagtcagaattttctgaacataattactcattaaagttcttgtgacaccagcagctgttcgtttatgagtattgttactatcatacaatagtatatgtcttacaaggagtaggaaatcaagctgaactctattaaccctatgatgtatgccaaaagtgactgactcttctgaatttctgatggcttcatatttacttgccacttgtctcatttttcttcagacttgaggattgtaaatttccatatgttttagatttaaacttagttgtgaataaagaggaatttctgacactcaccttccttgtttatatgatcagattatcagtaaacagtgtgggaacaaaaggcgtaagcagaacgttcagtgggtttgattctttgcatctaaggtcatttgatactggttgttttgattgtcctggcctttccagagcttctgctaatcaagaatatactatgaaaatcatcagagacctagcaactgttgagcttggttttggctgtcaggcccctgttctgctgatggattgaggtgaggtgcaggtacaccaggggacactggagttttgcttttctgttttataactttgtagtaataaatggagcctttctcttctgtttgaaaacaaaatcacggtggtggtaatgtcaaaaagttggaagcaggagttgccatcaacaaatcctagtacggcaaataactggaagttaaatgttgtcttggctttcttcttgcctaaattatttttatgctgatttatttttaatggaagctggtatcttatttattaagtacgtgtgttgatatacaggactagactcgctggattctggtaaaactgttgataataagttggagagtccattttaaataacctggccaggaggaaatcttttccagaaatcaaaatggtgaaaagcaaaaatattgtatgtacaatacaagtagttttaaaatagtgacacttacatcctccggaaataatattgtttttaaatgggtaatgggaagttaaaacttcttttgttgtgaaagacttcaaacatacataagagtagaagaatgattccacatatatataaagttagtaattattaagattttgctagaccaggcatggtggctcatgcctataatcccagcactttgggaggctgaggcaagaggattgcctgagcccaggagttcaagaccagcttgagagcttgtctctttaataaaaaataaattaatacaacaaaaatttttgccaggtgtgatggcatgcccttgtagtcccagctacttgggagactgagaccagtggattgcttgagcccaggagctcaaggctgtagtgcactgtgatcatgcctatgaataaccactgcactccagcctgacgacatagcgagaccttgtctcaataaaattaaaaaaaaagattttgtagcacttgcctcatctatcttctttttttcttcttgtcgctgaagtattttaagctgctcagcagatctcagacatcatgtcattttactcctacttacttctgggtatacaactcttaaaacattatggacattttcttatataacaaaatgtcattatacctagttaagtataattaatatgcaatccatattcatttcacaaatgtatgatctactctgaaggcagtagagtggacaccttgaacttttcttgttcctagactcttgggaattggtaacactgccatgaagacctaggtgggtaaggtcattcagatggagccagtggaaaggatgtaccttaaaactgactttctgaagtataattctccatagctgctgctgaagcctggaggcctcgactctgaaagctaaataactcttctttataaatgactacttctcaaggtttcagcaaagatagaagggaaagatgaaaggagcagtatgctaggagtcaaaaggggggaaggaaactctggagattgtcaaggtcagcaaactgcctcgagagaattagttctgatataacacttaacctctccaaggacctctgtatttttggaaacaaggagacactagggaggcagagaaagccgctagggaatgttgttcagagattatactctcctaatcaagctgaactctgttaaccctatgatgtttgccaaaagtgactgactcttctgaatttctgatggcttcatatcttatcctttcttatcttttccattctaagtgcacaatgtgtaaggagtccctcggaataaagcagccctggcatgccatcggggattgaagtaggaacgatttaacaagggatacttggaaatgttgtcatgtgcgagttgtaaattttcttttttaatctggtggaaaattggaatggcatttctctgttttgcccagctatgccaaaaatcttcttggtcccacataggcctaggaaggatgtagatggcaatcacaaaacaaacaaaaaatgagcaaacaaatagaagacctcaagcaacattttctcttgttaataggttagcaacctcatatttgtatattaaagagatctgcattatgttaggttgatttcatataatttcagctaagtagatctagtttaaggtcagtgttttattgaatcttgtattttagcttcagtatattaatttccttagctgagggactcctactgaaggagaaaagtgttcctgttaaaattttgaaataaaagtttctgttttactgtagattttttcactattgctccttatttttatgtattctttcccctggctgtttttcatggttcatattttatctgttacacagaacatttgtattctgttagaattatctataaaaatgaacaaaggatggaagaaaaaggaagagagtaatttttttcaataaatgctaaatctgtattataaaatgttccttagtcatccaattcagaaaaacccactgctttgaaccgtaactcattattgaaggtaattcaaggttcagaggccataataaaaagtaactggtgaactgttaatattagtaaccaacttttttcaacttcaacaagaatttgttatgtatctgtactcatattttgataattttgtatataatagctagtatatttctttaaaagtttgtttttggctttagaatacgcttttatgttttcatcccagtagtgtattaaaggtgacagtactttgctttaaataaattttgatgttgcagaggtaatttcaggaagtataaagcaatcagagtcaaatttcagaaaaattttggttttataattacaataaaaatgcatacaaatttattttagtgtttgagagactgttaaagatttttttgtaatttgtaatgattatgaggtttggatactcgtagaaaatgttcaagttccctttcttagttttactaatgggtagtttgtcactagcagtaatgaaaaaataactgagtataaatacagttactccttttgcctttttctgtatgattttctttagtaaaagagtaagctgagaggacggaaaaatggggagtcattttttaatgggtatggagtttcagatttgcaagatgaaaaagttctgtagatctgattaacaataatgtgaatatacttaacactacaaactacacttaaacagtgaatatgttatgtgtcttttaccacaataaaagataatgaataacaaaaaaaataggctagacattgaaatttgaaaaaagaaacattaattttatagtttcttttttgagtaagacttagggattcttttcttttcttttcttttctttttttttttgtagagatgggagtctcgctctgtcacctaggctggagtgcagtggcacaatgtcagctaactgcaacctccacctcccaggttcaagtgattctcttgcctcaggttcccgagagctgggactacaggcgcgtgccaccacacctggctaattgtttttgtagttttagtagagatggggtttcaccgtgttagccaggatgatcttgatctcctgaccttgtgatccacccgcctcagcctcccaaagtgctgggattacaggcatgagccactgcgcctggcctcttctttctttctttcttttttttttttgagacagagtcttgccctgttgcccaggctggagtgcagtggcgcgatctcggctcactgcaacgtccacctcccgggttcacaccattctcctgcctcagcctccttagtagcagagactacaggcgcccgccaccacacctggctaattttttgtatttttagtagagatggagtttcactgtggtagccaggatggtctcaatctcctgacctcgtgatccatccacctcagcctcccaaagtgctaggattacaggcgtgagccacagttcccggccacctcttttcttttctttttttttttaagaaacagagtctcactctgtcacccaggctggagtgcagtgatatgatcgtgactcactgcagcctcagtctcctgggctcaagtgatactcctgcctcagtctcctggagtaactagaactacaggtgcatactgccatgcctggctaacttgtaagttttttgtagagatggggtctcactgtcttgttcaggctggtctcgaactcctggcctcaagtgatcctccctcttcagtctcccaaaatgttggcattacaggtgtgagccactatgttcagccagagactattttctttcccttattttatcgtttgttattataacccttgtaaatcccagactattaagaattatatttggaaaacagaggctttgggaaatttctgcttcattgcatagttgtgacgatatcttcatagtgctctccacaaatgtggatttttgtagccctatcagagataaaactgtagtggttttcttaaaaggtataggggagaaaagcctggttatggtaatgaatgtattaggtagagacaatgttagatgaagaaaacagacatagttcaggaaaaacacatgtctttaaacaggtttcattcagaagtagacctctattttggcagataataactattttcctttaaaacaatgcatataaagatgcaacaacaacaacaaaaactacaggtcaatatccctgatgaacataggtacaaaaatccttaacaaaatactagcaaaccaaattcaacaacatattaaaaagatcattaacagtgatcaagtaccattcatcccagggatgcaaggatgtttcaacatatgcaaatcagtaaacctgataaatcacatcaacagaatgaaggaaaaagaccatatcatcatctcaatacatgcataaaaaacatttgaaaaattcattatttccttattataaaaactctcaacaaattacataaagaagggatgtacctcagtgcaacaaaggcagtatatgacacacccacaactaacatcatgctgaatggggaaaggttgaaagctttttctctaagatctggaataagataaggataccaggccaggtgtggtggctcacacctgtaatcccagcactttgggaggttgaggcaggcggatcgctggagcccaagagttaagagaccagcctgggcaacatggtgaaagcctgtctctaccagaaaatatacaaatattagccgggcatggtggcacacacctgtaagtcccagctacttgggaggctgaggtgggaggatggcttgaggctgggaggcacaggttgcaatgagccaagatcatgcccctgcactccagcccaggttgcagagccagaccctgtctcaaaaaaaaaaaaaaaaaaaaagtcacagatgcccatttttgccacttctatttagcattgtactcaaagtcctagccagagcaattaggcaaaagaaagaaaaggcaactgaattggaaaggaagaagtcaacttttccctgttcatagatgacatgatcttacatatgaaaacctttaaaaaaaggaacaaaaattagaaaaccttaaagatgccaccagaaaaacctgttagatctaatacatgaattcactgaagttgcaggatatgaaatcaacttataaaaaccagtattgtttttatgtactaatagtgaactacctggaaaaaatatcaagaaaactctatttacaatagctatgaaaaaaatacttagaaataaatttaagcaaggaggtgaaatatctgtacattgaaaactataaaaaacattgatgagagaaattgaaggagacacaagtaaatgttcatggattggaagaattagtattgttaaaatgtccatactacccaaagcggtctacagatttagtgcaatccctatcagaaatatcaatgacattcttcacaaaaatagggaaaaacaatccccaaatttatacaggaccacaaaagaccccaaatagcgaaaggaatattgaaccaaaagaatgaagctggaaccactgccatggccagtccattgcagggtatcctgcagctgctacagaccgagaagcaggctgctgagaaggtttccaaggcccacaggcagatgaaccgggggctgaagcaggccaaagaagtagcttaggctgaaattgaacagtgccgcctgcagagggtaaaaagagttcaaggcgaacgaagctgaagcactgaagtggagaaggaggcccaggagaaaagatgatcaccctccagacctacttccagcagaacaaggatgaagtcttgaataacctcttggcctttgtctgcaacatccggccagaaatctgtgaaaactgctgcataaatgggtaggagaagaaaaaagcacctgttctatgaattggcattttagatgctctcatggaatatgaagcttcaacatagctcaagttatattcttaaggcattaaattatttctgtatattatataataggtccctccactttttggagagtagcaaatatagtgttttttttttgttgttttgtttgttttttttttttttttacagacttagaacttatctaaagatttcatgtttcttagaaaattaattggtatatgttgtctatttttatatgccttttggttcaagcaacatatatatcagtgttgacattttctttcttagatctaattaaacaaaaccaattttttttgaagaaagaaagtgattaaataatttttccccctaatgcattcttgaattcatcagggctttatctatgaaaaagtagtaaatagttatttgtaacctatgtgaagcaacattcagccttaatctattcctgctaatgattagaacaacaatattggtatagttgtttgggttgcttttagtttctcttaatcatgtttactagatgatagaacttaagaacttgttacatcttattacttggtgtatgataatcatttgaaagtcaagactctttgtcatgcaggaaaaaaaaaagaacaaagctgaaggcatcacactacctgacttcaaaatatactatagagctatagtaattaaaactgcatggtaccagcatgaaaacagatacattgatcaatggaacagaatataaagtccagaaataaaaccatgcatttacttacaccaacttatattcaacaaaaatggcaggaccacacaatggggaaagggccatttctttaataaatgatgttgggaaaactagatatttacacagaagaatgaaattaggcccttgtctctcaccataaacaaaaatcaactcttgaaaatggattaaatataagacccaaaactatgaaactactacaaggaaacaggaaactccttgacattagtctggccgatgagttttttgatacaaccttaaaagcacaggcaacaaaagcaaaaatggacaaacagtattacgtcaaactataaagcttccccacagcaaaggaaacattccacagggtgaagaagggacctacagaatgggagaaaatatttgcaaactatacatctgataaggggttaatatccgaaacacagaaggactcaaacaactcaatagtaagaaaacaacctgattttctaaaaatgtgcagaagacccgaatagatttttctcaaaagaagacataaaaatggccaagtacagtcattcatcacttaacaacaggtctacattttgagaaatgtgttgttaggcaatttcatcttttttttttcccttatgatccaacagaaccaatggtgtggtgatttcatctttgtgcaaacatctagagtgtacttacacaaacctggatggtatagcccactacatacctaagctgtatggtacagcctgttattcctgggctgcaaacctgtataggatgcgattatactgaatactacaggcaattggagcacaataataagtatttgtgtatctaaacataggaaaggtacagtaaaaatacggtatcaaagataaaaatggcacatctgtatagggcacaaaaccatagtggagcttgcaggactggatgttgtcctgggtgtgccagcgagtgggcagtgagggaatgtgaaggcctaggacattattgtacactactgtagactgtctttttttttaatagaattttgttcttttgcccaggctggagtacagtggcacaatcatagttcactgcagcctcaaactcctgggctcaagtgatcctcctgtctcagcctctcgagtaactgggactacaggcacatgccaccatgcccagctaacttattttatttttttgctattgtagacttgataaacattgtacacttaggttacactaaattcataaaacatcatttcttcaatgaactgtagcttactgtaagttttttactttttgacttttgtaataacacttagcttaaaacacaaacatattacacagctgcataaaaatgttttcttctatgcttatgctgtgtaaaccttttctgtgtttgaaattttttattttttttatttttaaacttttttgttaaaaactgagacacaaacacacatgttggcctaggcctgtatagtgtcaggatcatctgtattgctgtcttccaccttcatatcctgtcccattggaaggttctcagggaaagaacactcatggagctgtcatctcttatgacagtgccttcttctggatactcgctgaaagacctgcctgaggctgttttacagttaactttttaaaataacttgaagtaaaataataataaaaagtatggtaaatacataaaccagtaacagtcatttttttattatcaagcatatgtactgtacataattgcattgctatgcttttatttaattatttatgagacagggtctcactctgttgcccatgctggtgtgtggtgatgtgatctcggctcactgcaacctccgcctcctgggttaaagctattcgcgtgcctcagcctcccgagtatgggattacagtcgtgcatcaccatgcctggctaatttttgtattttcagtacaaaatttctctactaaaaatacaaaaataagcagatgtggtggcaggcgcctgtaatcgcagctacttgggaggctgaggcaggagaattgcttaaacccagaggcggaggttgcagtgagccgagatggtcccagtggactccagcctgggcaacacagcaagactccatctcaaaaacaaaaaataaaaaaaattagccaggagtggtgttgtgcacctgtaatcccagttactcagaggctggggcaggagaatcacttgaacccgggaggcagaagttgcagtgagtcgagatcacaccactgcactccagcctgggcaacagagtgagactgtctcaccaaaaaaaaaaagctcgacatcattaatcatcagggaattgcaaatcaaaactacaatgagatatcaccttcctcttgttaggttggttattatcaaaatgacaaaagataacagatgttggcaagaatatggagaaaagggaacacttatacactgacggtgggaatgtaaatttgtatagccatatggaaaacagtatggaggttcctccagatatgaaaaatagaagtaccagatgatccagcaatttcattactgggtatctatccaaaggagatgaaagcagtgtgtggaagagatatctgcacttccatatttattgcagcactatgcataatggccaagatacggaatcagcctcggtgttcatcagtggatgaatggataaagaaagtatggtatgtatacacaatggaatactattcaaccataaaaaagaatgaagtgtcatttgcaacaagatggaggaatctggaagtcattctgttaagtgaataagccaggcccagaaagacacatactgcatgctctcactcatgtgtggagtctaaaaagttctcatagaattagagggaagaatggtggttaccagaggtgggggtgcttaggcagagggaaggatggggaaatgttggtccaagaatatataattacagttaggaggaatgagttcaagagagctatcatacagcatggtgactatagttaaggacaatgtattgttgaaaaatgcagagatagttgaatgttaataatgttctcaccacaaaaacaactatgtgaggtaatgctattattaattagctagatttaactattacataatgtatatatactccaaaacatcatgttgtacatgataaatgcaattttttctgtcaattcaaaatgtaaagtaagaacatttaaaaggtacatctccaacctccacatgctttccttgcccagtctttctctcctgcttgtctctctccctgtcagtatgagacaccctctctaggaagccgctgtcatcctttacaaagaaggagtccagaatctaaaatcttacacagcctgcttcaggcagtactgaagcctggacttctcagaggccacagtagaggccagttgtagcaaatttggttgaaaaagcaagaattatttttaagtttttctaaccacctgagctccatttgcccagttgtgagattaaacactttcttcgggcaccagcaaatcatggccaccagaaaataaaatcaaatacaaaataataattaatgggagaggagcagtggctcatgcctgtaatcccagcactttgggaggccaagtcaggaggattacttgagcccaggagttcaagaccagcctgggtcaaggtaagactccatctctacaaaaaaaaaaattagccaggcatggtggcacttgcctgtagtgctatctactcaggaggctaagatgggaggatctcttgagccctggaggttgattgaagctgcagtgattcgtgatcatgccaccgcactccagcctgggtgacagagcaagaccctgtctcaacgcaacaaaaaacaaaaataaaaaaaaatagagaacaaaaatattaaatgtgtgcgtatttactattggatatggtaatataccatggtaggtattgcctttgtaagttggtctcccctgtcttttgttcctagagctttctcattttctcatctccaagggcttgtttactgcttcatacataaaaagaggccaggtatgatggctcatgcctgtaatcccaacactttgggaggccgagatgagatgattgcttgagcacaggagttcgagaccagcctgtacaacatagggagaccatgtctctatgaaaaattaaaaacttaggccaggtgcagtggctcacgtgtaatcccagcactttgggaagctgaggcagtcagatcacctgaggtcaggagttcaagaccagcctggccaacaacatggtaaaaccttgtctctattaaaaatacaaaaagtagccaggcatggtggtgggcacctgtaatcccagctactcgggaggctgaggcgggagattcgcttgaacccgggaggcggaggttgcagtgagccaagatcacaccactgcgctccagcctgggcgacaagagtgaaactccgtctccaaaaaacaaaaaacaaacaaaaaaaaacaattagttgagtgtggtgacatgtgcttgtagttcaaattactcaggaggctgaggtgggaggatcgcttgagcctgggaagctgcactgcactctagcctgggtgacagcaagaacctatctcaaaaaaaaaaaaacaaaaaaagagccctaatttatacatgtattctcagtttgaattaaatttagcttgtttacttaaaagtagtgttgaaggtatttttcatactatattttaatactagattaaagttgatactaattttatgcagttttaagtattaagactaatcatttgacctttgctttctttacctaaaacatggaaaatactgatttcatagattaaatgagatgatttgtgtgaagcacaagcacagagtttggcatctggtcaatgtgcaataaatgcttgcttttatcctcatagtgaccttccttgatcttaaaatggtagtaattaggctttaagatgaaatggcttatgctggttttaaaatatattgtattcggaatcctttgtaaagtaacaaaaatctacaatgcttagtaggcctccaaagggtatagaggagaaaagctaattttttatagttttataagcaaagttccggtatgtcaggagcttgcttaaaattatatgttttatgcttcttaatttaggtactttagatttctcctagatattttaaaacattgctggccactttgggcataaaaatctaaaatataatctgtaactatttcagatttcatggtaagaccaaactgcattataatttttgtaaggagctaaactcttagactttactatttatgtactctgaccattggactggaactgaaaacaacttaaagatgcaatttggcctggctgtgttaaattagtctgctttgcattgctataaaggaatacctggctggggcagtggcccatgcctgtaatcccagcactttgggagcctgagttgggtggattatttgagctcaggagttcgagacgagcctggccaacatggtgaaaccctgtctctacaaaaaaatacaaaaatcagctgggcatggtggcaggcgcctgtaatcccagctacgccggaggctgaggcaggagaatcacttgaaacttgaacccggaaggcagaagttgcagtaagccagattgcaccactgctctccagcctgggccacagagcgaggctccatctcaaaaaaaaaaaaaaaaaaaaaagaaaaggaaaaagaaatacttgaggctggataatatataaagaaaagaagtttgttttggctcacggttctgcaggctgcacaagaagcatggcaccagtatctgcttctagggaagcctccagaagcttcaaatcatggcagcaggagaagggggagccagggtatcacatggagagagagggagcaagagagaggggaagtgccacactcttcaacaaccagctctcagaactaccagagcgagaactcatgaccattcatgagggatcccccatgacccaaacacctcccacaaggccccacctccaacattgaggattatatttcaacatgagattgggagcggataagcatccaaactgtatcacgttttgtcaaaatgattctgattttgacatctacttttatgtaattcttctttcctgttgcataaaaagcctttttttggcttagaatcttactgcaaattctttatgtgtatttattattttgaaatacatttggctagtaaattatgatcagtttcagtcttactgaaaccaaatacgagattggctttcaaaagttccttccagagctaaaagagtttgacttctataaaggtcatgtccatttttatagtactttaatatatatattattataataagtgaaacatatctcatattggttagaatataaaatgatgccccaaatactataaataggaaatccaagatactgtacagattagctagaaaaaaaaaagtttagctagggcactgttctcaaaggataaagaaccctaattttaatttaagtgcttactggaagcattatcaaaatagattatttaaacccttctggataattaagaatgactgaattataacacttgctttgctttcaagaagtgaattttttagaaacatgaaatttgaccatttacgtttacagtatcagaaacaatgatccttttcccccttttcaattcagattatggatttcagcttatgcgctatacataaaaaaaaggattggaggcaacaacaacatctctttagaagataatggatagtaaatatagaaataataatcatacttggcttatctctttgtaacaaatattttcaacatatattcttaaggtaaaatttaaatgcattgaatttgcaatttgttagccacactatcttaaaaacaaaacaaaaaaaacagctaggccagacacagtggctcacacctgttatctcagcactttgggaggccaaggcgggtagattacctgaggccaggagtcgagatcagcctgacaacatggtgaaactccgtctctactaaaattacaaaaattaactgggtgtggtgacaggcacctgtaatcccagctacttgggaggctgaggcaggagaatcgattcaacccaggaggtggatggaggttgcggtgagcccagatcacgccacttccctccagcctgggcgacagaacaagagtctgtatcaaaaaaaaaaaaaaattaccagggtgtggtggcgggcacctgtaatcccagccactcgggagtttgaggctggaggattgcttgagcctggaaggtggaggttgcagtgagccaacattgtgccactgaaccgcagcctgagcaacagagctgaactctgtctccaactcaaaacaaaaaacaccttcatgggaaggaagtcactcaagataaccgaaatgaagaccaactacatttttcattttgtgtttgtcttactcagcacaatcaaatatgacttttaaaaattaaagtgggccgggcacggtggctcacacctgtaatcccagcactttgagaggccaaggtggatggatcacctgaggtcaggagttcaagaccagcctggcagagatggtaaaccctgtctttactaaaaatacaaaaatcagccagacgtggtggcacatgcctataatcctagctatttgggtggctaaggcaggagaattgcttgaacccaggaggtggaggttgcagtgagccgagatcgcaccactgcactccatcctgggtgacagagcaagactccgtctcagtggggggaaaaaaaattaaagtggaatattttacatctttattcaggtatttgatttataatattcttattattttcagctttaaaacatttgaaatattctaatattctcttaaatgctttttcccctatagaacagacttttgagaatcctgtcttaatacataaatatcaagatagttttcaacttcttgcttagcttgttagtgtatttttattgtagtccttaaactaggtagtacagagatttgatttttcaggagcagagttgatagagcagtctgctatattgtgaattcacattttaaaatcctttattgtcttgaatgcaggcctagtagctttgtgacatgtgcagctatactatgacatcataaaccccatcgtgagggaacctagctacgggtcagagctagtccactaggtgctaatcaaatgctgtgttacaacactgtgaggttttcccagttataagtgtcactattagggttttttttaattgcaaagccaaataaggctgtcaattgcatcatcttaccttatttcttcagattaagtactgtttatagtgggatttttggtggatgtggtggcatcagcataatctatgtttcaggcgtcctatagaagaggattattcttcaggggatgtggaagaaaaggtaaatgatgtctgctataagtaccttcacacttttaaagccttgtgaaaagaggggtaaaaattgtgaaatataaaataacatccattttatgttttagttttttgttcttgcgatagtttactgagaatgatgatttccaatttcatccatgtccctacaaaggacatgaactcatcctttttttatggctgcatagtattccatggtgtatatgtgccacattttcttaatccagtctgtcattgttggacatttgggttggttccaagttgtagcagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcgccattctaactggtgtgagatggtatcttattgtggtttagatttgcatttctctgatggccagtgatgagcattttttcatgtgtctgttggctgcataaatgtcttcttttgagaagtgtctgttcatatccttcgcccactttttgatggggtggtttggttttttccttgtaaatttgtttgagttcattgtagattctggatattagcccattgtcagatgagtagattgcaaaaattttttcccattctgtaggttgcctcttcactttgatcgtagtttcttttgctgtgcagaagctctttagtttaattagatcccatttgtcaattttggctttgttgccattgctttttgtattttagacatgaagtccttgcccatgcctatgtcctgaatggtattgcctaggttttcttctagggtttttatggttttaggtctaacatttaagtctttaatccgtcttgaattaatttttgtacaaggtgtaaggaagagatctggtttcagctttttacatatggcaaaccagttttcccagcaccattaattaaatagggaatcctttccccatttcttgtttttgtcaggtttgtcaaagatcagatggttgtagatgtgtggtattacttctgagggctctgttctgttccatcggtctgtatctttgttttggtaccagtaccatgctgttttggttactgtggccttgtagtatagtttgaagtcaggtaacgtgatgcctccagctttgttcttttggtttaggattatcttggcaatgtgggctctttttgggttccatatgaactttaaagtcgttttttccatttctctgaagaaagtcattggtagcctgattgggatggcattgaatctataaattaccttgggcagtatggccgttttcaccatattgattcttcctgttcatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctgtttgtctgttactggtgtataagaatgcttgtgatttttgcacattgattttgtatcctgagactttgctgaagttgcttatcagcttaaggagattttgagctgagacgatggggttttctaaatatacaatcatgtcatctgcaaacagggacaatatgacttcctcttttcctaattgaataccctttatttctttctcctgcctgattgccctggccagaactgccaacactgttgaataggagtggtgagagagggcatccctgtcttgtgccagttttcaaagggaatgcttcccatttttgcccattcagtatgatattggctgtgggtttgtcataaatagctcttattattttgagatacgtcccatcaatacctaatttattgagagtttttagcatgaagggctgttgaattttgtcaaaggccttttctgcatctattgagataatcatgtggtttttgtctttgtttctgtttatatgctggattacgtttattgatttgcatgtgttgaaccagccttgcatcccaggaatgaagcccatttgatcatggtggagaagctttttttttttttttgagatggagtctcgctcttttgcccaagctggagtgcagtggcatgatcttcgctcactgcaagctccatctcctgggttcacgccattctcctgcttcagcctccctagtagctgggactacaggcacccgccaccacacccggctaattttttttgtattttttagtagaaacggggtttcaccatgttagccaggatggtctctatctcctgaactcgtgatccgcctgcctcaggctctgaaagtgctgggattacaggcgtgagccactgtgtctggccggataagctttttgatgtgctgctggattcagtttgccagtattttactgaggatttttgcatcgatgttcatcagggatattgttctaaaattctctttttttgttctgtctctgccaggctttggtatcaggatgatgctggcctcataagatgagttagggaggattccctgtttttctattgattggaatagtttcagaaggaatggtaccagctcctccttgtacttctggtagaattcggctgtgaatccatctggtcctggactttttttggttggtaggctattaattattgcctcaatttcagagcctgttattggtctattcaggaattcaacttcttcctggtttagtcttgggagggtgtatgtgtccaggaatttatccatttcttctagattttctagtgtatttgcatagaggtgtttatagtattctctgatggtagtttgtaattctgtggggtcggtggtgatatcccctttatcatgttttattgcatctatttgattcttctctcttttcttctttattggagtttaacctattaactctaccagtataattataaggttgacgctcttgcttataagttttggcctaaccagtgagaatgtagaatgatagttctccagatataagagttttcttttttaaaaggagacatttgaattctacctccagatgcgtcatttatgcaggttctcagcctttattttagcattttaatgaaaaaattgtctcatgagcttttggcctgcctagagtttggacatatggaagtttccttgtagttacagaatctgtataacctatctccagaattgtaaggatatggtttatgttagcgggtacaagttctttttctgcagcaggtattcttaaccaagcctttttttttttttttttttttttttgttaaggcacagtctcgctctgtcatccaggctggagtgcggtggcatgatctcagctcactgcaacctcgaactcctgggttcaagaaattctcatgcctcagcctcatgagtagctgggattacaggtgcgcacaaccacacccggctaatttttgtatttttagtagagagagggtttcaccatattggccaggctggtcttgaactcctgacctcaggtaatccacctgcctcggcctcctgaagtgctgggattacagtcatgaggacttagccatttttgatagagttattgtttaattaaaattctgataattgtacttgaaagatgattaaagcaatgtaaaggatgatttatgcctatcagatgcccatgaatctttgttgaattgtttttctgttctccataataatctgatttctttgaagctgggcatttccccacaaaaaatgaatgtggacaccacctgccatctcaacccacaggtctagtttgtgagaatacttgtaggacccctgggtttcccccgctatagtttcaagtacattgtcttcagataccttattctatgtacttggaaaaaagagtaaaacattgagagccactgggatctgacaagctttgggagctccttaattctaaaaagaaaattattttgatttgagaaaatgtaatatcttcagaaatttccaccacccagctatgtgactgcatttttaaaaaaggaaaggaacagaggaaaatcaagtcactctaccctccttacttacctgtggcttgtccctacacatggtggtgggtgggagaagtggtggtggagtactgggtcctccagagagctcagtttggaatctggaactaaagatcatgtcccaatttcctgagctgatgggatagaagctggtcaatgaagtcttctttttgtgttaatttttttcctttgttttcttttgttttatgtagttataaagcataatttctattttgccagtctctgacacatgggctctgtcagggttactggatatgtttattttgtctctgctgctctactggagctgaaatctcagcctgtctgagcagttctttaagctgaaagccagggtgtaggggctagattagtgtggaatagctgttttcaaagtgtggtgtgcagaaccctgggggtgactctgagacattttcatgaggcttgctaggtcaaaaccattttcacggtgatgctaagatgttgtttttctttttctctgttttgatatccacactgatggtgcaaaaacagtggtggtgggggagtggtaaattgttgggtgccttaactcaagtcagtgacacaaactgtgttagtattaactgtattcttcactgccatccacttgcagtttttttttttttaagtcagttttacttaagaatatctttgatgaagcagtaaaaattaccattgcattaaatcttgactctgagtacatgctgttttgatattctgtgtcctgaagtgggacagctgcagaaagcacccccccgctgcgtcctgacgacccatggtgttcttaaggaaaagcacgtgtgttatttgagtgccaagatgaattagctgcctgtttttccacagaacgtcattttcttcaaaagaatgactaatttccaaatgatggctattcaaacttgaagacatttcctcaaaaacaaatgaagtgagcttgtcagttcaagggaaacaactcatggtgtttattgtcacaagcttttaagccaaaactttgaattttggaaaatctgcatctgccattgtgagcttgacaatattcatagttttctgatcaaactggttatactttaatgaaatgtgatttataatactgtgtcatgaaatgtgtccacgtttggaagatctcctgaactcagtgagccagtattttccaaatgaatacttcaggatgttacaaaatcttacgtgggtaagagattcatccaaagtacaagacagatcaatggattttaatgtaactgatactgtctcagattgtatgttgcaattaatccttaagagacaatcagttgtcaagttttggtgtatccatgaagaatatccatgattttctacagaagctattataatattcctccctttttctaacacgagtctttgtgaggcccagattttcttcacataccaactaaagcaacatactgcaacagattcagtgtagaagtagatatgagaatctggctatcttcagttaaacctgacattaaaataatttgtaaaaatgtaaaacagtgctactcttctgatttttttgaaaatgtaatcatttttcataaaatgttatttatggtagcacatacttattattttaaaataagttactatttttaaaatttctgttttaatttccagtatgttaaatatcaacatatataaccagtggtgtgcacagctggcttgtaccagtgaaaaccaattgtataatctttatccggctttgtgttcaatgtcatccattggcagcttgaaatcagccatagtaggagtacttacatcacagaagtgagcaaacgctacaagtcagtgttcctccttcttaagatctagttaagtgtttaccagccctctactgaatatcaatcacagaaacaaaagctctttgaggtcatcagtaatttttaagagtgtaaagatgccctgagactaaaatatttgagaattagttgtgaggagaaagagttatcttttgagagttagtcactatagaggtgtataattcatacagagttgccttttgtgccggaaacatttgtagaataaatccaatgttttaaaacttgcagttgttaaatctactggttccataatgggaggatgtttttcttttccctggaatctaaactagatgataatactctgggggtaggtgagctgaattttccctgtgggctacatattggttgcctctgtcctggtttcacactatctgtccaactgttatctaggtttagatcaagccttcactcaagctctggcatctacataaagccctcacttactgtttgggcccatactgatctttctattctgtactcctgtgatattcatggcctctaaaatggagcaattcgttctgtactatttggtgtgccattgtttcttaggtgctagttttattaattctattttctaatagtgcacctagtacaaggctcaacacctaggttctcttacacggataaaacatgttttaacttttggattgccagagaagttagttttccaagggaatgatgatgtaaataaatcttagttatttgttataaacccagtttttaataattcttttcagatattaatataagttggaaatcattggtgttcctcaaagtgaagtcacacacaaagtcttccttgaaaaaattgttttagatgctgtggttctactaccactcatgatagacactggtgacttatttccaaggtctttgactcttgagtaagtcataatgaatggtgaatcttagtaaaatgaggcaaagtttctgcaattatgctagcctataggacagagttgtttactaattagaaaacctggcaggttttgagtccagaggagtggttagtatcgtgtttttctggtagggatctctgttgaaggaactcagggaagtagtgaggagatggctgttgtgctgatctctgcccaaagttaagtgatagttctggcctctctggatgctttagctagggagaggaaaagtgtccagaggcctcatcagccttcaaggcatgagctttctctgggtcagagacaccaggggcttgaaaggtcctggaatttcttcggcctatgcctttttagttattatgagggcataacagtgactgtgatttttatcagtctagagacaaagcatcagctcacatccagagtaacactagaatatcatatgtcacacatttaataaaaataattcactggccaggtacagtggctcacgcctgtaatcccagcactttgggaggccaaggtgggcagatcacaaggtcaggagatcgagaccatcctggctaatgggtgaaaccccgtctctactaaaaatacaaacaattagctgagcgtggtggcgggcacctgtagtcccagctactcaggaggctgaggcaggagaatggcttgaacctgggaggtagagcttgcagggagccaagatcacgccactgcactccagcctgggcagcagagcaagactccgtctcaaaaaaaaaagaaccatagttaagttctatctccaatttctctgaagaagttagagggtagtttatactctggcctaagaaaggcttcactgttagtaggcgtgaggtcgtagtgaggtagtttaactgctttagaactttgtgcttggaacattcttagccaccgaagtatgggcaccaaaagcgataaggagcatgtgttccttaataaatgtcacatcagaaaatgactgttccaggacagtaaccacctcccgatggtaagtatcctagatagtttgtcatttctcagcagcaggaaaaagagaagtaggccagtcatattagtgagtggtattacttaaaaatagcaaaaacaataacaaaaaaggtccagctttaatcctcaatggtgatcattttggcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggttagcttccttcctgaatggttttgtctttgactttcttgagccatttttttcctctttcactaattcatttatcatttttctttatgaagtgcttatacgcaaatctttttattagatatttggaggaatctcttctccttgcgtaaggtgctctgtgtcctgctaggtacgtaggtttcacttcagagctgcagctttgttgccaacttttcatttggggactgagtaattgcagatgagcagttcatgtcttcttcactttgttgttctgtgttcaaactcagatttatttagcaatgctccccaagggtgctgaaaaatattttgagggtgcatcagagaagatgtgtgataaacacagtaatataaagattatagtgctgatgctgttttctttttttttcttcttttttttttttttttgagacagagtctcgctttgtcgcccaggctggagggcagtggcatgatctcgggccattgcaagctccacctcccgggttcacgccattctcctgcctcagcctcccgagtagctgggactacaggcgcccgccaccatgcgtggctaattttttttgtatttttagtagagatggggtttcaccgtgttagccaggatggtcttgatctcctgacctcgtgatccgcctgtctcggcttcccaaagtgctgggattacaggcgtgagccactgcgcccagccagtgctgatgctgttttcatgaataatcaccttagtaggtagatataaatttataatcaccttagtaggtagatataaatttattttaaattcggtatacataattcttggtaagatgatattattaatgtatccctctcgattaaaccttggcttttgtagatatgattattattgtggttgtgatccagagatgtattttacccttaacatttcttgaagttaaaacattttttccatcaatagatgtaaattattaaatatgcattttttaaagtatgcatcttaattactgaatttatttttgttcatttttaaggtcagttattatcctttaaatgctgaaattatttgaacctaattgatgacaaaaaaaaaaatctgtgaggaaaatggagacacgtatacatagtatagtccttttcttgcgtgttcaagtagtttatcacagtagaatgataagagtggcgacaagatacctgatgtgacaaattcacatacattaaaagcttgattatctttgtggcatgggtattttctcctgtgtttcccagaagtgtaagaataattctcatcattatctttttttcctgtgatggcccctgattccaagagtttctaattctttctgacactaattataaaacaagaaagtctttccaacctcttctttgttttatgacttttattgaggtccacatatttctacttagttttaacctggctggtattggaagaaagtattgtctattattattatttattatttaatagagacagaattctcagtatgttacccaggtttgtgttgaggccctggcctcaagtgatcctcttgcctcagtctttcaaagtgctgggattacagatgtgagccacagcacccggctgaaagaaagtattctgttatattcagtagactttgtttggattttgttaagtgaacgatttaattgtccttgtagaaagaggtgccagtggatcttgtcctagaatacttacgtgttggatcatggtcaagccacttaatctctgtgcatgaactttaattttcacctttctaaaataggtaaattaatagcctacctcacctaagggagttgttatgattctatgacagatgtgtgacagcccggtgtaaaatgataaatatttaatatttggtggtgatatatgattatctgaggcaacaacatttttctcagtcctgttgattgggtgtgtgtgcttatgtgtggggcgttcatgagcaaaaacacgagtcatatgtggaggtgaatatacacctccgtgtacttcgggaagtatatattcttgcttgcattgttgatattttaataagctcttttgattttgtccaaatcaatttcccatgtaattataatatgaagtgagttttgtaaactctgctaccctaggccctcaaagtattaataattgactgaatatatcaaaatcagtcatgttgttgaagagattcattattttagttttctgacttctttaataatcatatcactgtattattacttgacttgaaaaatgaaatcatgcttaaaactctgatctttctcttaaggagaaatgctttatttggatcttcaagacccaccgccaccaagccctaacttactccttgtaatagaaatcctgattttacccaggcttgcttactgacttgcttatctacttaaatattctgtcttgggcctatctgatggctaatgtgaagacccagctcacgccagcgccagctgtgagagtgtgggaacagcagtgtgatccgggagctctcttctgcgttggcccctcgctggctccctcctggattcgtaggagcactttcaggttgaggagcttaggtcttgggtattttacattttgttctttcctgcaatgcctcatttgacatcccaaccactctttccctagtatttctgtagtatagagtacccgtaacattcctttccacacacatttgttttataactgaaatgtttgcgtctgcgcttcctttcttgagccagactccttcagtgcagattcactgtgttctattgctcagttgcttccacagctcctggctcagtgctgcacacacagactcttagcctcaattttttgaatgagggaaaagagcatatattttatgatacatttcagaaaatcttgtattataggtagcagcaattgcagagacagatgaatctgcagaatcagaaggtgtaattgattctcataaacgtagagaaatcctttcacgaagaccctcttataggtaagttaaccaagtttcctaatgtaaagatactttttccaaaatggtagaataattatacatcaaatcaattcttcctttatagcttttctgttttaagacttattcatgtatcttagtgacttaccttgttaaattgtattttaggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcacattcagtcttgtgcattttaatggaccgttaattctgtgctttttgctctgattaaagcactagtttttttcccaaaagaagagtgtttgatacgtaaaaagcaagagctagaaagaaaagaaaaaggaggagaaaggttagggatatcacatatcctaagctagccccttaggtactggaataatgtgatattcctgtcctttctgaagtataaattgtccatggaagttgtctaaatcaatttcccatgtaattataatatgaagtaaagtgagttttgtaaactctgctaccctaggtcctcaaagtaattgaacaaatatattgacagcagtcatgttgttgaagagattcataattttagttttctgactttaaaaagagctacttaggtactggaatatatgtgatattaaataatgtgtttatccaaataaggtattaagattttagatatattctttgtttttcctttaaaaagtagcaataccaagaaaaaaaaactcaagtcttaatttaagtcctgactactaaaacaagctataatctttaatgtatgagaagactttatatagtcattatttttgtggagctttttagagtttttcttgtagcagtggtagatttgcagtagtaaactattaaatacattctctgttggtaattgaggggaactcctaccatgatacctagcagatccggggtgtagtgtattcacacgtttgacagggcacccagtagacttgtccaaagtcagtgttaggaaaagaaaatccccaccatctgtaagaaatagaccttgaggtttacattgtcatttttttattacttctctcgtttacatgctcttttgtctggcacactgggaatctctggtgggttttagaactgtaaaactgaatatgccagctgatgagcctctacagcacagcacgcaggttatgagagtgctgagtgcctcgtccccccgtccccagaggggctgggcagaagctgctggcgcctcctggctggtcagccctggccttgagcagctccatccactcaccccagtgggctgtacacatgtcatcatgttctgtttgtgtaatgacagggaaaaggttggaagtgactgctgaaatgacactaagacttctcaaagtgttgggaaccactaagatgctgtcatcgtaacatttctctggcatatgctaatgctacttaggacttctgatagaagcagtgattcctttacaagttgatagggaagcagatgctgtagggttaacttgtctagattattagctgaaaatttgaaattgtgaaaatgtatggggttgaagctggagaggatgtggaaggaaccatctttgtgccatttgcaaactcaatgatcagagcaagaagctttattaaattcacatctcaggttttagtctttgaagtgggaataatactaaattgccaaactctggggttcctgtgaagacaaaggagataatgggtaaaagtagggggaaaaagacatgctactattggcatgaaacagagaaattaagttaggtgtaccattgtctcattcatgttcattgaactttccctccagccagccccaatggcttcattccctgtgtccttggtacctgctcacagcagggggctggccttaaacctcactctgtgtgtctgtgggggggatgagaggagcagagtcaggaattttggttgagaactagaaaactgcatctgtagaaattagatcttaggccaggtgtgatggctcccacctgtaatcccagcactttgggaggtctaggcaatgagggttgcttgaggccaggactttgagaccagtctgggcaatagagtgagaccctgtctctacaaaagaattttaaaaattagcagggtgtggtggtatgcgctcatcccagctactcaggaggctgaggtgggaggattctctgagcccaggagtttgaggctgcagtgagttatgattgcaccactgcactgtccaacctgggcagcagagtgagactctgtctcaaaacaacaaacaaaaaaaacacatctgtctatttgccacataagaggtcatggactatttcttactttggtttcttaatttgagtctatacagtatgatcctagaaattattctgatgagaagttatagttctgtatgtacagtctgcaggtaaaaattgccatttgttcacacaatgtgaatttcttttgttaaaaatgcattttggggacatttagtgaaatatatgtagataattctttgagaagtgaatactaacaacattcaaactttttagaagacgtttactttaattggagggtaaacatacttacacacacaacatccatttttattgatcttattttttatagaactaacttagcagatattaatgctttaatgttgtagcagaatgtctagaaatggaaacaattgccagtttcctttggtttttgaatagaggaacgtattttattagaatttctggagattttcctatttttttccttccctttgagctgtaaattttttttaatgctctttcataaccttttattataaaaaaaaattttaggtttaattgttcagcttttatccatggatggctttctcccaaactttgcttttatttctttttttccaatattttattagttatttttaatttggaataatgagttagctggtgtttaaaagaactaaatgtgtatcaaagttgaagaaataaagtatattcaagttttcccatatacaagcagttacatttttaatagttgaaagatatttggcagaagttggccttattatattgacttactattatcacaaaaactaaaaagtgaaagttggaataggctgctccctggggagtaggaaaaagcataaaatagacagggatccattattacaacaccaagtaagtgagctgtacctgcagaatcctcactggaagtacagatcttagtgataggtgtgttgcataacagttgagctggtcgaagaaagtcttttatttcagaagcatatacccgagagatggcgggagagagacagccttagaattaacaaagaatgttacttgctgcatgagacagttaagataggcagtaaatgagtgaatttgtaaaagcaaccgaggaaattaaaatgtttgaagcttcctaattcattaaatttcctcttgaaacaaaggttacttaaatcctccatcctactatacccaacctcttcctgtaccaattaaagactatcacccaagacttcagtttttttcccacaaatggcccttgtctctgcttgtgcctattgtattttacgaggaatcttattagagtattaactcatctttctggaattcttatacatgaaaggtaagtgggtcaatctaaactgcaccattatgaaaagaaaaatatgaactttgtggactccttataagaattcagaattctcaggaggctcacgaataagcaccaattcaacttcttcataaagggaattagaacataataggcttacacattcgaaagttaatccagttgcagttcttaatagtgacgttgtttacatttctctaaggcaactgtttcaaaattttttaaggcactacttaatgtaactctggcttttaaactttgatgttgctattgttgttatagcatgatttagtcttccttctgctataatgcacctcttggcttttaaggtacaagtactcataggtgctctcttatggtcactctgaatttaaacctgagaattcattggaacaaaggtctgtttgctgctgtttttaaagttaatgcagtgagatttcatttatgaatctttggattgcaatttggaacaagagtggttttaaatataaacatttacatgtgtatgtattttaattagctcatgtgtataaatttaggattagaagtatataacatgggccgggcgtgatggttcacgcctgtaatcccagcactttgggaggctgaggtgggcggatcacctgaggtcaggcattcgagaccagcctggccaacatggtgaaaccccatctctactgaaaatacaaaattagccgggtgtggtggtgcacacttgtaatcccagctactttggaggctgaggcaggagaatcgcttgaacccagcaggtggaggttgcagtgagctgagatcacacgattgcacttcagcctgggcgagaagagtgaaagtccatctcaaaataaatgaacaaataaataaataagaagtgtataacatcgccaggcttggtggtttgtgcctgtagtcccagctactcagaaggctgaggcagaaggattgcttgagcctagcagtttaagaccagctagaccaatatcaggatgtggggcaacacagcaagaccccatctcttaaataaatagctaaaatagaagatatgtctaaattcattcagttaatttcatcttattttttctatcttgatttatgtttattgaaagcacatgttatgctatccttgactattttgaaacctaaacagttttctcctcaaatctctgaatacagacaggcccacgtaaaacctatttccaggatcctgaggcactgggaaattttgtttattgtcagatgagagagaacattttcaatgggaaggtcctctgtcatttgataacaacaaaatcaagagcacctttggcataaaaatgaaaatgaggctgacgtgcctgacttaatcagtagaaatgttttctcactagagccagtgtgtgaggggtgtgtgtgtgtgtttgtttagcttttgttttccatatctaattatataatgacttccccagaaaataaaatgagaaacagattcttgatgtgtcagctgttcatattgtgaaaacaaagttttttgatcagaactgtggggaaacattactgaaaagaaaaaaggaaacgagtaaagcaaaaagaaagagaaaaaaggaagtaaaggtctttgttatctacctatttaggggttcttaccctgaggcagctactctcacctcagattgacttgatcgttatttaaaagcttgataatttggtgttgaaaaactaggttctatgattggaatttgaaaccatacctcatttaactctcctagattcacagggggcttaagttttttataatatcatctgtcatgaggaaatgatagccattcattcattcattcattcattcattcattctattttttgagtggctgctctgttctaggctttgtacttcttttttttttttttttgagacggagttttgctcttgtccaggctggtgtgcaatggtgcaatctctgctcaccgcaacccccgcctcccagattcaagcgattctcctccctcagcctcccgaggagctgggattgcaggcatgcaccaccacgcctggctaatttcttgtatttttagtagggacggggtttctccttgttggtcaggctggtcttgaactcctgacctcaggtgatccaccaacctcggcctcccaaagtgctgggattacagatgtgagccaccgcgcccggcctaggctttgtacttctaatacactgtggttacctgaccttgggctgctctttctaaagcactatttctgtgacatcaaactaattatcaactgaaaaatacacattcaaatatatgaaaacatacacaatttactcatgtctagccacaaggggccaagaaagcagtgtcttttgacattttcatacttgtaagaagttagttagatctctctcaaacccttttactatgagggctgaatcctgagacccatgaaatctttggaaagccatggtttaaaaataccctgtttttaaagtgtgtacagaaaataactgctctaggtgagccagataaagtgctgttacatcagggtgtctcaacctcagttctattgacattctgtaactgactcttcagtttctgccacactggcctgtcagtgaaataaaacacagagaacgcagcatgtggaagtctttttaaaaatgttaatctatcttcctgtgtagacactggcaccttaggtgaaagaagtgaaaatttgttgttgttactctttccataattctcataggtttgtcctatcaggttatcgcctaagtgcttttttgcctagatgcctttaaaaacgtttggaaatgacttgaaaatattcagagtgtattttaaacactactgttacgctactgtaaggtatttacattgatgtatagatgtcatgttattctggtgatgtgtttttaaaatcttcattgtaaagcctagttagctagtttatatgtgattttttaaaaagcatagcctctggtaccatttaatatctactgtttgaagcatgcagttggaatctttatgttaaaatatacagacctttcagatattttaaataatacttgtctattagagtgaaattttgaaacaaaacgtttgatcagttattctttggaagcttcaagtcaattaatatgttaacttttaaacatgactggcagatctcagtatttaaaggaaatctacttcctatttgttgccattagctgtagttacttgagatacttggtagaggtaaatattgtagcacaaatccttttagtaacagttactttttaaggacctttgcaacttgacaatttatatttcaggattctcctgacatagacaaaatggcaaaggttacagttttctagactttagctttataaccaaaatatgtttttatatatatttatatataaatatataatatatgtaaattatatagttatatataacatatgacatatataattataataaatatatattaaaaattttggtcatatatacaacatatataactatatataattatatatagttataattatatatagttatatataatatataacaaattatatataacataattatgttatatataattgtacataacatatatacatatataggtatatatacgtatatatgttatatataattatatattatatataaaatataaataattataaaaatataataattattaaaatatatgttatatataaatacaatataaattatatatataaatatataatttatatattatatgtgatatatattatatattatatataatataatatataatatatatcacatataatatatattatatataattaatatatataattaatataataatatatataatatataatatatatgatatatattatataaatatataaatatattaatatattaatatataatatatataatatatattatatattaatattaatatataaatatattaatatataatatatattatatatttatatatataaaatatataattatatataacatatataattatatgtatgttggtttttttttttagatggagtctctgttgcccaggctggagtgcagtgccgcaatctcagctcactgcaacctccaactcccgggttcaagtgattctcctgtctcagcctcccgagtaactgggactacagacacctgccaccacacctggctaatttttgtatttttagtagaggcggggtttcaccatattgatcaggctggtctcaaactcctgacctcaggtgatctgcctaccttggcctcccaaagtcctaagtttacaggcgtgagccactgcaccttgcctatatatttcttaaaaactactttcttttgatgacaaatcagaaaagtagttagctgaatgaaggtagaaattcattttaattgcaatattaaatgggaatttttcttttcttttcttttctttttttagagacagggttttcctgtgttgcccaggctggccttgaactcctgggctcaagtgatcctcctgccttggcctcccaaagtgctgggatcacaggcatgagccaccacacctggccttaaatgggaattttaaatggtagaagaatggtgtttataaggaaaaacatctgagagaatggagaaaaccaggaagctggactctccctgtctccttctccactcttcctcttgagtgatgtagtcagctggatgctaaggaggaggaacactccatgggctctatgaatctcaaacatttctgaatataaaatattttcaagtgtttataagcttttcctagagtatcgtcccatgacgaagctgatcttccttctcaattcagcatagaaaataagggtaacctgagaaagaagcaatggtaataaatagacccagagtatattcttccaataggggattattaaaaataaatcttgaaattctctaatatttcttttctttttctgttaagttgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaaggtatattttattaatctaatacatttagaatacctatggattactatatcacaccattgagtggtgattttatagttttttgaaatagatcgaaggtagatggtggggggttgggaggcacttaaaaaggcttacagaagaaatattttaatacattaaacagcaaattaagttttatcatttttcgccttttagcaggttttactggctctggagaaaggccaaattcagagtagcatgatagaaaaagagagatagaaacatgaatgaattttttttttttttttttgagatggagtctcgctctggcgcccaggctggagtacaatggcgtgatctcggctcactgcaacctgtctcctgggttcaagtgattcttctgcctcagcttcccggggagctgggattacaggcatgagccaccacgcctggctaatttttgtatttttagtagagacggggtttcaccatgttgggcaggctggtctcaaactcctgacctcagatggagtcgtcctgacctcaggtggaggcctcagcctcctaaagtgctgggattacagacgtgagccaccgcacccggccacatgaatgaatttttaaattaattagatatccttcatttgggggttgcaaatgttgtacctaatagatttctattacctaatctatgacaatttaagtattcaggctatgatgccccaaatttgtttttttccctagctgttactttcaagtctaatttctaggcaactcatttcaaaacaaatgctgactttgggttttttgtttttttttgtttgtttgtttttttgactgactgttcttagttgtttgaattctgaagtatccattctagctcttatggaagctgtcagtaatgaaataaaagttgagatgtagccctaagcttttagggttacctgagatttcaactggatttgcgttatacattattttaattcagttgtgcctatgataactgtaatagatgtatttaatacagctttcaaaactcctgtgttttaattgaattctattcctcttggtccattcgcttaggatttaggatatagcactattttttaaaaatttgcttgcttgtttgtttgtttgtttatttatttatttatttatttatttttgagacagagtctcgctctgttgcccaggctggagtgcagtggcgcgatctcggctcactgcgacctccgcctcccaggttcaagcaattcttctgcctcagcctcccgagtagctgggactacaggtgcataacgccatgcccggctaatttattgtattttagtagagacggggtttcaccgtattgcccaggctggtcgtgaactcctgagctcaggcagtccacccaccttggcctcccaaagtgctgggattacaggcagcactaacgttaaggaaagtaaaatcagttattttagttcgaatgtcttgcaggtatgataagcatattataattgatgagtctcttgataattatactcaggtattttgggggttaatgtggactatggtaaaagtgtgtgaagaactgaggtggtggcatttatggagtaaaaaatgcatagtacaaacccagtactttaatgttttcttgaaatgtaaaatgaaagccacctgttctattccccccatactcatggaccatatttatgtctaggtgaataatcttaaagaataattatttcttctcattttatctttgttacatggaagaatctactgcaaacaacagagttttgagaatttttaatgttttacacaatatgcacgtaagtttgtgccttggggtttttaagaattttcttccacaagtcacaaagatttttttccacattttcttctatttgctttatggttttacctttcacatttatgtctttaatgtatctgggcttcacttctgtatatagtatttggtgggaattcatttttaacttttttctccgtatatggagccactcccaagggtttgttgtttcctcactggtgtatggggcagccttaattagacagtgggtttgcttttgcacctggatctggccagtcttctgtctgattcatctttttctgaatcccagcgccatacatgtttgttatctcataaaacaagttccccttgtcttttttctcagtttgatacagagttagttttttgtgcacgattattctttcatatgcatttggaataagtttgagtttctaaatagtagtagtaataataataataataaaaccaatgatgagactgcattaattttttttttcttgagatggagtctcgctctgttgccctgcctggagtgcagtggcacgatggctcactgcaagctccacctcccgggttcacgccattcttctgcctcagcctcccaagtagctgggactacaggcgcctgccaccatgtccgactaatttttttgtatttttagtagatacagggtttcaccatgttcgccaggatggtctcgatctcctgacctcatgatccgcccacctcagcctcccgaagtgctgggattacaggcatgagccaccatgcccagccaagactgcatttaatttagggagagctgaagtcttcataatgttaagttgacctatcccaaaccatagaaagtcttgtttattcagatctcattttacttcttttaacagttgaacatttttctttttatttatttatttatttattatactttaagttttagggaacagttgaacatttttcttcacggagatcttgcatattctttctttagttggttcctaagtactttatgggttttgttgccattacaatggtaccttattttgtattgtattttctaattgttgctggtgtagagaaatacggattattttaagtcgatcttttatctattaactttgctgaactctaattacttctaataatttactgattctttgtgattcggtctgtgatcctatgtgaatgtttatacaaatagtgatgttttgtttcctcccttccaatctttattcctgttttctttttctctttttttcttttccttaaataatcatggccaggagctccagtttaaacacagcaaggccagtgggcattcttgtcttcctgaacttagtggcagtgttccctgccctccttctcccttcatctcactgaagggccctgtcagcttctttgtggattctcagtgcctgtcttggctgatgcctcagcagtatttaacactgtcgacttctgcttcctccacttcctgagactgtgtcctccttgctcttctctctctgctgcttctctgtcagtcctgttgctgggctaagcttcccctgcccctgtcctgagtgtttcagtgatcctcaggctcactcccccaccctcttcctgctgagctccctccctgaaggactccctcccacgctggcttcagttcactgtgactatgtcctgactccagctggttccttagatggccacacatacctctgactcctaaaatccactcttcctatcttcagtgattgaccactactatccttgatgccagaaacctaggtgttgtccagtattcttcccagtctccattcaaagtcactgtgtagattcttctgcctggctgagccatgaatgcttctgccactccacagccctctgtcctggccctggccctggcctgggtgctatccctctgacccaggctacccctgtgggctacagtctccggcagccaccggaagctggctattgtggaacagctttctgatcctcctaatcatgccagaggcagcagctcccttcttggctcagttttttgggaattgttcctgaaagttcagctaaactcttcattcctcacagtgattctgggagccactgatagttcttaaaaacagcagtttcttgcccccaacatctccattactgcattgcacttgttttgttttgtttcgttttgttttgttttgagacagagtctcactctcttggccaggctggaacacagtgatgtgatcttagctcactgcaacctctgtctcctgggctcaagcatttctcctgcctcagcttcccgagtagctgggattacaggcatgtaccaccatgcccagctaatttttgtatttttagtagagacggggttacaccatgttggccaggctggtcttgaactcctgagtttaggtaatccgtccatctcggcatcctaaagtgctacgattataggcatgagccaccacacctggtgtctggggtctttttaataagggcactaatcctgttcacaagggtgtcaccctcatgacctcatcacctctcagaggttccacctccaaatactattgcattggaggtgaggatttcaacagaggaaattgggtggggatacaaacattcagtctatagcatccactcaaaagcatccatcaatgtctgtgacctgttagacaaagctccaaatctttcatgtggcccaaatctttgcttgatccaagccttgcattctttaatagctgcctacctctccacttctccctcttttgtaatacagctctttctttcatttcctgggataggccatgccctctctccctccagggccttcttcacacataccgattgcctgataagaatacgttccccgaggaagccttgcccatcctccacatctggcttaggcaaccttctgtgagttcctactgtacttccttaggcacatatcatgttgtgttgtggctctctgtcttgctagatggtaagttctatttggacaaatacctagcacagaccctggcatgtgataaatgttcagtaagcatttaccaaatgaaagtgaactgttcttcctctgaaaatgtgatttgttctgtgtgctgattgacttgagattaactggtccagggaatacattaaaactactaagagcagtaatcaactaagcaacccatttcccttctttctttccttccttgccttttttttcacaccaatatttattgagcatctatgtgccaatttaaagaaatgctgacataaaaatcaatttcttattgattttctgaaatttgaaataaaatttactaatagcattcttggacccaaaccctcaggtgtgactgggacagcaaagagtccctgctggagccccagattgaggttgatgtctaggtgaccatccagggttccttactcagccaagatatcttcagctgaattgaaaccctaaccccattgtcaggtatcctggagaattactagaaacatggacactccctgaaactttacctcctgagcatctgaggtgtaaagtccttacctttactggaagatgattaaattaaatacagctaaaatgtggtgggatgtcctttcattgacataaggttgggttgaattctaatcatacaagggaaagggctttgggtgcggtggctcacacctgtaatcccagcactttgggaggctgaggtgggtggatcacctgagatcaggagttcgagaccagcctggccaacatggtgaaaccccgtctctactaaaaatacaaaaattagccaggcatggtgggcacctgtaatcccagctacttgggaagctgaggcaggagaatcatttgaacccaggaggcggaggttgcagtgagccaagattgcacctttgtactccagcctgggggagaatagcgagacttcatctcaaaaaaaaaaaaaaaaaaaaaaaaaaagacaaaaggtctcagtggcatgtcacttatttttttgcagtggaaatgccaataatttttttccaggctatggtctgttctatggttgaacattcgcccatttttgtgtctaaccttataatcactgaatttcctataatgatccagctctctatgtgccaagccttcattaagtgatccaaataaaatttgacatttaaaaaaaatgtacaaatagtaattttgatttatttatgaattttaaaaatcccaaatgtcttttcagggggttttaatctgggaaaataaggtattagattgaatcacatgaaactgctatttttgtaggccagaaagttcaaatatcagcaagttcatgtgattcaatctagtagttatgggagaatactacataatacttgctccattggcacagtgaatttttaaaatttaattatctactccctttaagtgaaagtagcaaattctgtatcaccttaggaagagttggattttttgatggtgtagcaaatggctcagcaaataaaaatgttaagtgaacacaggtggctggatatttcttggtgagtttagaagtgactatgaaatatggtatttctttgctgatagtcaatgtgttttttttttttttaaatctccaagtgttttttctcttatgagttaggaaattatgttgggtttattctcccttagtttacctagaagccttggacacaacaataataaagaagtagccctgtaagatacaatcatgtaacttttaatgctaaaagagacattattattattattattattattatttgctagagcccacctcaaacagatttctatgtaaaaatgagaaacaagagcattaagatggtttattacaggaagagtttttatagggcttgggtttcagtgagctcgcctgtgacaaagcaaattgatggcagtgataggctagtgatgtcattgtgatgtcagtcctcctgcttatcctgcacatgcttgctaatttggaacactttatgttgaactgtggtagaggaaacaagacagttctgtctgcagaagcccattatggctgtaactggagatgacacaggtaagaatgttaaagaggggttttcagttaattgtgcagattgttttgaagtttaggaagtattcaggaacatctgagtgtttcagaaagtgttactctcctagtcacttaggtgtaagactttttttgaaatatacatctatatattcagctcactttgttagggcatcttagtgtgattgtttctttgctcaatattctattgcttgcttgactgaggcactaatcctctcttcctccctctatcctccctcccctcctccccactcttcccctcctcttctcttcccctctcctccatctctgtgtctctctttcatatgcataccattctgccctactaaaataagctgttacttcataggcaacctgttgcaaattcaatctagccgcagattaaacatacagtatataccgttcatgttctgatttcattactgtggacaaatgcagctccaaacagaataggaaaaacccgcgtgttatggatgtttgtgtgcctacttgtttctttcctcctgtatttaaaatggtctgttcagctaattgagttcaaaaggctgatgtcattacatttcctggaatcgtatttcagcaggggaagtggaaaagttaaaactccaagcgagctgcacattgacgtcagctccgagtcatgttgtgatttagtcagttcctttccgctttgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctggtgagaaatggattatgtattgtataagctggcgggttctttactcttactccatcctcttactccatctataggaacttgcgattcagagctcctctagtgttcagtcagggaagtgcttgtcttttacttgttctcccagcctctggtatttaaatttgtaatcggtaatttttcactaggtttgcttttctcagtaacaaagagtgattttggaagacttagttactaataacctttgtgtgcttgcagtgttgtttattcagtggtcttgtttgtaatacagtactgaatttgcagttgaattaagagttttaaacaacttcactacaatttagctcttcgaagttaatgggtctcagccctctttgtggataggaacattggattgtcttgagtaagtaaaacctgtattacattgtttttaaaactgtcttgaggaactatttttttctcgaagttttgtgaagttctagagatgctatagactgcagaactcaaatgatgaatttattataagacatagatgaacttaaaatcatctcaaacactgcatgtcatatgattcttagaaccagaaggcacttttgtacatatattttctaaaaattattggttaatatctttctttaccaagcctttcattcctattacccctttgacttgtctaagcataagactcataacaaaaaataaataaaatgatgtgaaaacgctgtgtacttttttttttttttttttttttgagacggggtctcgctctgtcgcccaggctggagtgcagtggcgcgatcttggctcactgcaagctccgcctcccaggttcacgccattctcctgcctcagcctcctaagtagctgggactacaggcgcccgcctaattttttgtatttttaatagaggcggggtttcaccgtgttagccaggatggtctcgatttcctgacctcgtgatccgccctccttggcaatgctgtatacttttaaccactacatataaataaacaaacatttttgacatttgtttttacagaatgaacataacatccttgaaagtttttttcacagttttaccaataatgctacacatgattgattttccttttccaatttaaacttttcaaaatgctgaaactttaaaatgtcaaacaacttaaaacactttttcacaagacctgattttgcctttggaaatcatatttttaaaaatctggtcatttcttacagaatcagtgctatttgaaaaatgagtaataaattttatttcattttactttatttatttatttatttatttatttatttatttatttatttatttattttatgagacggagtctcgctctgtcgcccaggctggagtgcagtggctggatcttggctcactgcaagctcggcctcccgggttcacgccattctcctgcctcagcctcccgagtagctgggactacaggtgcccaccaccacgcccggctaattttgtttttttgtattttagtagagacggggtttcaccgtgttagccagaatggtctcgatctcctgacctcgtgatccgcctgcctcggcgtcccaaagtgctgggattacaggcgtgagccaccgcgctcggcctcattttactttatttttttaaagccagaagagcacagggttaagggacttttttgaaggtgtagtagagtagctttaggaaccagacctctgggctctcagttctgaggtaaccctatggatcggcagaccaagtagatctagattagtggcttgcaaacttttcaaccatgacccacgttaattatcacggcaaagtggacctatgtgtgtatgtaccctacatttatataaaacaagtttcagacataattcttatccttacaaaatatgatgtacccataattccttttctgtcctttttttaaaatgctattcttgacccatgaaatttgctttttgacccattaatggtctacagcttacagtttgaaaaactttgatctagaccaaaatcaggctcctagcactaatggctggcctggaaaagatattagcagcatttacctacaggatcatgaagtgaaatattaaaagcaaatgactggccgggcgcggtggctcacgtctgtaatcccagcactttgggaggccaaggcgggcggatcacaacctcaggagttcaagaccagcctggccaacatggtgaaaccccgtctctactaaaaatacaaaaattagccaggcgtggtggcacgcgcctgtaatctcagctactcgggaagctgaggcaagagaatggcttgaaaccgggaggcagagattgcaatgagccaacattgcaccactgcactccagcctgggtgacagaacgagactccatctcaaaaaaaaaaaaaaagtaaatgactatagtttatgggattatattattgattttgtggggcataatttacatttttattagaaattgcctttgttttattcataaactgattctgttaggagcataatttcctatcttttagactctgagtctgacgttgcattctgacgttgcattctggctggatttctgcattgtttaaaacaaactttccaacaaatttggaaaactagtgtcttagttaatatttgatgcatgagaataaggatatatatcacctttgtgaaaggaggctattagcaattatttttgcttaaaaatatttacataaaagaataatttcgaggctgggcgtggtggcttacgcctgtaatcccagcactttgggagaccgaggtgggctgatcacctgaggtcaggagttcaagaccagcctggccaacatggtgaaagcccatctccacaaaaatacaaaaattagccgggcgtggtggcatatgcctgtaatcccagctactcgggaggctgaggcggaagaatcacttgaacctgggaggtggaggttgcagtgagctgagatagtgccattgcactccagcctgggtgacagagcgagactccgtctcaacaacaacaaaaaagaataatttcatttaggtgtgacagcttcttgaagttggtaactgaacaagttataatcactttggaagtgaaaataacaaggcatttatctaccttaagattcagtaaaccaaatctgcagggtgaaattggaaattactcatgttattttcctactacttttgaaaaatgcataacgaaatgtaatttgggatatttatttcactttgccctgtttatatgaatatattaggcaaatatatttattcatttatattctaataaaatatactttgcatttatgtaaactttaaaataaaaaaatcacttaatgttacaaataaacatgaataccaactatagaaagtgctgtcaaagaaactatcagattgtgactgacacagaaacaggacatacaggttaagggatcaggtaggcctcactaggaaaccatgttcaaatgctaaaaaaggcagtttacaggcattctcactgatacatgcccaactacacccaggtcagactgggtaaatgacttccaagtttacaaagctagcaagtagtggacccgttcgagtcttcagaatcctcgggttctgctcatagcatattaatgtgactcctcaaaagtcacctgacattgacacatgaatgcagtgtcacgtgagtacatgctgctacacactgcttataaaacatataaaatgaggttaggttaatattattttaagtcgttaaaatggctttttttttttttttttttaagacagagtttcactcttgttgcccaggctggagtacagtggcgtgatcttggctcactgcaacctctgcctcccaggttcaagcgattcacctgcctcagcctcccaagtagctgagattacaagcacccaccaacacacccggctaattttgcatttttagtagagacagggtttcaccatttggtcaggctggtctcgaactcctgacctcaagcgatccacccgcctcagcctcccaaagtgctgggattacaggcatgagccaccacacccagcctaaaattgaattttttatagattattattactctcataggacagtagagcatatatttgctattatatggaacattaaatttcagtgttcgtaatttcccatcttttatatagactgacttatagattttcacatactgaactttaaaaggtcccttatgtataacttacttagctggattgtaataatttcataatgtatgcatatgtgaaagcatcacattatacactttgagtatatacagtttttgtcaattatacctcaaagctgaaaatattttggtgagttaattctatgtggtctatgtgttatagtgattgtagcaaatttgaaaatgatcagtgcttaaatagccatttttatgtagggtttaattttcacagagaagggaacgtttttggcagtgtgggataccaggcatggaggtgtaggatctgggtattaggagcaggtggtggtagacaggaagagaaccacagcagtggtggtgatgtcagcagcttaccagagctagggatagaagccccccacttagaagtgtgacatctaagttaacctctgctgcttacttaaaggtgtatttaggattagtgccatgctgtgaaatggcatatgaaaacaggaactctctatataaaaatgttttttattcagtctttgtgctcagtactacagatatcttaataaacaattgaataaaatcaccatcatttggggtgttgagaaatcgtttcactttggaagttaccaacataggtacttggctgggtttcttatttatttctttgtttcctactctcacttgtgggtttttttttcagttttcttcttcccagtctgatgagagtatatctttggccatttggggttctattataaatgattgcatacattgaaaaggatatcttacattatctttaatgtattctctaaaggaatataacgatatataattttataagtttttaataggcatattttttaacaaaataaggaataagagccataaatttggattccctgggtttgtcagaagggaaactccagggggaaatgtatttatggatgttatatgcgttttaactaatatacggtataagcataacttggaacgttgtctttcagaacttaaggaggggaagaggaagggaactaacatttgtggagtgcctgccatgtgccaggcactgtgctagacactttgacatacattgtagggtttattgtgagtattaaatgagatactgtatccccattttacagatgaggaaactgaacttgccccaagtcacatggctggtaagtggcagagctggactagaacccagactccaaaccccatgctttttctgctgtaccgtgtttaaagcttgcaaagagagatatgtagttaatgaccaaaattgagagttctaggaattttcttttcccatgaaatatttgatactgaacctaaaaaaaaaaaaatgctttcatgtcaggagctagatggaagcacatcataatgagaacgcctttgcttttaaaatgctatgttagacttatctaaagtgcatctaaggaaaatttaagaaataatgccttttatcaagaaaggccactttgaagagacacatcgcatcttgtagggctttccatgtcttagaggtaaaggtttagctataataatgtaagtttataagaaagactgcttattttaagcattctaaatgacagcaggcttgtgcaaaacccgaggaagttcaaattttacttcatacagcacacattaactcatgaaacacccattatatgccaagtatgtgctagattctaggggtttctggggttaaaaagatactatccctgatttgtcttaaagtttttgctttcctgagaataaagttagtgtacaaatatcttataatctttcttcaatcatgattgttaattccccactgataacccatatattttcaaaatatgaaaattctagaataaaaagtaatttagacactttcagtagttaaatgggacaggaagtggcctttataagaatacaggaatagcagtgtgtcatcagagaatgcaggatggtctttgaactgtgatccttggtgtcttatctgctttaaatttccactgagttcataatattggaaatttgaagctaactaagataaatactttttataacttgttttaaaattaaaacttgtgacatttagattttctcaaaacaagagattatctttgtatctttatttttttaagagacaaggtcttgctatgttgcccaggctggacttgaactcctgggctcaagtgatcctcatgcctcagcctctgaaggagctgagattacaggcatgagccactgtgcacagctgtctttgcccatatctttttaaatgtactttactaataagattatatttgagtatatggaatttgtccatcgaccattagaagtataccaccatatagatcctttgggatattatagaaatttatacaaattcctactaatttatactaactcctgtttctggcttgaactaatgcgcttgtcattttgattttattgagggaagtaaaatgaatatatgatacctctgaaaaattataataaaacccagtcacctaacatctcagaactaatacatctgaatatatcatccccttccaagttattttaaagtggtatttttttctgagctatcgctcaaaatgtttttaagaattcttattttggaactgccattatctttcatggtgccaaatttggtcccttgagggtggttgttgcttctggaaacaggcaagagttgtttggaagcatttctgataaatacaaggccaatgaatgaacgtctttttttgcttttttcctttttttttttcctgagacagggtcttactctgtcgctcaggctggagtgcagtagcataataacggctcactgtagcctcaacctcctgggctcacatgatcttcccacctaaggctctggaaccacagacgcacgccaccacacctggttaatttttgtatgtcttgtagagatcaggtttctccatgttgcccaggctggtcttgaactcctggactcaagtgaacctcctaccttggccttccaaaatgctgggattataggcgtgagccaccatgtctgcccttgaacttcattgttcacctgtgactattcccacccaccctttttttaaaaaaacaagttttttgtggccgggcgcagtggctcacgcctgtgatcccagcactttgggaggctgaggcaggtagatcacgaggttaggagttcgagaccagcctggccagaatggtgaaatctcatctctactaaacatacaaaaattagctgggagcggtggtgggcgtctgtaatcccagcaacttggaaggctgaggcaggagaatggcttcaacctgcgaggcggaggttgcagtgagccgagattgtgccactgcactctatcctgggtggcagcgtgagactctgtctcaaaataaaaataaaaagtaaaaagtttttttttttgttttttgtttttttttaaactagcttttgtatatatcatggaaccatcctgctctaacttcatattacaagaaaacagcaaacgtctacagaactagagtgtaatgagcccctctctacccattaattttactacacgtctgtgtgagcagtgtttggaaagaatgatcctagaccaaggtccatatccatgctgcctgcatgtgtcaacctggtgtcatgtaaacttctcattcgtcactggctattgttccaattttagaagacctaggtgaccaccagctgttctattgtttcagcctttattaccccataaccttcttccctggatgtgggtgaagagaaaaaagaggagagctatgttattctctgctccactccatctcttctgacaatacgatgaagatatgttaaacaatctattaagttagtttataactggcttaacgtgaccttgttaactatctcaaagctatacagttttgtacgactcattgagttgtctgtgtatacattattttgtatagtcacaaaaacaaatttaggacttttcccaagtttattcatatgctggtgatcattaatcacaattaggccaggcacagtggctcacgcctgtaatctcagcactttgggaggccaaggcaggcagatcacgaggtcgggagatcaagaccatcctgggcaacatggtgaaaccctgtttctactaaaaatacaaaaattagctgggcatgatggcgcgtgcctgtaatcccagctactcgggaggctgaggcaagagaatcacttgaaccagggagtagaaggttgcagtaagccaagattgcaccagtgcgctccagcctggtgtcagcaaaactacgtctcaaaaaaaaaaaaaaaaaaaaatcaattattccctatcaccaatgttttaaaattacatgtagaaggaaaaggcagtacaaccttataaacaatatttttattaattctatgaaaatctttaagtgagcttccttgaaagccatgtttttaactgttgtattctttcacctaattctcaagccttagaaggcagaaatctggcatatacccaaatagaagcacataaatcagttaatctttgtttaacttttttaaacaaagtttcagtgataatatcctatttagctgacaaagtatttgtctcccatgggtagcatttcacttcttattcattgggtataatacattttcatgaaatacagaaatgctgtgttttcctcttttgattggaatttagttcaggcaattgttatagaatttgataactttttaaaaaatcttttttcttgcacttagctttgagagagcatgtattttgtaatgtctcatcagagtgacaaactaactctggaccatacgttctcaatgttgaagcgttggtggtagaaatgttttatcactcgaatccatctgtcttttctaggaagctatgtttcttgcagtagacaaattttgaatataaattaggaaactttgagaacttacttttagtatttgatctgaatactaagtaaatattaaacgctgtattttaactgtatgattatactatgcttagacaatacttttaaatgaatatttacaaatgtattattttcctagaaacctaagaaagaaaaattatctttccccagagaaactaggtttaagcagagctttgctgggtttttattgttgttttttgttttttttactgaaactgcagtgagctcaattccttccagtgcttcagtgattttctagtaatgagaattgcacttaaagacattcagtgactgtttcaggcatgatatggagtataggaaaatctctaaactgaaacattcagaggatggagatattctgcttaatggaaatttttgcagtggtgtgctacagtcagctcctcctggcttgctagagcctattattaaattttcaggccgggcgtggtggctcacgcctgtaatcccaacactttgcgaggttgaggcaggcagatcacttgaggtcaggagttcaagaccagcctggccaacatggcaaaacaccatctctactaaaaatacaaaattagccaggtgtcgtggtgcacgcctgtaatcccagctacttgggaggctgaggtacaagaatcgcttgaactggggaggtggaggttacagtgagccaagattacaccactgcactccagcctggagccacttagtgagactctgtctaaaaaaaaaagccaggcgcgatggctcacacctgtaatcccagcactttgggaggccaaggtgggaggatcacgaggtcaggagattgagaccatcctggctaacacggtgaaaccccgtctctactaaaaatacaaaaaattagccaggcgtggtggcaggcgcctgtagtcccagctactcgggaggctgaggcaggagaatggcatgaacccaggaggcggagcttgcagtgagccaagatcgcgccactgcactccagcctgggcgacagagcgagactccgtctcaaaaaaaaaaaaatatgtgtgtgtataaatatgtatatatatacatgcatatatatatgcatatatacatacacatacacaatttacacattaaaaacattagtactcaaaactcataatttccaagtattttctctgtgctctgtgggtattggcatctgttttgtctgtatgctgtgctgcttaccacgtgtgtgtctttccaactctacgctcaggaaagtcaccttggtagcttgaaactggccatggtggaagtatttacatcgtgagaattactgaacactacacatcagggctttttcattgttttgtcctgaggactgtttcttaaatatttattagcacaccactgactttaagctaaatgagcatcttaagcttttgcctttgataaaaacctgtctaaaatgcattaggatgcttttctaccttaagtgtttagagcatgctaaatatcattgttctaagtgctgaagaagatctttaatacttgagattgctataatgctcagaataattatcttaaacattacaagatcacctcttatgagatgtcaaaagtatatcatttccagatcagttttatgtaaaatgccaaattatgaattctttatataagctcaaaatattttgttttactgcagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacaggtgaggtgttgcacagggaatcggtaacttctaggacactttttaaaaattacagttttcaccgggcgcagtggctcacgcctgtaatcccagcactttgggaggccaaggcaggcggatcacagggtcaggagatcaagaccatcctggctaacacggtgaaaccccatctctactaaaaaatacaaaaaaattcgccgggcgtggtggcaggtgcctgtagtcccagccacttgggaggctgaggcaggacaatggcatgaacctgggaggcggaggttgcagtgagccaagatcgtgccactgcactccagcctgggcgacagagcgagactccatctcaaaaaaataataaaacaatattaaatattaataaatgataataaaataatgataaaaataatatcaataaataaaaataaaaataaaaattacagttttcagctgggcgcagtggctcccgcctgtaatcccagcactttgggaggtcaaggcgggcagatcacaaggtcaagagattgagaccatcctggccaatatgacgaaaccctgtctctactaaaaatacaaaaattagctgggtgtggtggtgtgcacctgtaatcccagctactcgggaggctgaggcaagagaatcacttgaacccggaaggcggagcttgcagtgagctgaggtcgcgccactggactgcagcctgggtgacagtgagactccgtcttaaaaaaaaaaaattacagttttcataagccatttctcccaagttacatgttgtgtggcatttcatgtaggtttgtgctctgtgtgtgttattagattgtcttccagtcagaattcctggctgttaaactatttcatcagcaggagttacatccctatgttgtaagggtgatgtccaaaagatacagtaatttttaaaaataatgattaaaggactttgttagaaacaaagagctattttgtatttagtatttgctgtgaagtaggtgataagtcgaattttttagcttctctctgagaaaaatgaagtgtaagtgaggcgttacttttcgacattttctacatgtagtttccttttgtctattttttaactttttttcctctattacactgaaatacatatttaatctgataaattctagtcaagtgcaaatacaaaataacaaaaagaattaaaatcatccatggctctaaccacttaggatacctcctattatagtctatgtacttccagtcagctctcattttctctcactttttcttgctccatatctctgtcattttatttttaagcaacatattataaaatgctattttctaaaactttttaaaaatttaaacataaataaaattttatttaacttgtatattatttattggtttagtttttattatgaataatggtgcaaattaatctgattttcaaaaggaacagaattgtcttagagtttcccagtagtcttgtcaccttagtcctaatgtcaaataatgtcctcattgtgtgcagccaggacagagattcagcagtgttatcaagggcccagactcccgctcccggctgtgtcatcttcagcatgtatcattcattctcatgatcacagcgcggctactgaacctctaggcattgcctcagacaggaagaagggctagagccaaaaattggggctagctgaggtctggcccaactgcaaacctttcctggaagatcctcccagcaactttcacctacatttcattggctagaaataggtctttagtccctagctgtacaggattctgagaaaggtttattttcgctttctaaatctcagtttcagagcaagacaagagaaatgcagatgatacctggctgttaggttgctcattatctgtttagcagattttaagtgctttatttctactgtgtgtttaatgcttacatgagaataggtgattattatgcccagtttacagatgaggaccagaagttcagagatgttaaggaataagttggtcaagatcacatggcccaaactgggcagaaccaggatgggcaaccgggcagtctttattccagagcctgtcctctataccagcatcaggcatctcaaaaataccccatgataacctgcaaatttcacttcctggggaagtgtgaggctttagtcattcacagatagatctcttacatattttctttttattctttgattggcatctataatcgatatctcattatatcgtatttctgccaatccagcaacagtttttatttctttccagccttgtcagagtttcttccttgccttgcacttcctctccgtgctgaggatacacccagacacatgcaagcctgaaaaccgagctcactattaatagaagaaacaggtgttttccatggctgaggagtgcttaggaatgtaccatctactgatgtgatcggggaaagctttgtgcctgcaacattttgactctagtaatatgtgtgtctgtgcatgcacacacacacatgcacactcaaatgtagaagatgaagtatgagtatttataatagcttattaaagaaaatgtttaaacacccgcaacaccgctattaggtctttaaatttttcatttaatggtaaccatgttttgtaaaatgactatcttccttctaggtctagaatttaatataatttaatcatgaaaacgttggtattcataaatgaatttcagtgcctttgtggaaaagagttaaattatgtccccaaattggcaaatgtgtgtgtttggatttattcttaacttttccaattgcatcatttagattaaattagtcactataacattcttttcaattttacattttaaatttcttttgttaaccagctgagaagtctgagaactttgtatgttcacagggtgagtccattgttcctggctaggaagcaggggttgatcttttcctgcagttcatttggattgaaggttcttctttgctgactcttgcttccatagtgaaaacacagatatccactcagtgagagtcagctatcttaaaaaaaaaaaaaaaatcatgtatacatcacatgtggttcaggatgctagctggcattacagaaactggtgtttagacattcaacactgctttttttaacatatttgaatgatagtgtctgtttcagtgcaggcttttttgacatgaagggtgatctacctcaaaggcagttattctggaattgaatcctccaaaatgaggccaattaaagggtgtcttctacataggagttaagggaagtggttgccatccctcccaccctgaaaaaaagaaaaagagaaaatgttggctctatttattgttttggtggggttatgtatgaaaatgactaagtcaactcatctgtttgtgttgttgctttggctactggtctgttctttcattttgggcttatagtgctttaaaattcaatatattggatattaaatgcatgtgattaggaaacagtcttgaaatatgcccagagttactcagtagcttcttttttataattttaattgtggtggtctcacatttgtgggtttaaattgtctgagttattgagtgttgtattttgtagcccccttctttaattttcagaagcactgtccatttcatttcggtttataaaaatgcacatcttttgtttattgttatgatttatccatgtgtgttttctagccaataaactgtgtcttgcagtcatgattgatcttgttttactgagatttagttttgaagactaaaaatctccagtgttgatatttaaggtttttgaggattaattcttataatcatttttgatcgaataaaattaactcattatgtcggagtatgtgccttttgggagacaaaaataattaagagaattgaaaggatctataaatgtgtttgtagaaattccacttggggatgtggtcctattgtagtttactgaaaacagttgtgggcattgttaccagtggaatgtgtgccctaagaaaacaccatttgtgatgaatgctgggcgaactgtgttctcaaatcattcctgttgtctaatggttatcttacaaaaagcatgtgcctggttatgtttgttatgtggctttgtacagtccttacctaggatcgattggctgttgagttcggggggcagaagtgcactgacccactgtggattgtgttggaaggctgttcctgtagtcatttgccttgtgttgcttccagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccaca

SEQ ID NO: 291 - DNA, 75177 bp, Homo sapiens; identical to SEQ ID NO: 290

SEQ ID NO: 292 - DNA, 12309 bp, Homo sapiens
agctacgggtcagagctagtccactaggtgctaatcaaatgctgtgttacaacactgtgaggttttcccagttataagtgtcactattagggttttttttaattgcaaagccaaataaggctgtcaattgcatcatcttaccttatttcttcagattaagtactgtttatagtgggatttttggtggatgtggtggcatcagcataatctatgtttcaggcgtcctatagaagaggattattcttcaggggatgtggaagaaaaggtaaatgatgtctgctataagtaccttcacacttttaaagccttgtgaaaagaggggtaaaaattgtgaaatataaaataacatccattttatgttttagttttttgttcttgcgatagtttactgagaatgatgatttccaatttcatccatgtccctacaaaggacatgaactcatcctttttttatggctgcatagtattccatggtgtatatgtgccacattttcttaatccagtctgtcattgttggacatttgggttggttccaagttgtagcagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcgccattctaactggtgtgagatggtatcttattgtggtttagatttgcatttctctgatggccagtgatgagcattttttcatgtgtctgttggctgcataaatgtcttcttttgagaagtgtctgttcatatccttcgcccactttttgatggggtggtttggttttttccttgtaaatttgtttgagttcattgtagattctggatattagcccattgtcagatgagtagattgcaaaaattttttcccattctgtaggttgcctcttcactttgatcgtagtttcttttgctgtgcagaagctctttagtttaattagatcccatttgtcaattttggctttgttgccattgctttttgtattttagacatgaagtccttgcccatgcctatgtcctgaatggtattgcctaggttttcttctagggtttttatggttttaggtctaacatttaagtctttaatccgtcttgaattaatttttgtacaaggtgtaaggaagagatctggtttcagctttttacatatggcaaaccagttttcccagcaccattaattaaatagggaatcctttccccatttcttgtttttgtcaggtttgtcaaagatcagatggttgtagatgtgtggtattacttctgagggctctgttctgttccatcggtctgtatctttgttttggtaccagtaccatgctgttttggttactgtggccttgtagtatagtttgaagtcaggtaacgtgatgcctccagctttgttcttttggtttaggattatcttggcaatgtgggctctttttgggttccatatgaactttaaagtcgttttttccatttctctgaagaaagtcattggtagcctgattgggatggcattgaatctataaattaccttgggcagtatggccgttttcaccatattgattcttcctgttcatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctgtttgtctgttactggtgtataagaatgcttgtgatttttgcacattgattttgtatcctgagactttgctgaagttgcttatcagcttaaggagattttgagctgagacgatggggttttctaaatatacaatcatgtcatctgcaaacagggacaatatgacttcctcttttcctaattgaataccctttatttctttctcctgcctgattgccctggccagaactgccaacactgttgaataggagtggtgagagagggcatccctgtcttgtgccagttttcaaagggaatgcttcccatttttgcccattcagtatgatattggctgtgggtttgtcataaatagctcttattattttgagatacgtcccatcaatacctaatttattgagagtttttagcatgaagggctgttgaattttgtcaaaggccttttctgcatctattgagataatcatgtggtttttgtctttgtttctgtttatatgctggattacgtttattgatttgcatgtgttgaaccagccttgcatcccaggaatgaagcccatttgatcatggtggagaagctttttttttttttttgagatggagtctcgctcttttgcccaagctggagtgcagtggcatgatcttcgctcactgcaagctccatctcctgggttcacgccattctcctgcttcagcctccctagtagctgggactacaggcacccgccaccacacccggctaattttttttgtattttttagtagaaacggggtttcaccatgttagccaggatggtctctatctcctgaactcgtgatccgcctgcctcaggctctgaaagtgctgggattacaggcgtgagccactgtgtctggccggataagctttttgatgtgctgctggattcagtttgccagtattttactgaggatttttgcatcgatgttcatcagggatattgttctaaaattctctttttttgttctgtctctgccaggctttggtatcaggatgatgctggcctcataagatgagttagggaggattccctgtttttctattgattggaatagtttcagaaggaatggtaccagctcctccttgtacttctggtagaattcggctgtgaatccatctggtcctggactttttttggttggtaggctattaattattgcctcaatttcagagcctgttattggtctattcaggaattcaacttcttcctggtttagtcttgggagggtgtatgtgtccaggaatttatccatttcttctagattttctagtgtatttgcatagaggtgtttatagtattctctgatggtagtttgtaattctgtggggtcggtggtgatatcccctttatcatgttttattgcatctatttgattcttctctcttttcttctttattggagtttaacctattaactctaccagtataattataaggttgacgctcttgcttataagttttggcctaaccagtgagaatgtagaatgatagttctccagatataagagttttcttttttaaaaggagacatttgaattctacctccagatgcgtcatttatgcaggttctcagcctttattttagcattttaatgaaaaaattgtctcatgagcttttggcctgcctagagtttggacatatggaagtttccttgtagttacagaatctgtataacctatctccagaattgtaaggatatggtttatgttagcgggtacaagttctttttctgcagcaggtattcttaaccaagcctttttttttttttttttttttttttgttaaggcacagtctcgctctgtcatccaggctggagtgcggtggcatgatctcagctcactgcaacctcgaactcctgggttcaagaaattctcatgcctcagcctcatgagtagctgggattacaggtgcgcacaaccacacccggctaatttttgtatttttagtagagagagggtttcaccatattggccaggctggtcttgaactcctgacctcaggtaatccacctgcctcggcctcctgaagtgctgggattacagtcatgaggacttagccatttttgatagagttattgtttaattaaaattctgataattgtacttgaaagatgattaaagcaatgtaaaggatgatttatgcctatcagatgcccatgaatctttgttgaattgtttttctgttctccataataatctgatttctttgaagctgggcatttccccacaaaaaatgaatgtggacaccacctgccatctcaacccacaggtctagtttgtgagaatacttgtaggacccctgggtttcccccgctatagtttcaagtacattgtcttcagataccttattctatgtacttggaaaaaagagtaaaacattgagagccactgggatctgacaagctttgggagctccttaattctaaaaagaaaattattttgatttgagaaaatgtaatatcttcagaaatttccaccacccagctatgtgactgcatttttaaaaaaggaaaggaacagaggaaaatcaagtcactctaccctccttacttacctgtggcttgtccctacacatggtggtgggtgggagaagtggtggtggagtactgggtcctccagagagctcagtttggaatctggaactaaagatcatgtcccaatttcctgagctgatgggatagaagctggtcaatgaagtcttctttttgtgttaatttttttcctttgttttcttttgttttatgtagttataaagcataatttctattttgccagtctctgacacatgggctctgtcagggttactggatatgtttattttgtctctgctgctctactggagctgaaatctcagcctgtctgagcagttctttaagctgaaagccagggtgtaggggctagattagtgtggaatagctgttttcaaagtgtggtgtgcagaaccctgggggtgactctgagacattttcatgaggcttgctaggtcaaaaccattttcacggtgatgctaagatgttgtttttctttttctctgttttgatatccacactgatggtgcaaaaacagtggtggtgggggagtggtaaattgttgggtgccttaactcaagtcagtgacacaaactgtgttagtattaactgtattcttcactgccatccacttgcagtttttttttttttaagtcagttttacttaagaatatctttgatgaagcagtaaaaattaccattgcattaaatcttgactctgagtacatgctgttttgatattctgtgtcctgaagtgggacagctgcagaaagcacccccccgctgcgtcctgacgacccatggtgttcttaaggaaaagcacgtgtgttatttgagtgccaagatgaattagctgcctgtttttccacagaacgtcattttcttcaaaagaatgactaatttccaaatgatggctattcaaacttgaagacatttcctcaaaaacaaatgaagtgagcttgtcagttcaagggaaacaactcatggtgtttattgtcacaagcttttaagccaaaactttgaattttggaaaatctgcatctgccattgtgagcttgacaatattcatagttttctgatcaaactggttatactttaatgaaatgtgatttataatactgtgtcatgaaatgtgtccacgtttggaagatctcctgaactcagtgagccagtattttccaaatgaatacttcaggatgttacaaaatcttacgtgggtaagagattcatccaaagtacaagacagatcaatggattttaatgtaactgatactgtctcagattgtatgttgcaattaatccttaagagacaatcagttgtcaagttttggtgtatccatgaagaatatccatgattttctacagaagctattataatattcctccctttttctaacacgagtctttgtgaggcccagattttcttcacataccaactaaagcaacatactgcaacagattcagtgtagaagtagatatgagaatctggctatcttcagttaaacctgacattaaaataatttgtaaaaatgtaaaacagtgctactcttctgatttttttgaaaatgtaatcatttttcataaaatgttatttatggtagcacatacttattattttaaaataagttactatttttaaaatttctgttttaatttccagtatgttaaatatcaacatatataaccagtggtgtgcacagctggcttgtaccagtgaaaaccaattgtataatctttatccggctttgtgttcaatgtcatccattggcagcttgaaatcagccatagtaggagtacttacatcacagaagtgagcaaacgctacaagtcagtgttcctccttcttaagatctagttaagtgtttaccagccctctactgaatatcaatcacagaaacaaaagctctttgaggtcatcagtaatttttaagagtgtaaagatgccctgagactaaaatatttgagaattagttgtgaggagaaagagttatcttttgagagttagtcactatagaggtgtataattcatacagagttgccttttgtgccggaaacatttgtagaataaatccaatgttttaaaacttgcagttgttaaatctactggttccataatgggaggatgtttttcttttccctggaatctaaactagatgataatactctgggggtaggtgagctgaattttccctgtgggctacatattggttgcctctgtcctggtttcacactatctgtccaactgttatctaggtttagatcaagccttcactcaagctctggcatctacataaagccctcacttactgtttgggcccatactgatctttctattctgtactcctgtgatattcatggcctctaaaatggagcaattcgttctgtactatttggtgtgccattgtttcttaggtgctagttttattaattctattttctaatagtgcacctagtacaaggctcaacacctaggttctcttacacggataaaacatgttttaacttttggattgccagagaagttagttttccaagggaatgatgatgtaaataaatcttagttatttgttataaacccagtttttaataattcttttcagatattaatataagttggaaatcattggtgttcctcaaagtgaagtcacacacaaagtcttccttgaaaaaattgttttagatgctgtggttctactaccactcatgatagacactggtgacttatttccaaggtctttgactcttgagtaagtcataatgaatggtgaatcttagtaaaatgaggcaaagtttctgcaattatgctagcctataggacagagttgtttactaattagaaaacctggcaggttttgagtccagaggagtggttagtatcgtgtttttctggtagggatctctgttgaaggaactcagggaagtagtgaggagatggctgttgtgctgatctctgcccaaagttaagtgatagttctggcctctctggatgctttagctagggagaggaaaagtgtccagaggcctcatcagccttcaaggcatgagctttctctgggtcagagacaccaggggcttgaaaggtcctggaatttcttcggcctatgcctttttagttattatgagggcataacagtgactgtgatttttatcagtctagagacaaagcatcagctcacatccagagtaacactagaatatcatatgtcacacatttaataaaaataattcactggccaggtacagtggctcacgcctgtaatcccagcactttgggaggccaaggtgggcagatcacaaggtcaggagatcgagaccatcctggctaatgggtgaaaccccgtctctactaaaaatacaaacaattagctgagcgtggtggcgggcacctgtagtcccagctactcaggaggctgaggcaggagaatggcttgaacctgggaggtagagcttgcagggagccaagatcacgccactgcactccagcctgggcagcagagcaagactccgtctcaaaaaaaaaagaaccatagttaagttctatctccaatttctctgaagaagttagagggtagtttatactctggcctaagaaaggcttcactgttagtaggcgtgaggtcgtagtgaggtagtttaactgctttagaactttgtgcttggaacattcttagccaccgaagtatgggcaccaaaagcgataaggagcatgtgttccttaataaatgtcacatcagaaaatgactgttccaggacagtaaccacctcccgatggtaagtatcctagatagtttgtcatttctcagcagcaggaaaaagagaagtaggccagtcatattagtgagtggtattacttaaaaatagcaaaaacaataacaaaaaaggtccagctttaatcctcaatggtgatcattttggcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggttagcttccttcctgaatggttttgtctttgactttcttgagccatttttttcctctttcactaattcatttatcatttttctttatgaagtgcttatacgcaaatctttttattagatatttggaggaatctcttctccttgcgtaaggtgctctgtgtcctgctaggtacgtaggtttcacttcagagctgcagctttgttgccaacttttcatttggggactgagtaattgcagatgagcagttcatgtcttcttcactttgttgttctgtgttcaaactcagatttatttagcaatgctccccaagggtgctgaaaaatattttgagggtgcatcagagaagatgtgtgataaacacagtaatataaagattatagtgctgatgctgttttctttttttttcttcttttttttttttttttgagacagagtctcgctttgtcgcccaggctggagggcagtggcatgatctcgggccattgcaagctccacctcccgggttcacgccattctcctgcctcagcctcccgagtagctgggactacaggcgcccgccaccatgcgtggctaattttttttgtatttttagtagagatggggtttcaccgtgttagccaggatggtcttgatctcctgacctcgtgatccgcctgtctcggcttcccaaagtgctgggattacaggcgtgagccactgcgcccagccagtgctgatgctgttttcatgaataatcaccttagtaggtagatataaatttataatcaccttagtaggtagatataaatttattttaaattcggtatacataattcttggtaagatgatattattaatgtatccctctcgattaaaccttggcttttgtagatatgattattattgtggttgtgatccagagatgtattttacccttaacatttcttgaagttaaaacattttttccatcaatagatgtaaattattaaatatgcattttttaaagtatgcatcttaattactgaatttatttttgttcatttttaaggtcagttattatcctttaaatgctgaaattatttgaacctaattgatgacaaaaaaaaaaatctgtgaggaaaatggagacacgtatacatagtatagtccttttcttgcgtgttcaagtagtttatcacagtagaatgataagagtggcgacaagatacctgatgtgacaaattcacatacattaaaagcttgattatctttgtggcatgggtattttctcctgtgtttcccagaagtgtaagaataattctcatcattatctttttttcctgtgatggcccctgattccaagagtttctaattctttctgacactaattataaaacaagaaagtctttccaacctcttctttgttttatgacttttattgaggtccacatatttctacttagttttaacctggctggtattggaagaaagtattgtctattattattatttattatttaatagagacagaattctcagtatgttacccaggtttgtgttgaggccctggcctcaagtgatcctcttgcctcagtctttcaaagtgctgggattacagatgtgagccacagcacccggctgaaagaaagtattctgttatattcagtagactttgtttggattttgttaagtgaacgatttaattgtccttgtagaaagaggtgccagtggatcttgtcctagaatacttacgtgttggatcatggtcaagccacttaatctctgtgcatgaactttaattttcacctttctaaaataggtaaattaatagcctacctcacctaagggagttgttatgattctatgacagatgtgtgacagcccggtgtaaaatgataaatatttaatatttggtggtgatatatgattatctgaggcaacaacatttttctcagtcctgttgattgggtgtgtgtgcttatgtgtggggcgttcatgagcaaaaacacgagtcatatgtggaggtgaatatacacctccgtgtacttcgggaagtatatattcttgcttgcattgttgatattttaataagctcttttgattttgtccaaatcaatttcccatgtaattataatatgaagtgagttttgtaaactctgctaccctaggccctcaaagtattaataattgactgaatatatcaaaatcagtcatgttgttgaagagattcattattttagttttctgacttctttaataatcatatcactgtattattacttgacttgaaaaatgaaatcatgcttaaaactctgatctttctcttaaggagaaatgctttatttggatcttcaagacccaccgccaccaagccctaacttactccttgtaatagaaatcctgattttacccaggcttgcttactgacttgcttatctacttaaatattctgtcttgggcctatctgatggctaatgtgaagacccagctcacgccagcgccagctgtgagagtgtgggaacagcagtgtgatccgggagctctcttctgcgttggcccctcgctggctccctcctggattcgtaggagcactttcaggttgaggagcttaggtcttgggtattttacattttgttctttcctgcaatgcctcatttgacatcccaaccactctttccctagtatttctgtagtatagagtacccgtaacattcctttccacacacatttgttttataactgaaatgtttgcgtctgcgcttcctttcttgagccagactccttcagtgcagattcactgtgttctattgctcagttgcttccacagctcctggctcagtgctgcacacacagactcttagcctcaattttttgaatgagggaaaagagcatatattttatgatacatttcagaaaatcttgtattataggtagcagcaattgcagagacagatgaatctgcagaatcagaaggtgtaattgattctcataaacgtagagaaatcctttcacgaagaccctcttataggtaagttaaccaagtttcctaatgtaaagatactttttccaaaatggtagaataattatacatcaaatcaattcttcctttatagcttttctgttttaagacttattcatgtatcttagtgacttaccttgttaaattgtattttaggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcacattca

SEQ ID NO: 293 - DNA, 45420 bp, Homo sapiens
agctacgggtcagagctagtccactaggtgctaatcaaatgctgtgttacaacactgtgaggttttcccagttataagtgtcactattagggttttttttaattgcaaagccaaataaggctgtcaattgcatcatcttaccttatttcttcagattaagtactgtttatagtgggatttttggtggatgtggtggcatcagcataatctatgtttcaggcgtcctatagaagaggattattcttcaggggatgtggaagaaaaggtaaatgatgtctgctataagtaccttcacacttttaaagccttgtgaaaagaggggtaaaaattgtgaaatataaaataacatccattttatgttttagttttttgttcttgcgatagtttactgagaatgatgatttccaatttcatccatgtccctacaaaggacatgaactcatcctttttttatggctgcatagtattccatggtgtatatgtgccacattttcttaatccagtctgtcattgttggacatttgggttggttccaagttgtagcagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcgccattctaactggtgtgagatggtatcttattgtggtttagatttgcatttctctgatggccagtgatgagcattttttcatgtgtctgttggctgcataaatgtcttcttttgagaagtgtctgttcatatccttcgcccactttttgatggggtggtttggttttttccttgtaaatttgtttgagttcattgtagattctggatattagcccattgtcagatgagtagattgcaaaaattttttcccattctgtaggttgcctcttcactttgatcgtagtttcttttgctgtgcagaagctctttagtttaattagatcccatttgtcaattttggctttgttgccattgctttttgtattttagacatgaagtccttgcccatgcctatgtcctgaatggtattgcctaggttttcttctagggtttttatggttttaggtctaacatttaagtctttaatccgtcttgaattaatttttgtacaaggtgtaaggaagagatctggtttcagctttttacatatggcaaaccagttttcccagcaccattaattaaatagggaatcctttccccatttcttgtttttgtcaggtttgtcaaagatcagatggttgtagatgtgtggtattacttctgagggctctgttctgttccatcggtctgtatctttgttttggtaccagtaccatgctgttttggttactgtggccttgtagtatagtttgaagtcaggtaacgtgatgcctccagctttgttcttttggtttaggattatcttggcaatgtgggctctttttgggttccatatgaactttaaagtcgttttttccatttctctgaagaaagtcattggtagcctgattgggatggcattgaatctataaattaccttgggcagtatggccgttttcaccatattgattcttcctgttcatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctgtttgtctgttactggtgtataagaatgcttgtgatttttgcacattgattttgtatcctgagactttgctgaagttgcttatcagcttaaggagattttgagctgagacgatggggttttctaaatatacaatcatgtcatctgcaaacagggacaatatgacttcctcttttcctaattgaataccctttatttctttctcctgcctgattgccctggccagaactgccaacactgttgaataggagtggtgagagagggcatccctgtcttgtgccagttttcaaagggaatgcttcccatttttgcccattcagtatgatattggctgtgggtttgtcataaatagctcttattattttgagatacgtcccatcaatacctaatttattgagagtttttagcatgaagggctgttgaattttgtcaaaggccttttctgcatctattgagataatcatgtggtttttgtctttgtttctgtttatatgctggattacgtttattgatttgcatgtgttgaaccagccttgcatcccaggaatgaagcccatttgatcatggtggagaagctttttttttttttttgagatggagtctcgctcttttgcccaagctggagtgcagtggcatgatcttcgctcactgcaagctccatctcctgggttcacgccattctcctgcttcagcctccctagtagctgggactacaggcacccgccaccacacccggctaattttttttgtattttttagtagaaacggggtttcaccatgttagccaggatggtctctatctcctgaactcgtgatccgcctgcctcaggctctgaaagtgctgggattacaggcgtgagccactgtgtctggccggataagctttttgatgtgctgctggattcagtttgccagtattttactgaggatttttgcatcgatgttcatcagggatattgttctaaaattctctttttttgttctgtctctgccaggctttggtatcaggatgatgctggcctcataagatgagttagggaggattccctgtttttctattgattggaatagtttcagaaggaatggtaccagctcctccttgtacttctggtagaattcggctgtgaatccatctggtcctggactttttttggttggtaggctattaattattgcctcaatttcagagcctgttattggtctattcaggaattcaacttcttcctggtttagtcttgggagggtgtatgtgtccaggaatttatccatttcttctagattttctagtgtatttgcatagaggtgtttatagtattctctgatggtagtttgtaattctgtggggtcggtggtgatatcccctttatcatgttttattgcatctatttgattcttctctcttttcttctttattggagtttaacctattaactctaccagtataattataaggttgacgctcttgcttataagttttggcctaaccagtgagaatgtagaatgatagttctccagatataagagttttcttttttaaaaggagacatttgaattctacctccagatgcgtcatttatgcaggttctcagcctttattttagcattttaatgaaaaaattgtctcatgagcttttggcctgcctagagtttggacatatggaagtttccttgtagttacagaatctgtataacctatctccagaattgtaaggatatggtttatgttagcgggtacaagttctttttctgcagcaggtattcttaaccaagcctttttttttttttttttttttttttgttaaggcacagtctcgctctgtcatccaggctggagtgcggtggcatgatctcagctcactgcaacctcgaactcctgggttcaagaaattctcatgcctcagcctcatgagtagctgggattacaggtgcgcacaaccacacccggctaatttttgtatttttagtagagagagggtttcaccatattggccaggctggtcttgaactcctgacctcaggtaatccacctgcctcggcctcctgaagtgctgggattacagtcatgaggacttagccatttttgatagagttattgtttaattaaaattctgataattgtacttgaaagatgattaaagcaatgtaaaggatgatttatgcctatcagatgcccatgaatctttgttgaattgtttttctgttctccataataatctgatttctttgaagctgggcatttccccacaaaaaatgaatgtggacaccacctgccatctcaacccacaggtctagtttgtgagaatacttgtaggacccctgggtttcccccgctatagtttcaagtacattgtcttcagataccttattctatgtacttggaaaaaagagtaaaacattgagagccactgggatctgacaagctttgggagctccttaattctaaaaagaaaattattttgatttgagaaaatgtaatatcttcagaaatttccaccacccagctatgtgactgcatttttaaaaaaggaaaggaacagaggaaaatcaagtcactctaccctccttacttacctgtggcttgtccctacacatggtggtgggtgggagaagtggtggtggagtactgggtcctccagagagctcagtttggaatctggaactaaagatcatgtcccaatttcctgagctgatgggatagaagctggtcaatgaagtcttctttttgtgttaatttttttcctttgttttcttttgttttatgtagttataaagcataatttctattttgccagtctctgacacatgggctctgtcagggttactggatatgtttattttgtctctgctgctctactggagctgaaatctcagcctgtctgagcagttctttaagctgaaagccagggtgtaggggctagattagtgtggaatagctgttttcaaagtgtggtgtgcagaaccctgggggtgactctgagacattttcatgaggcttgctaggtcaaaaccattttcacggtgatgctaagatgttgtttttctttttctctgttttgatatccacactgatggtgcaaaaacagtggtggtgggggagtggtaaattgttgggtgccttaactcaagtcagtgacacaaactgtgttagtattaactgtattcttcactgccatccacttgcagtttttttttttttaagtcagttttacttaagaatatctttgatgaagcagtaaaaattaccattgcattaaatcttgactctgagtacatgctgttttgatattctgtgtcctgaagtgggacagctgcagaaagcacccccccgctgcgtcctgacgacccatggtgttcttaaggaaaagcacgtgtgttatttgagtgccaagatgaattagctgcctgtttttccacagaacgtcattttcttcaaaagaatgactaatttccaaatgatggctattcaaacttgaagacatttcctcaaaaacaaatgaagtgagcttgtcagttcaagggaaacaactcatggtgtttattgtcacaagcttttaagccaaaactttgaattttggaaaatctgcatctgccattgtgagcttgacaatattcatagttttctgatcaaactggttatactttaatgaaatgtgatttataatactgtgtcatgaaatgtgtccacgtttggaagatctcctgaactcagtgagccagtattttccaaatgaatacttcaggatgttacaaaatcttacgtgggtaagagattcatccaaagtacaagacagatcaatggattttaatgtaactgatactgtctcagattgtatgttgcaattaatccttaagagacaatcagttgtcaagttttggtgtatccatgaagaatatccatgattttctacagaagctattataatattcctccctttttctaacacgagtctttgtgaggcccagattttcttcacataccaactaaagcaacatactgcaacagattcagtgtagaagtagatatgagaatctggctatcttcagttaaacctgacattaaaataatttgtaaaaatgtaaaacagtgctactcttctgatttttttgaaaatgtaatcatttttcataaaatgttatttatggtagcacatacttattattttaaaataagttactatttttaaaatttctgttttaatttccagtatgttaaatatcaacatatataaccagtggtgtgcacagctggcttgtaccagtgaaaaccaattgtataatctttatccggctttgtgttcaatgtcatccattggcagcttgaaatcagccatagtaggagtacttacatcacagaagtgagcaaacgctacaagtcagtgttcctccttcttaagatctagttaagtgtttaccagccctctactgaatatcaatcacagaaacaaaagctctttgaggtcatcagtaatttttaagagtgtaaagatgccctgagactaaaatatttgagaattagttgtgaggagaaagagttatcttttgagagttagtcactatagaggtgtataattcatacagagttgccttttgtgccggaaacatttgtagaataaatccaatgttttaaaacttgcagttgttaaatctactggttccataatgggaggatgtttttcttttccctggaatctaaactagatgataatactctgggggtaggtgagctgaattttccctgtgggctacatattggttgcctctgtcctggtttcacactatctgtccaactgttatctaggtttagatcaagccttcactcaagctctggcatctacataaagccctcacttactgtttgggcccatactgatctttctattctgtactcctgtgatattcatggcctctaaaatggagcaattcgttctgtactatttggtgtgccattgtttcttaggtgctagttttattaattctattttctaatagtgcacctagtacaaggctcaacacctaggttctcttacacggataaaacatgttttaacttttggattgccagagaagttagttttccaagggaatgatgatgtaaataaatcttagttatttgttataaacccagtttttaataattcttttcagatattaatataagttggaaatcattggtgttcctcaaagtgaagtcacacacaaagtcttccttgaaaaaattgttttagatgctgtggttctactaccactcatgatagacactggtgacttatttccaaggtctttgactcttgagtaagtcataatgaatggtgaatcttagtaaaatgaggcaaagtttctgcaattatgctagcctataggacagagttgtttactaattagaaaacctggcaggttttgagtccagaggagtggttagtatcgtgtttttctggtagggatctctgttgaaggaactcagggaagtagtgaggagatggctgttgtgctgatctctgcccaaagttaagtgatagttctggcctctctggatgctttagctagggagaggaaaagtgtccagaggcctcatcagccttcaaggcatgagctttctctgggtcagagacaccaggggcttgaaaggtcctggaatttcttcggcctatgcctttttagttattatgagggcataacagtgactgtgatttttatcagtctagagacaaagcatcagctcacatccagagtaacactagaatatcatatgtcacacatttaataaaaataattcactggccaggtacagtggctcacgcctgtaatcccagcactttgggaggccaaggtgggcagatcacaaggtcaggagatcgagaccatcctggctaatgggtgaaaccccgtctctactaaaaatacaaacaattagctgagcgtggtggcgggcacctgtagtcccagctactcaggaggctgaggcaggagaatggcttgaacctgggaggtagagcttgcagggagccaagatcacgccactgcactccagcctgggcagcagagcaagactccgtctcaaaaaaaaaagaaccatagttaagttctatctccaatttctctgaagaagttagagggtagtttatactctggcctaagaaaggcttcactgttagtaggcgtgaggtcgtagtgaggtagtttaactgctttagaactttgtgcttggaacattcttagccaccgaagtatgggcaccaaaagcgataaggagcatgtgttccttaataaatgtcacatcagaaaatgactgttccaggacagtaaccacctcccgatggtaagtatcctagatagtttgtcatttctcagcagcaggaaaaagagaagtaggccagtcatattagtgagtggtattacttaaaaatagcaaaaacaataacaaaaaaggtccagctttaatcctcaatggtgatcattttggcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggttagcttccttcctgaatggttttgtctttgactttcttgagccatttttttcctctttcactaattcatttatcatttttctttatgaagtgcttatacgcaaatctttttattagatatttggaggaatctcttctccttgcgtaaggtgctctgtgtcctgctaggtacgtaggtttcacttcagagctgcagctttgttgccaacttttcatttggggactgagtaattgcagatgagcagttcatgtcttcttcactttgttgttctgtgttcaaactcagatttatttagcaatgctccccaagggtgctgaaaaatattttgagggtgcatcagagaagatgtgtgataaacacagtaatataaagattatagtgctgatgctgttttctttttttttcttcttttttttttttttttgagacagagtctcgctttgtcgcccaggctggagggcagtggcatgatctcgggccattgcaagctccacctcccgggttcacgccattctcctgcctcagcctcccgagtagctgggactacaggcgcccgccaccatgcgtggctaattttttttgtatttttagtagagatggggtttcaccgtgttagccaggatggtcttgatctcctgacctcgtgatccgcctgtctcggcttcccaaagtgctgggattacaggcgtgagccactgcgcccagccagtgctgatgctgttttcatgaataatcaccttagtaggtagatataaatttataatcaccttagtaggtagatataaatttattttaaattcggtatacataattcttggtaagatgatattattaatgtatccctctcgattaaaccttggcttttgtagatatgattattattgtggttgtgatccagagatgtattttacccttaacatttcttgaagttaaaacattttttccatcaatagatgtaaattattaaatatgcattttttaaagtatgcatcttaattactgaatttatttttgttcatttttaaggtcagttattatcctttaaatgctgaaattatttgaacctaattgatgacaaaaaaaaaaatctgtgaggaaaatggagacacgtatacatagtatagtccttttcttgcgtgttcaagtagtttatcacagtagaatgataagagtggcgacaagatacctgatgtgacaaattcacatacattaaaagcttgattatctttgtggcatgggtattttctcctgtgtttcccagaagtgtaagaataattctcatcattatctttttttcctgtgatggcccctgattccaagagtttctaattctttctgacactaattataaaacaagaaagtctttccaacctcttctttgttttatgacttttattgaggtccacatatttctacttagttttaacctggctggtattggaagaaagtattgtctattattattatttattatttaatagagacagaattctcagtatgttacccaggtttgtgttgaggccctggcctcaagtgatcctcttgcctcagtctttcaaagtgctgggattacagatgtgagccacagcacccggctgaaagaaagtattctgttatattcagtagactttgtttggattttgttaagtgaacgatttaattgtccttgtagaaagaggtgccagtggatcttgtcctagaatacttacgtgttggatcatggtcaagccacttaatctctgtgcatgaactttaattttcacctttctaaaataggtaaattaatagcctacctcacctaagggagttgttatgattctatgacagatgtgtgacagcccggtgtaaaatgataaatatttaatatttggtggtgatatatgattatctgaggcaacaacatttttctcagtcctgttgattgggtgtgtgtgcttatgtgtggggcgttcatgagcaaaaacacgagtcatatgtggaggtgaatatacacctccgtgtacttcgggaagtatatattcttgcttgcattgttgatattttaataagctcttttgattttgtccaaatcaatttcccatgtaattataatatgaagtgagttttgtaaactctgctaccctaggccctcaaagtattaataattgactgaatatatcaaaatcagtcatgttgttgaagagattcattattttagttttctgacttctttaataatcatatcactgtattattacttgacttgaaaaatgaaatcatgcttaaaactctgatctttctcttaaggagaaatgctttatttggatcttcaagacccaccgccaccaagccctaacttactccttgtaatagaaatcctgattttacccaggcttgcttactgacttgcttatctacttaaatattctgtcttgggcctatctgatggctaatgtgaagacccagctcacgccagcgccagctgtgagagtgtgggaacagcagtgtgatccgggagctctcttctgcgttggcccctcgctggctccctcctggattcgtaggagcactttcaggttgaggagcttaggtcttgggtattttacattttgttctttcctgcaatgcctcatttgacatcccaaccactctttccctagtatttctgtagtatagagtacccgtaacattcctttccacacacatttgttttataactgaaatgtttgcgtctgcgcttcctttcttgagccagactccttcagtgcagattcactgtgttctattgctcagttgcttccacagctcctggctcagtgctgcacacacagactcttagcctcaattttttgaatgagggaaaagagcatatattttatgatacatttcagaaaatcttgtattataggtagcagcaattgcagagacagatgaatctgcagaatcagaaggtgtaattgattctcataaacgtagagaaatcctttcacgaagaccctcttataggtaagttaaccaagtttcctaatgtaaagatactttttccaaaatggtagaataattatacatcaaatcaattcttcctttatagcttttctgttttaagacttattcatgtatcttagtgacttaccttgttaaattgtattttaggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcacattcagtcttgtgcattttaatggaccgttaattctgtgctttttgctctgattaaagcactagtttttttcccaaaagaagagtgtttgatacgtaaaaagcaagagctagaaagaaaagaaaaaggaggagaaaggttagggatatcacatatcctaagctagccccttaggtactggaataatgtgatattcctgtcctttctgaagtataaattgtccatggaagttgtctaaatcaatttcccatgtaattataatatgaagtaaagtgagttttgtaaactctgctaccctaggtcctcaaagtaattgaacaaatatattgacagcagtcatgttgttgaagagattcataattttagttttctgactttaaaaagagctacttaggtactggaatatatgtgatattaaataatgtgtttatccaaataaggtattaagattttagatatattctttgtttttcctttaaaaagtagcaataccaagaaaaaaaaactcaagtcttaatttaagtcctgactactaaaacaagctataatctttaatgtatgagaagactttatatagtcattatttttgtggagctttttagagtttttcttgtagcagtggtagatttgcagtagtaaactattaaatacattctctgttggtaattgaggggaactcctaccatgatacctagcagatccggggtgtagtgtattcacacgtttgacagggcacccagtagacttgtccaaagtcagtgttaggaaaagaaaatccccaccatctgtaagaaatagaccttgaggtttacattgtcatttttttattacttctctcgtttacatgctcttttgtctggcacactgggaatctctggtgggttttagaactgtaaaactgaatatgccagctgatgagcctctacagcacagcacgcaggttatgagagtgctgagtgcctcgtccccccgtccccagaggggctgggcagaagctgctggcgcctcctggctggtcagccctggccttgagcagctccatccactcaccccagtgggctgtacacatgtcatcatgttctgtttgtgtaatgacagggaaaaggttggaagtgactgctgaaatgacactaagacttctcaaagtgttgggaaccactaagatgctgtcatcgtaacatttctctggcatatgctaatgctacttaggacttctgatagaagcagtgattcctttacaagttgatagggaagcagatgctgtagggttaacttgtctagattattagctgaaaatttgaaattgtgaaaatgtatggggttgaagctggagaggatgtggaaggaaccatctttgtgccatttgcaaactcaatgatcagagcaagaagctttattaaattcacatctcaggttttagtctttgaagtgggaataatactaaattgccaaactctggggttcctgtgaagacaaaggagataatgggtaaaagtagggggaaaaagacatgctactattggcatgaaacagagaaattaagttaggtgtaccattgtctcattcatgttcattgaactttccctccagccagccccaatggcttcattccctgtgtccttggtacctgctcacagcagggggctggccttaaacctcactctgtgtgtctgtgggggggatgagaggagcagagtcaggaattttggttgagaactagaaaactgcatctgtagaaattagatcttaggccaggtgtgatggctcccacctgtaatcccagcactttgggaggtctaggcaatgagggttgcttgaggccaggactttgagaccagtctgggcaatagagtgagaccctgtctctacaaaagaattttaaaaattagcagggtgtggtggtatgcgctcatcccagctactcaggaggctgaggtgggaggattctctgagcccaggagtttgaggctgcagtgagttatgattgcaccactgcactgtccaacctgggcagcagagtgagactctgtctcaaaacaacaaacaaaaaaaacacatctgtctatttgccacataagaggtcatggactatttcttactttggtttcttaatttgagtctatacagtatgatcctagaaattattctgatgagaagttatagttctgtatgtacagtctgcaggtaaaaattgccatttgttcacacaatgtgaatttcttttgttaaaaatgcattttggggacatttagtgaaatatatgtagataattctttgagaagtgaatactaacaacattcaaactttttagaagacgtttactttaattggagggtaaacatacttacacacacaacatccatttttattgatcttattttttatagaactaacttagcagatattaatgctttaatgttgtagcagaatgtctagaaatggaaacaattgccagtttcctttggtttttgaatagaggaacgtattttattagaatttctggagattttcctatttttttccttccctttgagctgtaaattttttttaatgctctttcataaccttttattataaaaaaaaattttaggtttaattgttcagcttttatccatggatggctttctcccaaactttgcttttatttctttttttccaatattttattagttatttttaatttggaataatgagttagctggtgtttaaaagaactaaatgtgtatcaaagttgaagaaataaagtatattcaagttttcccatatacaagcagttacatttttaatagttgaaagatatttggcagaagttggccttattatattgacttactattatcacaaaaactaaaaagtgaaagttggaataggctgctccctggggagtaggaaaaagcataaaatagacagggatccattattacaacaccaagtaagtgagctgtacctgcagaatcctcactggaagtacagatcttagtgataggtgtgttgcataacagttgagctggtcgaagaaagtcttttatttcagaagcatatacccgagagatggcgggagagagacagccttagaattaacaaagaatgttacttgctgcatgagacagttaagataggcagtaaatgagtgaatttgtaaaagcaaccgaggaaattaaaatgtttgaagcttcctaattcattaaatttcctcttgaaacaaaggttacttaaatcctccatcctactatacccaacctcttcctgtaccaattaaagactatcacccaagacttcagtttttttcccacaaatggcccttgtctctgcttgtgcctattgtattttacgaggaatcttattagagtattaactcatctttctggaattcttatacatgaaaggtaagtgggtcaatctaaactgcaccattatgaaaagaaaaatatgaactttgtggactccttataagaattcagaattctcaggaggctcacgaataagcaccaattcaacttcttcataaagggaattagaacataataggcttacacattcgaaagttaatccagttgcagttcttaatagtgacgttgtttacatttctctaaggcaactgtttcaaaattttttaaggcactacttaatgtaactctggcttttaaactttgatgttgctattgttgttatagcatgatttagtcttccttctgctataatgcacctcttggcttttaaggtacaagtactcataggtgctctcttatggtcactctgaatttaaacctgagaattcattggaacaaaggtctgtttgctgctgtttttaaagttaatgcagtgagatttcatttatgaatctttggattgcaatttggaacaagagtggttttaaatataaacatttacatgtgtatgtattttaattagctcatgtgtataaatttaggattagaagtatataacatgggccgggcgtgatggttcacgcctgtaatcccagcactttgggaggctgaggtgggcggatcacctgaggtcaggcattcgagaccagcctggccaacatggtgaaaccccatctctactgaaaatacaaaattagccgggtgtggtggtgcacacttgtaatcccagctactttggaggctgaggcaggagaatcgcttgaacccagcaggtggaggttgcagtgagctgagatcacacgattgcacttcagcctgggcgagaagagtgaaagtccatctcaaaataaatgaacaaataaataaataagaagtgtataacatcgccaggcttggtggtttgtgcctgtagtcccagctactcagaaggctgaggcagaaggattgcttgagcctagcagtttaagaccagctagaccaatatcaggatgtggggcaacacagcaagaccccatctcttaaataaatagctaaaatagaagatatgtctaaattcattcagttaatttcatcttattttttctatcttgatttatgtttattgaaagcacatgttatgctatccttgactattttgaaacctaaacagttttctcctcaaatctctgaatacagacaggcccacgtaaaacctatttccaggatcctgaggcactgggaaattttgtttattgtcagatgagagagaacattttcaatgggaaggtcctctgtcatttgataacaacaaaatcaagagcacctttggcataaaaatgaaaatgaggctgacgtgcctgacttaatcagtagaaatgttttctcactagagccagtgtgtgaggggtgtgtgtgtgtgtttgtttagcttttgttttccatatctaattatataatgacttccccagaaaataaaatgagaaacagattcttgatgtgtcagctgttcatattgtgaaaacaaagttttttgatcagaactgtggggaaacattactgaaaagaaaaaaggaaacgagtaaagcaaaaagaaagagaaaaaaggaagtaaaggtctttgttatctacctatttaggggttcttaccctgaggcagctactctcacctcagattgacttgatcgttatttaaaagcttgataatttggtgttgaaaaactaggttctatgattggaatttgaaaccatacctcatttaactctcctagattcacagggggcttaagttttttataatatcatctgtcatgaggaaatgatagccattcattcattcattcattcattcattcattctattttttgagtggctgctctgttctaggctttgtacttcttttttttttttttttgagacggagttttgctcttgtccaggctggtgtgcaatggtgcaatctctgctcaccgcaacccccgcctcccagattcaagcgattctcctccctcagcctcccgaggagctgggattgcaggcatgcaccaccacgcctggctaatttcttgtatttttagtagggacggggtttctccttgttggtcaggctggtcttgaactcctgacctcaggtgatccaccaacctcggcctcccaaagtgctgggattacagatgtgagccaccgcgcccggcctaggctttgtacttctaatacactgtggttacctgaccttgggctgctctttctaaagcactatttctgtgacatcaaactaattatcaactgaaaaatacacattcaaatatatgaaaacatacacaatttactcatgtctagccacaaggggccaagaaagcagtgtcttttgacattttcatacttgtaagaagttagttagatctctctcaaacccttttactatgagggctgaatcctgagacccatgaaatctttggaaagccatggtttaaaaataccctgtttttaaagtgtgtacagaaaataactgctctaggtgagccagataaagtgctgttacatcagggtgtctcaacctcagttctattgacattctgtaactgactcttcagtttctgccacactggcctgtcagtgaaataaaacacagagaacgcagcatgtggaagtctttttaaaaatgttaatctatcttcctgtgtagacactggcaccttaggtgaaagaagtgaaaatttgttgttgttactctttccataattctcataggtttgtcctatcaggttatcgcctaagtgcttttttgcctagatgcctttaaaaacgtttggaaatgacttgaaaatattcagagtgtattttaaacactactgttacgctactgtaaggtatttacattgatgtatagatgtcatgttattctggtgatgtgtttttaaaatcttcattgtaaagcctagttagctagtttatatgtgattttttaaaaagcatagcctctggtaccatttaatatctactgtttgaagcatgcagttggaatctttatgttaaaatatacagacctttcagatattttaaataatacttgtctattagagtgaaattttgaaacaaaacgtttgatcagttattctttggaagcttcaagtcaattaatatgttaacttttaaacatgactggcagatctcagtatttaaaggaaatctacttcctatttgttgccattagctgtagttacttgagatacttggtagaggtaaatattgtagcacaaatccttttagtaacagttactttttaaggacctttgcaacttgacaatttatatttcaggattctcctgacatagacaaaatggcaaaggttacagttttctagactttagctttataaccaaaatatgtttttatatatatttatatataaatatataatatatgtaaattatatagttatatataacatatgacatatataattataataaatatatattaaaaattttggtcatatatacaacatatataactatatataattatatatagttataattatatatagttatatataatatataacaaattatatataacataattatgttatatataattgtacataacatatatacatatataggtatatatacgtatatatgttatatataattatatattatatataaaatataaataattataaaaatataataattattaaaatatatgttatatataaatacaatataaattatatatataaatatataatttatatattatatgtgatatatattatatattatatataatataatatataatatatatcacatataatatatattatatataattaatatatataattaatataataatatatataatatataatatatatgatatatattatataaatatataaatatattaatatattaatatataatatatataatatatattatatattaatattaatatataaatatattaatatataatatatattatatatttatatatataaaatatataattatatataacatatataattatatgtatgttggtttttttttttagatggagtctctgttgcccaggctggagtgcagtgccgcaatctcagctcactgcaacctccaactcccgggttcaagtgattctcctgtctcagcctcccgagtaactgggactacagacacctgccaccacacctggctaatttttgtatttttagtagaggcggggtttcaccatattgatcaggctggtctcaaactcctgacctcaggtgatctgcctaccttggcctcccaaagtcctaagtttacaggcgtgagccactgcaccttgcctatatatttcttaaaaactactttcttttgatgacaaatcagaaaagtagttagctgaatgaaggtagaaattcattttaattgcaatattaaatgggaatttttcttttcttttcttttctttttttagagacagggttttcctgtgttgcccaggctggccttgaactcctgggctcaagtgatcctcctgccttggcctcccaaagtgctgggatcacaggcatgagccaccacacctggccttaaatgggaattttaaatggtagaagaatggtgtttataaggaaaaacatctgagagaatggagaaaaccaggaagctggactctccctgtctccttctccactcttcctcttgagtgatgtagtcagctggatgctaaggaggaggaacactccatgggctctatgaatctcaaacatttctgaatataaaatattttcaagtgtttataagcttttcctagagtatcgtcccatgacgaagctgatcttccttctcaattcagcatagaaaataagggtaacctgagaaagaagcaatggtaataaatagacccagagtatattcttccaataggggattattaaaaataaatcttgaaattctctaatatttcttttctttttctgttaagttgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaaggtatattttattaatctaatacatttagaatacctatggattactatatcacaccattgagtggtgattttatagttttttgaaatagatcgaaggtagatggtggggggttgggaggcacttaaaaaggcttacagaagaaatattttaatacattaaacagcaaattaagttttatcatttttcgccttttagcaggttttactggctctggagaaaggccaaattcagagtagcatgatagaaaaagagagatagaaacatgaatgaattttttttttttttttttgagatggagtctcgctctggcgcccaggctggagtacaatggcgtgatctcggctcactgcaacctgtctcctgggttcaagtgattcttctgcctcagcttcccggggagctgggattacaggcatgagccaccacgcctggctaatttttgtatttttagtagagacggggtttcaccatgttgggcaggctggtctcaaactcctgacctcagatggagtcgtcctgacctcaggtggaggcctcagcctcctaaagtgctgggattacagacgtgagccaccgcacccggccacatgaatgaatttttaaattaattagatatccttcatttgggggttgcaaatgttgtacctaatagatttctattacctaatctatgacaatttaagtattcaggctatgatgccccaaatttgtttttttccctagctgttactttcaagtctaatttctaggcaactcatttcaaaacaaatgctgactttgggttttttgtttttttttgtttgtttgtttttttgactgactgttcttagttgtttgaattctgaagtatccattctagctcttatggaagctgtcagtaatgaaataaaagttgagatgtagccctaagcttttagggttacctgagatttcaactggatttgcgttatacattattttaattcagttgtgcctatgataactgtaatagatgtatttaatacagctttcaaaactcctgtgttttaattgaattctattcctcttggtccattcgcttaggatttaggatatagcactattttttaaaaatttgcttgcttgtttgtttgtttgtttatttatttatttatttatttatttttgagacagagtctcgctctgttgcccaggctggagtgcagtggcgcgatctcggctcactgcgacctccgcctcccaggttcaagcaattcttctgcctcagcctcccgagtagctgggactacaggtgcataacgccatgcccggctaatttattgtattttagtagagacggggtttcaccgtattgcccaggctggtcgtgaactcctgagctcaggcagtccacccaccttggcctcccaaagtgctgggattacaggcagcactaacgttaaggaaagtaaaatcagttattttagttcgaatgtcttgcaggtatgataagcatattataattgatgagtctcttgataattatactcaggtattttgggggttaatgtggactatggtaaaagtgtgtgaagaactgaggtggtggcatttatggagtaaaaaatgcatagtacaaacccagtactttaatgttttcttgaaatgtaaaatgaaagccacctgttctattccccccatactcatggaccatatttatgtctaggtgaataatcttaaagaataattatttcttctcattttatctttgttacatggaagaatctactgcaaacaacagagttttgagaatttttaatgttttacacaatatgcacgtaagtttgtgccttggggtttttaagaattttcttccacaagtcacaaagatttttttccacattttcttctatttgctttatggttttacctttcacatttatgtctttaatgtatctgggcttcacttctgtatatagtatttggtgggaattcatttttaacttttttctccgtatatggagccactcccaagggtttgttgtttcctcactggtgtatggggcagccttaattagacagtgggtttgcttttgcacctggatctggccagtcttctgtctgattcatctttttctgaatcccagcgccatacatgtttgttatctcataaaacaagttccccttgtcttttttctcagtttgatacagagttagttttttgtgcacgattattctttcatatgcatttggaataagtttgagtttctaaatagtagtagtaataataataataataaaaccaatgatgagactgcattaattttttttttcttgagatggagtctcgctctgttgccctgcctggagtgcagtggcacgatggctcactgcaagctccacctcccgggttcacgccattcttctgcctcagcctcccaagtagctgggactacaggcgcctgccaccatgtccgactaatttttttgtatttttagtagatacagggtttcaccatgttcgccaggatggtctcgatctcctgacctcatgatccgcccacctcagcctcccgaagtgctgggattacaggcatgagccaccatgcccagccaagactgcatttaatttagggagagctgaagtcttcataatgttaagttgacctatcccaaaccatagaaagtcttgtttattcagatctcattttacttcttttaacagttgaacatttttctttttatttatttatttatttattatactttaagttttagggaacagttgaacatttttcttcacggagatcttgcatattctttctttagttggttcctaagtactttatgggttttgttgccattacaatggtaccttattttgtattgtattttctaattgttgctggtgtagagaaatacggattattttaagtcgatcttttatctattaactttgctgaactctaattacttctaataatttactgattctttgtgattcggtctgtgatcctatgtgaatgtttatacaaatagtgatgttttgtttcctcccttccaatctttattcctgttttctttttctctttttttcttttccttaaataatcatggccaggagctccagtttaaacacagcaaggccagtgggcattcttgtcttcctgaacttagtggcagtgttccctgccctccttctcccttcatctcactgaagggccctgtcagcttctttgtggattctcagtgcctgtcttggctgatgcctcagcagtatttaacactgtcgacttctgcttcctccacttcctgagactgtgtcctccttgctcttctctctctgctgcttctctgtcagtcctgttgctgggctaagcttcccctgcccctgtcctgagtgtttcagtgatcctcaggctcactcccccaccctcttcctgctgagctccctccctgaaggactccctcccacgctggcttcagttcactgtgactatgtcctgactccagctggttccttagatggccacacatacctctgactcctaaaatccactcttcctatcttcagtgattgaccactactatccttgatgccagaaacctaggtgttgtccagtattcttcccagtctccattcaaagtcactgtgtagattcttctgcctggctgagccatgaatgcttctgccactccacagccctctgtcctggccctggccctggcctgggtgctatccctctgacccaggctacccctgtgggctacagtctccggcagccaccggaagctggctattgtggaacagctttctgatcctcctaatcatgccagaggcagcagctcccttcttggctcagttttttgggaattgttcctgaaagttcagctaaactcttcattcctcacagtgattctgggagccactgatagttcttaaaaacagcagtttcttgcccccaacatctccattactgcattgcacttgttttgttttgtttcgttttgttttgttttgagacagagtctcactctcttggccaggctggaacacagtgatgtgatcttagctcactgcaacctctgtctcctgggctcaagcatttctcctgcctcagcttcccgagtagctgggattacaggcatgtaccaccatgcccagctaatttttgtatttttagtagagacggggttacaccatgttggccaggctggtcttgaactcctgagtttaggtaatccgtccatctcggcatcctaaagtgctacgattataggcatgagccaccacacctggtgtctggggtctttttaataagggcactaatcctgttcacaagggtgtcaccctcatgacctcatcacctctcagaggttccacctccaaatactattgcattggaggtgaggatttcaacagaggaaattgggtggggatacaaacattcagtctatagcatccactcaaaagcatccatcaatgtctgtgacctgttagacaaagctccaaatctttcatgtggcccaaatctttgcttgatccaagccttgcattctttaatagctgcctacctctccacttctccctcttttgtaatacagctctttctttcatttcctgggataggccatgccctctctccctccagggccttcttcacacataccgattgcctgataagaatacgttccccgaggaagccttgcccatcctccacatctggcttaggcaaccttctgtgagttcctactgtacttccttaggcacatatcatgttgtgttgtggctctctgtcttgctagatggtaagttctatttggacaaatacctagcacagaccctggcatgtgataaatgttcagtaagcatttaccaaatgaaagtgaactgttcttcctctgaaaatgtgatttgttctgtgtgctgattgacttgagattaactggtccagggaatacattaaaactactaagagcagtaatcaactaagcaacccatttcccttctttctttccttccttgccttttttttcacaccaatatttattgagcatctatgtgccaatttaaagaaatgctgacataaaaatcaatttcttattgattttctgaaatttgaaataaaatttactaatagcattcttggacccaaaccctcaggtgtgactgggacagcaaagagtccctgctggagccccagattgaggttgatgtctaggtgaccatccagggttccttactcagccaagatatcttcagctgaattgaaaccctaaccccattgtcaggtatcctggagaattactagaaacatggacactccctgaaactttacctcctgagcatctgaggtgtaaagtccttacctttactggaagatgattaaattaaatacagctaaaatgtggtgggatgtcctttcattgacataaggttgggttgaattctaatcatacaagggaaagggctttgggtgcggtggctcacacctgtaatcccagcactttgggaggctgaggtgggtggatcacctgagatcaggagttcgagaccagcctggccaacatggtgaaaccccgtctctactaaaaatacaaaaattagccaggcatggtgggcacctgtaatcccagctacttgggaagctgaggcaggagaatcatttgaacccaggaggcggaggttgcagtgagccaagattgcacctttgtactccagcctgggggagaatagcgagacttcatctcaaaaaaaaaaaaaaaaaaaaaaaaaaagacaaaaggtctcagtggcatgtcacttatttttttgcagtggaaatgccaataatttttttccaggctatggtctgttctatggttgaacattcgcccatttttgtgtctaaccttataatcactgaatttcctataatgatccagctctctatgtgccaagccttcattaagtgatccaaataaaatttgacatttaaaaaaaatgtacaaatagtaattttgatttatttatgaattttaaaaatcccaaatgtcttttcagggggttttaatctgggaaaataaggtattagattgaatcacatgaaactgctatttttgtaggccagaaagttcaaatatcagcaagttcatgtgattcaatctagtagttatgggagaatactacataatacttgctccattggcacagtgaatttttaaaatttaattatctactccctttaagtgaaagtagcaaattctgtatcaccttaggaagagttggattttttgatggtgtagcaaatggctcagcaaataaaaatgttaagtgaacacaggtggctggatatttcttggtgagtttagaagtgactatgaaatatggtatttctttgctgatagtcaatgtgttttttttttttttaaatctccaagtgttttttctcttatgagttaggaaattatgttgggtttattctcccttagtttacctagaagccttggacacaacaataataaagaagtagccctgtaagatacaatcatgtaacttttaatgctaaaagagacattattattattattattattattatttgctagagcccacctcaaacagatttctatgtaaaaatgagaaacaagagcattaagatggtttattacaggaagagtttttatagggcttgggtttcagtgagctcgcctgtgacaaagcaaattgatggcagtgataggctagtgatgtcattgtgatgtcagtcctcctgcttatcctgcacatgcttgctaatttggaacactttatgttgaactgtggtagaggaaacaagacagttctgtctgcagaagcccattatggctgtaactggagatgacacaggtaagaatgttaaagaggggttttcagttaattgtgcagattgttttgaagtttaggaagtattcaggaacatctgagtgtttcagaaagtgttactctcctagtcacttaggtgtaagactttttttgaaatatacatctatatattcagctcactttgttagggcatcttagtgtgattgtttctttgctcaatattctattgcttgcttgactgaggcactaatcctctcttcctccctctatcctccctcccctcctccccactcttcccctcctcttctcttcccctctcctccatctctgtgtctctctttcatatgcataccattctgccctactaaaataagctgttacttcataggcaacctgttgcaaattcaatctagccgcagattaaacatacagtatataccgttcatgttctgatttcattactgtggacaaatgcagctccaaacagaataggaaaaacccgcgtgttatggatgtttgtgtgcctacttgtttctttcctcctgtatttaaaatggtctgttcagctaattgagttcaaaaggctgatgtcattacatttcctggaatcgtatttcagcaggggaagtggaaaagttaaaactccaagcgagctgcacattgacgtcagctccgagtcatgttgtgatttagtcagttcctttccgctttgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctggtgagaaatggattatgtattgtataagctggcgggttctttactcttactccatcctcttactccatctataggaacttgcgattcagagctcctctagtgttcagtcagggaagtgcttgtcttttacttgttctcccagcctctggtatttaaatttgtaatcggtaatttttcactaggtttgcttttctcagtaacaaagagtgattttggaagacttagttactaataacctttgtgtgcttgcagtgttgtttattcagtggtcttgtttgtaatacagtactgaatttgcagttgaattaagagttttaaacaacttcactacaatttagctcttcgaagttaatgggtctcagccctctttgtggataggaacattggattgtcttgagtaagtaaaacctgtattacattgtttttaaaactgtcttgaggaactatttttttctcgaagttttgtgaagttctagagatgctatagactgcagaactcaaatgatgaatttattataagacatagatgaacttaaaatcatctcaaacactgcatgtcatatgattcttagaaccagaaggcacttttgtacatatattttctaaaaattattggttaatatctttctttaccaagcctttcattcctattacccctttgacttgtctaagcataagactcataacaaaaaataaataaaatgatgtgaaaacgctgtgtacttttttttttttttttttttttgagacggggtctcgctctgtcgcccaggctggagtgcagtggcgcgatcttggctcactgcaagctccgcctcccaggttcacgccattctcctgcctcagcctcctaagtagctgggactacaggcgcccgcctaattttttgtatttttaatagaggcggggtttcaccgtgttagccaggatggtctcgatttcctgacctcgtgatccgccctccttggcaatgctgtatacttttaaccactacatataaataaacaaacatttttgacatttgtttttacagaatgaacataacatccttgaaagtttttttcacagttttaccaataatgctacacatgattgattttccttttccaatttaaacttttcaaaatgctgaaactttaaaatgtcaaacaacttaaaacactttttcacaagacctgattttgcctttggaaatcatatttttaaaaatctggtcatttcttacagaatcagtgctatttgaaaaatgagtaataaattttatttcattttactttatttatttatttatttatttatttatttatttatttatttatttattttatgagacggagtctcgctctgtcgcccaggctggagtgcagtggctggatcttggctcactgcaagctcggcctcccgggttcacgccattctcctgcctcagcctcccgagtagctgggactacaggtgcccaccaccacgcccggctaattttgtttttttgtattttagtagagacggggtttcaccgtgttagccagaatggtctcgatctcctgacctcgtgatccgcctgcctcggcgtcccaaagtgctgggattacaggcgtgagccaccgcgctcggcctcattttactttatttttttaaagccagaagagcacagggttaagggacttttttgaaggtgtagtagagtagctttaggaaccagacctctgggctctcagttctgaggtaaccctatggatcggcagaccaagtagatctagattagtggcttgcaaacttttcaaccatgacccacgttaattatcacggcaaagtggacctatgtgtgtatgtaccctacatttatataaaacaagtttcagacataattcttatccttacaaaatatgatgtacccataattccttttctgtcctttttttaaaatgctattcttgacccatgaaatttgctttttgacccattaatggtctacagcttacagtttgaaaaactttgatctagaccaaaatcaggctcctagcactaatggctggcctggaaaagatattagcagcatttacctacaggatcatgaagtgaaatattaaaagcaaatgactggccgggcgcggtggctcacgtctgtaatcccagcactttgggaggccaaggcgggcggatcacaacctcaggagttcaagaccagcctggccaacatggtgaaaccccgtctctactaaaaatacaaaaattagccaggcgtggtggcacgcgcctgtaatctcagctactcgggaagctgaggcaagagaatggcttgaaaccgggaggcagagattgcaatgagccaacattgcaccactgcactccagcctgggtgacagaacgagactccatctcaaaaaaaaaaaaaaagtaaatgactatagtttatgggattatattattgattttgtggggcataatttacatttttattagaaattgcctttgttttattcataaactgattctgttaggagcataatttcctatcttttagactctgagtctgacgttgcattctgacgttgcattctggctggatttctgcattgtttaaaacaaactttccaacaaatttggaaaactagtgtcttagttaatatttgatgcatgagaataaggatatatatcacctttgtgaaaggaggctattagcaattatttttgcttaaaaatatttacataaaagaataatttcgaggctgggcgtggtggcttacgcctgtaatcccagcactttgggagaccgaggtgggctgatcacctgaggtcaggagttcaagaccagcctggccaacatggtgaaagcccatctccacaaaaatacaaaaattagccgggcgtggtggcatatgcctgtaatcccagctactcgggaggctgaggcggaagaatcacttgaacctgggaggtggaggttgcagtgagctgagatagtgccattgcactccagcctgggtgacagagcgagactccgtctcaacaacaacaaaaaagaataatttcatttaggtgtgacagcttcttgaagttggtaactgaacaagttataatcactttggaagtgaaaataacaaggcatttatctaccttaagattcagtaaaccaaatctgcagggtgaaattggaaattactcatgttattttcctactacttttgaaaaatgcataacgaaatgtaatttgggatatttatttcactttgccctgtttatatgaatatattaggcaaatatatttattcatttatattctaataaaatatactttgcatttatgtaaactttaaaataaaaaaatcacttaatgttacaaataaacatgaataccaactatagaaagtgctgtcaaagaaactatcagattgtgactgacacagaaacaggacatacaggttaagggatcaggtaggcctcactaggaaaccatgttcaaatgctaaaaaaggcagtttacaggcattctcactgatacatgcccaactacacccaggtcagactgggtaaatgacttccaagtttacaaagctagcaagtagtggacccgttcgagtcttcagaatcctcgggttctgctcatagcatattaatgtgactcctcaaaagtcacctgacattgacacatgaatgcagtgtcacgtgagtacatgctgctacacactgcttataaaacatataaaatgaggttaggttaatattattttaagtcgttaaaatggctttttttttttttttttttaagacagagtttcactcttgttgcccaggctggagtacagtggcgtgatcttggctcactgcaacctctgcctcccaggttcaagcgattcacctgcctcagcctcccaagtagctgagattacaagcacccaccaacacacccggctaattttgcatttttagtagagacagggtttcaccatttggtcaggctggtctcgaactcctgacctcaagcgatccacccgcctcagcctcccaaagtgctgggattacaggcatgagccaccacacccagcctaaaattgaattttttatagattattattactctcataggacagtagagcatatatttgctattatatggaacattaaatttcagtgttcgtaatttcccatcttttatatagactgacttatagattttcacatactgaactttaaaaggtcccttatgtataacttacttagctggattgtaataatttcataatgtatgcatatgtgaaagcatcacattatacactttgagtatatacagtttttgtcaattatacctcaaagctgaaaatattttggtgagttaattctatgtggtctatgtgttatagtgattgtagcaaatttgaaaatgatcagtgcttaaatagccatttttatgtagggtttaattttcacagagaagggaacgtttttggcagtgtgggataccaggcatggaggtgtaggatctgggtattaggagcaggtggtggtagacaggaagagaaccacagcagtggtggtgatgtcagcagcttaccagagctagggatagaagccccccacttagaagtgtgacatctaagttaacctctgctgcttacttaaaggtgtatttaggattagtgccatgctgtgaaatggcatatgaaaacaggaactctctatataaaaatgttttttattcagtctttgtgctcagtactacagatatcttaataaacaattgaataaaatcaccatcatttggggtgttgagaaatcgtttcactttggaagttaccaacataggtacttggctgggtttcttatttatttctttgtttcctactctcacttgtgggtttttttttcagttttcttcttcccagtctgatgagagtatatctttggccatttggggttctattataaatgattgcatacattgaaaaggatatcttacattatctttaatgtattctctaaaggaatataacgatatataattttataagtttttaataggcatattttttaacaaaataaggaataagagccataaatttggattccctgggtttgtcagaagggaaactccagggggaaatgtatttatggatgttatatgcgttttaactaatatacggtataagcataacttggaacgttgtctttcagaacttaaggaggggaagaggaagggaactaacatttgtggagtgcctgccatgtgccaggcactgtgctagacactttgacatacattgtagggtttattgtgagtattaaatgagatactgtatccccattttacagatgaggaaactgaacttgccccaagtcacatggctggtaagtggcagagctggactagaacccagactccaaaccccatgctttttctgctgtaccgtgtttaaagcttgcaaagagagatatgtagttaatgaccaaaattgagagttctaggaattttcttttcccatgaaatatttgatactgaacctaaaaaaaaaaaaatgctttcatgtcaggagctagatggaagcacatcataatgagaacgcctttgcttttaaaatgctatgttagacttatctaaagtgcatctaaggaaaatttaagaaataatgccttttatcaagaaaggccactttgaagagacacatcgcatcttgtagggctttccatgtcttagaggtaaaggtttagctataataatgtaagtttataagaaagactgcttattttaagcattctaaatgacagcaggcttgtgcaaaacccgaggaagttcaaattttacttcatacagcacacattaactcatgaaacacccattatatgccaagtatgtgctagattctaggggtttctggggttaaaaagatactatccctgatttgtcttaaagtttttgctttcctgagaataaagttagtgtacaaatatcttataatctttcttcaatcatgattgttaattccccactgataacccatatattttcaaaatatgaaaattctagaataaaaagtaatttagacactttcagtagttaaatgggacaggaagtggcctttataagaatacaggaatagcagtgtgtcatcagagaatgcaggatggtctttgaactgtgatccttggtgtcttatctgctttaaatttccactgagttcataatattggaaatttgaagctaactaagataaatactttttataacttgttttaaaattaaaacttgtgacatttagattttctcaaaacaagagattatctttgtatctttatttttttaagagacaaggtcttgctatgttgcccaggctggacttgaactcctgggctcaagtgatcctcatgcctcagcctctgaaggagctgagattacaggcatgagccactgtgcacagctgtctttgcccatatctttttaaatgtactttactaataagattatatttgagtatatggaatttgtccatcgaccattagaagtataccaccatatagatcctttgggatattatagaaatttatacaaattcctactaatttatactaactcctgtttctggcttgaactaatgcgcttgtcattttgattttattgagggaagtaaaatgaatatatgatacctctgaaaaattataataaaacccagtcacctaacatctcagaactaatacatctgaatatatcatccccttccaagttattttaaagtggtatttttttctgagctatcgctcaaaatgtttttaagaattcttattttggaactgccattatctttcatggtgccaaatttggtcccttgagggtggttgttgcttctggaaacaggcaagagttgtttggaagcatttctgataaatacaaggccaatgaatgaacgtctttttttgcttttttcctttttttttttcctgagacagggtcttactctgtcgctcaggctggagtgcagtagcataataacggctcactgtagcctcaacctcctgggctcacatgatcttcccacctaaggctctggaaccacagacgcacgccaccacacctggttaatttttgtatgtcttgtagagatcaggtttctccatgttgcccaggctggtcttgaactcctggactcaagtgaacctcctaccttggccttccaaaatgctgggattataggcgtgagccaccatgtctgcccttgaacttcattgttcacctgtgactattcccacccaccctttttttaaaaaaacaagttttttgtggccgggcgcagtggctcacgcctgtgatcccagcactttgggaggctgaggcaggtagatcacgaggttaggagttcgagaccagcctggccagaatggtgaaatctcatctctactaaacatacaaaaattagctgggagcggtggtgggcgtctgtaatcccagcaacttggaaggctgaggcaggagaatggcttcaacctgcgaggcggaggttgcagtgagccgagattgtgccactgcactctatcctgggtggcagcgtgagactctgtctcaaaataaaaataaaaagtaaaaagtttttttttttgttttttgtttttttttaaactagcttttgtatatatcatggaaccatcctgctctaacttcatattacaagaaaacagcaaacgtctacagaactagagtgtaatgagcccctctctacccattaattttactacacgtctgtgtgagcagtgtttggaaagaatgatcctagaccaaggtccatatccatgctgcctgcatgtgtcaacctggtgtcatgtaaacttctcattcgtcactggctattgttccaattttagaagacctaggtgaccaccagctgttctattgtttcagcctttattaccccataaccttcttccctggatgtgggtgaagagaaaaaagaggagagctatgttattctctgctccactccatctcttctgacaatacgatgaagatatgttaaacaatctattaagttagtttataactggcttaacgtgaccttgttaactatctcaaagctatacagttttgtacgactcattgagttgtctgtgtatacattattttgtatagtcacaaaaacaaatttaggacttttcccaagtttattcatatgctggtgatcattaatcacaattaggccaggcacagtggctcacgcctgtaatctcagcactttgggaggccaaggcaggcagatcacgaggtcgggagatcaagaccatcctgggcaacatggtgaaaccctgtttctactaaaaatacaaaaattagctgggcatgatggcgcgtgcctgtaatcccagctactcgggaggctgaggcaagagaatcacttgaaccagggagtagaaggttgcagtaagccaagattgcaccagtgcgctccagcctggtgtcagcaaaactacgtctcaaaaaaaaaaaaaaaaaaaaatcaattattccctatcaccaatgttttaaaattacatgtagaaggaaaaggcagtacaaccttataaacaatatttttattaattctatgaaaatctttaagtgagcttccttgaaagccatgtttttaactgttgtattctttcacctaattctcaagccttagaaggcagaaatctggcatatacccaaatagaagcacataaatcagttaatctttgtttaacttttttaaacaaagtttcagtgataatatcctatttagctgacaaagtatttgtctcccatgggtagcatttcacttcttattcattgggtataatacattttcatgaaatacagaaatgctgtgttttcctcttttgattggaatttagttcaggcaattgttatagaatttgataactttttaaaaaatcttttttcttgcacttagctttgagagagcatgtattttgtaatgtctcatcagagtgacaaactaactctggaccatacgttctcaatgttgaagcgttggtggtagaaatgttttatcactcgaatccatctgtcttttctaggaagctatgtttcttgcagtagacaaattttgaatataaattaggaaactttgagaacttacttttagtatttgatctgaatactaagtaaatattaaacgctgtattttaactgtatgattatactatgcttagacaatacttttaaatgaatatttacaaatgtattattttcctagaaacctaagaaagaaaaattatctttccccagagaaactaggtttaagcagagctttgctgggtttttattgttgttttttgttttttttactgaaactgcagtgagctcaattccttccagtgcttcagtgattttctagtaatgagaattgcacttaaagacattcagtgactgtttcaggcatgatatggagtataggaaaatctctaaactgaaacattcagaggatggagatattctgcttaatggaaatttttgcagtggtgtgctacagtcagctcctcctggcttgctagagcctattattaaattttcaggccgggcgtggtggctcacgcctgtaatcccaacactttgcgaggttgaggcaggcagatcacttgaggtcaggagttcaagaccagcctggccaacatggcaaaacaccatctctactaaaaatacaaaattagccaggtgtcgtggtgcacgcctgtaatcccagctacttgggaggctgaggtacaagaatcgcttgaactggggaggtggaggttacagtgagccaagattacaccactgcactccagcctggagccacttagtgagactctgtctaaaaaaaaaagccaggcgcgatggctcacacctgtaatcccagcactttgggaggccaaggtgggaggatcacgaggtcaggagattgagaccatcctggctaacacggtgaaaccccgtctctactaaaaatacaaaaaattagccaggcgtggtggcaggcgcctgtagtcccagctactcgggaggctgaggcaggagaatggcatgaacccaggaggcggagcttgcagtgagccaagatcgcgccactgcactccagcctgggcgacagagcgagactccgtctcaaaaaaaaaaaaatatgtgtgtgtataaatatgtatatatatacatgcatatatatatgcatatatacatacacatacacaatttacacattaaaaacattagtactcaaaactcataatttccaagtattttctctgtgctctgtgggtattggcatctgttttgtctgtatgctgtgctgcttaccacgtgtgtgtctttccaactctacgctcaggaaagtcaccttggtagcttgaaactggccatggtggaagtatttacatcgtgagaattactgaacactacacatcagggctttttcattgttttgtcctgaggactgtttcttaaatatttattagcacaccactgactttaagctaaatgagcatcttaagcttttgcctttgataaaaacctgtctaaaatgcattaggatgcttttctaccttaagtgtttagagcatgctaaatatcattgttctaagtgctgaagaagatctttaatacttgagattgctataatgctcagaataattatcttaaacattacaagatcacctcttatgagatgtcaaaagtatatcatttccagatcagttttatgtaaaatgccaaattatgaattctttatataagctcaaaatattttgttttactgcagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacaggtgaggtgttgcacagggaatcggtaacttctaggacactttttaaaaattacagttttcaccgggcgcagtggctcacgcctgtaatcccagcactttgggaggccaaggcaggcggatcacagggtcaggagatcaagaccatcctggctaacacggtgaaaccccatctctactaaaaaatacaaaaaaattcgccgggcgtggtggcaggtgcctgtagtcccagccacttgggaggctgaggcaggacaatggcatgaacctgggaggcggaggttgcagtgagccaagatcgtgccactgcactccagcctgggcgacagagcgagactccatctcaaaaaaataataaaacaatattaaatattaataaatgataataaaataatgataaaaataatatcaataaataaaaataaaaataaaaattacagttttcagctgggcgcagtggctcccgcctgtaatcccagcactttgggaggtcaaggcgggcagatcacaaggtcaagagattgagaccatcctggccaatatgacgaaaccctgtctctactaaaaatacaaaaattagctgggtgtggtggtgtgcacctgtaatcccagctactcgggaggctgaggcaagagaatcacttgaacccggaaggcggagcttgcagtgagctgaggtcgcgccactggactgcagcctgggtgacagtgagactccgtcttaaaaaaaaaaaattacagttttcataagccatttctcccaagttacatgttgtgtggcatttcatgtaggtttgtgctctgtgtgtgttattagattgtcttccagtcagaattcctggctgttaaactatttcatcagcaggagttacatccctatgttgtaagggtgatgtccaaaagatacagtaatttttaaaaataatgattaaaggactttgttagaaacaaagagctattttgtatttagtatttgctgtgaagtaggtgataagtcgaattttttagcttctctctgagaaaaatgaagtgtaagtgaggcgttacttttcgacattttctacatgtagtttccttttgtctattttttaactttttttcctctattacactgaaatacatatttaatctgataaattctagtcaagtgcaaatacaaaataacaaaaagaattaaaatcatccatggctctaaccacttaggatacctcctattatagtctatgtacttccagtcagctctcattttctctcactttttcttgctccatatctctgtcattttatttttaagcaacatattataaaatgctattttctaaaactttttaaaaatttaaacataaataaaattttatttaacttgtatattatttattggtttagtttttattatgaataatggtgcaaattaatctgattttcaaaaggaacagaattgtcttagagtttcccagtagtcttgtcaccttagtcctaatgtcaaataatgtcctcattgtgtgcagccaggacagagattcagcagtgttatcaagggcccagactcccgctcccggctgtgtcatcttcagcatgtatcattcattctcatgatcacagcgcggctactgaacctctaggcattgcctcagacaggaagaagggctagagccaaaaattggggctagctgaggtctggcccaactgcaaacctttcctggaagatcctcccagcaactttcacctacatttcattggctagaaataggtctttagtccctagctgtacaggattctgagaaaggtttattttcgctttctaaatctcagtttcagagcaagacaagagaaatgcagatgatacctggctgttaggttgctcattatctgtttagcagattttaagtgctttatttctactgtgtgtttaatgcttacatgagaataggtgattattatgcccagtttacagatgaggaccagaagttcagagatgttaaggaataagttggtcaagatcacatggcccaaactgggcagaaccaggatgggcaaccgggcagtctttattccagagcctgtcctctataccagcatcaggcatctcaaaaataccccatgataacctgcaaatttcacttcctggggaagtgtgaggctttagtcattcacagatagatctcttacatattttctttttattctttgattggcatctataatcgatatctcattatatcgtatttctgccaatccagcaacagtttttatttctttccagccttgtcagagtttcttccttgccttgcacttcctctccgtgctgaggatacacccagacacatgcaagcctgaaaaccgagctcactattaatagaagaaacaggtgttttccatggctgaggagtgcttaggaatgtaccatctactgatgtgatcggggaaagctttgtgcctgcaacattttgactctagtaatatgtgtgtctgtgcatgcacacacacacatgcacactcaaatgtagaagatgaagtatgagtatttataatagcttattaaagaaaatgtttaaacacccgcaacaccgctattaggtctttaaatttttcatttaatggtaaccatgttttgtaaaatgactatcttccttctaggtctagaatttaatataatttaatcatgaaaacgttggtattcataaatgaatttcagtgcctttgtggaaaagagttaaattatgtccccaaattggcaaatgtgtgtgtttggatttattcttaacttttccaattgcatcatttagattaaattagtcactataacattcttttcaattttacattttaaatttcttttgttaaccagctgagaagtctgagaactttgtatgttcacagggtgagtccattgttcctggctaggaagcaggggttgatcttttcctgcagttcatttggattgaaggttcttctttgctgactcttgcttccatagtgaaaacacagatatccactcagtgagagtcagctatcttaaaaaaaaaaaaaaaatcatgtatacatcacatgtggttcaggatgctagctggcattacagaaactggtgtttagacattcaacactgctttttttaacatatttgaatgatagtgtctgtttcagtgcaggcttttttgacatgaagggtgatctacctcaaaggcagttattctggaattgaatcctccaaaatgaggccaattaaagggtgtcttctacataggagttaagggaagtggttgccatccctcccaccctgaaaaaaagaaaaagagaaaatgttggctctatttattgttttggtggggttatgtatgaaaatgactaagtcaactcatctgtttgtgttgttgctttggctactggtctgttctttcattttgggcttatagtgctttaaaattcaatatattggatattaaatgcatgtgattaggaaacagtcttgaaatatgcccagagttactcagtagcttcttttttataattttaattgtggtggtctcacatttgtgggtttaaattgtctgagttattgagtgttgtattttgtagcccccttctttaattttcagaagcactgtccatttcatttcggtttataaaaatgcacatcttttgtttattgttatgatttatccatgtgtgttttctagccaataaactgtgtcttgcagtcatgattgatcttgttttactgagatttagttttgaagactaaaaatctccagtgttgatatttaaggtttttgaggattaattcttataatcatttttgatcgaataaaattaactcattatgtcggagtatgtgccttttgggagacaaaaataattaagagaattgaaaggatctataaatgtgtttgtagaaattccacttggggatgtggtcctattgtagtttactgaaaacagttgtgggcattgttaccagtggaatgtgtgccctaagaaaacaccatttgtgatgaatgctgggcgaactgtgttctcaaatcattcctgttgtctaatggttatcttacaaaaagcatgtgcctggttatgtttgttatgtggctttgtacagtccttacctaggatcgattggctgttgagttcggggggcagaagtgcactgacccactgtggattgtgttggaaggctgttcctgtagtcatttgccttgtgttgcttccagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccaca

SEQ ID NO: 294 - DNA, 45420 bp, Homo sapiens; identical to SEQ ID NO: 293

SEQ ID NO: 295 - DNA, 45420 bp, Homo sapiens; identical to SEQ ID NO: 293

SEQ ID NO: 296 - DNA, 4261 bp, Homo sapiens
gtgcttggaacattcttagccaccgaagtatgggcaccaaaagcgataaggagcatgtgttccttaataaatgtcacatcagaaaatgactgttccaggacagtaaccacctcccgatggtaagtatcctagatagtttgtcatttctcagcagcaggaaaaagagaagtaggccagtcatattagtgagtggtattacttaaaaatagcaaaaacaataacaaaaaaggtccagctttaatcctcaatggtgatcattttggcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggttagcttccttcctgaatggttttgtctttgactttcttgagccatttttttcctctttcactaattcatttatcatttttctttatgaagtgcttatacgcaaatctttttattagatatttggaggaatctcttctccttgcgtaaggtgctctgtgtcctgctaggtacgtaggtttcacttcagagctgcagctttgttgccaacttttcatttggggactgagtaattgcagatgagcagttcatgtcttcttcactttgttgttctgtgttcaaactcagatttatttagcaatgctccccaagggtgctgaaaaatattttgagggtgcatcagagaagatgtgtgataaacacagtaatataaagattatagtgctgatgctgttttctttttttttcttcttttttttttttttttgagacagagtctcgctttgtcgcccaggctggagggcagtggcatgatctcgggccattgcaagctccacctcccgggttcacgccattctcctgcctcagcctcccgagtagctgggactacaggcgcccgccaccatgcgtggctaattttttttgtatttttagtagagatggggtttcaccgtgttagccaggatggtcttgatctcctgacctcgtgatccgcctgtctcggcttcccaaagtgctgggattacaggcgtgagccactgcgcccagccagtgctgatgctgttttcatgaataatcaccttagtaggtagatataaatttataatcaccttagtaggtagatataaatttattttaaattcggtatacataattcttggtaagatgatattattaatgtatccctctcgattaaaccttggcttttgtagatatgattattattgtggttgtgatccagagatgtattttacccttaacatttcttgaagttaaaacattttttccatcaatagatgtaaattattaaatatgcattttttaaagtatgcatcttaattactgaatttatttttgttcatttttaaggtcagttattatcctttaaatgctgaaattatttgaacctaattgatgacaaaaaaaaaaatctgtgaggaaaatggagacacgtatacatagtatagtccttttcttgcgtgttcaagtagtttatcacagtagaatgataagagtggcgacaagatacctgatgtgacaaattcacatacattaaaagcttgattatctttgtggcatgggtattttctcctgtgtttcccagaagtgtaagaataattctcatcattatctttttttcctgtgatggcccctgattccaagagtttctaattctttctgacactaattataaaacaagaaagtctttccaacctcttctttgttttatgacttttattgaggtccacatatttctacttagttttaacctggctggtattggaagaaagtattgtctattattattatttattatttaatagagacagaattctcagtatgttacccaggtttgtgttgaggccctggcctcaagtgatcctcttgcctcagtctttcaaagtgctgggattacagatgtgagccacagcacccggctgaaagaaagtattctgttatattcagtagactttgtttggattttgttaagtgaacgatttaattgtccttgtagaaagaggtgccagtggatcttgtcctagaatacttacgtgttggatcatggtcaagccacttaatctctgtgcatgaactttaattttcacctttctaaaataggtaaattaatagcctacctcacctaagggagttgttatgattctatgacagatgtgtgacagcccggtgtaaaatgataaatatttaatatttggtggtgatatatgattatctgaggcaacaacatttttctcagtcctgttgattgggtgtgtgtgcttatgtgtggggcgttcatgagcaaaaacacgagtcatatgtggaggtgaatatacacctccgtgtacttcgggaagtatatattcttgcttgcattgttgatattttaataagctcttttgattttgtccaaatcaatttcccatgtaattataatatgaagtgagttttgtaaactctgctaccctaggccctcaaagtattaataattgactgaatatatcaaaatcagtcatgttgttgaagagattcattattttagttttctgacttctttaataatcatatcactgtattattacttgacttgaaaaatgaaatcatgcttaaaactctgatctttctcttaaggagaaatgctttatttggatcttcaagacccaccgccaccaagccctaacttactccttgtaatagaaatcctgattttacccaggcttgcttactgacttgcttatctacttaaatattctgtcttgggcctatctgatggctaatgtgaagacccagctcacgccagcgccagctgtgagagtgtgggaacagcagtgtgatccgggagctctcttctgcgttggcccctcgctggctccctcctggattcgtaggagcactttcaggttgaggagcttaggtcttgggtattttacattttgttctttcctgcaatgcctcatttgacatcccaaccactctttccctagtatttctgtagtatagagtacccgtaacattcctttccacacacatttgttttataactgaaatgtttgcgtctgcgcttcctttcttgagccagactccttcagtgcagattcactgtgttctattgctcagttgcttccacagctcctggctcagtgctgcacacacagactcttagcctcaattttttgaatgagggaaaagagcatatattttatgatacatttcagaaaatcttgtattataggtagcagcaattgcagagacagatgaatctgcagaatcagaaggtgtaattgattctcataaacgtagagaaatcctttcacgaagaccctcttataggtaagttaaccaagtttcctaatgtaaagatactttttccaaaatggtagaataattatacatcaaatcaattcttcctttatagcttttctgttttaagacttattcatgtatcttagtgacttaccttgttaaattgtattttaggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcacattca

SEQ ID NO: 297 - DNA, 37372 bp, Homo sapiens
gtgcttggaacattcttagccaccgaagtatgggcaccaaaagcgataaggagcatgtgttccttaataaatgtcacatcagaaaatgactgttccaggacagtaaccacctcccgatggtaagtatcctagatagtttgtcatttctcagcagcaggaaaaagagaagtaggccagtcatattagtgagtggtattacttaaaaatagcaaaaacaataacaaaaaaggtccagctttaatcctcaatggtgatcattttggcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggttagcttccttcctgaatggttttgtctttgactttcttgagccatttttttcctctttcactaattcatttatcatttttctttatgaagtgcttatacgcaaatctttttattagatatttggaggaatctcttctccttgcgtaaggtgctctgtgtcctgctaggtacgtaggtttcacttcagagctgcagctttgttgccaacttttcatttggggactgagtaattgcagatgagcagttcatgtcttcttcactttgttgttctgtgttcaaactcagatttatttagcaatgctccccaagggtgctgaaaaatattttgagggtgcatcagagaagatgtgtgataaacacagtaatataaagattatagtgctgatgctgttttctttttttttcttcttttttttttttttttgagacagagtctcgctttgtcgcccaggctggagggcagtggcatgatctcgggccattgcaagctccacctcccgggttcacgccattctcctgcctcagcctcccgagtagctgggactacaggcgcccgccaccatgcgtggctaattttttttgtatttttagtagagatggggtttcaccgtgttagccaggatggtcttgatctcctgacctcgtgatccgcctgtctcggcttcccaaagtgctgggattacaggcgtgagccactgcgcccagccagtgctgatgctgttttcatgaataatcaccttagtaggtagatataaatttataatcaccttagtaggtagatataaatttattttaaattcggtatacataattcttggtaagatgatattattaatgtatccctctcgattaaaccttggcttttgtagatatgattattattgtggttgtgatccagagatgtattttacccttaacatttcttgaagttaaaacattttttccatcaatagatgtaaattattaaatatgcattttttaaagtatgcatcttaattactgaatttatttttgttcatttttaaggtcagttattatcctttaaatgctgaaattatttgaacctaattgatgacaaaaaaaaaaatctgtgaggaaaatggagacacgtatacatagtatagtccttttcttgcgtgttcaagtagtttatcacagtagaatgataagagtggcgacaagatacctgatgtgacaaattcacatacattaaaagcttgattatctttgtggcatgggtattttctcctgtgtttcccagaagtgtaagaataattctcatcattatctttttttcctgtgatggcccctgattccaagagtttctaattctttctgacactaattataaaacaagaaagtctttccaacctcttctttgttttatgacttttattgaggtccacatatttctacttagttttaacctggctggtattggaagaaagtattgtctattattattatttattatttaatagagacagaattctcagtatgttacccaggtttgtgttgaggccctggcctcaagtgatcctcttgcctcagtctttcaaagtgctgggattacagatgtgagccacagcacccggctgaaagaaagtattctgttatattcagtagactttgtttggattttgttaagtgaacgatttaattgtccttgtagaaagaggtgccagtggatcttgtcctagaatacttacgtgttggatcatggtcaagccacttaatctctgtgcatgaactttaattttcacctttctaaaataggtaaattaatagcctacctcacctaagggagttgttatgattctatgacagatgtgtgacagcccggtgtaaaatgataaatatttaatatttggtggtgatatatgattatctgaggcaacaacatttttctcagtcctgttgattgggtgtgtgtgcttatgtgtggggcgttcatgagcaaaaacacgagtcatatgtggaggtgaatatacacctccgtgtacttcgggaagtatatattcttgcttgcattgttgatattttaataagctcttttgattttgtccaaatcaatttcccatgtaattataatatgaagtgagttttgtaaactctgctaccctaggccctcaaagtattaataattgactgaatatatcaaaatcagtcatgttgttgaagagattcattattttagttttctgacttctttaataatcatatcactgtattattacttgacttgaaaaatgaaatcatgcttaaaactctgatctttctcttaaggagaaatgctttatttggatcttcaagacccaccgccaccaagccctaacttactccttgtaatagaaatcctgattttacccaggcttgcttactgacttgcttatctacttaaatattctgtcttgggcctatctgatggctaatgtgaagacccagctcacgccagcgccagctgtgagagtgtgggaacagcagtgtgatccgggagctctcttctgcgttggcccctcgctggctccctcctggattcgtaggagcactttcaggttgaggagcttaggtcttgggtattttacattttgttctttcctgcaatgcctcatttgacatcccaaccactctttccctagtatttctgtagtatagagtacccgtaacattcctttccacacacatttgttttataactgaaatgtttgcgtctgcgcttcctttcttgagccagactccttcagtgcagattcactgtgttctattgctcagttgcttccacagctcctggctcagtgctgcacacacagactcttagcctcaattttttgaatgagggaaaagagcatatattttatgatacatttcagaaaatcttgtattataggtagcagcaattgcagagacagatgaatctgcagaatcagaaggtgtaattgattctcataaacgtagagaaatcctttcacgaagaccctcttataggtaagttaaccaagtttcctaatgtaaagatactttttccaaaatggtagaataattatacatcaaatcaattcttcctttatagcttttctgttttaagacttattcatgtatcttagtgacttaccttgttaaattgtattttaggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcacattcagtcttgtgcattttaatggaccgttaattctgtgctttttgctctgattaaagcactagtttttttcccaaaagaagagtgtttgatacgtaaaaagcaagagctagaaagaaaagaaaaaggaggagaaaggttagggatatcacatatcctaagctagccccttaggtactggaataatgtgatattcctgtcctttctgaagtataaattgtccatggaagttgtctaaatcaatttcccatgtaattataatatgaagtaaagtgagttttgtaaactctgctaccctaggtcctcaaagtaattgaacaaatatattgacagcagtcatgttgttgaagagattcataattttagttttctgactttaaaaagagctacttaggtactggaatatatgtgatattaaataatgtgtttatccaaataaggtattaagattttagatatattctttgtttttcctttaaaaagtagcaataccaagaaaaaaaaactcaagtcttaatttaagtcctgactactaaaacaagctataatctttaatgtatgagaagactttatatagtcattatttttgtggagctttttagagtttttcttgtagcagtggtagatttgcagtagtaaactattaaatacattctctgttggtaattgaggggaactcctaccatgatacctagcagatccggggtgtagtgtattcacacgtttgacagggcacccagtagacttgtccaaagtcagtgttaggaaaagaaaatccccaccatctgtaagaaatagaccttgaggtttacattgtcatttttttattacttctctcgtttacatgctcttttgtctggcacactgggaatctctggtgggttttagaactgtaaaactgaatatgccagctgatgagcctctacagcacagcacgcaggttatgagagtgctgagtgcctcgtccccccgtccccagaggggctgggcagaagctgctggcgcctcctggctggtcagccctggccttgagcagctccatccactcaccccagtgggctgtacacatgtcatcatgttctgtttgtgtaatgacagggaaaaggttggaagtgactgctgaaatgacactaagacttctcaaagtgttgggaaccactaagatgctgtcatcgtaacatttctctggcatatgctaatgctacttaggacttctgatagaagcagtgattcctttacaagttgatagggaagcagatgctgtagggttaacttgtctagattattagctgaaaatttgaaattgtgaaaatgtatggggttgaagctggagaggatgtggaaggaaccatctttgtgccatttgcaaactcaatgatcagagcaagaagctttattaaattcacatctcaggttttagtctttgaagtgggaataatactaaattgccaaactctggggttcctgtgaagacaaaggagataatgggtaaaagtagggggaaaaagacatgctactattggcatgaaacagagaaattaagttaggtgtaccattgtctcattcatgttcattgaactttccctccagccagccccaatggcttcattccctgtgtccttggtacctgctcacagcagggggctggccttaaacctcactctgtgtgtctgtgggggggatgagaggagcagagtcaggaattttggttgagaactagaaaactgcatctgtagaaattagatcttaggccaggtgtgatggctcccacctgtaatcccagcactttgggaggtctaggcaatgagggttgcttgaggccaggactttgagaccagtctgggcaatagagtgagaccctgtctctacaaaagaattttaaaaattagcagggtgtggtggtatgcgctcatcccagctactcaggaggctgaggtgggaggattctctgagcccaggagtttgaggctgcagtgagttatgattgcaccactgcactgtccaacctgggcagcagagtgagactctgtctcaaaacaacaaacaaaaaaaacacatctgtctatttgccacataagaggtcatggactatttcttactttggtttcttaatttgagtctatacagtatgatcctagaaattattctgatgagaagttatagttctgtatgtacagtctgcaggtaaaaattgccatttgttcacacaatgtgaatttcttttgttaaaaatgcattttggggacatttagtgaaatatatgtagataattctttgagaagtgaatactaacaacattcaaactttttagaagacgtttactttaattggagggtaaacatacttacacacacaacatccatttttattgatcttattttttatagaactaacttagcagatattaatgctttaatgttgtagcagaatgtctagaaatggaaacaattgccagtttcctttggtttttgaatagaggaacgtattttattagaatttctggagattttcctatttttttccttccctttgagctgtaaattttttttaatgctctttcataaccttttattataaaaaaaaattttaggtttaattgttcagcttttatccatggatggctttctcccaaactttgcttttatttctttttttccaatattttattagttatttttaatttggaataatgagttagctggtgtttaaaagaactaaatgtgtatcaaagttgaagaaataaagtatattcaagttttcccatatacaagcagttacatttttaatagttgaaagatatttggcagaagttggccttattatattgacttactattatcacaaaaactaaaaagtgaaagttggaataggctgctccctggggagtaggaaaaagcataaaatagacagggatccattattacaacaccaagtaagtgagctgtacctgcagaatcctcactggaagtacagatcttagtgataggtgtgttgcataacagttgagctggtcgaagaaagtcttttatttcagaagcatatacccgagagatggcgggagagagacagccttagaattaacaaagaatgttacttgctgcatgagacagttaagataggcagtaaatgagtgaatttgtaaaagcaaccgaggaaattaaaatgtttgaagcttcctaattcattaaatttcctcttgaaacaaaggttacttaaatcctccatcctactatacccaacctcttcctgtaccaattaaagactatcacccaagacttcagtttttttcccacaaatggcccttgtctctgcttgtgcctattgtattttacgaggaatcttattagagtattaactcatctttctggaattcttatacatgaaaggtaagtgggtcaatctaaactgcaccattatgaaaagaaaaatatgaactttgtggactccttataagaattcagaattctcaggaggctcacgaataagcaccaattcaacttcttcataaagggaattagaacataataggcttacacattcgaaagttaatccagttgcagttcttaatagtgacgttgtttacatttctctaaggcaactgtttcaaaattttttaaggcactacttaatgtaactctggcttttaaactttgatgttgctattgttgttatagcatgatttagtcttccttctgctataatgcacctcttggcttttaaggtacaagtactcataggtgctctcttatggtcactctgaatttaaacctgagaattcattggaacaaaggtctgtttgctgctgtttttaaagttaatgcagtgagatttcatttatgaatctttggattgcaatttggaacaagagtggttttaaatataaacatttacatgtgtatgtattttaattagctcatgtgtataaatttaggattagaagtatataacatgggccgggcgtgatggttcacgcctgtaatcccagcactttgggaggctgaggtgggcggatcacctgaggtcaggcattcgagaccagcctggccaacatggtgaaaccccatctctactgaaaatacaaaattagccgggtgtggtggtgcacacttgtaatcccagctactttggaggctgaggcaggagaatcgcttgaacccagcaggtggaggttgcagtgagctgagatcacacgattgcacttcagcctgggcgagaagagtgaaagtccatctcaaaataaatgaacaaataaataaataagaagtgtataacatcgccaggcttggtggtttgtgcctgtagtcccagctactcagaaggctgaggcagaaggattgcttgagcctagcagtttaagaccagctagaccaatatcaggatgtggggcaacacagcaagaccccatctcttaaataaatagctaaaatagaagatatgtctaaattcattcagttaatttcatcttattttttctatcttgatttatgtttattgaaagcacatgttatgctatccttgactattttgaaacctaaacagttttctcctcaaatctctgaatacagacaggcccacgtaaaacctatttccaggatcctgaggcactgggaaattttgtttattgtcagatgagagagaacattttcaatgggaaggtcctctgtcatttgataacaacaaaatcaagagcacctttggcataaaaatgaaaatgaggctgacgtgcctgacttaatcagtagaaatgttttctcactagagccagtgtgtgaggggtgtgtgtgtgtgtttgtttagcttttgttttccatatctaattatataatgacttccccagaaaataaaatgagaaacagattcttgatgtgtcagctgttcatattgtgaaaacaaagttttttgatcagaactgtggggaaacattactgaaaagaaaaaaggaaacgagtaaagcaaaaagaaagagaaaaaaggaagtaaaggtctttgttatctacctatttaggggttcttaccctgaggcagctactctcacctcagattgacttgatcgttatttaaaagcttgataatttggtgttgaaaaactaggttctatgattggaatttgaaaccatacctcatttaactctcctagattcacagggggcttaagttttttataatatcatctgtcatgaggaaatgatagccattcattcattcattcattcattcattcattctattttttgagtggctgctctgttctaggctttgtacttcttttttttttttttttgagacggagttttgctcttgtccaggctggtgtgcaatggtgcaatctctgctcaccgcaacccccgcctcccagattcaagcgattctcctccctcagcctcccgaggagctgggattgcaggcatgcaccaccacgcctggctaatttcttgtatttttagtagggacggggtttctccttgttggtcaggctggtcttgaactcctgacctcaggtgatccaccaacctcggcctcccaaagtgctgggattacagatgtgagccaccgcgcccggcctaggctttgtacttctaatacactgtggttacctgaccttgggctgctctttctaaagcactatttctgtgacatcaaactaattatcaactgaaaaatacacattcaaatatatgaaaacatacacaatttactcatgtctagccacaaggggccaagaaagcagtgtcttttgacattttcatacttgtaagaagttagttagatctctctcaaacccttttactatgagggctgaatcctgagacccatgaaatctttggaaagccatggtttaaaaataccctgtttttaaagtgtgtacagaaaataactgctctaggtgagccagataaagtgctgttacatcagggtgtctcaacctcagttctattgacattctgtaactgactcttcagtttctgccacactggcctgtcagtgaaataaaacacagagaacgcagcatgtggaagtctttttaaaaatgttaatctatcttcctgtgtagacactggcaccttaggtgaaagaagtgaaaatttgttgttgttactctttccataattctcataggtttgtcctatcaggttatcgcctaagtgcttttttgcctagatgcctttaaaaacgtttggaaatgacttgaaaatattcagagtgtattttaaacactactgttacgctactgtaaggtatttacattgatgtatagatgtcatgttattctggtgatgtgtttttaaaatcttcattgtaaagcctagttagctagtttatatgtgattttttaaaaagcatagcctctggtaccatttaatatctactgtttgaagcatgcagttggaatctttatgttaaaatatacagacctttcagatattttaaataatacttgtctattagagtgaaattttgaaacaaaacgtttgatcagttattctttggaagcttcaagtcaattaatatgttaacttttaaacatgactggcagatctcagtatttaaaggaaatctacttcctatttgttgccattagctgtagttacttgagatacttggtagaggtaaatattgtagcacaaatccttttagtaacagttactttttaaggacctttgcaacttgacaatttatatttcaggattctcctgacatagacaaaatggcaaaggttacagttttctagactttagctttataaccaaaatatgtttttatatatatttatatataaatatataatatatgtaaattatatagttatatataacatatgacatatataattataataaatatatattaaaaattttggtcatatatacaacatatataactatatataattatatatagttataattatatatagttatatataatatataacaaattatatataacataattatgttatatataattgtacataacatatatacatatataggtatatatacgtatatatgttatatataattatatattatatataaaatataaataattataaaaatataataattattaaaatatatgttatatataaatacaatataaattatatatataaatatataatttatatattatatgtgatatatattatatattatatataatataatatataatatatatcacatataatatatattatatataattaatatatataattaatataataatatatataatatataatatatatgatatatattatataaatatataaatatattaatatattaatatataatatatataatatatattatatattaatattaatatataaatatattaatatataatatatattatatatttatatatataaaatatataattatatataacatatataattatatgtatgttggtttttttttttagatggagtctctgttgcccaggctggagtgcagtgccgcaatctcagctcactgcaacctccaactcccgggttcaagtgattctcctgtctcagcctcccgagtaactgggactacagacacctgccaccacacctggctaatttttgtatttttagtagaggcggggtttcaccatattgatcaggctggtctcaaactcctgacctcaggtgatctgcctaccttggcctcccaaagtcctaagtttacaggcgtgagccactgcaccttgcctatatatttcttaaaaactactttcttttgatgacaaatcagaaaagtagttagctgaatgaaggtagaaattcattttaattgcaatattaaatgggaatttttcttttcttttcttttctttttttagagacagggttttcctgtgttgcccaggctggccttgaactcctgggctcaagtgatcctcctgccttggcctcccaaagtgctgggatcacaggcatgagccaccacacctggccttaaatgggaattttaaatggtagaagaatggtgtttataaggaaaaacatctgagagaatggagaaaaccaggaagctggactctccctgtctccttctccactcttcctcttgagtgatgtagtcagctggatgctaaggaggaggaacactccatgggctctatgaatctcaaacatttctgaatataaaatattttcaagtgtttataagcttttcctagagtatcgtcccatgacgaagctgatcttccttctcaattcagcatagaaaataagggtaacctgagaaagaagcaatggtaataaatagacccagagtatattcttccaataggggattattaaaaataaatcttgaaattctctaatatttcttttctttttctgttaagttgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaaggtatattttattaatctaatacatttagaatacctatggattactatatcacaccattgagtggtgattttatagttttttgaaatagatcgaaggtagatggtggggggttgggaggcacttaaaaaggcttacagaagaaatattttaatacattaaacagcaaattaagttttatcatttttcgccttttagcaggttttactggctctggagaaaggccaaattcagagtagcatgatagaaaaagagagatagaaacatgaatgaattttttttttttttttttgagatggagtctcgctctggcgcccaggctggagtacaatggcgtgatctcggctcactgcaacctgtctcctgggttcaagtgattcttctgcctcagcttcccggggagctgggattacaggcatgagccaccacgcctggctaatttttgtatttttagtagagacggggtttcaccatgttgggcaggctggtctcaaactcctgacctcagatggagtcgtcctgacctcaggtggaggcctcagcctcctaaagtgctgggattacagacgtgagccaccgcacccggccacatgaatgaatttttaaattaattagatatccttcatttgggggttgcaaatgttgtacctaatagatttctattacctaatctatgacaatttaagtattcaggctatgatgccccaaatttgtttttttccctagctgttactttcaagtctaatttctaggcaactcatttcaaaacaaatgctgactttgggttttttgtttttttttgtttgtttgtttttttgactgactgttcttagttgtttgaattctgaagtatccattctagctcttatggaagctgtcagtaatgaaataaaagttgagatgtagccctaagcttttagggttacctgagatttcaactggatttgcgttatacattattttaattcagttgtgcctatgataactgtaatagatgtatttaatacagctttcaaaactcctgtgttttaattgaattctattcctcttggtccattcgcttaggatttaggatatagcactattttttaaaaatttgcttgcttgtttgtttgtttgtttatttatttatttatttatttatttttgagacagagtctcgctctgttgcccaggctggagtgcagtggcgcgatctcggctcactgcgacctccgcctcccaggttcaagcaattcttctgcctcagcctcccgagtagctgggactacaggtgcataacgccatgcccggctaatttattgtattttagtagagacggggtttcaccgtattgcccaggctggtcgtgaactcctgagctcaggcagtccacccaccttggcctcccaaagtgctgggattacaggcagcactaacgttaaggaaagtaaaatcagttattttagttcgaatgtcttgcaggtatgataagcatattataattgatgagtctcttgataattatactcaggtattttgggggttaatgtggactatggtaaaagtgtgtgaagaactgaggtggtggcatttatggagtaaaaaatgcatagtacaaacccagtactttaatgttttcttgaaatgtaaaatgaaagccacctgttctattccccccatactcatggaccatatttatgtctaggtgaataatcttaaagaataattatttcttctcattttatctttgttacatggaagaatctactgcaaacaacagagttttgagaatttttaatgttttacacaatatgcacgtaagtttgtgccttggggtttttaagaattttcttccacaagtcacaaagatttttttccacattttcttctatttgctttatggttttacctttcacatttatgtctttaatgtatctgggcttcacttctgtatatagtatttggtgggaattcatttttaacttttttctccgtatatggagccactcccaagggtttgttgtttcctcactggtgtatggggcagccttaattagacagtgggtttgcttttgcacctggatctggccagtcttctgtctgattcatctttttctgaatcccagcgccatacatgtttgttatctcataaaacaagttccccttgtcttttttctcagtttgatacagagttagttttttgtgcacgattattctttcatatgcatttggaataagtttgagtttctaaatagtagtagtaataataataataataaaaccaatgatgagactgcattaattttttttttcttgagatggagtctcgctctgttgccctgcctggagtgcagtggcacgatggctcactgcaagctccacctcccgggttcacgccattcttctgcctcagcctcccaagtagctgggactacaggcgcctgccaccatgtccgactaatttttttgtatttttagtagatacagggtttcaccatgttcgccaggatggtctcgatctcctgacctcatgatccgcccacctcagcctcccgaagtgctgggattacaggcatgagccaccatgcccagccaagactgcatttaatttagggagagctgaagtcttcataatgttaagttgacctatcccaaaccatagaaagtcttgtttattcagatctcattttacttcttttaacagttgaacatttttctttttatttatttatttatttattatactttaagttttagggaacagttgaacatttttcttcacggagatcttgcatattctttctttagttggttcctaagtactttatgggttttgttgccattacaatggtaccttattttgtattgtattttctaattgttgctggtgtagagaaatacggattattttaagtcgatcttttatctattaactttgctgaactctaattacttctaataatttactgattctttgtgattcggtctgtgatcctatgtgaatgtttatacaaatagtgatgttttgtttcctcccttccaatctttattcctgttttctttttctctttttttcttttccttaaataatcatggccaggagctccagtttaaacacagcaaggccagtgggcattcttgtcttcctgaacttagtggcagtgttccctgccctccttctcccttcatctcactgaagggccctgtcagcttctttgtggattctcagtgcctgtcttggctgatgcctcagcagtatttaacactgtcgacttctgcttcctccacttcctgagactgtgtcctccttgctcttctctctctgctgcttctctgtcagtcctgttgctgggctaagcttcccctgcccctgtcctgagtgtttcagtgatcctcaggctcactcccccaccctcttcctgctgagctccctccctgaaggactccctcccacgctggcttcagttcactgtgactatgtcctgactccagctggttccttagatggccacacatacctctgactcctaaaatccactcttcctatcttcagtgattgaccactactatccttgatgccagaaacctaggtgttgtccagtattcttcccagtctccattcaaagtcactgtgtagattcttctgcctggctgagccatgaatgcttctgccactccacagccctctgtcctggccctggccctggcctgggtgctatccctctgacccaggctacccctgtgggctacagtctccggcagccaccggaagctggctattgtggaacagctttctgatcctcctaatcatgccagaggcagcagctcccttcttggctcagttttttgggaattgttcctgaaagttcagctaaactcttcattcctcacagtgattctgggagccactgatagttcttaaaaacagcagtttcttgcccccaacatctccattactgcattgcacttgttttgttttgtttcgttttgttttgttttgagacagagtctcactctcttggccaggctggaacacagtgatgtgatcttagctcactgcaacctctgtctcctgggctcaagcatttctcctgcctcagcttcccgagtagctgggattacaggcatgtaccaccatgcccagctaatttttgtatttttagtagagacggggttacaccatgttggccaggctggtcttgaactcctgagtttaggtaatccgtccatctcggcatcctaaagtgctacgattataggcatgagccaccacacctggtgtctggggtctttttaataagggcactaatcctgttcacaagggtgtcaccctcatgacctcatcacctctcagaggttccacctccaaatactattgcattggaggtgaggatttcaacagaggaaattgggtggggatacaaacattcagtctatagcatccactcaaaagcatccatcaatgtctgtgacctgttagacaaagctccaaatctttcatgtggcccaaatctttgcttgatccaagccttgcattctttaatagctgcctacctctccacttctccctcttttgtaatacagctctttctttcatttcctgggataggccatgccctctctccctccagggccttcttcacacataccgattgcctgataagaatacgttccccgaggaagccttgcccatcctccacatctggcttaggcaaccttctgtgagttcctactgtacttccttaggcacatatcatgttgtgttgtggctctctgtcttgctagatggtaagttctatttggacaaatacctagcacagaccctggcatgtgataaatgttcagtaagcatttaccaaatgaaagtgaactgttcttcctctgaaaatgtgatttgttctgtgtgctgattgacttgagattaactggtccagggaatacattaaaactactaagagcagtaatcaactaagcaacccatttcccttctttctttccttccttgccttttttttcacaccaatatttattgagcatctatgtgccaatttaaagaaatgctgacataaaaatcaatttcttattgattttctgaaatttgaaataaaatttactaatagcattcttggacccaaaccctcaggtgtgactgggacagcaaagagtccctgctggagccccagattgaggttgatgtctaggtgaccatccagggttccttactcagccaagatatcttcagctgaattgaaaccctaaccccattgtcaggtatcctggagaattactagaaacatggacactccctgaaactttacctcctgagcatctgaggtgtaaagtccttacctttactggaagatgattaaattaaatacagctaaaatgtggtgggatgtcctttcattgacataaggttgggttgaattctaatcatacaagggaaagggctttgggtgcggtggctcacacctgtaatcccagcactttgggaggctgaggtgggtggatcacctgagatcaggagttcgagaccagcctggccaacatggtgaaaccccgtctctactaaaaatacaaaaattagccaggcatggtgggcacctgtaatcccagctacttgggaagctgaggcaggagaatcatttgaacccaggaggcggaggttgcagtgagccaagattgcacctttgtactccagcctgggggagaatagcgagacttcatctcaaaaaaaaaaaaaaaaaaaaaaaaaaagacaaaaggtctcagtggcatgtcacttatttttttgcagtggaaatgccaataatttttttccaggctatggtctgttctatggttgaacattcgcccatttttgtgtctaaccttataatcactgaatttcctataatgatccagctctctatgtgccaagccttcattaagtgatccaaataaaatttgacatttaaaaaaaatgtacaaatagtaattttgatttatttatgaattttaaaaatcccaaatgtcttttcagggggttttaatctgggaaaataaggtattagattgaatcacatgaaactgctatttttgtaggccagaaagttcaaatatcagcaagttcatgtgattcaatctagtagttatgggagaatactacataatacttgctccattggcacagtgaatttttaaaatttaattatctactccctttaagtgaaagtagcaaattctgtatcaccttaggaagagttggattttttgatggtgtagcaaatggctcagcaaataaaaatgttaagtgaacacaggtggctggatatttcttggtgagtttagaagtgactatgaaatatggtatttctttgctgatagtcaatgtgttttttttttttttaaatctccaagtgttttttctcttatgagttaggaaattatgttgggtttattctcccttagtttacctagaagccttggacacaacaataataaagaagtagccctgtaagatacaatcatgtaacttttaatgctaaaagagacattattattattattattattattatttgctagagcccacctcaaacagatttctatgtaaaaatgagaaacaagagcattaagatggtttattacaggaagagtttttatagggcttgggtttcagtgagctcgcctgtgacaaagcaaattgatggcagtgataggctagtgatgtcattgtgatgtcagtcctcctgcttatcctgcacatgcttgctaatttggaacactttatgttgaactgtggtagaggaaacaagacagttctgtctgcagaagcccattatggctgtaactggagatgacacaggtaagaatgttaaagaggggttttcagttaattgtgcagattgttttgaagtttaggaagtattcaggaacatctgagtgtttcagaaagtgttactctcctagtcacttaggtgtaagactttttttgaaatatacatctatatattcagctcactttgttagggcatcttagtgtgattgtttctttgctcaatattctattgcttgcttgactgaggcactaatcctctcttcctccctctatcctccctcccctcctccccactcttcccctcctcttctcttcccctctcctccatctctgtgtctctctttcatatgcataccattctgccctactaaaataagctgttacttcataggcaacctgttgcaaattcaatctagccgcagattaaacatacagtatataccgttcatgttctgatttcattactgtggacaaatgcagctccaaacagaataggaaaaacccgcgtgttatggatgtttgtgtgcctacttgtttctttcctcctgtatttaaaatggtctgttcagctaattgagttcaaaaggctgatgtcattacatttcctggaatcgtatttcagcaggggaagtggaaaagttaaaactccaagcgagctgcacattgacgtcagctccgagtcatgttgtgatttagtcagttcctttccgctttgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctggtgagaaatggattatgtattgtataagctggcgggttctttactcttactccatcctcttactccatctataggaacttgcgattcagagctcctctagtgttcagtcagggaagtgcttgtcttttacttgttctcccagcctctggtatttaaatttgtaatcggtaatttttcactaggtttgcttttctcagtaacaaagagtgattttggaagacttagttactaataacctttgtgtgcttgcagtgttgtttattcagtggtcttgtttgtaatacagtactgaatttgcagttgaattaagagttttaaacaacttcactacaatttagctcttcgaagttaatgggtctcagccctctttgtggataggaacattggattgtcttgagtaagtaaaacctgtattacattgtttttaaaactgtcttgaggaactatttttttctcgaagttttgtgaagttctagagatgctatagactgcagaactcaaatgatgaatttattataagacatagatgaacttaaaatcatctcaaacactgcatgtcatatgattcttagaaccagaaggcacttttgtacatatattttctaaaaattattggttaatatctttctttaccaagcctttcattcctattacccctttgacttgtctaagcataagactcataacaaaaaataaataaaatgatgtgaaaacgctgtgtacttttttttttttttttttttttgagacggggtctcgctctgtcgcccaggctggagtgcagtggcgcgatcttggctcactgcaagctccgcctcccaggttcacgccattctcctgcctcagcctcctaagtagctgggactacaggcgcccgcctaattttttgtatttttaatagaggcggggtttcaccgtgttagccaggatggtctcgatttcctgacctcgtgatccgccctccttggcaatgctgtatacttttaaccactacatataaataaacaaacatttttgacatttgtttttacagaatgaacataacatccttgaaagtttttttcacagttttaccaataatgctacacatgattgattttccttttccaatttaaacttttcaaaatgctgaaactttaaaatgtcaaacaacttaaaacactttttcacaagacctgattttgcctttggaaatcatatttttaaaaatctggtcatttcttacagaatcagtgctatttgaaaaatgagtaataaattttatttcattttactttatttatttatttatttatttatttatttatttatttatttatttattttatgagacggagtctcgctctgtcgcccaggctggagtgcagtggctggatcttggctcactgcaagctcggcctcccgggttcacgccattctcctgcctcagcctcccgagtagctgggactacaggtgcccaccaccacgcccggctaattttgtttttttgtattttagtagagacggggtttcaccgtgttagccagaatggtctcgatctcctgacctcgtgatccgcctgcctcggcgtcccaaagtgctgggattacaggcgtgagccaccgcgctcggcctcattttactttatttttttaaagccagaagagcacagggttaagggacttttttgaaggtgtagtagagtagctttaggaaccagacctctgggctctcagttctgaggtaaccctatggatcggcagaccaagtagatctagattagtggcttgcaaacttttcaaccatgacccacgttaattatcacggcaaagtggacctatgtgtgtatgtaccctacatttatataaaacaagtttcagacataattcttatccttacaaaatatgatgtacccataattccttttctgtcctttttttaaaatgctattcttgacccatgaaatttgctttttgacccattaatggtctacagcttacagtttgaaaaactttgatctagaccaaaatcaggctcctagcactaatggctggcctggaaaagatattagcagcatttacctacaggatcatgaagtgaaatattaaaagcaaatgactggccgggcgcggtggctcacgtctgtaatcccagcactttgggaggccaaggcgggcggatcacaacctcaggagttcaagaccagcctggccaacatggtgaaaccccgtctctactaaaaatacaaaaattagccaggcgtggtggcacgcgcctgtaatctcagctactcgggaagctgaggcaagagaatggcttgaaaccgggaggcagagattgcaatgagccaacattgcaccactgcactccagcctgggtgacagaacgagactccatctcaaaaaaaaaaaaaaagtaaatgactatagtttatgggattatattattgattttgtggggcataatttacatttttattagaaattgcctttgttttattcataaactgattctgttaggagcataatttcctatcttttagactctgagtctgacgttgcattctgacgttgcattctggctggatttctgcattgtttaaaacaaactttccaacaaatttggaaaactagtgtcttagttaatatttgatgcatgagaataaggatatatatcacctttgtgaaaggaggctattagcaattatttttgcttaaaaatatttacataaaagaataatttcgaggctgggcgtggtggcttacgcctgtaatcccagcactttgggagaccgaggtgggctgatcacctgaggtcaggagttcaagaccagcctggccaacatggtgaaagcccatctccacaaaaatacaaaaattagccgggcgtggtggcatatgcctgtaatcccagctactcgggaggctgaggcggaagaatcacttgaacctgggaggtggaggttgcagtgagctgagatagtgccattgcactccagcctgggtgacagagcgagactccgtctcaacaacaacaaaaaagaataatttcatttaggtgtgacagcttcttgaagttggtaactgaacaagttataatcactttggaagtgaaaataacaaggcatttatctaccttaagattcagtaaaccaaatctgcagggtgaaattggaaattactcatgttattttcctactacttttgaaaaatgcataacgaaatgtaatttgggatatttatttcactttgccctgtttatatgaatatattaggcaaatatatttattcatttatattctaataaaatatactttgcatttatgtaaactttaaaataaaaaaatcacttaatgttacaaataaacatgaataccaactatagaaagtgctgtcaaagaaactatcagattgtgactgacacagaaacaggacatacaggttaagggatcaggtaggcctcactaggaaaccatgttcaaatgctaaaaaaggcagtttacaggcattctcactgatacatgcccaactacacccaggtcagactgggtaaatgacttccaagtttacaaagctagcaagtagtggacccgttcgagtcttcagaatcctcgggttctgctcatagcatattaatgtgactcctcaaaagtcacctgacattgacacatgaatgcagtgtcacgtgagtacatgctgctacacactgcttataaaacatataaaatgaggttaggttaatattattttaagtcgttaaaatggctttttttttttttttttttaagacagagtttcactcttgttgcccaggctggagtacagtggcgtgatcttggctcactgcaacctctgcctcccaggttcaagcgattcacctgcctcagcctcccaagtagctgagattacaagcacccaccaacacacccggctaattttgcatttttagtagagacagggtttcaccatttggtcaggctggtctcgaactcctgacctcaagcgatccacccgcctcagcctcccaaagtgctgggattacaggcatgagccaccacacccagcctaaaattgaattttttatagattattattactctcataggacagtagagcatatatttgctattatatggaacattaaatttcagtgttcgtaatttcccatcttttatatagactgacttatagattttcacatactgaactttaaaaggtcccttatgtataacttacttagctggattgtaataatttcataatgtatgcatatgtgaaagcatcacattatacactttgagtatatacagtttttgtcaattatacctcaaagctgaaaatattttggtgagttaattctatgtggtctatgtgttatagtgattgtagcaaatttgaaaatgatcagtgcttaaatagccatttttatgtagggtttaattttcacagagaagggaacgtttttggcagtgtgggataccaggcatggaggtgtaggatctgggtattaggagcaggtggtggtagacaggaagagaaccacagcagtggtggtgatgtcagcagcttaccagagctagggatagaagccccccacttagaagtgtgacatctaagttaacctctgctgcttacttaaaggtgtatttaggattagtgccatgctgtgaaatggcatatgaaaacaggaactctctatataaaaatgttttttattcagtctttgtgctcagtactacagatatcttaataaacaattgaataaaatcaccatcatttggggtgttgagaaatcgtttcactttggaagttaccaacataggtacttggctgggtttcttatttatttctttgtttcctactctcacttgtgggtttttttttcagttttcttcttcccagtctgatgagagtatatctttggccatttggggttctattataaatgattgcatacattgaaaaggatatcttacattatctttaatgtattctctaaaggaatataacgatatataattttataagtttttaataggcatattttttaacaaaataaggaataagagccataaatttggattccctgggtttgtcagaagggaaactccagggggaaatgtatttatggatgttatatgcgttttaactaatatacggtataagcataacttggaacgttgtctttcagaacttaaggaggggaagaggaagggaactaacatttgtggagtgcctgccatgtgccaggcactgtgctagacactttgacatacattgtagggtttattgtgagtattaaatgagatactgtatccccattttacagatgaggaaactgaacttgccccaagtcacatggctggtaagtggcagagctggactagaacccagactccaaaccccatgctttttctgctgtaccgtgtttaaagcttgcaaagagagatatgtagttaatgaccaaaattgagagttctaggaattttcttttcccatgaaatatttgatactgaacctaaaaaaaaaaaaatgctttcatgtcaggagctagatggaagcacatcataatgagaacgcctttgcttttaaaatgctatgttagacttatctaaagtgcatctaaggaaaatttaagaaataatgccttttatcaagaaaggccactttgaagagacacatcgcatcttgtagggctttccatgtcttagaggtaaaggtttagctataataatgtaagtttataagaaagactgcttattttaagcattctaaatgacagcaggcttgtgcaaaacccgaggaagttcaaattttacttcatacagcacacattaactcatgaaacacccattatatgccaagtatgtgctagattctaggggtttctggggttaaaaagatactatccctgatttgtcttaaagtttttgctttcctgagaataaagttagtgtacaaatatcttataatctttcttcaatcatgattgttaattccccactgataacccatatattttcaaaatatgaaaattctagaataaaaagtaatttagacactttcagtagttaaatgggacaggaagtggcctttataagaatacaggaatagcagtgtgtcatcagagaatgcaggatggtctttgaactgtgatccttggtgtcttatctgctttaaatttccactgagttcataatattggaaatttgaagctaactaagataaatactttttataacttgttttaaaattaaaacttgtgacatttagattttctcaaaacaagagattatctttgtatctttatttttttaagagacaaggtcttgctatgttgcccaggctggacttgaactcctgggctcaagtgatcctcatgcctcagcctctgaaggagctgagattacaggcatgagccactgtgcacagctgtctttgcccatatctttttaaatgtactttactaataagattatatttgagtatatggaatttgtccatcgaccattagaagtataccaccatatagatcctttgggatattatagaaatttatacaaattcctactaatttatactaactcctgtttctggcttgaactaatgcgcttgtcattttgattttattgagggaagtaaaatgaatatatgatacctctgaaaaattataataaaacccagtcacctaacatctcagaactaatacatctgaatatatcatccccttccaagttattttaaagtggtatttttttctgagctatcgctcaaaatgtttttaagaattcttattttggaactgccattatctttcatggtgccaaatttggtcccttgagggtggttgttgcttctggaaacaggcaagagttgtttggaagcatttctgataaatacaaggccaatgaatgaacgtctttttttgcttttttcctttttttttttcctgagacagggtcttactctgtcgctcaggctggagtgcagtagcataataacggctcactgtagcctcaacctcctgggctcacatgatcttcccacctaaggctctggaaccacagacgcacgccaccacacctggttaatttttgtatgtcttgtagagatcaggtttctccatgttgcccaggctggtcttgaactcctggactcaagtgaacctcctaccttggccttccaaaatgctgggattataggcgtgagccaccatgtctgcccttgaacttcattgttcacctgtgactattcccacccaccctttttttaaaaaaacaagttttttgtggccgggcgcagtggctcacgcctgtgatcccagcactttgggaggctgaggcaggtagatcacgaggttaggagttcgagaccagcctggccagaatggtgaaatctcatctctactaaacatacaaaaattagctgggagcggtggtgggcgtctgtaatcccagcaacttggaaggctgaggcaggagaatggcttcaacctgcgaggcggaggttgcagtgagccgagattgtgccactgcactctatcctgggtggcagcgtgagactctgtctcaaaataaaaataaaaagtaaaaagtttttttttttgttttttgtttttttttaaactagcttttgtatatatcatggaaccatcctgctctaacttcatattacaagaaaacagcaaacgtctacagaactagagtgtaatgagcccctctctacccattaattttactacacgtctgtgtgagcagtgtttggaaagaatgatcctagaccaaggtccatatccatgctgcctgcatgtgtcaacctggtgtcatgtaaacttctcattcgtcactggctattgttccaattttagaagacctaggtgaccaccagctgttctattgtttcagcctttattaccccataaccttcttccctggatgtgggtgaagagaaaaaagaggagagctatgttattctctgctccactccatctcttctgacaatacgatgaagatatgttaaacaatctattaagttagtttataactggcttaacgtgaccttgttaactatctcaaagctatacagttttgtacgactcattgagttgtctgtgtatacattattttgtatagtcacaaaaacaaatttaggacttttcccaagtttattcatatgctggtgatcattaatcacaattaggccaggcacagtggctcacgcctgtaatctcagcactttgggaggccaaggcaggcagatcacgaggtcgggagatcaagaccatcctgggcaacatggtgaaaccctgtttctactaaaaatacaaaaattagctgggcatgatggcgcgtgcctgtaatcccagctactcgggaggctgaggcaagagaatcacttgaaccagggagtagaaggttgcagtaagccaagattgcaccagtgcgctccagcctggtgtcagcaaaactacgtctcaaaaaaaaaaaaaaaaaaaaatcaattattccctatcaccaatgttttaaaattacatgtagaaggaaaaggcagtacaaccttataaacaatatttttattaattctatgaaaatctttaagtgagcttccttgaaagccatgtttttaactgttgtattctttcacctaattctcaagccttagaaggcagaaatctggcatatacccaaatagaagcacataaatcagttaatctttgtttaacttttttaaacaaagtttcagtgataatatcctatttagctgacaaagtatttgtctcccatgggtagcatttcacttcttattcattgggtataatacattttcatgaaatacagaaatgctgtgttttcctcttttgattggaatttagttcaggcaattgttatagaatttgataactttttaaaaaatcttttttcttgcacttagctttgagagagcatgtattttgtaatgtctcatcagagtgacaaactaactctggaccatacgttctcaatgttgaagcgttggtggtagaaatgttttatcactcgaatccatctgtcttttctaggaagctatgtttcttgcagtagacaaattttgaatataaattaggaaactttgagaacttacttttagtatttgatctgaatactaagtaaatattaaacgctgtattttaactgtatgattatactatgcttagacaatacttttaaatgaatatttacaaatgtattattttcctagaaacctaagaaagaaaaattatctttccccagagaaactaggtttaagcagagctttgctgggtttttattgttgttttttgttttttttactgaaactgcagtgagctcaattccttccagtgcttcagtgattttctagtaatgagaattgcacttaaagacattcagtgactgtttcaggcatgatatggagtataggaaaatctctaaactgaaacattcagaggatggagatattctgcttaatggaaatttttgcagtggtgtgctacagtcagctcctcctggcttgctagagcctattattaaattttcaggccgggcgtggtggctcacgcctgtaatcccaacactttgcgaggttgaggcaggcagatcacttgaggtcaggagttcaagaccagcctggccaacatggcaaaacaccatctctactaaaaatacaaaattagccaggtgtcgtggtgcacgcctgtaatcccagctacttgggaggctgaggtacaagaatcgcttgaactggggaggtggaggttacagtgagccaagattacaccactgcactccagcctggagccacttagtgagactctgtctaaaaaaaaaagccaggcgcgatggctcacacctgtaatcccagcactttgggaggccaaggtgggaggatcacgaggtcaggagattgagaccatcctggctaacacggtgaaaccccgtctctactaaaaatacaaaaaattagccaggcgtggtggcaggcgcctgtagtcccagctactcgggaggctgaggcaggagaatggcatgaacccaggaggcggagcttgcagtgagccaagatcgcgccactgcactccagcctgggcgacagagcgagactccgtctcaaaaaaaaaaaaatatgtgtgtgtataaatatgtatatatatacatgcatatatatatgcatatatacatacacatacacaatttacacattaaaaacattagtactcaaaactcataatttccaagtattttctctgtgctctgtgggtattggcatctgttttgtctgtatgctgtgctgcttaccacgtgtgtgtctttccaactctacgctcaggaaagtcaccttggtagcttgaaactggccatggtggaagtatttacatcgtgagaattactgaacactacacatcagggctttttcattgttttgtcctgaggactgtttcttaaatatttattagcacaccactgactttaagctaaatgagcatcttaagcttttgcctttgataaaaacctgtctaaaatgcattaggatgcttttctaccttaagtgtttagagcatgctaaatatcattgttctaagtgctgaagaagatctttaatacttgagattgctataatgctcagaataattatcttaaacattacaagatcacctcttatgagatgtcaaaagtatatcatttccagatcagttttatgtaaaatgccaaattatgaattctttatataagctcaaaatattttgttttactgcagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacaggtgaggtgttgcacagggaatcggtaacttctaggacactttttaaaaattacagttttcaccgggcgcagtggctcacgcctgtaatcccagcactttgggaggccaaggcaggcggatcacagggtcaggagatcaagaccatcctggctaacacggtgaaaccccatctctactaaaaaatacaaaaaaattcgccgggcgtggtggcaggtgcctgtagtcccagccacttgggaggctgaggcaggacaatggcatgaacctgggaggcggaggttgcagtgagccaagatcgtgccactgcactccagcctgggcgacagagcgagactccatctcaaaaaaataataaaacaatattaaatattaataaatgataataaaataatgataaaaataatatcaataaataaaaataaaaataaaaattacagttttcagctgggcgcagtggctcccgcctgtaatcccagcactttgggaggtcaaggcgggcagatcacaaggtcaagagattgagaccatcctggccaatatgacgaaaccctgtctctactaaaaatacaaaaattagctgggtgtggtggtgtgcacctgtaatcccagctactcgggaggctgaggcaagagaatcacttgaacccggaaggcggagcttgcagtgagctgaggtcgcgccactggactgcagcctgggtgacagtgagactccgtcttaaaaaaaaaaaattacagttttcataagccatttctcccaagttacatgttgtgtggcatttcatgtaggtttgtgctctgtgtgtgttattagattgtcttccagtcagaattcctggctgttaaactatttcatcagcaggagttacatccctatgttgtaagggtgatgtccaaaagatacagtaatttttaaaaataatgattaaaggactttgttagaaacaaagagctattttgtatttagtatttgctgtgaagtaggtgataagtcgaattttttagcttctctctgagaaaaatgaagtgtaagtgaggcgttacttttcgacattttctacatgtagtttccttttgtctattttttaactttttttcctctattacactgaaatacatatttaatctgataaattctagtcaagtgcaaatacaaaataacaaaaagaattaaaatcatccatggctctaaccacttaggatacctcctattatagtctatgtacttccagtcagctctcattttctctcactttttcttgctccatatctctgtcattttatttttaagcaacatattataaaatgctattttctaaaactttttaaaaatttaaacataaataaaattttatttaacttgtatattatttattggtttagtttttattatgaataatggtgcaaattaatctgattttcaaaaggaacagaattgtcttagagtttcccagtagtcttgtcaccttagtcctaatgtcaaataatgtcctcattgtgtgcagccaggacagagattcagcagtgttatcaagggcccagactcccgctcccggctgtgtcatcttcagcatgtatcattcattctcatgatcacagcgcggctactgaacctctaggcattgcctcagacaggaagaagggctagagccaaaaattggggctagctgaggtctggcccaactgcaaacctttcctggaagatcctcccagcaactttcacctacatttcattggctagaaataggtctttagtccctagctgtacaggattctgagaaaggtttattttcgctttctaaatctcagtttcagagcaagacaagagaaatgcagatgatacctggctgttaggttgctcattatctgtttagcagattttaagtgctttatttctactgtgtgtttaatgcttacatgagaataggtgattattatgcccagtttacagatgaggaccagaagttcagagatgttaaggaataagttggtcaagatcacatggcccaaactgggcagaaccaggatgggcaaccgggcagtctttattccagagcctgtcctctataccagcatcaggcatctcaaaaataccccatgataacctgcaaatttcacttcctggggaagtgtgaggctttagtcattcacagatagatctcttacatattttctttttattctttgattggcatctataatcgatatctcattatatcgtatttctgccaatccagcaacagtttttatttctttccagccttgtcagagtttcttccttgccttgcacttcctctccgtgctgaggatacacccagacacatgcaagcctgaaaaccgagctcactattaatagaagaaacaggtgttttccatggctgaggagtgcttaggaatgtaccatctactgatgtgatcggggaaagctttgtgcctgcaacattttgactctagtaatatgtgtgtctgtgcatgcacacacacacatgcacactcaaatgtagaagatgaagtatgagtatttataatagcttattaaagaaaatgtttaaacacccgcaacaccgctattaggtctttaaatttttcatttaatggtaaccatgttttgtaaaatgactatcttccttctaggtctagaatttaatataatttaatcatgaaaacgttggtattcataaatgaatttcagtgcctttgtggaaaagagttaaattatgtccccaaattggcaaatgtgtgtgtttggatttattcttaacttttccaattgcatcatttagattaaattagtcactataacattcttttcaattttacattttaaatttcttttgttaaccagctgagaagtctgagaactttgtatgttcacagggtgagtccattgttcctggctaggaagcaggggttgatcttttcctgcagttcatttggattgaaggttcttctttgctgactcttgcttccatagtgaaaacacagatatccactcagtgagagtcagctatcttaaaaaaaaaaaaaaaatcatgtatacatcacatgtggttcaggatgctagctggcattacagaaactggtgtttagacattcaacactgctttttttaacatatttgaatgatagtgtctgtttcagtgcaggcttttttgacatgaagggtgatctacctcaaaggcagttattctggaattgaatcctccaaaatgaggccaattaaagggtgtcttctacataggagttaagggaagtggttgccatccctcccaccctgaaaaaaagaaaaagagaaaatgttggctctatttattgttttggtggggttatgtatgaaaatgactaagtcaactcatctgtttgtgttgttgctttggctactggtctgttctttcattttgggcttatagtgctttaaaattcaatatattggatattaaatgcatgtgattaggaaacagtcttgaaatatgcccagagttactcagtagcttcttttttataattttaattgtggtggtctcacatttgtgggtttaaattgtctgagttattgagtgttgtattttgtagcccccttctttaattttcagaagcactgtccatttcatttcggtttataaaaatgcacatcttttgtttattgttatgatttatccatgtgtgttttctagccaataaactgtgtcttgcagtcatgattgatcttgttttactgagatttagttttgaagactaaaaatctccagtgttgatatttaaggtttttgaggattaattcttataatcatttttgatcgaataaaattaactcattatgtcggagtatgtgccttttgggagacaaaaataattaagagaattgaaaggatctataaatgtgtttgtagaaattccacttggggatgtggtcctattgtagtttactgaaaacagttgtgggcattgttaccagtggaatgtgtgccctaagaaaacaccatttgtgatgaatgctgggcgaactgtgttctcaaatcattcctgttgtctaatggttatcttacaaaaagcatgtgcctggttatgtttgttatgtggctttgtacagtccttacctaggatcgattggctgttgagttcggggggcagaagtgcactgacccactgtggattgtgttggaaggctgttcctgtagtcatttgccttgtgttgcttccagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccaca

SEQ ID NO: 298 - DNA, 37372 bp, Homo sapiens; identical to SEQ ID NO: 297

SEQ ID NO: 299 - DNA, 37372 bp, Homo sapiens; identical to SEQ ID NO: 297

SEQ ID NO: 300 - DNA, 15624 bp, Homo sapiens
tggaacactttatgttgaactgtggtagaggaaacaagacagttctgtctgcagaagcccattatggctgtaactggagatgacacaggtaagaatgttaaagaggggttttcagttaattgtgcagattgttttgaagtttaggaagtattcaggaacatctgagtgtttcagaaagtgttactctcctagtcacttaggtgtaagactttttttgaaatatacatctatatattcagctcactttgttagggcatcttagtgtgattgtttctttgctcaatattctattgcttgcttgactgaggcactaatcctctcttcctccctctatcctccctcccctcctccccactcttcccctcctcttctcttcccctctcctccatctctgtgtctctctttcatatgcataccattctgccctactaaaataagctgttacttcataggcaacctgttgcaaattcaatctagccgcagattaaacatacagtatataccgttcatgttctgatttcattactgtggacaaatgcagctccaaacagaataggaaaaacccgcgtgttatggatgtttgtgtgcctacttgtttctttcctcctgtatttaaaatggtctgttcagctaattgagttcaaaaggctgatgtcattacatttcctggaatcgtatttcagcaggggaagtggaaaagttaaaactccaagcgagctgcacattgacgtcagctccgagtcatgttgtgatttagtcagttcctttccgctttgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctggtgagaaatggattatgtattgtataagctggcgggttctttactcttactccatcctcttactccatctataggaacttgcgattcagagctcctctagtgttcagtcagggaagtgcttgtcttttacttgttctcccagcctctggtatttaaatttgtaatcggtaatttttcactaggtttgcttttctcagtaacaaagagtgattttggaagacttagttactaataacctttgtgtgcttgcagtgttgtttattcagtggtcttgtttgtaatacagtactgaatttgcagttgaattaagagttttaaacaacttcactacaatttagctcttcgaagttaatgggtctcagccctctttgtggataggaacattggattgtcttgagtaagtaaaacctgtattacattgtttttaaaactgtcttgaggaactatttttttctcgaagttttgtgaagttctagagatgctatagactgcagaactcaaatgatgaatttattataagacatagatgaacttaaaatcatctcaaacactgcatgtcatatgattcttagaaccagaaggcacttttgtacatatattttctaaaaattattggttaatatctttctttaccaagcctttcattcctattacccctttgacttgtctaagcataagactcataacaaaaaataaataaaatgatgtgaaaacgctgtgtacttttttttttttttttttttttgagacggggtctcgctctgtcgcccaggctggagtgcagtggcgcgatcttggctcactgcaagctccgcctcccaggttcacgccattctcctgcctcagcctcctaagtagctgggactacaggcgcccgcctaattttttgtatttttaatagaggcggggtttcaccgtgttagccaggatggtctcgatttcctgacctcgtgatccgccctccttggcaatgctgtatacttttaaccactacatataaataaacaaacatttttgacatttgtttttacagaatgaacataacatccttgaaagtttttttcacagttttaccaataatgctacacatgattgattttccttttccaatttaaacttttcaaaatgctgaaactttaaaatgtcaaacaacttaaaacactttttcacaagacctgattttgcctttggaaatcatatttttaaaaatctggtcatttcttacagaatcagtgctatttgaaaaatgagtaataaattttatttcattttactttatttatttatttatttatttatttatttatttatttatttatttattttatgagacggagtctcgctctgtcgcccaggctggagtgcagtggctggatcttggctcactgcaagctcggcctcccgggttcacgccattctcctgcctcagcctcccgagtagctgggactacaggtgcccaccaccacgcccggctaattttgtttttttgtattttagtagagacggggtttcaccgtgttagccagaatggtctcgatctcctgacctcgtgatccgcctgcctcggcgtcccaaagtgctgggattacaggcgtgagccaccgcgctcggcctcattttactttatttttttaaagccagaagagcacagggttaagggacttttttgaaggtgtagtagagtagctttaggaaccagacctctgggctctcagttctgaggtaaccctatggatcggcagaccaagtagatctagattagtggcttgcaaacttttcaaccatgacccacgttaattatcacggcaaagtggacctatgtgtgtatgtaccctacatttatataaaacaagtttcagacataattcttatccttacaaaatatgatgtacccataattccttttctgtcctttttttaaaatgctattcttgacccatgaaatttgctttttgacccattaatggtctacagcttacagtttgaaaaactttgatctagaccaaaatcaggctcctagcactaatggctggcctggaaaagatattagcagcatttacctacaggatcatgaagtgaaatattaaaagcaaatgactggccgggcgcggtggctcacgtctgtaatcccagcactttgggaggccaaggcgggcggatcacaacctcaggagttcaagaccagcctggccaacatggtgaaaccccgtctctactaaaaatacaaaaattagccaggcgtggtggcacgcgcctgtaatctcagctactcgggaagctgaggcaagagaatggcttgaaaccgggaggcagagattgcaatgagccaacattgcaccactgcactccagcctgggtgacagaacgagactccatctcaaaaaaaaaaaaaaagtaaatgactatagtttatgggattatattattgattttgtggggcataatttacatttttattagaaattgcctttgttttattcataaactgattctgttaggagcataatttcctatcttttagactctgagtctgacgttgcattctgacgttgcattctggctggatttctgcattgtttaaaacaaactttccaacaaatttggaaaactagtgtcttagttaatatttgatgcatgagaataaggatatatatcacctttgtgaaaggaggctattagcaattatttttgcttaaaaatatttacataaaagaataatttcgaggctgggcgtggtggcttacgcctgtaatcccagcactttgggagaccgaggtgggctgatcacctgaggtcaggagttcaagaccagcctggccaacatggtgaaagcccatctccacaaaaatacaaaaattagccgggcgtggtggcatatgcctgtaatcccagctactcgggaggctgaggcggaagaatcacttgaacctgggaggtggaggttgcagtgagctgagatagtgccattgcactccagcctgggtgacagagcgagactccgtctcaacaacaacaaaaaagaataatttcatttaggtgtgacagcttcttgaagttggtaactgaacaagttataatcactttggaagtgaaaataacaaggcatttatctaccttaagattcagtaaaccaaatctgcagggtgaaattggaaattactcatgttattttcctactacttttgaaaaatgcataacgaaatgtaatttgggatatttatttcactttgccctgtttatatgaatatattaggcaaatatatttattcatttatattctaataaaatatactttgcatttatgtaaactttaaaataaaaaaatcacttaatgttacaaataaacatgaataccaactatagaaagtgctgtcaaagaaactatcagattgtgactgacacagaaacaggacatacaggttaagggatcaggtaggcctcactaggaaaccatgttcaaatgctaaaaaaggcagtttacaggcattctcactgatacatgcccaactacacccaggtcagactgggtaaatgacttccaagtttacaaagctagcaagtagtggacccgttcgagtcttcagaatcctcgggttctgctcatagcatattaatgtgactcctcaaaagtcacctgacattgacacatgaatgcagtgtcacgtgagtacatgctgctacacactgcttataaaacatataaaatgaggttaggttaatattattttaagtcgttaaaatggctttttttttttttttttttaagacagagtttcactcttgttgcccaggctggagtacagtggcgtgatcttggctcactgcaacctctgcctcccaggttcaagcgattcacctgcctcagcctcccaagtagctgagattacaagcacccaccaacacacccggctaattttgcatttttagtagagacagggtttcaccatttggtcaggctggtctcgaactcctgacctcaagcgatccacccgcctcagcctcccaaagtgctgggattacaggcatgagccaccacacccagcctaaaattgaattttttatagattattattactctcataggacagtagagcatatatttgctattatatggaacattaaatttcagtgttcgtaatttcccatcttttatatagactgacttatagattttcacatactgaactttaaaaggtcccttatgtataacttacttagctggattgtaataatttcataatgtatgcatatgtgaaagcatcacattatacactttgagtatatacagtttttgtcaattatacctcaaagctgaaaatattttggtgagttaattctatgtggtctatgtgttatagtgattgtagcaaatttgaaaatgatcagtgcttaaatagccatttttatgtagggtttaattttcacagagaagggaacgtttttggcagtgtgggataccaggcatggaggtgtaggatctgggtattaggagcaggtggtggtagacaggaagagaaccacagcagtggtggtgatgtcagcagcttaccagagctagggatagaagccccccacttagaagtgtgacatctaagttaacctctgctgcttacttaaaggtgtatttaggattagtgccatgctgtgaaatggcatatgaaaacaggaactctctatataaaaatgttttttattcagtctttgtgctcagtactacagatatcttaataaacaattgaataaaatcaccatcatttggggtgttgagaaatcgtttcactttggaagttaccaacataggtacttggctgggtttcttatttatttctttgtttcctactctcacttgtgggtttttttttcagttttcttcttcccagtctgatgagagtatatctttggccatttggggttctattataaatgattgcatacattgaaaaggatatcttacattatctttaatgtattctctaaaggaatataacgatatataattttataagtttttaataggcatattttttaacaaaataaggaataagagccataaatttggattccctgggtttgtcagaagggaaactccagggggaaatgtatttatggatgttatatgcgttttaactaatatacggtataagcataacttggaacgttgtctttcagaacttaaggaggggaagaggaagggaactaacatttgtggagtgcctgccatgtgccaggcactgtgctagacactttgacatacattgtagggtttattgtgagtattaaatgagatactgtatccccattttacagatgaggaaactgaacttgccccaagtcacatggctggtaagtggcagagctggactagaacccagactccaaaccccatgctttttctgctgtaccgtgtttaaagcttgcaaagagagatatgtagttaatgaccaaaattgagagttctaggaattttcttttcccatgaaatatttgatactgaacctaaaaaaaaaaaaatgctttcatgtcaggagctagatggaagcacatcataatgagaacgcctttgcttttaaaatgctatgttagacttatctaaagtgcatctaaggaaaatttaagaaataatgccttttatcaagaaaggccactttgaagagacacatcgcatcttgtagggctttccatgtcttagaggtaaaggtttagctataataatgtaagtttataagaaagactgcttattttaagcattctaaatgacagcaggcttgtgcaaaacccgaggaagttcaaattttacttcatacagcacacattaactcatgaaacacccattatatgccaagtatgtgctagattctaggggtttctggggttaaaaagatactatccctgatttgtcttaaagtttttgctttcctgagaataaagttagtgtacaaatatcttataatctttcttcaatcatgattgttaattccccactgataacccatatattttcaaaatatgaaaattctagaataaaaagtaatttagacactttcagtagttaaatgggacaggaagtggcctttataagaatacaggaatagcagtgtgtcatcagagaatgcaggatggtctttgaactgtgatccttggtgtcttatctgctttaaatttccactgagttcataatattggaaatttgaagctaactaagataaatactttttataacttgttttaaaattaaaacttgtgacatttagattttctcaaaacaagagattatctttgtatctttatttttttaagagacaaggtcttgctatgttgcccaggctggacttgaactcctgggctcaagtgatcctcatgcctcagcctctgaaggagctgagattacaggcatgagccactgtgcacagctgtctttgcccatatctttttaaatgtactttactaataagattatatttgagtatatggaatttgtccatcgaccattagaagtataccaccatatagatcctttgggatattatagaaatttatacaaattcctactaatttatactaactcctgtttctggcttgaactaatgcgcttgtcattttgattttattgagggaagtaaaatgaatatatgatacctctgaaaaattataataaaacccagtcacctaacatctcagaactaatacatctgaatatatcatccccttccaagttattttaaagtggtatttttttctgagctatcgctcaaaatgtttttaagaattcttattttggaactgccattatctttcatggtgccaaatttggtcccttgagggtggttgttgcttctggaaacaggcaagagttgtttggaagcatttctgataaatacaaggccaatgaatgaacgtctttttttgcttttttcctttttttttttcctgagacagggtcttactctgtcgctcaggctggagtgcagtagcataataacggctcactgtagcctcaacctcctgggctcacatgatcttcccacctaaggctctggaaccacagacgcacgccaccacacctggttaatttttgtatgtcttgtagagatcaggtttctccatgttgcccaggctggtcttgaactcctggactcaagtgaacctcctaccttggccttccaaaatgctgggattataggcgtgagccaccatgtctgcccttgaacttcattgttcacctgtgactattcccacccaccctttttttaaaaaaacaagttttttgtggccgggcgcagtggctcacgcctgtgatcccagcactttgggaggctgaggcaggtagatcacgaggttaggagttcgagaccagcctggccagaatggtgaaatctcatctctactaaacatacaaaaattagctgggagcggtggtgggcgtctgtaatcccagcaacttggaaggctgaggcaggagaatggcttcaacctgcgaggcggaggttgcagtgagccgagattgtgccactgcactctatcctgggtggcagcgtgagactctgtctcaaaataaaaataaaaagtaaaaagtttttttttttgttttttgtttttttttaaactagcttttgtatatatcatggaaccatcctgctctaacttcatattacaagaaaacagcaaacgtctacagaactagagtgtaatgagcccctctctacccattaattttactacacgtctgtgtgagcagtgtttggaaagaatgatcctagaccaaggtccatatccatgctgcctgcatgtgtcaacctggtgtcatgtaaacttctcattcgtcactggctattgttccaattttagaagacctaggtgaccaccagctgttctattgtttcagcctttattaccccataaccttcttccctggatgtgggtgaagagaaaaaagaggagagctatgttattctctgctccactccatctcttctgacaatacgatgaagatatgttaaacaatctattaagttagtttataactggcttaacgtgaccttgttaactatctcaaagctatacagttttgtacgactcattgagttgtctgtgtatacattattttgtatagtcacaaaaacaaatttaggacttttcccaagtttattcatatgctggtgatcattaatcacaattaggccaggcacagtggctcacgcctgtaatctcagcactttgggaggccaaggcaggcagatcacgaggtcgggagatcaagaccatcctgggcaacatggtgaaaccctgtttctactaaaaatacaaaaattagctgggcatgatggcgcgtgcctgtaatcccagctactcgggaggctgaggcaagagaatcacttgaaccagggagtagaaggttgcagtaagccaagattgcaccagtgcgctccagcctggtgtcagcaaaactacgtctcaaaaaaaaaaaaaaaaaaaaatcaattattccctatcaccaatgttttaaaattacatgtagaaggaaaaggcagtacaaccttataaacaatatttttattaattctatgaaaatctttaagtgagcttccttgaaagccatgtttttaactgttgtattctttcacctaattctcaagccttagaaggcagaaatctggcatatacccaaatagaagcacataaatcagttaatctttgtttaacttttttaaacaaagtttcagtgataatatcctatttagctgacaaagtatttgtctcccatgggtagcatttcacttcttattcattgggtataatacattttcatgaaatacagaaatgctgtgttttcctcttttgattggaatttagttcaggcaattgttatagaatttgataactttttaaaaaatcttttttcttgcacttagctttgagagagcatgtattttgtaatgtctcatcagagtgacaaactaactctggaccatacgttctcaatgttgaagcgttggtggtagaaatgttttatcactcgaatccatctgtcttttctaggaagctatgtttcttgcagtagacaaattttgaatataaattaggaaactttgagaacttacttttagtatttgatctgaatactaagtaaatattaaacgctgtattttaactgtatgattatactatgcttagacaatacttttaaatgaatatttacaaatgtattattttcctagaaacctaagaaagaaaaattatctttccccagagaaactaggtttaagcagagctttgctgggtttttattgttgttttttgttttttttactgaaactgcagtgagctcaattccttccagtgcttcagtgattttctagtaatgagaattgcacttaaagacattcagtgactgtttcaggcatgatatggagtataggaaaatctctaaactgaaacattcagaggatggagatattctgcttaatggaaatttttgcagtggtgtgctacagtcagctcctcctggcttgctagagcctattattaaattttcaggccgggcgtggtggctcacgcctgtaatcccaacactttgcgaggttgaggcaggcagatcacttgaggtcaggagttcaagaccagcctggccaacatggcaaaacaccatctctactaaaaatacaaaattagccaggtgtcgtggtgcacgcctgtaatcccagctacttgggaggctgaggtacaagaatcgcttgaactggggaggtggaggttacagtgagccaagattacaccactgcactccagcctggagccacttagtgagactctgtctaaaaaaaaaagccaggcgcgatggctcacacctgtaatcccagcactttgggaggccaaggtgggaggatcacgaggtcaggagattgagaccatcctggctaacacggtgaaaccccgtctctactaaaaatacaaaaaattagccaggcgtggtggcaggcgcctgtagtcccagctactcgggaggctgaggcaggagaatggcatgaacccaggaggcggagcttgcagtgagccaagatcgcgccactgcactccagcctgggcgacagagcgagactccgtctcaaaaaaaaaaaaatatgtgtgtgtataaatatgtatatatatacatgcatatatatatgcatatatacatacacatacacaatttacacattaaaaacattagtactcaaaactcataatttccaagtattttctctgtgctctgtgggtattggcatctgttttgtctgtatgctgtgctgcttaccacgtgtgtgtctttccaactctacgctcaggaaagtcaccttggtagcttgaaactggccatggtggaagtatttacatcgtgagaattactgaacactacacatcagggctttttcattgttttgtcctgaggactgtttcttaaatatttattagcacaccactgactttaagctaaatgagcatcttaagcttttgcctttgataaaaacctgtctaaaatgcattaggatgcttttctaccttaagtgtttagagcatgctaaatatcattgttctaagtgctgaagaagatctttaatacttgagattgctataatgctcagaataattatcttaaacattacaagatcacctcttatgagatgtcaaaagtatatcatttccagatcagttttatgtaaaatgccaaattatgaattctttatataagctcaaaatattttgttttactgcagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacaggtgaggtgttgcacagggaatcggtaacttctaggacactttttaaaaattacagttttcaccgggcgcagtggctcacgcctgtaatcccagcactttgggaggccaaggcaggcggatcacagggtcaggagatcaagaccatcctggctaacacggtgaaaccccatctctactaaaaaatacaaaaaaattcgccgggcgtggtggcaggtgcctgtagtcccagccacttgggaggctgaggcaggacaatggcatgaacctgggaggcggaggttgcagtgagccaagatcgtgccactgcactccagcctgggcgacagagcgagactccatctcaaaaaaataataaaacaatattaaatattaataaatgataataaaataatgataaaaataatatcaataaataaaaataaaaataaaaattacagttttcagctgggcgcagtggctcccgcctgtaatcccagcactttgggaggtcaaggcgggcagatcacaaggtcaagagattgagaccatcctggccaatatgacgaaaccctgtctctactaaaaatacaaaaattagctgggtgtggtggtgtgcacctgtaatcccagctactcgggaggctgaggcaagagaatcacttgaacccggaaggcggagcttgcagtgagctgaggtcgcgccactggactgcagcctgggtgacagtgagactccgtcttaaaaaaaaaaaattacagttttcataagccatttctcccaagttacatgttgtgtggcatttcatgtaggtttgtgctctgtgtgtgttattagattgtcttccagtcagaattcctggctgttaaactatttcatcagcaggagttacatccctatgttgtaagggtgatgtccaaaagatacagtaatttttaaaaataatgattaaaggactttgttagaaacaaagagctattttgtatttagtatttgctgtgaagtaggtgataagtcgaattttttagcttctctctgagaaaaatgaagtgtaagtgaggcgttacttttcgacattttctacatgtagtttccttttgtctattttttaactttttttcctctattacactgaaatacatatttaatctgataaattctagtcaagtgcaaatacaaaataacaaaaagaattaaaatcatccatggctctaaccacttaggatacctcctattatagtctatgtacttccagtcagctctcattttctctcactttttcttgctccatatctctgtcattttatttttaagcaacatattataaaatgctattttctaaaactttttaaaaatttaaacataaataaaattttatttaacttgtatattatttattggtttagtttttattatgaataatggtgcaaattaatctgattttcaaaaggaacagaattgtcttagagtttcccagtagtcttgtcaccttagtcctaatgtcaaataatgtcctcattgtgtgcagccaggacagagattcagcagtgttatcaagggcccagactcccgctcccggctgtgtcatcttcagcatgtatcattcattctcatgatcacagcgcggctactgaacctctaggcattgcctcagacaggaagaagggctagagccaaaaattggggctagctgaggtctggcccaactgcaaacctttcctggaagatcctcccagcaactttcacctacatttcattggctagaaataggtctttagtccctagctgtacaggattctgagaaaggtttattttcgctttctaaatctcagtttcagagcaagacaagagaaatgcagatgatacctggctgttaggttgctcattatctgtttagcagattttaagtgctttatttctactgtgtgtttaatgcttacatgagaataggtgattattatgcccagtttacagatgaggaccagaagttcagagatgttaaggaataagttggtcaagatcacatggcccaaactgggcagaaccaggatgggcaaccgggcagtctttattccagagcctgtcctctataccagcatcaggcatctcaaaaataccccatgataacctgcaaatttcacttcctggggaagtgtgaggctttagtcattcacagatagatctcttacatattttctttttattctttgattggcatctataatcgatatctcattatatcgtatttctgccaatccagcaacagtttttatttctttccagccttgtcagagtttcttccttgccttgcacttcctctccgtgctgaggatacacccagacacatgcaagcctgaaaaccgagctcactattaatagaagaaacaggtgttttccatggctgaggagtgcttaggaatgtaccatctactgatgtgatcggggaaagctttgtgcctgcaacattttgactctagtaatatgtgtgtctgtgcatgcacacacacacatgcacactcaaatgtagaagatgaagtatgagtatttataatagcttattaaagaaaatgtttaaacacccgcaacaccgctattaggtctttaaatttttcatttaatggtaaccatgttttgtaaaatgactatcttccttctaggtctagaatttaatataatttaatcatgaaaacgttggtattcataaatgaatttcagtgcctttgtggaaaagagttaaattatgtccccaaattggcaaatgtgtgtgtttggatttattcttaacttttccaattgcatcatttagattaaattagtcactataacattcttttcaattttacattttaaatttcttttgttaaccagctgagaagtctgagaactttgtatgttcacagggtgagtccattgttcctggctaggaagcaggggttgatcttttcctgcagttcatttggattgaaggttcttctttgctgactcttgcttccatagtgaaaacacagatatccactcagtgagagtcagctatcttaaaaaaaaaaaaaaaatcatgtatacatcacatgtggttcaggatgctagctggcattacagaaactggtgtttagacattcaacactgctttttttaacatatttgaatgatagtgtctgtttcagtgcaggcttttttgacatgaagggtgatctacctcaaaggcagttattctggaattgaatcctccaaaatgaggccaattaaagggtgtcttctacataggagttaagggaagtggttgccatccctcccaccctgaaaaaaagaaaaagagaaaatgttggctctatttattgttttggtggggttatgtatgaaaatgactaagtcaactcatctgtttgtgttgttgctttggctactggtctgttctttcattttgggcttatagtgctttaaaattcaatatattggatattaaatgcatgtgattaggaaacagtcttgaaatatgcccagagttactcagtagcttcttttttataattttaattgtggtggtctcacatttgtgggtttaaattgtctgagttattgagtgttgtattttgtagcccccttctttaattttcagaagcactgtccatttcatttcggtttataaaaatgcacatcttttgtttattgttatgatttatccatgtgtgttttctagccaataaactgtgtcttgcagtcat

SEQ ID NO: 301 - DNA, 15624 bp, Homo sapiens; identical to SEQ ID NO: 300

SEQ ID NO: 302 - DNA, 17832 bp, Homo sapiens
tggaacactttatgttgaactgtggtagaggaaacaagacagttctgtctgcagaagcccattatggctgtaactggagatgacacaggtaagaatgttaaagaggggttttcagttaattgtgcagattgttttgaagtttaggaagtattcaggaacatctgagtgtttcagaaagtgttactctcctagtcacttaggtgtaagactttttttgaaatatacatctatatattcagctcactttgttagggcatcttagtgtgattgtttctttgctcaatattctattgcttgcttgactgaggcactaatcctctcttcctccctctatcctccctcccctcctccccactcttcccctcctcttctcttcccctctcctccatctctgtgtctctctttcatatgcataccattctgccctactaaaataagctgttacttcataggcaacctgttgcaaattcaatctagccgcagattaaacatacagtatataccgttcatgttctgatttcattactgtggacaaatgcagctccaaacagaataggaaaaacccgcgtgttatggatgtttgtgtgcctacttgtttctttcctcctgtatttaaaatggtctgttcagctaattgagttcaaaaggctgatgtcattacatttcctggaatcgtatttcagcaggggaagtggaaaagttaaaactccaagcgagctgcacattgacgtcagctccgagtcatgttgtgatttagtcagttcctttccgctttgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctggtgagaaatggattatgtattgtataagctggcgggttctttactcttactccatcctcttactccatctataggaacttgcgattcagagctcctctagtgttcagtcagggaagtgcttgtcttttacttgttctcccagcctctggtatttaaatttgtaatcggtaatttttcactaggtttgcttttctcagtaacaaagagtgattttggaagacttagttactaataacctttgtgtgcttgcagtgttgtttattcagtggtcttgtttgtaatacagtactgaatttgcagttgaattaagagttttaaacaacttcactacaatttagctcttcgaagttaatgggtctcagccctctttgtggataggaacattggattgtcttgagtaagtaaaacctgtattacattgtttttaaaactgtcttgaggaactatttttttctcgaagttttgtgaagttctagagatgctatagactgcagaactcaaatgatgaatttattataagacatagatgaacttaaaatcatctcaaacactgcatgtcatatgattcttagaaccagaaggcacttttgtacatatattttctaaaaattattggttaatatctttctttaccaagcctttcattcctattacccctttgacttgtctaagcataagactcataacaaaaaataaataaaatgatgtgaaaacgctgtgtacttttttttttttttttttttttgagacggggtctcgctctgtcgcccaggctggagtgcagtggcgcgatcttggctcactgcaagctccgcctcccaggttcacgccattctcctgcctcagcctcctaagtagctgggactacaggcgcccgcctaattttttgtatttttaatagaggcggggtttcaccgtgttagccaggatggtctcgatttcctgacctcgtgatccgccctccttggcaatgctgtatacttttaaccactacatataaataaacaaacatttttgacatttgtttttacagaatgaacataacatccttgaaagtttttttcacagttttaccaataatgctacacatgattgattttccttttccaatttaaacttttcaaaatgctgaaactttaaaatgtcaaacaacttaaaacactttttcacaagacctgattttgcctttggaaatcatatttttaaaaatctggtcatttcttacagaatcagtgctatttgaaaaatgagtaataaattttatttcattttactttatttatttatttatttatttatttatttatttatttatttatttattttatgagacggagtctcgctctgtcgcccaggctggagtgcagtggctggatcttggctcactgcaagctcggcctcccgggttcacgccattctcctgcctcagcctcccgagtagctgggactacaggtgcccaccaccacgcccggctaattttgtttttttgtattttagtagagacggggtttcaccgtgttagccagaatggtctcgatctcctgacctcgtgatccgcctgcctcggcgtcccaaagtgctgggattacaggcgtgagccaccgcgctcggcctcattttactttatttttttaaagccagaagagcacagggttaagggacttttttgaaggtgtagtagagtagctttaggaaccagacctctgggctctcagttctgaggtaaccctatggatcggcagaccaagtagatctagattagtggcttgcaaacttttcaaccatgacccacgttaattatcacggcaaagtggacctatgtgtgtatgtaccctacatttatataaaacaagtttcagacataattcttatccttacaaaatatgatgtacccataattccttttctgtcctttttttaaaatgctattcttgacccatgaaatttgctttttgacccattaatggtctacagcttacagtttgaaaaactttgatctagaccaaaatcaggctcctagcactaatggctggcctggaaaagatattagcagcatttacctacaggatcatgaagtgaaatattaaaagcaaatgactggccgggcgcggtggctcacgtctgtaatcccagcactttgggaggccaaggcgggcggatcacaacctcaggagttcaagaccagcctggccaacatggtgaaaccccgtctctactaaaaatacaaaaattagccaggcgtggtggcacgcgcctgtaatctcagctactcgggaagctgaggcaagagaatggcttgaaaccgggaggcagagattgcaatgagccaacattgcaccactgcactccagcctgggtgacagaacgagactccatctcaaaaaaaaaaaaaaagtaaatgactatagtttatgggattatattattgattttgtggggcataatttacatttttattagaaattgcctttgttttattcataaactgattctgttaggagcataatttcctatcttttagactctgagtctgacgttgcattctgacgttgcattctggctggatttctgcattgtttaaaacaaactttccaacaaatttggaaaactagtgtcttagttaatatttgatgcatgagaataaggatatatatcacctttgtgaaaggaggctattagcaattatttttgcttaaaaatatttacataaaagaataatttcgaggctgggcgtggtggcttacgcctgtaatcccagcactttgggagaccgaggtgggctgatcacctgaggtcaggagttcaagaccagcctggccaacatggtgaaagcccatctccacaaaaatacaaaaattagccgggcgtggtggcatatgcctgtaatcccagctactcgggaggctgaggcggaagaatcacttgaacctgggaggtggaggttgcagtgagctgagatagtgccattgcactccagcctgggtgacagagcgagactccgtctcaacaacaacaaaaaagaataatttcatttaggtgtgacagcttcttgaagttggtaactgaacaagttataatcactttggaagtgaaaataacaaggcatttatctaccttaagattcagtaaaccaaatctgcagggtgaaattggaaattactcatgttattttcctactacttttgaaaaatgcataacgaaatgtaatttgggatatttatttcactttgccctgtttatatgaatatattaggcaaatatatttattcatttatattctaataaaatatactttgcatttatgtaaactttaaaataaaaaaatcacttaatgttacaaataaacatgaataccaactatagaaagtgctgtcaaagaaactatcagattgtgactgacacagaaacaggacatacaggttaagggatcaggtaggcctcactaggaaaccatgttcaaatgctaaaaaaggcagtttacaggcattctcactgatacatgcccaactacacccaggtcagactgggtaaatgacttccaagtttacaaagctagcaagtagtggacccgttcgagtcttcagaatcctcgggttctgctcatagcatattaatgtgactcctcaaaagtcacctgacattgacacatgaatgcagtgtcacgtgagtacatgctgctacacactgcttataaaacatataaaatgaggttaggttaatattattttaagtcgttaaaatggctttttttttttttttttttaagacagagtttcactcttgttgcccaggctggagtacagtggcgtgatcttggctcactgcaacctctgcctcccaggttcaagcgattcacctgcctcagcctcccaagtagctgagattacaagcacccaccaacacacccggctaattttgcatttttagtagagacagggtttcaccatttggtcaggctggtctcgaactcctgacctcaagcgatccacccgcctcagcctcccaaagtgctgggattacaggcatgagccaccacacccagcctaaaattgaattttttatagattattattactctcataggacagtagagcatatatttgctattatatggaacattaaatttcagtgttcgtaatttcccatcttttatatagactgacttatagattttcacatactgaactttaaaaggtcccttatgtataacttacttagctggattgtaataatttcataatgtatgcatatgtgaaagcatcacattatacactttgagtatatacagtttttgtcaattatacctcaaagctgaaaatattttggtgagttaattctatgtggtctatgtgttatagtgattgtagcaaatttgaaaatgatcagtgcttaaatagccatttttatgtagggtttaattttcacagagaagggaacgtttttggcagtgtgggataccaggcatggaggtgtaggatctgggtattaggagcaggtggtggtagacaggaagagaaccacagcagtggtggtgatgtcagcagcttaccagagctagggatagaagccccccacttagaagtgtgacatctaagttaacctctgctgcttacttaaaggtgtatttaggattagtgccatgctgtgaaatggcatatgaaaacaggaactctctatataaaaatgttttttattcagtctttgtgctcagtactacagatatcttaataaacaattgaataaaatcaccatcatttggggtgttgagaaatcgtttcactttggaagttaccaacataggtacttggctgggtttcttatttatttctttgtttcctactctcacttgtgggtttttttttcagttttcttcttcccagtctgatgagagtatatctttggccatttggggttctattataaatgattgcatacattgaaaaggatatcttacattatctttaatgtattctctaaaggaatataacgatatataattttataagtttttaataggcatattttttaacaaaataaggaataagagccataaatttggattccctgggtttgtcagaagggaaactccagggggaaatgtatttatggatgttatatgcgttttaactaatatacggtataagcataacttggaacgttgtctttcagaacttaaggaggggaagaggaagggaactaacatttgtggagtgcctgccatgtgccaggcactgtgctagacactttgacatacattgtagggtttattgtgagtattaaatgagatactgtatccccattttacagatgaggaaactgaacttgccccaagtcacatggctggtaagtggcagagctggactagaacccagactccaaaccccatgctttttctgctgtaccgtgtttaaagcttgcaaagagagatatgtagttaatgaccaaaattgagagttctaggaattttcttttcccatgaaatatttgatactgaacctaaaaaaaaaaaaatgctttcatgtcaggagctagatggaagcacatcataatgagaacgcctttgcttttaaaatgctatgttagacttatctaaagtgcatctaaggaaaatttaagaaataatgccttttatcaagaaaggccactttgaagagacacatcgcatcttgtagggctttccatgtcttagaggtaaaggtttagctataataatgtaagtttataagaaagactgcttattttaagcattctaaatgacagcaggcttgtgcaaaacccgaggaagttcaaattttacttcatacagcacacattaactcatgaaacacccattatatgccaagtatgtgctagattctaggggtttctggggttaaaaagatactatccctgatttgtcttaaagtttttgctttcctgagaataaagttagtgtacaaatatcttataatctttcttcaatcatgattgttaattccccactgataacccatatattttcaaaatatgaaaattctagaataaaaagtaatttagacactttcagtagttaaatgggacaggaagtggcctttataagaatacaggaatagcagtgtgtcatcagagaatgcaggatggtctttgaactgtgatccttggtgtcttatctgctttaaatttccactgagttcataatattggaaatttgaagctaactaagataaatactttttataacttgttttaaaattaaaacttgtgacatttagattttctcaaaacaagagattatctttgtatctttatttttttaagagacaaggtcttgctatgttgcccaggctggacttgaactcctgggctcaagtgatcctcatgcctcagcctctgaaggagctgagattacaggcatgagccactgtgcacagctgtctttgcccatatctttttaaatgtactttactaataagattatatttgagtatatggaatttgtccatcgaccattagaagtataccaccatatagatcctttgggatattatagaaatttatacaaattcctactaatttatactaactcctgtttctggcttgaactaatgcgcttgtcattttgattttattgagggaagtaaaatgaatatatgatacctctgaaaaattataataaaacccagtcacctaacatctcagaactaatacatctgaatatatcatccccttccaagttattttaaagtggtatttttttctgagctatcgctcaaaatgtttttaagaattcttattttggaactgccattatctttcatggtgccaaatttggtcccttgagggtggttgttgcttctggaaacaggcaagagttgtttggaagcatttctgataaatacaaggccaatgaatgaacgtctttttttgcttttttcctttttttttttcctgagacagggtcttactctgtcgctcaggctggagtgcagtagcataataacggctcactgtagcctcaacctcctgggctcacatgatcttcccacctaaggctctggaaccacagacgcacgccaccacacctggttaatttttgtatgtcttgtagagatcaggtttctccatgttgcccaggctggtcttgaactcctggactcaagtgaacctcctaccttggccttccaaaatgctgggattataggcgtgagccaccatgtctgcccttgaacttcattgttcacctgtgactattcccacccaccctttttttaaaaaaacaagttttttgtggccgggcgcagtggctcacgcctgtgatcccagcactttgggaggctgaggcaggtagatcacgaggttaggagttcgagaccagcctggccagaatggtgaaatctcatctctactaaacatacaaaaattagctgggagcggtggtgggcgtctgtaatcccagcaacttggaaggctgaggcaggagaatggcttcaacctgcgaggcggaggttgcagtgagccgagattgtgccactgcactctatcctgggtggcagcgtgagactctgtctcaaaataaaaataaaaagtaaaaagtttttttttttgttttttgtttttttttaaactagcttttgtatatatcatggaaccatcctgctctaacttcatattacaagaaaacagcaaacgtctacagaactagagtgtaatgagcccctctctacccattaattttactacacgtctgtgtgagcagtgtttggaaagaatgatcctagaccaaggtccatatccatgctgcctgcatgtgtcaacctggtgtcatgtaaacttctcattcgtcactggctattgttccaattttagaagacctaggtgaccaccagctgttctattgtttcagcctttattaccccataaccttcttccctggatgtgggtgaagagaaaaaagaggagagctatgttattctctgctccactccatctcttctgacaatacgatgaagatatgttaaacaatctattaagttagtttataactggcttaacgtgaccttgttaactatctcaaagctatacagttttgtacgactcattgagttgtctgtgtatacattattttgtatagtcacaaaaacaaatttaggacttttcccaagtttattcatatgctggtgatcattaatcacaattaggccaggcacagtggctcacgcctgtaatctcagcactttgggaggccaaggcaggcagatcacgaggtcgggagatcaagaccatcctgggcaacatggtgaaaccctgtttctactaaaaatacaaaaattagctgggcatgatggcgcgtgcctgtaatcccagctactcgggaggctgaggcaagagaatcacttgaaccagggagtagaaggttgcagtaagccaagattgcaccagtgcgctccagcctggtgtcagcaaaactacgtctcaaaaaaaaaaaaaaaaaaaaatcaattattccctatcaccaatgttttaaaattacatgtagaaggaaaaggcagtacaaccttataaacaatatttttattaattctatgaaaatctttaagtgagcttccttgaaagccatgtttttaactgttgtattctttcacctaattctcaagccttagaaggcagaaatctggcatatacccaaatagaagcacataaatcagttaatctttgtttaacttttttaaacaaagtttcagtgataatatcctatttagctgacaaagtatttgtctcccatgggtagcatttcacttcttattcattgggtataatacattttcatgaaatacagaaatgctgtgttttcctcttttgattggaatttagttcaggcaattgttatagaatttgataactttttaaaaaatcttttttcttgcacttagctttgagagagcatgtattttgtaatgtctcatcagagtgacaaactaactctggaccatacgttctcaatgttgaagcgttggtggtagaaatgttttatcactcgaatccatctgtcttttctaggaagctatgtttcttgcagtagacaaattttgaatataaattaggaaactttgagaacttacttttagtatttgatctgaatactaagtaaatattaaacgctgtattttaactgtatgattatactatgcttagacaatacttttaaatgaatatttacaaatgtattattttcctagaaacctaagaaagaaaaattatctttccccagagaaactaggtttaagcagagctttgctgggtttttattgttgttttttgttttttttactgaaactgcagtgagctcaattccttccagtgcttcagtgattttctagtaatgagaattgcacttaaagacattcagtgactgtttcaggcatgatatggagtataggaaaatctctaaactgaaacattcagaggatggagatattctgcttaatggaaatttttgcagtggtgtgctacagtcagctcctcctggcttgctagagcctattattaaattttcaggccgggcgtggtggctcacgcctgtaatcccaacactttgcgaggttgaggcaggcagatcacttgaggtcaggagttcaagaccagcctggccaacatggcaaaacaccatctctactaaaaatacaaaattagccaggtgtcgtggtgcacgcctgtaatcccagctacttgggaggctgaggtacaagaatcgcttgaactggggaggtggaggttacagtgagccaagattacaccactgcactccagcctggagccacttagtgagactctgtctaaaaaaaaaagccaggcgcgatggctcacacctgtaatcccagcactttgggaggccaaggtgggaggatcacgaggtcaggagattgagaccatcctggctaacacggtgaaaccccgtctctactaaaaatacaaaaaattagccaggcgtggtggcaggcgcctgtagtcccagctactcgggaggctgaggcaggagaatggcatgaacccaggaggcggagcttgcagtgagccaagatcgcgccactgcactccagcctgggcgacagagcgagactccgtctcaaaaaaaaaaaaatatgtgtgtgtataaatatgtatatatatacatgcatatatatatgcatatatacatacacatacacaatttacacattaaaaacattagtactcaaaactcataatttccaagtattttctctgtgctctgtgggtattggcatctgttttgtctgtatgctgtgctgcttaccacgtgtgtgtctttccaactctacgctcaggaaagtcaccttggtagcttgaaactggccatggtggaagtatttacatcgtgagaattactgaacactacacatcagggctttttcattgttttgtcctgaggactgtttcttaaatatttattagcacaccactgactttaagctaaatgagcatcttaagcttttgcctttgataaaaacctgtctaaaatgcattaggatgcttttctaccttaagtgtttagagcatgctaaatatcattgttctaagtgctgaagaagatctttaatacttgagattgctataatgctcagaataattatcttaaacattacaagatcacctcttatgagatgtcaaaagtatatcatttccagatcagttttatgtaaaatgccaaattatgaattctttatataagctcaaaatattttgttttactgcagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacaggtgaggtgttgcacagggaatcggtaacttctaggacactttttaaaaattacagttttcaccgggcgcagtggctcacgcctgtaatcccagcactttgggaggccaaggcaggcggatcacagggtcaggagatcaagaccatcctggctaacacggtgaaaccccatctctactaaaaaatacaaaaaaattcgccgggcgtggtggcaggtgcctgtagtcccagccacttgggaggctgaggcaggacaatggcatgaacctgggaggcggaggttgcagtgagccaagatcgtgccactgcactccagcctgggcgacagagcgagactccatctcaaaaaaataataaaacaatattaaatattaataaatgataataaaataatgataaaaataatatcaataaataaaaataaaaataaaaattacagttttcagctgggcgcagtggctcccgcctgtaatcccagcactttgggaggtcaaggcgggcagatcacaaggtcaagagattgagaccatcctggccaatatgacgaaaccctgtctctactaaaaatacaaaaattagctgggtgtggtggtgtgcacctgtaatcccagctactcgggaggctgaggcaagagaatcacttgaacccggaaggcggagcttgcagtgagctgaggtcgcgccactggactgcagcctgggtgacagtgagactccgtcttaaaaaaaaaaaattacagttttcataagccatttctcccaagttacatgttgtgtggcatttcatgtaggtttgtgctctgtgtgtgttattagattgtcttccagtcagaattcctggctgttaaactatttcatcagcaggagttacatccctatgttgtaagggtgatgtccaaaagatacagtaatttttaaaaataatgattaaaggactttgttagaaacaaagagctattttgtatttagtatttgctgtgaagtaggtgataagtcgaattttttagcttctctctgagaaaaatgaagtgtaagtgaggcgttacttttcgacattttctacatgtagtttccttttgtctattttttaactttttttcctctattacactgaaatacatatttaatctgataaattctagtcaagtgcaaatacaaaataacaaaaagaattaaaatcatccatggctctaaccacttaggatacctcctattatagtctatgtacttccagtcagctctcattttctctcactttttcttgctccatatctctgtcattttatttttaagcaacatattataaaatgctattttctaaaactttttaaaaatttaaacataaataaaattttatttaacttgtatattatttattggtttagtttttattatgaataatggtgcaaattaatctgattttcaaaaggaacagaattgtcttagagtttcccagtagtcttgtcaccttagtcctaatgtcaaataatgtcctcattgtgtgcagccaggacagagattcagcagtgttatcaagggcccagactcccgctcccggctgtgtcatcttcagcatgtatcattcattctcatgatcacagcgcggctactgaacctctaggcattgcctcagacaggaagaagggctagagccaaaaattggggctagctgaggtctggcccaactgcaaacctttcctggaagatcctcccagcaactttcacctacatttcattggctagaaataggtctttagtccctagctgtacaggattctgagaaaggtttattttcgctttctaaatctcagtttcagagcaagacaagagaaatgcagatgatacctggctgttaggttgctcattatctgtttagcagattttaagtgctttatttctactgtgtgtttaatgcttacatgagaataggtgattattatgcccagtttacagatgaggaccagaagttcagagatgttaaggaataagttggtcaagatcacatggcccaaactgggcagaaccaggatgggcaaccgggcagtctttattccagagcctgtcctctataccagcatcaggcatctcaaaaataccccatgataacctgcaaatttcacttcctggggaagtgtgaggctttagtcattcacagatagatctcttacatattttctttttattctttgattggcatctataatcgatatctcattatatcgtatttctgccaatccagcaacagtttttatttctttccagccttgtcagagtttcttccttgccttgcacttcctctccgtgctgaggatacacccagacacatgcaagcctgaaaaccgagctcactattaatagaagaaacaggtgttttccatggctgaggagtgcttaggaatgtaccatctactgatgtgatcggggaaagctttgtgcctgcaacattttgactctagtaatatgtgtgtctgtgcatgcacacacacacatgcacactcaaatgtagaagatgaagtatgagtatttataatagcttattaaagaaaatgtttaaacacccgcaacaccgctattaggtctttaaatttttcatttaatggtaaccatgttttgtaaaatgactatcttccttctaggtctagaatttaatataatttaatcatgaaaacgttggtattcataaatgaatttcagtgcctttgtggaaaagagttaaattatgtccccaaattggcaaatgtgtgtgtttggatttattcttaacttttccaattgcatcatttagattaaattagtcactataacattcttttcaattttacattttaaatttcttttgttaaccagctgagaagtctgagaactttgtatgttcacagggtgagtccattgttcctggctaggaagcaggggttgatcttttcctgcagttcatttggattgaaggttcttctttgctgactcttgcttccatagtgaaaacacagatatccactcagtgagagtcagctatcttaaaaaaaaaaaaaaaatcatgtatacatcacatgtggttcaggatgctagctggcattacagaaactggtgtttagacattcaacactgctttttttaacatatttgaatgatagtgtctgtttcagtgcaggcttttttgacatgaagggtgatctacctcaaaggcagttattctggaattgaatcctccaaaatgaggccaattaaagggtgtcttctacataggagttaagggaagtggttgccatccctcccaccctgaaaaaaagaaaaagagaaaatgttggctctatttattgttttggtggggttatgtatgaaaatgactaagtcaactcatctgtttgtgttgttgctttggctactggtctgttctttcattttgggcttatagtgctttaaaattcaatatattggatattaaatgcatgtgattaggaaacagtcttgaaatatgcccagagttactcagtagcttcttttttataattttaattgtggtggtctcacatttgtgggtttaaattgtctgagttattgagtgttgtattttgtagcccccttctttaattttcagaagcactgtccatttcatttcggtttataaaaatgcacatcttttgtttattgttatgatttatccatgtgtgttttctagccaataaactgtgtcttgcagtcatgattgatcttgttttactgagatttagttttgaagactaaaaatctccagtgttgatatttaaggtttttgaggattaattcttataatcatttttgatcgaataaaattaactcattatgtcggagtatgtgccttttgggagacaaaaataattaagagaattgaaaggatctataaatgtgtttgtagaaattccacttggggatgtggtcctattgtagtttactgaaaacagttgtgggcattgttaccagtggaatgtgtgccctaagaaaacaccatttgtgatgaatgctgggcgaactgtgttctcaaatcattcctgttgtctaatggttatcttacaaaaagcatgtgcctggttatgtttgttatgtggctttgtacagtccttacctaggatcgattggctgttgagttcggggggcagaagtgcactgacccactgtggattgtgttggaaggctgttcctgtagtcatttgccttgtgttgcttccagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccaca

SEQ ID NO: 303 - DNA, 17832 bp, Homo sapiens; identical to SEQ ID NO: 302

SEQ ID NO: 304 - DNA, 17832 bp, Homo sapiens; identical to SEQ ID NO: 302

SEQ ID NO: 305 - DNA, 17832 bp, Homo sapiens; identical to SEQ ID NO: 302

SEQ ID NO: 306 - DNA, 17057 bp, Homo sapiens
gtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctggtgagaaatggattatgtattgtataagctggcgggttctttactcttactccatcctcttactccatctataggaacttgcgattcagagctcctctagtgttcagtcagggaagtgcttgtcttttacttgttctcccagcctctggtatttaaatttgtaatcggtaatttttcactaggtttgcttttctcagtaacaaagagtgattttggaagacttagttactaataacctttgtgtgcttgcagtgttgtttattcagtggtcttgtttgtaatacagtactgaatttgcagttgaattaagagttttaaacaacttcactacaatttagctcttcgaagttaatgggtctcagccctctttgtggataggaacattggattgtcttgagtaagtaaaacctgtattacattgtttttaaaactgtcttgaggaactatttttttctcgaagttttgtgaagttctagagatgctatagactgcagaactcaaatgatgaatttattataagacatagatgaacttaaaatcatctcaaacactgcatgtcatatgattcttagaaccagaaggcacttttgtacatatattttctaaaaattattggttaatatctttctttaccaagcctttcattcctattacccctttgacttgtctaagcataagactcataacaaaaaataaataaaatgatgtgaaaacgctgtgtacttttttttttttttttttttttgagacggggtctcgctctgtcgcccaggctggagtgcagtggcgcgatcttggctcactgcaagctccgcctcccaggttcacgccattctcctgcctcagcctcctaagtagctgggactacaggcgcccgcctaattttttgtatttttaatagaggcggggtttcaccgtgttagccaggatggtctcgatttcctgacctcgtgatccgccctccttggcaatgctgtatacttttaaccactacatataaataaacaaacatttttgacatttgtttttacagaatgaacataacatccttgaaagtttttttcacagttttaccaataatgctacacatgattgattttccttttccaatttaaacttttcaaaatgctgaaactttaaaatgtcaaacaacttaaaacactttttcacaagacctgattttgcctttggaaatcatatttttaaaaatctggtcatttcttacagaatcagtgctatttgaaaaatgagtaataaattttatttcattttactttatttatttatttatttatttatttatttatttatttatttatttattttatgagacggagtctcgctctgtcgcccaggctggagtgcagtggctggatcttggctcactgcaagctcggcctcccgggttcacgccattctcctgcctcagcctcccgagtagctgggactacaggtgcccaccaccacgcccggctaattttgtttttttgtattttagtagagacggggtttcaccgtgttagccagaatggtctcgatctcctgacctcgtgatccgcctgcctcggcgtcccaaagtgctgggattacaggcgtgagccaccgcgctcggcctcattttactttatttttttaaagccagaagagcacagggttaagggacttttttgaaggtgtagtagagtagctttaggaaccagacctctgggctctcagttctgaggtaaccctatggatcggcagaccaagtagatctagattagtggcttgcaaacttttcaaccatgacccacgttaattatcacggcaaagtggacctatgtgtgtatgtaccctacatttatataaaacaagtttcagacataattcttatccttacaaaatatgatgtacccataattccttttctgtcctttttttaaaatgctattcttgacccatgaaatttgctttttgacccattaatggtctacagcttacagtttgaaaaactttgatctagaccaaaatcaggctcctagcactaatggctggcctggaaaagatattagcagcatttacctacaggatcatgaagtgaaatattaaaagcaaatgactggccgggcgcggtggctcacgtctgtaatcccagcactttgggaggccaaggcgggcggatcacaacctcaggagttcaagaccagcctggccaacatggtgaaaccccgtctctactaaaaatacaaaaattagccaggcgtggtggcacgcgcctgtaatctcagctactcgggaagctgaggcaagagaatggcttgaaaccgggaggcagagattgcaatgagccaacattgcaccactgcactccagcctgggtgacagaacgagactccatctcaaaaaaaaaaaaaaagtaaatgactatagtttatgggattatattattgattttgtggggcataatttacatttttattagaaattgcctttgttttattcataaactgattctgttaggagcataatttcctatcttttagactctgagtctgacgttgcattctgacgttgcattctggctggatttctgcattgtttaaaacaaactttccaacaaatttggaaaactagtgtcttagttaatatttgatgcatgagaataaggatatatatcacctttgtgaaaggaggctattagcaattatttttgcttaaaaatatttacataaaagaataatttcgaggctgggcgtggtggcttacgcctgtaatcccagcactttgggagaccgaggtgggctgatcacctgaggtcaggagttcaagaccagcctggccaacatggtgaaagcccatctccacaaaaatacaaaaattagccgggcgtggtggcatatgcctgtaatcccagctactcgggaggctgaggcggaagaatcacttgaacctgggaggtggaggttgcagtgagctgagatagtgccattgcactccagcctgggtgacagagcgagactccgtctcaacaacaacaaaaaagaataatttcatttaggtgtgacagcttcttgaagttggtaactgaacaagttataatcactttggaagtgaaaataacaaggcatttatctaccttaagattcagtaaaccaaatctgcagggtgaaattggaaattactcatgttattttcctactacttttgaaaaatgcataacgaaatgtaatttgggatatttatttcactttgccctgtttatatgaatatattaggcaaatatatttattcatttatattctaataaaatatactttgcatttatgtaaactttaaaataaaaaaatcacttaatgttacaaataaacatgaataccaactatagaaagtgctgtcaaagaaactatcagattgtgactgacacagaaacaggacatacaggttaagggatcaggtaggcctcactaggaaaccatgttcaaatgctaaaaaaggcagtttacaggcattctcactgatacatgcccaactacacccaggtcagactgggtaaatgacttccaagtttacaaagctagcaagtagtggacccgttcgagtcttcagaatcctcgggttctgctcatagcatattaatgtgactcctcaaaagtcacctgacattgacacatgaatgcagtgtcacgtgagtacatgctgctacacactgcttataaaacatataaaatgaggttaggttaatattattttaagtcgttaaaatggctttttttttttttttttttaagacagagtttcactcttgttgcccaggctggagtacagtggcgtgatcttggctcactgcaacctctgcctcccaggttcaagcgattcacctgcctcagcctcccaagtagctgagattacaagcacccaccaacacacccggctaattttgcatttttagtagagacagggtttcaccatttggtcaggctggtctcgaactcctgacctcaagcgatccacccgcctcagcctcccaaagtgctgggattacaggcatgagccaccacacccagcctaaaattgaattttttatagattattattactctcataggacagtagagcatatatttgctattatatggaacattaaatttcagtgttcgtaatttcccatcttttatatagactgacttatagattttcacatactgaactttaaaaggtcccttatgtataacttacttagctggattgtaataatttcataatgtatgcatatgtgaaagcatcacattatacactttgagtatatacagtttttgtcaattatacctcaaagctgaaaatattttggtgagttaattctatgtggtctatgtgttatagtgattgtagcaaatttgaaaatgatcagtgcttaaatagccatttttatgtagggtttaattttcacagagaagggaacgtttttggcagtgtgggataccaggcatggaggtgtaggatctgggtattaggagcaggtggtggtagacaggaagagaaccacagcagtggtggtgatgtcagcagcttaccagagctagggatagaagccccccacttagaagtgtgacatctaagttaacctctgctgcttacttaaaggtgtatttaggattagtgccatgctgtgaaatggcatatgaaaacaggaactctctatataaaaatgttttttattcagtctttgtgctcagtactacagatatcttaataaacaattgaataaaatcaccatcatttggggtgttgagaaatcgtttcactttggaagttaccaacataggtacttggctgggtttcttatttatttctttgtttcctactctcacttgtgggtttttttttcagttttcttcttcccagtctgatgagagtatatctttggccatttggggttctattataaatgattgcatacattgaaaaggatatcttacattatctttaatgtattctctaaaggaatataacgatatataattttataagtttttaataggcatattttttaacaaaataaggaataagagccataaatttggattccctgggtttgtcagaagggaaactccagggggaaatgtatttatggatgttatatgcgttttaactaatatacggtataagcataacttggaacgttgtctttcagaacttaaggaggggaagaggaagggaactaacatttgtggagtgcctgccatgtgccaggcactgtgctagacactttgacatacattgtagggtttattgtgagtattaaatgagatactgtatccccattttacagatgaggaaactgaacttgccccaagtcacatggctggtaagtggcagagctggactagaacccagactccaaaccccatgctttttctgctgtaccgtgtttaaagcttgcaaagagagatatgtagttaatgaccaaaattgagagttctaggaattttcttttcccatgaaatatttgatactgaacctaaaaaaaaaaaaatgctttcatgtcaggagctagatggaagcacatcataatgagaacgcctttgcttttaaaatgctatgttagacttatctaaagtgcatctaaggaaaatttaagaaataatgccttttatcaagaaaggccactttgaagagacacatcgcatcttgtagggctttccatgtcttagaggtaaaggtttagctataataatgtaagtttataagaaagactgcttattttaagcattctaaatgacagcaggcttgtgcaaaacccgaggaagttcaaattttacttcatacagcacacattaactcatgaaacacccattatatgccaagtatgtgctagattctaggggtttctggggttaaaaagatactatccctgatttgtcttaaagtttttgctttcctgagaataaagttagtgtacaaatatcttataatctttcttcaatcatgattgttaattccccactgataacccatatattttcaaaatatgaaaattctagaataaaaagtaatttagacactttcagtagttaaatgggacaggaagtggcctttataagaatacaggaatagcagtgtgtcatcagagaatgcaggatggtctttgaactgtgatccttggtgtcttatctgctttaaatttccactgagttcataatattggaaatttgaagctaactaagataaatactttttataacttgttttaaaattaaaacttgtgacatttagattttctcaaaacaagagattatctttgtatctttatttttttaagagacaaggtcttgctatgttgcccaggctggacttgaactcctgggctcaagtgatcctcatgcctcagcctctgaaggagctgagattacaggcatgagccactgtgcacagctgtctttgcccatatctttttaaatgtactttactaataagattatatttgagtatatggaatttgtccatcgaccattagaagtataccaccatatagatcctttgggatattatagaaatttatacaaattcctactaatttatactaactcctgtttctggcttgaactaatgcgcttgtcattttgattttattgagggaagtaaaatgaatatatgatacctctgaaaaattataataaaacccagtcacctaacatctcagaactaatacatctgaatatatcatccccttccaagttattttaaagtggtatttttttctgagctatcgctcaaaatgtttttaagaattcttattttggaactgccattatctttcatggtgccaaatttggtcccttgagggtggttgttgcttctggaaacaggcaagagttgtttggaagcatttctgataaatacaaggccaatgaatgaacgtctttttttgcttttttcctttttttttttcctgagacagggtcttactctgtcgctcaggctggagtgcagtagcataataacggctcactgtagcctcaacctcctgggctcacatgatcttcccacctaaggctctggaaccacagacgcacgccaccacacctggttaatttttgtatgtcttgtagagatcaggtttctccatgttgcccaggctggtcttgaactcctggactcaagtgaacctcctaccttggccttccaaaatgctgggattataggcgtgagccaccatgtctgcccttgaacttcattgttcacctgtgactattcccacccaccctttttttaaaaaaacaagttttttgtggccgggcgcagtggctcacgcctgtgatcccagcactttgggaggctgaggcaggtagatcacgaggttaggagttcgagaccagcctggccagaatggtgaaatctcatctctactaaacatacaaaaattagctgggagcggtggtgggcgtctgtaatcccagcaacttggaaggctgaggcaggagaatggcttcaacctgcgaggcggaggttgcagtgagccgagattgtgccactgcactctatcctgggtggcagcgtgagactctgtctcaaaataaaaataaaaagtaaaaagtttttttttttgttttttgtttttttttaaactagcttttgtatatatcatggaaccatcctgctctaacttcatattacaagaaaacagcaaacgtctacagaactagagtgtaatgagcccctctctacccattaattttactacacgtctgtgtgagcagtgtttggaaagaatgatcctagaccaaggtccatatccatgctgcctgcatgtgtcaacctggtgtcatgtaaacttctcattcgtcactggctattgttccaattttagaagacctaggtgaccaccagctgttctattgtttcagcctttattaccccataaccttcttccctggatgtgggtgaagagaaaaaagaggagagctatgttattctctgctccactccatctcttctgacaatacgatgaagatatgttaaacaatctattaagttagtttataactggcttaacgtgaccttgttaactatctcaaagctatacagttttgtacgactcattgagttgtctgtgtatacattattttgtatagtcacaaaaacaaatttaggacttttcccaagtttattcatatgctggtgatcattaatcacaattaggccaggcacagtggctcacgcctgtaatctcagcactttgggaggccaaggcaggcagatcacgaggtcgggagatcaagaccatcctgggcaacatggtgaaaccctgtttctactaaaaatacaaaaattagctgggcatgatggcgcgtgcctgtaatcccagctactcgggaggctgaggcaagagaatcacttgaaccagggagtagaaggttgcagtaagccaagattgcaccagtgcgctccagcctggtgtcagcaaaactacgtctcaaaaaaaaaaaaaaaaaaaaatcaattattccctatcaccaatgttttaaaattacatgtagaaggaaaaggcagtacaaccttataaacaatatttttattaattctatgaaaatctttaagtgagcttccttgaaagccatgtttttaactgttgtattctttcacctaattctcaagccttagaaggcagaaatctggcatatacccaaatagaagcacataaatcagttaatctttgtttaacttttttaaacaaagtttcagtgataatatcctatttagctgacaaagtatttgtctcccatgggtagcatttcacttcttattcattgggtataatacattttcatgaaatacagaaatgctgtgttttcctcttttgattggaatttagttcaggcaattgttatagaatttgataactttttaaaaaatcttttttcttgcacttagctttgagagagcatgtattttgtaatgtctcatcagagtgacaaactaactctggaccatacgttctcaatgttgaagcgttggtggtagaaatgttttatcactcgaatccatctgtcttttctaggaagctatgtttcttgcagtagacaaattttgaatataaattaggaaactttgagaacttacttttagtatttgatctgaatactaagtaaatattaaacgctgtattttaactgtatgattatactatgcttagacaatacttttaaatgaatatttacaaatgtattattttcctagaaacctaagaaagaaaaattatctttccccagagaaactaggtttaagcagagctttgctgggtttttattgttgttttttgttttttttactgaaactgcagtgagctcaattccttccagtgcttcagtgattttctagtaatgagaattgcacttaaagacattcagtgactgtttcaggcatgatatggagtataggaaaatctctaaactgaaacattcagaggatggagatattctgcttaatggaaatttttgcagtggtgtgctacagtcagctcctcctggcttgctagagcctattattaaattttcaggccgggcgtggtggctcacgcctgtaatcccaacactttgcgaggttgaggcaggcagatcacttgaggtcaggagttcaagaccagcctggccaacatggcaaaacaccatctctactaaaaatacaaaattagccaggtgtcgtggtgcacgcctgtaatcccagctacttgggaggctgaggtacaagaatcgcttgaactggggaggtggaggttacagtgagccaagattacaccactgcactccagcctggagccacttagtgagactctgtctaaaaaaaaaagccaggcgcgatggctcacacctgtaatcccagcactttgggaggccaaggtgggaggatcacgaggtcaggagattgagaccatcctggctaacacggtgaaaccccgtctctactaaaaatacaaaaaattagccaggcgtggtggcaggcgcctgtagtcccagctactcgggaggctgaggcaggagaatggcatgaacccaggaggcggagcttgcagtgagccaagatcgcgccactgcactccagcctgggcgacagagcgagactccgtctcaaaaaaaaaaaaatatgtgtgtgtataaatatgtatatatatacatgcatatatatatgcatatatacatacacatacacaatttacacattaaaaacattagtactcaaaactcataatttccaagtattttctctgtgctctgtgggtattggcatctgttttgtctgtatgctgtgctgcttaccacgtgtgtgtctttccaactctacgctcaggaaagtcaccttggtagcttgaaactggccatggtggaagtatttacatcgtgagaattactgaacactacacatcagggctttttcattgttttgtcctgaggactgtttcttaaatatttattagcacaccactgactttaagctaaatgagcatcttaagcttttgcctttgataaaaacctgtctaaaatgcattaggatgcttttctaccttaagtgtttagagcatgctaaatatcattgttctaagtgctgaagaagatctttaatacttgagattgctataatgctcagaataattatcttaaacattacaagatcacctcttatgagatgtcaaaagtatatcatttccagatcagttttatgtaaaatgccaaattatgaattctttatataagctcaaaatattttgttttactgcagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacaggtgaggtgttgcacagggaatcggtaacttctaggacactttttaaaaattacagttttcaccgggcgcagtggctcacgcctgtaatcccagcactttgggaggccaaggcaggcggatcacagggtcaggagatcaagaccatcctggctaacacggtgaaaccccatctctactaaaaaatacaaaaaaattcgccgggcgtggtggcaggtgcctgtagtcccagccacttgggaggctgaggcaggacaatggcatgaacctgggaggcggaggttgcagtgagccaagatcgtgccactgcactccagcctgggcgacagagcgagactccatctcaaaaaaataataaaacaatattaaatattaataaatgataataaaataatgataaaaataatatcaataaataaaaataaaaataaaaattacagttttcagctgggcgcagtggctcccgcctgtaatcccagcactttgggaggtcaaggcgggcagatcacaaggtcaagagattgagaccatcctggccaatatgacgaaaccctgtctctactaaaaatacaaaaattagctgggtgtggtggtgtgcacctgtaatcccagctactcgggaggctgaggcaagagaatcacttgaacccggaaggcggagcttgcagtgagctgaggtcgcgccactggactgcagcctgggtgacagtgagactccgtcttaaaaaaaaaaaattacagttttcataagccatttctcccaagttacatgttgtgtggcatttcatgtaggtttgtgctctgtgtgtgttattagattgtcttccagtcagaattcctggctgttaaactatttcatcagcaggagttacatccctatgttgtaagggtgatgtccaaaagatacagtaatttttaaaaataatgattaaaggactttgttagaaacaaagagctattttgtatttagtatttgctgtgaagtaggtgataagtcgaattttttagcttctctctgagaaaaatgaagtgtaagtgaggcgttacttttcgacattttctacatgtagtttccttttgtctattttttaactttttttcctctattacactgaaatacatatttaatctgataaattctagtcaagtgcaaatacaaaataacaaaaagaattaaaatcatccatggctctaaccacttaggatacctcctattatagtctatgtacttccagtcagctctcattttctctcactttttcttgctccatatctctgtcattttatttttaagcaacatattataaaatgctattttctaaaactttttaaaaatttaaacataaataaaattttatttaacttgtatattatttattggtttagtttttattatgaataatggtgcaaattaatctgattttcaaaaggaacagaattgtcttagagtttcccagtagtcttgtcaccttagtcctaatgtcaaataatgtcctcattgtgtgcagccaggacagagattcagcagtgttatcaagggcccagactcccgctcccggctgtgtcatcttcagcatgtatcattcattctcatgatcacagcgcggctactgaacctctaggcattgcctcagacaggaagaagggctagagccaaaaattggggctagctgaggtctggcccaactgcaaacctttcctggaagatcctcccagcaactttcacctacatttcattggctagaaataggtctttagtccctagctgtacaggattctgagaaaggtttattttcgctttctaaatctcagtttcagagcaagacaagagaaatgcagatgatacctggctgttaggttgctcattatctgtttagcagattttaagtgctttatttctactgtgtgtttaatgcttacatgagaataggtgattattatgcccagtttacagatgaggaccagaagttcagagatgttaaggaataagttggtcaagatcacatggcccaaactgggcagaaccaggatgggcaaccgggcagtctttattccagagcctgtcctctataccagcatcaggcatctcaaaaataccccatgataacctgcaaatttcacttcctggggaagtgtgaggctttagtcattcacagatagatctcttacatattttctttttattctttgattggcatctataatcgatatctcattatatcgtatttctgccaatccagcaacagtttttatttctttccagccttgtcagagtttcttccttgccttgcacttcctctccgtgctgaggatacacccagacacatgcaagcctgaaaaccgagctcactattaatagaagaaacaggtgttttccatggctgaggagtgcttaggaatgtaccatctactgatgtgatcggggaaagctttgtgcctgcaacattttgactctagtaatatgtgtgtctgtgcatgcacacacacacatgcacactcaaatgtagaagatgaagtatgagtatttataatagcttattaaagaaaatgtttaaacacccgcaacaccgctattaggtctttaaatttttcatttaatggtaaccatgttttgtaaaatgactatcttccttctaggtctagaatttaatataatttaatcatgaaaacgttggtattcataaatgaatttcagtgcctttgtggaaaagagttaaattatgtccccaaattggcaaatgtgtgtgtttggatttattcttaacttttccaattgcatcatttagattaaattagtcactataacattcttttcaattttacattttaaatttcttttgttaaccagctgagaagtctgagaactttgtatgttcacagggtgagtccattgttcctggctaggaagcaggggttgatcttttcctgcagttcatttggattgaaggttcttctttgctgactcttgcttccatagtgaaaacacagatatccactcagtgagagtcagctatcttaaaaaaaaaaaaaaaatcatgtatacatcacatgtggttcaggatgctagctggcattacagaaactggtgtttagacattcaacactgctttttttaacatatttgaatgatagtgtctgtttcagtgcaggcttttttgacatgaagggtgatctacctcaaaggcagttattctggaattgaatcctccaaaatgaggccaattaaagggtgtcttctacataggagttaagggaagtggttgccatccctcccaccctgaaaaaaagaaaaagagaaaatgttggctctatttattgttttggtggggttatgtatgaaaatgactaagtcaactcatctgtttgtgttgttgctttggctactggtctgttctttcattttgggcttatagtgctttaaaattcaatatattggatattaaatgcatgtgattaggaaacagtcttgaaatatgcccagagttactcagtagcttcttttttataattttaattgtggtggtctcacatttgtgggtttaaattgtctgagttattgagtgttgtattttgtagcccccttctttaattttcagaagcactgtccatttcatttcggtttataaaaatgcacatcttttgtttattgttatgatttatccatgtgtgttttctagccaataaactgtgtcttgcagtcatgattgatcttgttttactgagatttagttttgaagactaaaaatctccagtgttgatatttaaggtttttgaggattaattcttataatcatttttgatcgaataaaattaactcattatgtcggagtatgtgccttttgggagacaaaaataattaagagaattgaaaggatctataaatgtgtttgtagaaattccacttggggatgtggtcctattgtagtttactgaaaacagttgtgggcattgttaccagtggaatgtgtgccctaagaaaacaccatttgtgatgaatgctgggcgaactgtgttctcaaatcattcctgttgtctaatggttatcttacaaaaagcatgtgcctggttatgtttgttatgtggctttgtacagtccttacctaggatcgattggctgttgagttcggggggcagaagtgcactgacccactgtggattgtgttggaaggctgttcctgtagtcatttgccttgtgttgcttccagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccaca

SEQ ID NO: 307 - DNA, 17057 bp, Homo sapiens; identical to SEQ ID NO: 306

SEQ ID NO: 308 - DNA, 17057 bp, Homo sapiens; identical to SEQ ID NO: 306

SEQ ID NO: 309 - DNA, 17057 bp, Homo sapiens; identical to SEQ ID NO: 306

SEQ ID NO: 310 - DNA, 17057 bp, Homo sapiens; identical to SEQ ID NO: 306

SEQ ID NO: 311 - DNA, 17057 bp, Homo sapiens; identical to SEQ ID NO: 306

SEQ ID NO: 312 - DNA, 65780 bp, Homo sapiens
tcaatttggaaaacttttatcaatcaacaagttatcaaaacaagggtttgctttttgacagtgaatgtacaatattatatggtttgccattatttcctcttttggaagaaaggtaaaatgagaaatacattatataagtcattataagttcagtagatttttaaaacacttgagacacgagttagaaaaaatgcaattgaataaaccaattgtaagacccatctcaaaacaacaaatttaaatatgaaccacatattagatgatactaagtaattattgtttttgttaggagtaataatatcactgtggattttttaaaggccttactgaagtattataagtgaaataatttgtgtgatttgctttaaaatattccgattttaaaaattttgtgttggatggatgcagtggctcatgcttgtaatcccagcactttgggagacagagataggattgcttgaggccagaagttccagactagcctgggaaacatggcgaaaccccgtctcttattttttttaaaataaagaaaaattgtatgttgagggaggaggggtgtggtggtggtggtgatggtgtggatagacaataaatatgataatagatcgcagtactcttaacactgctgttgagatatatatatatatatattatatatatatatatatataaaataaacaaaataatgggatttatatatgtggcacccagtacaatgtacaattttcttttttaaaaaagtatttaggttatgcattgctaagcacatctgtgattgatgagagtgactctagtatctaaactgttggaggagggttgtaagggtaacaggtaggggaggcatatagaaggaatatgttggtatcatagatttcctaagactcagggaaggccacagagctagggtactagtctatgctagaattaatggattatgcaaccgaagaaagacaacttttgaatgaaaagctctctctgtgccagacttgaggtcaccaagcatcctgctcacactctgcgatgtctgtggagtagcacaccaccagaaactgctgatggaattacatcttcaagattcaaaatgtttagatccaatatatctaatccataaaaataaagcattctttatgctgaatgcagtcctatgcagtcaagaacaataatctagacatttttcatgtaggatttaaataggagtacaagtgaattaaaccattcagataaaaacgcaactaaagatgcattagctgctttgagtcaatatattttgtggtcaacctgatactccatccacataaaaaaggcattctatttctttattttttttttatttgacaagcagcagtatcatgtttgtcattttaatgtagatacaattattaggttatctgtcatattacaatatttaagtttttaaattttatgtcctttaagatacattaaaaaaaaaaaaaaagacacatcaactgcaaacgtgaaggggagaaaaagcatggtacccaaccgaatttccacttttcagcaatacttcactcattcttttaataaagttttaagaaatgtcataatgacatgagcttgaaatatctctaggcattttctttgacgctcatgacgtggcactggtgatgttgtaaacagcagaaaacaggggctgccaaatgaccaaattatggaggcacagtcctgctttttcccacaggaacacaccaaatggtgatggcaatgatcttctcacaccacgctggaggagagcgacatcacgcgacgtagctgtattcatctgccgacgcctggctgcgttctatgtattgtttgtctatcagaacttcaatacacttcttaatcatgctgatactgggattaaacctagctcttgactggctaatcacctgtggaagagatgtggaagtcaaactactgccagttcttcagctattaagtaatgacttttaaccaatcagtttaaagtgcctcaaatgtactgaggtttcaacaaatgggccaaattaagtatgaaaataggaactacaatgtggaaaatggatacagcaaaatctaataatgatacataattaagtgaaacaataaactaattaacctaagtactcacacacaaccccaagcttctatttaactcaactctcagctcttagttcaaacactttctcaagaaagttttccccagcagcccctaggccaggatatttaaatacattctcatagtactgtatacgtttccttcagtgcatgctaatgtaattttacatttatttgcatatcatttcaatagtgtatttcttcccccattaaactgtgaactccaaaaaagcctgccatatcttcagctgctctgtgctatatcccagggaccagcccagctgtctatcacatggtaggctcagatagttatggaatgaatgaatatctgatgggtcaatttccttcaataactggacagaagactcaatgaatcagcaagttttagacctctaaaataaagccaaagcaaatatgaatttattattatcatttgagatagcatctcactgtgtcacacaggctcaatccctgggctcaagcaatcctcccgcctcagcctcccaagtagttggtactacaagtgtgccgccacaactggctaattttttaattttttaatttttttttttttttttttttaggtgagatggggtctccctgtgttgcccaggctggtctgaaactcctggactcaagtgatcctcctgtcttggcctaacaagacattcagattacaggtgtccactgggcatggtggctcacacctgtaaccccagcacttttggaggccgaggcaggtggatcacctgaggtcaggagttcgagaccagcctggccaacatggtgaaaccctgtctctacgaaaaatacaaaaattagccaagtatggtggtgcacgcctgtattcccaactactcgggaggctgaggcaggagactcacttgaacctgggaggcagaggttgcagtgagccaagatcacgccactgtactccagcctgggcgacagagcaagactctgtctcaacaacaacaacaaaaaggattacaggcatgagccactgtgcccagcctgcaaatctgaatttaatactgaaattgtgagtgagtacgattctgattaagtatgaaacatttctttatgctatctgaggatcaggttatttctgtatcctctttaagaagaaagagactgaatctgtacaatgacaatgccctctaccctaagaagccctgaggactgccctccttttacctcttgaataagggcattgtgccgaagcacttttcgtgctttcatgatacgaactatagcagcttggagatacattttccggtcctcatcaactgcacttctagtctgctccatttcctgttttacagaagaaaagaaaaaagacccaacaagacattaagtcactgaacttgttttcaattcattttatcagtgagtgcaaatacttttttttttttttttttgagacagggtttcactctgtcgtcctggctggagttcagtgactcgctctcagctcaccgcaacctccatctcctgggttcatgtgattctcatgcctcagactcctgagcagctgggattacaggtatgcaccacaatattgagcaaattatatagttatgttgtgccaatatcacataaccactgctaaaacatctacaatttctagggttaaagttgaaagattagaaaaaaatttacattattgtaaactgtactgttaaggtaaagaggcaataaaggaggacacagcaataatttgcaagatcattttcttatcagtgattacagaatctttcatgacgcttttagatggagttgtgtcaactgcagtaattagctccaaatgcatactggatcaggcttcaaagggaagagctgtgaagtggcattttatgtggctcaagcagagaagccaggagagggggcctatctccacggagctcaagaaacacagaagcaaggcatagaagcagaccatgccacattaagaggatctcctcacagcgtttcaaagacaaaatacaatctatatattgcaaattattatttattagcctggaggaaaatggaatcttgaccattttaggtttcaaagtaaatggcagttaatatttgtctccccccatcgggaattaagtttctggagagggtctaacatcttatattatcttcacatcctgcatcagcccaaggactgcacaccggaggcaatcaggaagcataagtgatagaaacagtctatcccagaccaaagcaacaatcactgctgagttaaaataatgaagagcagaagtcccctcctcacactggcctgtcagtacctcactccacacccactagatcacaatctgcatttgaacaagatgcccaggtggctcatttgcatatgaaagtttaagaagcattttctactgacaaattttctttgaaagaaatgagctgtaggccaggcgcggtggttcacacctgtaatcccagcactttggcaggctgaggcgggcggatcacgatgtcaggagatcgagaccaccctggctaacacagtgaaaccccgtctatactaaaagtacaaaaaacaaaattagccaggcatagtggtgggcgcctgtagtcccagctactcaggaggctgaggcaggagaatggcgtgaacccgggaggcagagcttgcagtgagccgagatcacaccactgcactccagcctgggcgagagagcaagactccgtctcaaaaaaaaaaaaaaaaatgaactggagaactttcccttattttacaaatgaaaaatatgaaattttattacttctcaatgtgggaattttcggagagaatgcatagttacacattctaatggtttaagagcaaatacaacaaaaccatacccttttccttagaaaaaactaaaatacaagtagagatttctgtttgactgtaaggttaataaatgccaacaacaaaccagaaaagacatatcccattattaattttgctgtgcaaagttttgcacaatctcaatgtaaacacttgtaaagtccaatgcttaaatgtttccccctcaaaaaaaacttgacattaaaagcacttacttgtggtgtgtctttctgcattgatgtagtaattttaaattttgttcttttactgctaaagttcatatttaatgaaaacgaagattctgcatcaatatcttcctacatttaaaaataaaacatttatatttataaaaaccaaaatctttaaataagagtttgctgcaagcaattctgctaaattaatgaccaagcaaaaaagcctccactctcataacttttatattatagattaccaaatttaagagaaaaataattcttttgttcaaacaaacaggaaaaaacccaattattttctacttttacatctgccagaatcttaagcagtttatgtttgggaataagctattttctggtcctactattctatatacactactttttgataaaataagagtcaagctcattgcctagagtttgacattttaatttttatgaaacaccaaagtgcgtaacttttccatcaccccattttgaaaaagcaaccacatttttttttacaaatgccgcagtaacaaaatacccactgtaaatggcctgatgacaagagaaagctgtgcctccagtagcacacagcatcaatttgctgtgacctggggtgatggtgaaaacatttatttcaatccatgttttattcactcttcaagaagcaagtggcctttgctcaggggaaaactgtttaggcaatttttagaataacaacttctgtatcaggcttaagaaagccactgatatcatagagtggaatttctctggcagcagaatcaaaaggcacttggaagatgaaataattctcaataataatctaagacattctgctaaggaatggacagattcataattaaatttaaaggccaggcatggtggctcacgtctgtaatcccaccactttgggaggctgaggtgggcagattacttgagctcaggagtttgagaccagcctggccaacaaagcaaaacccggtctctactaaaaattaaaaaattagcctggcatagtggcttacacctgtggtcccagctacttggaaggctgaggcaggattatcacttgagcccaggaggtggggattgcagtgagctgagatggcaccactgcactccaacctgggtggcacagcaagatctcatctcaaaaataaataaacataaaataaaatttaaagtgcaaacaaggaatctatgtttactttgtcaatttctgggcagcaaaaatagcatgttttagaaaaaaatataaaacctttaagaatttactagcctaaaattagaaaccataattaattaaccttaagaaatccctattttggccaggcacagtggctcacgcctgtaatcccagaactttgggaaagacaggtggatcacctgaggtcaggagttcgagaccagcctgaccagcctggccaacattgtgaaaccctatctctactaaaaatacaaaattagctgggcatggtggcacgtgcctgtagtcccagctactcaggaggctgagacaggagaatcatttgaacccaggaggtggaggttgcagtgagccaagatcacgccattgcactccaccctgggcaacaagagtggaactccgtctcaaaaaaaaaaaaaaaaaatccatattttgctaagattctgatgccagataaatcatttctcaaaattatgaaaacattgatttgaatttcagaatatgccttttacagttgttcagttatagactataaaatgtcatcataatcctagggatgtcagcaaaatgaattaatgagagaaataaactgtaggctattaactttacaaaaataaaaacaaaacattatttataggaattttttcttataagcacaataatttgaaggagatataatcccacctctgttgcatttttaactatttaaacatctaggatatactatgacaacaaaacagcaaaatcttgtaactagaaaaaaagttacagagaaaaaaagtaatatactaatggcttgttattcttgtgacagatattaaaaatatatggtggttaaaaacagatgacagttaattgagtgctgacattaagaacacttggaatggagttacacatattaaatatgtgtacaaacagacatcaacaggctgtcatttcctgttatagaaccatgaaattaagcacatttataaaaccaaaaacctggaaagtctttaaaggctagtttcaaaatctcaattaatcaaaatcttccagatggcaattcttttacaattattcaataagctgtaacagtataggacaaataaaatcaaactataaacggcacatggcaccaactcacacagcatgctctgtgatgccttaacgctcgcagctctatggagcgtacagtaacgtagtgaatacaagtgctttccagagcacaataacaattacagccttattttaaaactgcaaacatctcatgaaaaagctttaatgctgatgatgcttaaattctttggaatattactacataccttttctgaatcatggttaatcattttcacatcaagtaatgatttgattgtttttgtcagttccttttcattcatctgagtgctgtcctgaagctctttataactgacagtttcactgttgttaaaggcaagaagaactgccatttggtatgttgtaaccatggctacatatggtttgcccaaatagttcattttaacttcacctacaattaaaacaaaaactgacagtgaattgaccattcaaagaaacatttcaaatttactttatttcagacattttcttcggaaagagtgaaccaataattttattaaattgttgtaaagccactgctgttaacaaggtagtcattttgtttcttggggaggtgaggatggaagtctattagttttgagtatatggtataaatcagtaaaactatcataacttcaccagtaggttaaaacagtctttaaggccaggcgcagcggctcacgcctgtaatcccagcactgtgggaggccgaggcagacagatcactttaggtcaggagctcgagaccagcctggtcaacatagtaaaaccccatctttactaaaagtacaaaaattagccaggcatggtggctcatgcttgtaatcctagccacttgggaggctgaggcaggaaaatcacttgaacctgggaggcggaggttgcagcaagccaagatcacaccactgcactccagcacgggtgacagagcgagactctgtctcaaaaaaaaaaaaaaaacaaaaaaaaaagtctttaaatattaatagaaatgctaagacttaggcagaaaaagaaaagaacaaaaaacccaaacaataaaaggaggtgggagaaggagaaatggacagacaaagggcaaagtgatatcagcaacagcctcaagtgctgtcgatagctgggctctcccaggtaaggttcaagcctcctgggaggtccacagccacatggaaaatgcttttgaggccctgtctaagctgtaatttctgccaaaattaatgctattatgtctcataaacaacatttttctttccagtaacttcctagaggcaaacaggtatgaaaggagagacaaacaggcagacccattctcttgctgaaagttgatagcaaaagaatctgaatgttttcataaaaatgtttaatctgaatgttttcataaaaatgaaaaacatttaatctgaatgttttcataaatatgttctatatgtgctgggcacggtagcttatgcctgtaatcccagcactttgaaaggccgaggtgggcagatcacttaaacccaggagttcgagaccagcctggtcaacatggcgaaaccttgtctctactaaaaatacaaaaattcgccgggcatgatggcatatgcctgtaaacccagctactcgggaggctaaggtataagaatccttgaacctgggaggcagaagttgcagtgagccaagatcacaccactgcactcaaacctgggcgacagaatgagtatctgtctcaaaaaaaaaaaaaaaattctatatgctaaatgaccctgggagctctaagagatagagcaagtattatgtatactacagttctgcaacatcctgggagacagcagcatgacatcagcacactgaaagctcataatgaataatatggcaaacatgtctacactctgtaatgttccatacgtgtttaaaaaaaaaaaaaaagaaaagaaaaaagatgcagatcaaagagctgcttcctaaagcacgaagttgtggtttgacgactaacacacacacggcctgcattatttgattgttgaatggattataaatgaaattgggccaggcgtggtggctcacgcctgtaatcccagcattttgggaggtggaggcaggcggatcacgaggtcaggagatcgagaccacggtgaaacccctgctctactaaaaatacaaaaaaaaaaaaaaactagcagggcgcagtggcggacacctgtaatcccagctactcgggaggctgaggcaggagaatggcgtgaacccgggaggcggagcttgcagtgagccgagatcgcaccactgcactccagcctgggcaacagagcaagactccatctcacaaaaaaaaaaaaaaaaaaaaaaaaaagatgaaatcaacatgagatttgattttaaagctcttcattgttaactcaaggaagctgtatttctcataaaattaccccagagactgcattttccctctcaaggataattagtaactctgattaaggttttctgctttatgtattcattacctcattaaagattttaggccgggcgcagtggctcacgcctgtaatcccagcactttgggaggccgaggcaggtggatcacctgaggtctggagttcaagaccagcctgaccaacatggagaaaccccgtctctactaaaaatacaaaattagccgggtgtggtggtgcatgcctgtaatctcatctactccggaggctgaggcaggagaatggcttgaacccgggaggtggaggttgctgtgagccgagatcgcgccattgcactccagcctgggtaacaagagcgaaactccgtctcaaaaaaaaaaaaaaaaaagattttaaaggctatgagtgaattcattagcttaatatcaccataaatgcaatattatcttgattattatcatttatgccttgacatttcagataaaactgatatttagaaacatttttcagaattatctggatgggaataccaagagaaaaaattcatagccctctaaattttcacaaaaggaggtttaatatattaaattcaatatccaattcatagaaacagcttgtgcaaaaaattatcatttggagtatactattaacaatttctataaaaaggactcttatcaacatttaagtttggaaaatgtaagtaaaacattacataaattgcattttgttatttctgcaatgacgacttaatcatatgcagaaataagtagagaattatgcatcaagcaccaagatgattaagtggcaccatcagccaggatgtcactgatgctgtaatatgctgccgtgggtttgaaagcagaatgagtcttctgccgtctttcagcaccacgagacccaaagagcattaggagatcatgcgaggggccaaagcatcatttacttcttattgagttcattctttcattgtgccctttcttgctatttttcaatactctaccagggatcaggggtacactgacctcttcccacttttcttagcaccatactcttactgaaaagactggggaaggggtgggaagacacgacaggggaaaggaaacttcaaacttggatgattcatttaattactgtggtgtaaacacaaatgagaaacaacaagagtggtgatttaccctgcagaataggttggcaaaccctaagagactaaaaactaaaataaaacattctgatacatgcatacttaaagtaagccaacaataaataattcaagcagcatttacaatgacaggaaataaagagcgggcagaactctcacaatagtttcatccaagtcactccccagtatctgtgtcagctctctactctctcagggcaagttgaaggcatgataggatatcaccattttgcaaccagtaatgaaacaactgattctggcaaggatcatcagtggaggctaaaactacattaggttcctggaacagggtattcatgccaaagtatcatccctcagactgtctgctaagctaactgaagaggggaaagagtgcctctacaatggagatatctggtggttaccgccttcatcaagtgaccaaatttagcatctctaatagtgagacaatctgacattagatgcctttgaaatatgcaatatgaaatacacaggaccacctatgaaatatccttgccaataatacttaactgaatataatcaaacctttagaactaatttccactttccagaacatacaaggaatagaaaacaaatttaaaaaaaaaaaaaataaatcacaaataagtaatccaaagtactggatattctacaagacaactggcctggtctgttcaaaacagtgtgtcaaagaatgctgagaagtggggaggtggaagggaaatgtaacaaccaaatacaattagtgacctctgacagtcaagcaagtcaccttgggacagtcagggaaatttgaatatggactggacattagacaatactaacatccctccctatttttagctgttggaattatttgaaaacaaaagcaggacaaatttagtcaatagaatcgttatcttttaaggtatgcacaatgatatggtgttacttttattctggcaaacactagtaactaccaacacatactatgatgtagggttcacaaaattctagcctgatccatactatgtactgtctggtgaagttttttttatcttccttgagttcatcatttctcaacgtgtctttcagcaactgaccagcaatctctacaacttcttgctctgccacaaataaaacttatttatacaaagacagtgtaatggtttctgtcacactgtctggttatatctctttatcaagtatctgtatgtctttatcaaactgttccttatcgttaattctatccaaagccttagtcataaatccagtggaattttcaggatttttctcactctgtcacatctggcatcacagattgcttcttaaaattcttcctctgttggaaatacactctcaacactctcctttacgtagcttggttaagtcctattcattctttttattttatgggtttttttttttttttttcaagacagggtctcactatgttgcccaggctgatcttgaactcctgggctcaagtgatactcctgcctcagcctcccacagtgctagattactatgaccttatttaaccttgatcaccttctcatggaccttaggggttagagcttcaacagaagactttgtagggagcacattacagtctctgcaagccatggacatggtgacaattttattccattctaactgcagattaaattaacctccatgttaatctgcagcatgttttctttctttctttctttcttttttttttttgagacggagtcttgctctgtcgcccaggctggagtgcagtggcgtgatctcggctcactgcaatctccgccacccgggttcatgccattctcctgcctcagagaatcttattttctgcacactgctgtgtataaacatacatttttttatatatgtatgtatatatatacacacacacacatacatacacacacacaaatatgtagtgataaaactatatagatgatatttccataattaatacatgtttatattaatgtcaattttaatgtatgaatatgtattaaataaaaacccatttcatttacatatacatgtatatccttccttccttccttctttcatttattattttttattttcatttatttattttctttttgggcctgcctggtcttctcactctgggctctggtgacctcagcctcccaagtagctgggactacagggatctcttaagcccgggaggcagaggctaatgtgggctgtgatcgcgcacctccactccagcttacgtgaggtggggtgaggagaggcgaggtggggtgaggtgaggcgaggtgaggtgaggtgaggtgaggtgaggtggggtggggtgaggtggggtgaggtggggtgaggtggggtgaggtggggcgaagtggggcgagggggcacccggccctattagctcttgaaaacaagttgagatgtgatttccccagaagacttccctcgcaaggacctgactgccaccaccattctgtgatatgccctgggctggcctctatcacattcaaaacaccgtactgtaactatgtacgtatgtctgtcttcctactagacatgagttttttttgagggccaaggctctgtattttatttctgtccacttggcgtttagaagtacctgagacatagaaaatgttctttgagttgatcaatgaattttacaacaataaagagaaggaaacaggctcaaaggagttaagtaatttgcttaagattacacagctaataagttgtgagctaataactccagccacaggtcttctgattctaaattcccccaaacaccaccttgtgcaccatcaaccatttgtgaagactcttcatttacaatacaaaaattaaccttttcttgggtattccatgagctgggaatgtagaaatagactaggcaagaataattttcattctatgtttaagcagaagtaacaggggttctcaagaaacagaactctgagagatctgtccagcctcagagccagtgttttaaagaagtcctggagccttaggccatatatgggtaatctagaacaagtatcttcaatacacatagcgtgtgagaaactttttgttaaatgaataaatggagaacaaaaataaaatgaaaaatgttgatcaaaggggacaaagtttcagttaggaccagtaagttctggagatctatcatatagcatggtgactgttaatctactgtggagtaaacttgaaaattactgtgacaaggctgggcacggtggctcatgcctgtaatcccagcactttaggaggccgaggtgggtggatcacgaggtcaggcgttcgagaccagcctggccaacatggtgaaacaccgtctctactaaaaatacaaaaattagctgggagtggtagtgtgtgcctgtaatcccagctactcagaaggctgaggcaggagaatcacttgaacccagaaggtggaggttgcagtgagccgagatcgccactgcactccagcctgggtgacagagcaagaccccatctcaaagaaaaaaagaaaaagaaaattgctgtgacagtaattgctgtgacagtagatgttaaatgctctcaccacaaataaagataagtgagaagctacttatgttaattagcttgagttaatcattttacaatataaacataacaaagcatcacactgtacactgtaaacagatacaatttttatgtgtcaattgtatcttatcaaagttgggaagaaaaacaactctaactcctggtttcactgataggtcacaggtgttttcagtaccttcggtgactcaaaacaaaaaaataaacttataaggttctctttccaaaggaagtaactatttggttttaactaaaacacaaataatattaaataaaagaaatgaacaaacaaaagagctccccaaatcaacttatgtatcagcttagaaatttagtatagctcaaaaacagaaagaaagttattctctttcctatttaggtgatattggtgactattttcaaactaaattccaatggctaaaaaactatgtgcataaatttattttcttcttatacaccactggttgttaaaatgagccccttactaaaattactttaggagacacattgattattgctgaaataatgagaataaccaagaatgtttaaactcccccagacagatattcatggaaagtaaaagcaagctaaatcgaactgcactaagatatattagttttcttaggggaaaaaaaaaaaatctaaaaccctggtccagcatttttttcttaaaatcaattatgtttactaaatgaaaatagaacatattgattgactggttgagacagggtcttgctctgttgcccaggctggagtgcagtggcacgatcatggctcactgcagcctccagctcgtgggctcaagtgatcctcccatctcagcctctcgagtagctgggactacaggtgtgctccaccacgcctggctaatttttggattttttagtagagacaggttttgtcatgttgcccaggctggtctcaaactcctgggattaagtgacccacctgtctcagcctccccaagtgctggggttacaggtgtgagccactgcacctagccaaaagtcaaattaaaatttgacctttgactaccactaagagtatcagtaaaaaatctcatttcaaaaattattttaaaaattagaatgtccaacttgctcagtaaagatcgacttatataagtaatgcaaaatgtattactaatacaatgagccatcacgttcccaagatgtaaattagtcaaataaacaccaagtatcatagttacttggataaagtaactcttggggaggggatagaaaacatttcctaataaaggttatggcaaatgattttcttgtaccatctctaagaaatattagcatatataccctttccttcttgtacaaagaaaaagtgattcaatgaacttgtcaaagcatagtttagcaaaaaaagagaaaattcaagtgtctgctttggcttacatcttcaggcaactccacacacagtccacaataattcaggtattaatcctactgtaagtaagtggactccattgttccagaaagaagcaaaggaaattagattgtgataaaagttttttaaaattggaaactattgaaaattaagtaggactttctgcaaaaagctttactattgcattcactgcagtatcacaagtaaaaatcaaatggttaggtctccttatgatgctataataaagaaactggcaagaggatctggcatacttagagaacaagtttctaagtgtgtctgccccatcaaatgtgagtttctaaatacatttgctaatgaagtggttggctagagaaatgtaataaatcagtataaagtcagaacatttctttaaaagcagcaagattataaacagtgtaattataaaatactatgaaaaagtgctatacttggatttcattgttagttgctttaatggggaaaggttgatggaggagaaaaggttaaaaactgtaattgggccatagaaaacctctttctaaattaatataatcatcaggtaaatttcattaagccagatataattaaatgcattttacctgtacacagataatgtaaccatgtaagtttccttccactgaaatgttggctataaaataattcaaactgtaaaaaaaaaaaaaaaacacacattatttttagctactataacttgcctagttaattaacacaatactacaaaagcaatgaaaaccattcatattagaagagacattaaagcccatctggtttacctccttcttttacagaggagaaagcacgttcctgtggtccctaatcaaggctatacacatatattccagctcttttaattgacaacttgttctagagttctctccactaaaccacagcactgcaaatttgactttctgtatgacacagtgattcattatcatttctgaataatactaacatggactttataaattctactaaccaaacacagcaacatatatatttcaccatgaaaagagaaaccctaccttcatctctaatctcccatttgccaacatatagcttccacattcaattagacacaaatacgaagttttagggtatatctctggattattcttttgctgatattattgtgaacaattaaatttaaattctattaatgtagccttcaaattttaaacattcctccctggactgaatgtgtaattacagaacaaaaatacagagttcttttttctttaataaagagctagtatacaataaaaagtggaaaaatgatactggatgtgaaaaagataaaaactcaatttctttataaaactaaaaaataaactgcattatgccagttcagaattctgaataaacttttagcatgatgtaccatatataacatacttaaagcttttatttgtatatcaaactttaccttttgtactttaaaaaggaagttcacataaagcagtcagcaatgactgacctatcagctatattatgaccactccttaacagcaaaagttaatagctccagccaagaaaatgagtcaattccttcagcagttactctaagtttgcctagtcctgggaagctgaaatatgttgagcctattttccctctaatggtgcagcatcctcctctaccagcagatccaccaatccctttgcaggatgaacaggagatgactagcacctggaatacttcagattgcctgcttagttctaatccagacaaacagcaaattgaaatatgtcataagaggatttcagaagtatgatctgactaactaataactcccagggatatcaataaaattcaatcactactatataattcacaatttataacacatttacaatgaatctggacaaaagcaaaataaaagttaaaaaaactttcatttttttctcaaaacactttcggaaatgagaaattccagctttaaaatgctcataatttaaagtgcaaagctggctttaaaaggtatattccaagctctaaaaacatgttttacctcttcagtagtactatttggtaaagttttattgacgataatatcaatatgccaaaagaagatactgattcatccttacatttaaaatctgactacaaagactctcgtatctatagctagtcaagaacaaacagactccaataaattcatcaattcatatggcactacaaagaccaaagttataaaaccttccttgattatatcattaaaataattgtgttagcaaagcttattagtaaaaaatatatgttgactaaacttattttatttttttaaattttattattattatactttaagttttagggtacatgtgcacaatgtgcaggttagttacatatgcatacatgtgccatgctggtgtgctgcacccactaactcgtcatttagcattaggtatatctcctaatgctatccctcccccctcctcccagactaaacttattttaaaataaacaggataaaaaacagcatttttcaaacactgtttaagggcattaattagatctcaaagagccttaaaaattcaatgagtttatttacctttaatagatagctacattaatatacactactttagatactttttttttttttttttttgaggcggagtctcgctctatcacccaggctaaagtgcagtggcgcaaactcggctcactgcaacctccacctcctgggttcaaccgattctcttgcctcagcctccagagtagctgggactacaggtgcatgccaccatgcccggctaattttttctatttttagtagagacggggtttcactgtgttagccaggatggtctcaatctcctgacctcatgatccgcccgcctcggcctcccaaggtgctgggattacaggcgtgagccaccgcgcccggcaactttagatacttctaatattattcaggtttttggcctaggtaaaaaagaaatgtaacaattaagattgactggcctaaagtataaaataaattacttttaattacagctttaattccacagttttgagatactttggtgtaaaataaaggtaattcttgatagttatatttaagattaagatgtaaaaaatgcaaatcatcactaaggcaggatggattaatttacatgagaaaactgtacactattaagtatacaaatggatttcaatcctatgtatctgaaaacttggacttactagaaaaaaaataaaggacaaactccctctactggtaattggagacaattcaaatggagagaatagtatttttggaatcagaattttacagacagaaactcacttcctatttgtaaatggggaaactaaaacctgaggaagactatacatcaacaaataaagtttaaagagttaaaaactataaatagaaaataattatttcaaggaaagaggaaagaaaaaactaaaggaaaacttcatttctgccagctcctattctctcccttaatttcaatcagggacacatgatatttaaaaagaaatgtaaaagactgccaaggccaggcatggtggctcatgcctgaaatcccagcactttgggatgtatcctttctgcaaaatttgtaataaccttggattatagtctgccccatccaatgaatgtctgcacaaatgctcttcttcacatagtttctaaaatagtctgtgctacaatctcttttcaaagaagatgtaagaagtcctaatttagcctcctattctgaaagtctatcatgcttgccttcctgaaacctacctgactggttacaggactctcctctattagttattaccacgaaactaataaccactatcaatcactgttactacttactctactagcagttacttcacatatatttacctacattacaggacagaaataaaaatattacaagggctgaatgaggtatttggtcaaaattcaaaaggaaaactggtaagtgatattttaggtgttgaattctaagctttcttctgatatcaacatttttataatttaaaactgcttaatagcagatgatagacttactcagaataagagacatgctttgacaaagaactgtatgacattcttcttagcattttagtatcaatattagtaactacaataacttacattcttcctaaagggcagactgactataatttctgaatctatttttatcacatgaacccttaagactctgaaaaaatattaaaggtgatataatatgaagacaattattaaaattcctttagtcttctaatatatttcctgcaaacttaccatctgtacacttttttctaattcctggggaattgcaaacgtagatgaaggagcctgagtaagaggccacgcaccagcctagaaggaaaaaaataaaataaaataagctaaatggatcaacatctaaattcaaagtaaatatttattaaataatctaagcatctaaaacatttttttcttcctcaaaatgttgatgaaatctgagtatttctatcatggcacatttcattccaaaccaataggacctttttttgttttttttttttgagatggagtctcactccatcacccaggcttcaatgcagtggcacgatctccgctcactgcaacctccgcctctggggttcaagcaattctcctgcctctgcctccccagtaactgggattacaggcacgcaccaccacacctggctaatttttgcatttttagtagagacgggttttcacatgttggccaggctggtctggaactcctgagctcaagagatctgcctgctttggcctctgaaagtgctgggattacaggcataagccaccacgcccagcccaaatcaataggactttagaagccacaatctactcacagaaccaaacgtaatcaggcatccatttatgaatcatttgtatcaacgtactgaaatgattagtaaatgctcatagtaaaacacatattcatacctgtagaacatatatttgaaaactaattcccaaatctattactgtgtcttggtttttgataaaattgttgaacttattgttgagatcagcgctgacactcatatctgtatacatccgatgtagcttgctggtaaactcataaccacaggcttgctataaaaaagttttagaaaatacatgaattcaaaagaaaaataataagtcatattggttaataataatgtgtcggtattgctaggtctttgatcaaaggttcttgcatatacacttatacccaaggactagtaatatattcttcataagtcaaagcaactaatcaaaacctttcaaactttctttttaaagacgtattttaaataagtgaataaaaaccacctatctaggaacaataaatctccccttaaacaaaaacttttttatacattcatctcttatttcagcactgcaaaatgccccgttactatacataagataccttaaaaggattttatgttgtgttttgttttaaagacttggggtctcactgttgcccatgctgcaacgcagtggctattcattggagccatcatggtgcactacaacttcgaacacctgggctcaagtgatcctcctatctcactctcccagtagctgggactattggcacatgccacagctgctggctcttataaggtttacagatagtatcaaatgaaagattacataaatgattactgggaatactccagcctgtagtcaattgaaaaagttctatttaggcatatttttaatagcatctactgagtgctgaagaaaactatttctttaaaattattcaaaattctgttgttaccaggtcagaaaatctgaatctctaatcttgaaatataaaaagctcattaacactactttttttttgtaattaatctatttagaggcaggatcttgctctgtcactcaggatggagtgcagtggtatgatcatggctcacagcagccttgatgtcccaggctccagcaatcctcccacctcagccacctgagtaactgggactagaggaacacgccaccaagcccagctaacttttgtatttttggtagagacagggttttgccatgtttcccaggctggtcttgaactactgagctcaaacaatctacatgccttggcctcccaaagtgctactattataggcatgaaccaccacacctggccaacactacttttagaaattaaaaattaagtttctttttggaggtttaaaaaagagcacacagcaactgggtgcagtggtgcacacctattgtcccagctgctcaggaggctgaggcgggaggatcgcttgagcccaggagttagagtccagcctgggcaacatagtgagaccctatctcttaaaaaaagaaaaaggaaaaaaggaatgcatattatattcaaaatgtctactatgcaagaaaatttattgaataacacaggataaatatgaacctgctaccacttatcggtatgtaagcaagctgaaatgatgtaaaaataaattgaaatggaattgcactccaaaatctgtacttaaaggaatattttaggtgtattcatttataagtagtaataatcttttatcattaatactgattatcttgtgaatcttcatatataaacatatacattttgtccttttaatacagtatttgtatatcccactgtgtgactacacaaatacacatttaaccagatgaattgtttcctgttactgtacacaatgctgcaatgaacatctttatgtgcttgtgaatgaatttctaggacaataccacattaaagacttacattacctttaatttgttgatcatggcttcttcagagtccatagacatggataacccatgaattaaacgttttgccagcattcttgcgtagaactacatttaaaaatattttaaaagattacttcctttctaatgatttagcattcagaaataaagttgaccaaaatacaaatgaaacttttctgttcacaacataccttttgaaagacgtccttgtcatcaatgtatttgaacactgtgatgaagctcgtgagcctgtcttccacttcattctctgtcatccctttcgctgacttcttcagtaagttgtcacagtacttagcaagctcatgtagaaattgataataaatcttacaaagggtgcttctgtatatatcacgcctcaaaggaggcaaagtggtgatacaaggtaagatcagcggacagaatttttgctgttttttttagagaccgggtcttgctctgttgccaggctggattgcagtggacaagatcatagctcactgcagcctcaaactcctaggctcaaaggatcctcctgcctcagcctcccaagtagttgggactacaggcatgcacaaccacaccaggcttctaaagctttatgtaataatcataaatgtaaactaaataaaatatacatcataaggtaaatttttaaaaagaacaagtcaaatatcaaatcatcacttattgaccaataaagcaactgatataagtaatacaaatttttaaaagaacacctaggtgagtttcgagtggttttataatttttgacattgaacaagtactttaaaaaaaagttacaaaaatcttgtaagcaagtttccttcaaaggttacccaaactttatcatcagatttcctttagatttcagatgtaacagaatctacatgaaaagtattgcaaattatttcaaagtagatatacattaaaacccaaactttgtaaaatggttattctttaagacacatagtatattgcattccttacataaatgccaaactatatacaatgtagataattttccttctatttttctgaaaaatgctacaaaaaccaaattaatttgatattctgagttctcattttctaatactgacttttcataagattacttttcagcaaccaccaaacttaccagttcaggtgctttgcaaacagacttaggttctctgtaatttacaactgacgtaagggcctgaataaaaaaacacgccataattaaccaccagccatagggaaaaagtacagctagttcaatataagccataatctgtacatccaaaaattaccccgccacataaaacacagcattgccggtagtttgttaatattttcatgcctaacatggtagactcctctgactttattctctaattacaaaatatctatatatcctgttgctattccaagatattctgtaactcattatcgaaatttgaacagataaaataacgttacttaaaaaaaaacttacaatcttgtaagcagctttcctttaacgtatgcaaaagttcatgtaaaacatatctattctcttttcaaatattattcaatatagcctaagtattatggccaaagaaaaaaaatcagtactaaaaattgcaaaattatgcatgtctatccagaacatatcagattaaaaattccccttatatagcataatcacgggacattctacaagcattcaatttaactattcagttaataatttaaaaattatattatttctattttgaatttcatatcaaaattacttaatctccatgtctacatcagaaacctcatactagaattctgatcttgaaactgcctaaagaatgatagagttttatgtacatatatagtatatatgtatttaaaacttaccttatccaacgcactcataaaatgctgatcaccattcaaaacagtgttgataagctgaacaaatttaccatgcacttccaaaactgactccacaaatagtgttggcatctaaaaatgaaatataagtacaaaaccacattttaagaggttcaaggatatccaaactatgaggtttattagacttattagtaaatttttcctcaaggaaattatgtttcacacatgcacacttctcagaaaatggttttagctaagacggtcttagaaatttacaactttggtgttgaaggctgggcacagtggctcacacctgtaatcccagcacttctgggaggctgaggcgggcggatcatgaggtcaggagatcgagaccatcctggccaacacggtgaaaccccgtctctactaaaaatacaaaaaaattagccagacgtggtggcgtccacctgtaatcccagctacacgggaggctgaggcaggggaactgctggaaccagggaggtggaggttgcagtgagcagagatcgcaccactgcactccagcttgggcgacagagtgagactccgtctcagaaaaacaacaacaacaacaaaaaaaaaaaaaaaggaagaaagaaaatagcttgtcattcaacacaacaagctgtcatagactgtctagtacctgtcagaagaacccaccaaaagcatacttttctactgtgttggaataacttatcttaaggataacaagacctgaactaccaggtctatcactttcatagaggcttaaataagcaaagactgcctgcaaagtcactaaaggctgagagaaaggagagttaaaaagccaataatcctgagaacagagaccccttgaactcggcaagacaatccctcacatctcagagagaagaaatacctaatagtacaaaagtgagttttccctcttaatggagataaccatgaagaagttactacctaagacttaactaagtcagttggatttgagtctaccacaaatgtattcacttatgtttccatctcccagccttgacacaaaattcgatgcttctatgcccaatgtcattggacatggaatctataaacgtaataatgtaaactagtaagtttgacaaataatagagtaataaacctgaatactataaactaatagttctacaaaaaatagaaaactgtggtaaagggaatttgaagaaataaaaaaatagaaaacttacacattattgtggcataacataaaaactaaaaattattacttgccaaaaaccaatctgcagctaaggtaacagcctctaaaaagtgctcctgaacagtgacgtctatacacagatactatcttatagatgaagggcaaacagctctacttaagaagagacagtaacatttgaagttatttctctcttgctcatcaaacattaccagtaataacaagatttggtgatgggaaagacaaactgttacagtacaaactgttacagtcatgtgattggcaaagtattcgagaaagatgagtattagggatatgagggttattgttttgggtatttggggcagcaagcatatacttacagaagattattttaatctaaatttgcttcctggacaaccaaattcagaggatatggaaaggaggcaaattgcaagtcgtctatattaccactgattaatactactaccatgacaacaaactacgttatcaatgccaattacacaaaaacacagttatttaaaaatggcgagcttattttcctgtggaaagttaacaactgttcaatggacaccctccgtatggctaagcagcagcctatcaatagctttctaataatctgataattccaaaatgagtccaacaaattctaggtttaaaacatttgaataaagacatttctttcgttggcatggtaagactttttctttcatctttcaaaacaataaagtcaaaggaaaggctccacgctggatctgattaggaggaaaacattgcagtttcccacacaactcacgttttcctgagtaaggttgctggttgctcgaaggccctcatcatggatgtggttttgcagctcctgaatcatatgaggtaaaccagtggacacagcacggagtaagacgtacatatttgccatgtctgagaggaaaaagacatctgagggttaactcccaaatattttcatttattaggtaatatatggatccaagtgcaggagtacaatatacggatccaagtgcagagcacccagagaaaagtcccccatgcccacctcccagccacccaagcccctctccccacaggaaagggatgtggttatttaacatcttcccaaagatattttgtgcaaattcaagtgaatacatatattcttccctttgccccttttaatacagtgtactgtattttgtatattatttgtagcttcagaacacattttaacttagtggtcttttcctatcagtacacaaagcatttctatgtattttacagctgcacagtactccattatgtggatataatttcttaacaactgatggaaatttaggtggtttccagtctcttgatattgcaatgttgcaatcaataatcttatacatgagcaagaatatatgcaatataagttcccaaaagtgaggttactgtgtcaaagtttaatcttgtagacagatccttctaaccacagctgccaacagcagagagttcctttgccaacaatgtgttgccaaatgttttgatctctaacactgggaggtgaataatgatctctcagtgtagtaggtttaattttaaacgtttcattaaagcatcatacatatacagaaaagtatacaaaccataagtgtatatcttactgaattatcacaagtgaacacacaacacacccatgtaatcacacgcaggataagaaacaggcattacctacacccaggagtccccttcatgcctccttccaatcacacactcttgctcctctgcaaaggtaaccactgctgtgacttctaaatcacagatgagtttgaactacgtataaaaatgggatcacacaattctttcgtgtctggcttcttgtgttcaacatgtgtataaggatcatctatgttgttgtgcatggctttaatttgttcatttccactcctctataatattccattgtatgaatatactgtactattctacagtaactggacatttgagctgttccagtttatggagctattacaaacactactatgaacattcctgtatgtctttttgtatatatgtccaggcattggcagtggggaggtaaagctggggggtggttatatgtttaggagaactgctggatcataaaatatgcataatatatcccacttagcggtcagtgccagtttcccaaagtagttgcatcaatttatactctcacttcagtgttcaacaagttcctgctacttcacacttctttctatgtttattggccatctgggtatcttctattctgcagtgcctgttttttgagcattttatattttggatataaatctttagtattgcaggtacattaccctataactgtcttctgatgatccagtggttttaatggctttttttgagacagggtcttactctgtcacccaggctggagtgcagtggcaggatctcggctcactgcaaccaccacctcccagattcaagtgatcctcccacctcagcctcccaagtagatgggaccacaggtgcacaccaccccgcctggctaatgcttgtatttttttgcagagatgggatactgtcatgttgcccaggctggtcttgtactcctgagctcaagcaatcttcctccctcttaatggccttttaataatccaaagtttttcattttaatgtagttcactggatcaatcgttcctttgtggttagggctttttgtgtcctatttaaaatatctttccctgtctcaaggttatgaagatattcttctatattatcttctagaagtgttatttttttaccttgtacatttagagaaaaaactcaatagtgaattgattttgtatatggtatcttgaggtagtgatcaaatttcattttcttctgaaatggatatccaattgactgagcaatgcgtgttgaaaagaccatcttttacctgccgctctgcagcgccaccttggtcttacatcaagtggccacatatgcttgggttgtttctaggatctcttattttattaggatatctgtctgtccttgtaccaatgcctcactgtcttaattactataggttttacaataagtcttgctggtcattaaagtctttccatcatactcttcaagacagtgactttcggaattaaaatgaaattattgggttttgactacattgccctggatctatgaaattaatgttgctgtaaaaaacacggggccaagggtggtggctcgtgtctataatcccagcactttgggaggccaaggcaggtggatcacgagctcaggagttcgagaccagccggccaacatagtgaaacctcgtctctactaaaaatacaaaaattagccaggtgtgggggcggatgcctgtagtcccagctactcaggaggctgaggcaggagaatcgcttgaacccaggaggcagaggttatagtgaacagagatcgcgccactgcattatagcctgggccacagagcgggactccgtctcaaaaaacaaaaacaaaaagcctgattaatggccgggcgcggtgactcacacctgtaatcccagcacttcgggaggccggggcaagcagattatctgaggtcaggagctcaagaccaggaggccaacatggtgacaccccgtctctactaaaaatacaaaaattagctggatgtgatggcacacacctgcaatcccagctacttgggaggctgaggcagaattgcttgaacctgggaggcaggggttgcaatgagccaagatcatgccattgcactccagcctgggcgacggagcgagactccatctcaaaaaaattaattaattaaataaaatatacatatttattatctttcctgcctataaaagtaatgcatgttttttgtttttttaaaaatcagagaggccgggcgcagtggctcacgcctgtaatcccagcactttgggaggctgaggcgggcggaccacaaggtcaggagtccgagaccagcctgaccaacatggtgaaaccctgtctctactaaaagtacaaaaaaattagccaggtgtggtgatgagcgcctgtaatcccagctactcaggagtctgaggcaggagaatcacttgaatctgggaggcggaggttgcagcgagccaagagcacgccgctgcactccagcctgggcgacagagtgagactctgtctcaaaaaaaaaaaaaaaaaaaaaaaaatcagatatagctgattttttatattatataaattattacatttattacataatatttgtatttcctttttatagtctttgcctttattcctactgtttatcaggaattctaaatgcattaaggaaattagctcttgtaatatataaaaatgtataaacacaatttcccactttttcttctgattttagaacactctgaaaacactttcctaaaatagtctttcaaaataaagtattaataatctgtaaaaggttatttaaaatattttaaagactattactaaaataggcattaaatcaagggtgactagaggatgatataaaaggtggatttataatttaatttctactcatgtttggtgtcacttaccattttttttctcttgtcgaattatattatgacattctgcatgtaaaaactgtaagtggtctgctaccattcgttgttgacattcatgaatcaccttagtatatgaacttggatgtaggtattttcgacatcgaatttcttcatcttttaatctacctagaacctataaaaatattttcttacagtcatgaacacaaagttttactatgaggaaaaatctgtaatatcagcaagtaactcagccaaattttaatggctgaattaaacatggcaaaggtaataagggttacataagcaatttaaacccacattctataaatcatttcaaatttttatttaagctactagctgtcatctacattccaccagtcttataagcaagaactaaagttaaatagtctgcattttgtcttcatttacctacaccattcatcctattacatggacaacataacatgtaacaggaaaagtgggtacagatgattaaattcagaacaggtgatctctgttatgaataactatcaaactaaaaaataaattatattgaaatcaagtagatgaatctaattattttacgttggtttctcttcttgtaaatggaactgtatgtgcatgatagttaactaccatattaaagatttaattaaaatttttgaaagtaggggctggacatggtggctcacacctgtaatcccagtactttgggaggccaaggcaggtggatcatctgaggtcaggagtttgagaccagcatggccaatatggcgaaaccctgtctctactaaaaatataaaaattagccgggcatgcctgtaatcccagctccttgggaggccagggcaagagaatcacttcatcccgggaggtgggggttgtaacgagccaagatcgcaccactgcactccagcctgtgtgacagagtgagacactgtctcaaaaaaataaaaataaggccaggcaaggtggctcatgcctgcaatcccagcactttgggaggccgaggtgggtggatcacatgaggtcaggagtttgagaccagcctggccaacatggtgaaaccccgtctctacaaaaatacaaaaaattagccaggtgtggtggcaggtgcctgtagcaccagctactcgggaggctgaggcagaagaactgcttgaacccaggaggaggaggttgcagtgagccgacatcacgccactgcactctagcctaggcaataagagcgaggctctgtctcaaaaaataaatataaataaaaaataaaaaatttgaaagtaaatataatttagtcatagtcaagtatgtcaatcaagacttttattaaagtttatcctacataaagcgctgagctacaaataacactggttaatatcaacaagaactagcccataaggaaaataaccaaagaatttgactaatttctgtctcaagacaaaacaacaacatatacacagacaaatgcaccggcttggaaacactctggaacataaagctgtgtaattagagtttctgaaattaagtgttcccggggaactacatacacctggcactttggagagtgctgctgagttggcctgggcacaaggagtgaaaatcattcctggaaagcggatcagaaattttcaataaaaatgaggctccagacagtaggttcccacagtcctgtctttcctattgtgcgaccctttgaagccaggagttcagggcaaagtcacagactcaggtcgggcaagaaggggtctagagcagcagtccctaaccttttaggcaccaggctctgcttttgtggaagacaatttttccacagacggagtgcgggcggcattggtgggggcaggtggcttccaggtgaagtattccacctcagatcctcaggcattagattcttctaaagagcgcacatcctagaccccttgcatgcagagttcacaatggagtttgcgctctgtgagaatctatgagaatctaatgctgctgctgatgtgacaggaggcggagctcaggcagtaggtaatgctcacacagtggctgctcactccctgctgtgcagcccggttcctcctaacaggccacaggtcagtactggtcctccccagttcctaacaggccacaggtcagtactggtcctcagcctgagggtcagggacccctggtctagaggacaaaagtgttcaccacatattacatcagctaagaaaggcactttgattaacaataaatcctttaagggctatttttataacaaaaaggattaagtctattagtcattcagagcatactatagtgactttaatctgcttgccaagttaatgcaacaggaattacagtgggtctgagagaggtgaaggaggatggaagaaggaaaaaataaaacaatgataacttgggagagagaggcgcatatcaagagaaatgtagagaaggttggactgccccagtgcagggcttcaaacagctgtaaaacccctgggggaaagaaaggccaaagctataagaggaacgcagcaaggaggcaggaaggctgtactgactcattccccaattaactaaatggagagcaaagcccagggttttgcccttgaagctaatatggtccaacattatttcctgaaatgagcttttctttttctttcttttgtcagacaggatctcgctctctggcccaggcaggagggcagtggtgcaatctcggctcactgcaacttccgcctctcaggctcaagtgatcttcccacctcagcgtcccaagagctatgaccagacgactacaccaccatgtgtggctagttttttaattttttgtagagatggggttttgccacgttgcccaggcttgtcctgaactcctggacttgcgtaatctgcccgcctcagcctcccaaagtgctgcaattacaggtctgagccaccgtgcccagcctgaaataagcttttctaataaacattcttttccaaacataatttattccaatgtccctccttcccttttaacaccttgagatgtaatttacatattaaataattcacccatttaaagtgtgcaattcaatggttttggtatattacattatcaatgtttttaaattgtggtaaaaacatagataataaaatttacattagccatttttatgtgggcaattcagtggcattaaataacgctcactatgttgtgtaatcacccccattgtctacttccaaatatttttcattaccccatcagaaactttataaccattaagtaacaactcctcacatcctcctcccctgataacctctaatctatcttctgtccttttgaatttgtctgttctagatatttcctataaattgaaccacagaatatttgcccttttgtgtctgtctttttccacttagcataacattttcatggttcatccatgttgtatcatgtataacttcaattctttttaaagactgtgtggtgttgtgatatgtaagtacattggttttcatctgtggttcctggttcataactcccttagccctagttacagtctttagttataatgttgagtgtgttaggtctcaggaaacagaatttctctcctactctcctttcacctgcctcaaggcaggactctaatcttgccctacctttctgactgtgggtcataagaccctccccagagaaagccccaccctgtacgctgggggaaagactactgacatcatgaagcttccacaaaaatccaagaagactgggttccacagggatagaagctcctgcactcatggtgatttcagaccttcccttatgtgtctcctcaagtggttgtttatttgtatcctctaaaatatccttcttaatgaactagtaaacattaagtgagtgtttccctaagttctgtgagctgctctagcaaattaatggaacccaaacagtgtactgtaggacttcaacttgaaagccagtcggtcagtagtccggaggcccagacttgtgactggtgtctgggggtgtgcagggcagtcttggagactcagtccccaaactgtgggattagccactatctcaagtagatggtgttagagttgaactggaggacacctagctggtgtctgctgcttggtgtgtgggagaagagagccacacctttgtttacagaagccttctgtgctgatgattgttgctgtggtgtgagagtagaggaaaaacatggtttgagagagtttttcactacacacgatgaataatattccaatgcacatatgtatcacattttgcttattctttcaacttctaacagacatctgggctactgccaccacttgccagtggcatatttttgacagccagacagagcaaagtgcatgtatcacagataatctgtgtgtgattcttggggctggatctagaggcttcaacaaaagtctaaggtgcaataagggctaagagcttagaaccactgatctagtgtaacctgaacttaattgatgggggaaaagttccagataatttgctcaggggacagagctaactagtaagaaaagcaggaagataatcaaacaactaagacctctagatctgggctttgtggatgacacaacagtgtatcggtaagcacggatgctttgtgacttgtggcctagggatgtaggatgacagctcacccacttaaactactcgacctttcttggctacataaactaacacaaaccatcccaaaataaaatgcttgaaatccaacactgcagatttaaaaacctggctagaagttctaatatatcttacatatggtggtttaatttgtatgaacacttttttcttctactactgagaaaataaacatgggatttaacatatgataaccaatatgtactggtttagtgatcaattaaaatttcttggctgggtgcaatggctcacatctaaaatcccagcgctttgggaggctgaggcaggaggactgctcaagttgaggagttctgagaccagcctgggcaacacagcaagaccccatctctataacaaattttaaaagttgctgggcgtggtggtgtgtgcctgtagtcccagctacttcgtaggctgagacaggaggaccacttgagcctgggagccatgatcaagccactgcactctagtctgggcaccagagcaagaccacatctccaaaaaaaaaaaaaaaaaaaaaaaacacctcacgtggggttgtctctcagcctttcaagaacttaacagaccaaaagagtgactcatccaaatgtctagaattactatattttcctcatatttttcctctcattttaaaggaagaaaaaaacctcaacacagagcttctgcacttatcctattctctaaactaaccactaagcatgaaatccagtataaactgattattctgccaagaatgtgcatatatattaatttcaaggacaagtaaaccaagcagtcaggatttatcaaaaagcatcaattatgatgaaaactggaagggtattgtaaagagcaatgacttatcaatcgatattatataataactgtaactcagagttaatgattaaatagattaaataaacagaatatttttccaccaagaaacaaaacaagaaaactaagaacgatgttaaataaaaccaggccagatacaaaatagataaatgtattcgatatgttttatttcttaccttttccatatactgtgagcagtttgattcttgtaataaatttgaagcttcttgtttgtaatactctcctgtttcagtcagaaagggagactcaaaaatttcctgataaaactgaataaatcaattacatcatattagaagaaattagaacaagcagtttaagaaattaacagtctgattatttgtttttaaaggaggctgtttacctttaaggggaattttttcttatactgttcaacatgaacaaaggagttaataaccccatggattactttctggtttgggtcttctccaccacgatcactaaaacaaggtataacacaaaatattcttgagaatacaaattatctatggaaatatacccaaaatatgccaaaatatggctccttattctattggtctaatcaaagtgtaaagaactataaaaaggtacatgcatgaatcttaacaatgattttttttatatcacagctgagttaatattcatgatagttaatgtatacattagatgtcatttcaagaaataaaaagaaaactgattgtaaagttcaagatactatgtcagtaataagataacacttctttaattttaacaaagtagatacgagcccatcaattcaaaactttaatactggcggttaagaatgcttgattttcactcactacaaactacaaagtcttaatcatattaagacatgtaggtgaaatgttagcttttctaataaaaggaatatgaaatagaaccaggcaccgtggctcgtgcctgtaatcccaacactttgggaggccaaggtgggaggatccctgagtgctgaatttgtgagctgcctgggcaatagagcgagacctcattcaaaaaaaaaattagccatgcatggtggcacacacctgtggtcccagctactctggaggctgaggtgggatgatcccttgagtcctgagtttgagactagcctgggcaacatagcaagaccccatacaaaaaaaaaaaaaaaacaacttagctgtgcatggtggcacatgcttgtggtcccagctactctggaggctgaggtgggaggatcgtttgagcccaggaggagtcgaggctacagtgagccacgattgcaccactgcactccagcctgggtgacagagcaagaccctgtctcaaaaattaaaaaataaaaataaaaataaaatagaaaaaaagtttgcttaaagccacagtaaaataatctagctctaaattgggattttgtgactctagtaccaatgctcaaatcaaaccattatggtttacctcactacacactcttccaacctactttaaaataatttcttctttgcattaataatgtcacaaagagagcaacagaaaacttattatcatcattccctagtaagagcttgttgctctatatataggatgtaagaattttctatcattgaagaaaagcatcaaggaaaagcatccaggcaattacctttacatactagagtccttccctgcctctgaacccctctagtcctctttgattcttcctttaattatttggatattctgagaactattttttggacatgaattaatatggctacagtaattctgtcagtcatagagaatcttgatatcttgatatcactgactagttcatataataaggtcacacatgtgagctcatttccttggcttgggtcacatgcgtgacctcacataagcccacattcaatctggtgagatactgatctgaactgttacctattttctcatgttctgcttatggtggaagaacagatactgtggaggacatactggcaaaactctaagtatacacaccctatgaccccaagcaaacatctacatatgtgtacaacagaaacaagagtggtgttagtggaaaaactggaaggaacctaatatacgccactaggagaagagtttaataaagtgaggtaggcctctctagtttaagtctgagttcatcctggtaaagtttaaaaagctaactggtcacctaaggatgacagcaaaccaactcattatcttaaaaactgggttattggccaggcgcagtggctcacactggtaatcccagcactttaggaggctgaggtgggcagatcatctgaggtcgggagttagagagcagcctggccaacatggtgaaatccagtctctactaaaaatacaaaaattagctgggcatggtggcgcatgtctataatcccagctgctcaggaggctgaggtaggaaaattggcttgaacctgggaggaggaggttacagtgagccaagatcgtgccacggcattctagcctgggcaacagagtgagactctgtctcaaaacaaaacaaaacaaaacaaaacaaaacaaaacaaaaacaaaaaactgggttattaaaaaggaaagaaacaaacagttattttgcttttcctatatgaactctaccattgggtaactaaacagtaggtgagaagaagcatatcttgataaaattttccaggtaataaagaagaacaaaatgatagatggctctaacaagcagctctataatatgctgactaaattactaatttcttcatttcctttaactgacattcccacctagaaaacaattttaaatatcaggaattctattcactgtaaaagaaagatgtggctcacatcagaaaccctacctcaacctccatatttgcttaattctctatgatagttcctcaattctgtgagtgaacacattagattacaataaaaaataatttggttaaagatttctgggccaggcgcagtggctcacgcctgtaatcccagcactttggaaggccgaggcgggtggatcacgaggtcaggagatagagaccatcctggctaaaacggtgaaaccccgtctccactaaaaaaaaaaaaaaatagccgggtgtggtggtgcgcgtctgtagtcccagctactcgggaggctgaggcagaagaatcgcttgaacccagcaggcagaagttgcaatgagctaagatcgtgcaattgcactccaacctgggcaacagagcaagactgtctcaaaaaaaaaaaaaaaatacaggcataaaggccgggtgcggtggctcactcctgtaatccccacacttttggaggccgagaaagttggatctcttgaggtaggagctcgagaccaacctggccaacatggtgaaaaccggtctctactaaaaatacaaaaattagcagggcgtggtggtgcccagctactcgggaggctgaggcaggagaattgcttgaacccaggaggcggaggctgcagtgagctgaaatcatgtcaccgcactccagcctagtagacagagtgggaatcctgtctcaaaaaaaaaaaggaaaaaaggacaggcataatgaattcagagttagattagcccagatgtgaatccctagaattattattagatggaggctggagtcaaatgatctgagtcagatcaccaccattgacttttgcatgtcaaggatgtcatgcatgtaaaatggtgacactaatagtattagccttccagtgttgtgaggattaaatgggaagatggatgtaaaatttttagcacaatgcttggtatgtagttcccatgtttaatttctattattaatatgccttagtttccttaactttaacatgcaaaactctaagagagctgtcatgaagaataagtgagatcttagtaaagcatgtgaaacaatgctttaatggaagccgattataacaacaaaaataagacaagcagaccagataatctatcttttccagaactaatatgctttagttgtattatttttcttacattgtttccttcattttttatcatattgatttttagcaaactaacaatcacactaaaaatttactaggttgggacaaaattatattaaaaaagatatttcacaaaagtacatttagaaagtataacagtattgtcattatacttttaaatacttgaattccaagtcaaaagaaaagttagtatattttagcaggagaaattatattagaacttagaagttttgttgggagtgttcttttagttcacagttttgtaaagaaaagaggaagaaaaacaacgggttacaccctactgcttcagtattgcctttcctctccagctctctatctctaaaaacaatggaatcactcaaacggtcagtgacaatttttaaaaatcaagttactagttgttaccacctactttctattgggtatcaaaaatttaaaaatattctcttatcttcttatgtgaggcataggggtgggtgtgtgtgtttaatcccttacttcctcccaggagtcccatactaaataccacggctttgacaaagtattcctcatataaaaaaaactccttatttaggtcttcttgatgagcacagatataggtggagtggccattattacactacaattcactggtctagataattcctataacatcagttccagtaacctggaatttactggatatatatttgtgtgactgacagagtgcttctgagagtctttgagccagagctaatccaaggatgttctattctagactccacaggaaaatgttctttgtactaaattgtattcacacagcactagggtaaaaagtgttaaccactctgagccatgggtagagtgggaaaccattttcccataaatttatctcacagaattaggcaagttattgattataacactgaggctaagaggtagccaactaactagaagaatgtcttcctcaataggtggtcctcacgaggatttaaacaggtaatatgtacaagcaactcagggcactgcctagaaagtctaagagttttcagctctgaaaagcaataagtcacttccctcagatacttatttatatactaagcatattagggtataagaaaagaccagagctccccccaccaaaaagaaaaaaaaagaaagaagaagaagaagaagaaaataaaacaacttaaaaaatgctggcattggaagtaaaatgaggctcattacagtaaaaccagccccaaggctagtcactggctctgcaattgtacactattttaaaaccatatcaaacaacaaaataaaattgactcagtaagataaatgtcagcactcactttttgatttctcggagcagcattcggataaggatggcctgaagtggttcaaccatcaatttcctccacatatccaatgctagctgccgggaaaaacgaaaatcatcagggctgaattacttagtatatgtttaacatttcctcaaggttttttttaactaaaaatactcatcaaaagaagtatttatactaatacttcaaaattcaaataaaacctgaacaaaaatttaaaaactcaaagaaaacaaatttctaatttgaaatatcagtgaccactctactagccttatcaacattaaggttttattattagttgaaaatcttaagaaataattgattattataaaaccttaatttaggccaggtacagtgggtaacgtctgtaatcccagcactttgggaggccaaggtgggcacatcacgaggtcaggagatcaagaccatcctggctaacatggcaaaaccctgtctctactaaaaatacaaaaatgagcctggtgtggtggcatgcgcctgtaatcccagctactcgggaggctgaggcaggagaattgcttgaacctgggaggtggaggttgcagtgagcccagatcgtgccactgcactccagcctggtgacaacagtgcgagactccgtctcaaaaaaaaaaaaaaaacttaattttttgattgttaaaatgctcaacactataaatgggctatagatacctagaccgtaacagaaacaaaggatttatgttaaatgaaataatgtgatttggctgtagactgatttttttaattatgaaaaattttataccaacataaaaagagcaagtcggttaaaagagtaataaaacattcctgtattcactacccagtttaagaaatacaacttcatcattaccattgtcccagatatcctcctcctttcccctcaggttattacaatccacaattttgtgaaacccatccagtggaaacatacagccatagctcaatcattggcactgctatacagcatcctgttgcataaatatgccatgatttatttttccactctactgctgatgactgctgatgtgtctgtgattcctattttctgctactggaaacaatgctgtgattcctgtatgcatcatttggcccacataagcaacagattctctgatatacatctacaagttgagatcctgtactgaacaatcaagtgctcatgcagctttactaaatcaagccaaatgattttccaatttatacttgcatagcaaagcacaagatttcccattagtccccatccttgacaacaagtggtactgccaggctttagtcaaattttgccagtctgctggacataaaatagtgtctccttggccaggcacagtggctcacgcctgtaatcccagcactttgggaggctgagacgggcggatcacgaggtcaggagattgaaaccatcctggctaacagggtgaaaccccatctctactaaaaatacaaaaaattagcggggcgtggtggcgggtgcctatagtcccagctatgcgggaggctgaggcaggagaacggtgtgaacccgggaggcggagcttgcagtgagccgagatcgcgccactgcactcccgcccaggtgacagagcgagactccgtctcaaaaaagaaaaaaaaccggccaggcgcggtggctcacgcctgtaatcccagcactttgggaggccgaggcgggcggatcacaaggtcaggagatggagaccatcctggctaacatagtgaaatcccgtctctactaaaaatacaaaaaattagccgggcgaggtggcgggcgcctgtagtcccagctactcgggaggctgaggcaggagaatggcgtgaaccggccgggcggagcctgcagtgagccgagatcgtgccactgcactccagcctgggcgacagcaagactccgtctcaaaacaacaacaacaacaacaaaaaatagtgtctccttgtggttttaactctcattttactgaatgaagctgggaattctttaatgtttattgtccattttgggttcttccctgtgaaacgcccattcctaattttgcccgttagtctgttaaagtttgtcttgttcttaataaaagctagagttttttatatattgtggaaattaatcccttgaaagtttcacagtctgtcccagtaaatcaactgctcggtttctttattgtgttttggtaaaaatatattaaagtttaatatactcaaatttaccaatcttctttatcatgggtattttttaagaaatccttctctgccctaaggtaataggcatatgtgtggtcctactctgccttccaagttttcaagctttgcctttcacatttaggcctttaaacttcaaatatattttccccacatagagtataaattattccagtactgaaaaccaattttttgtttgtttgactcttctctttttccaccctaactacatccagataggctgttgctagcctccctattgtttccctagggtaattttattctgatccattggtaattaagcatctgtcttcccacaaggaacactgttcaagttttgcctttctttcttaatagcatgaatgggggttggggaggcaatacatgaaaaactggtattttacacatgtggtggaagggcaaactggtaaaggcccttctgaaaggcaatggggcagagctgcgaaacttcaggatgtgcttcgacagaggctccacttcctgacacccagtctataaaaagttctgctcatgtaccaagagatacacataaatataactccatgagcataagatttttctctattttgttcactgttgtattcaacatatataacacagacgggttcaaaaatacttaatgaatgaataaatgaatagtggtgttcactgcagtgttgtttgtaataacaaaaaattaaaaattggggggcgcggtggctcatacctgtaatcccagcactttgagaagcggaggcaggcggatcacaaggtcaggagatcgagaccatcctggctaacacggtgaaaccccgcctctactaaatatacaaaaaattagccgggtgtggtggcaggcgcctgtagtcccagctacttgggaggctgaggcaggagactagtgtgaacctgggaggcagagcttgcagtgagccaagatcacaccactgcactccagcctgggtgacacagcgagactccgtctcaaaaaaaaaaaagaaaaaaaaaaattaaagggatagtttaaaaaattattctgtatctctacagaatattaagctttcacaaaaaacaaacttatgtaaaaagacagacagtaacaaataacaaaaaaaaaggcaagaaatataggctgtagaactttatgtgtgccgttttatcgcagtttgaaaaataaaatcaaaactgctgtgtgtgtgtgtgtttatgtaaatatttataaatacacaggtaaagttcagaaaagatgcgaactaaattgtttacagtgattttctgggaagagaagtgtgcttgacagtgctggtgataagggaatgatttattcacttacaatgctactaactaaaagcaactactgttaatattttggtatttctcattgatctttttctctatatcatcttttccctataattgtatttgtattcaacatatacctataattttgtgtccaaattttttcataaacaatgtcccctttgttaaagtttctatgaacaattttctgctattaatttatccatttgcctacttttataacaaaatcatatcatatataatacattcttcttccatgctttttattgctgaatgttggatgctgaaattttacactgttcagccattaggcaccctattaacaatgattgcaaagaatacttttaaacattaaactcttttctaatatttattattttccaagtatggatcactaggcttaggacttgggattacttggtcaaaaggtattaagtattttaaactgtactgaaagaaagacactgatcaatttctttcggaaaggattacactaccttaaatgtctcctaatgctgcctcttagcctgtttatttccttcattaacataaatcacaagttaacattaatttcctatttggcatctgcttcccttacatgaacttacaagcttttgtgtgcagggaccttctgtctgttcaccattgtatccccaatgcctggctactcaataaagatgtattaaatgaataaacaagcttgtacaataatacttctttcacaatcagcataattttccatattttaatttgcactgtacctcaagaacttgaatggaccaaactgcccatttaattgtttcactctgaatttaattacttttaaagtaaagttacaataaatttgttgtatccataaatttgtgtttcctctcctctagcctgtcttttaagtacttgtcccctgcactttttaactacagggccgtcaacactttataattgtttctgagttttttcacaatgcagaaccattaactctatcattcatccattataaatttaattatcaaaagagtagttgtcacatctttttcgttcctgaggattcttaggaaatcactatagcattttatttaggatcttttaaatcttgaccattttaagctagccaaatcagtgtccttaaaaaatgatgtgcaatcaaattacctcagtgtataaaaacatacttatgtttgctagtcacttaaagaatgtcctacctctcctatttccataagtggttcattcatatctacaccaccatagccatactgaaggtccgcttctgttaatttattctttttaataaactgggtgttgagatacctggaaaataaatgtaatatcaatggatattaagttaaagtcagtaggaaagcaaatgacttgcaactttagaagaatatttttaagattacatataagccatggaatagcctactaacaaatccaaaagaaatgaattatgtagagattagaaatataataaaaattaaaattatcagcccacctttctctgcaagcccttacaatacccttctagcccaacagctcttatccaagtttcagaatttctataatctcgtttgctacttcccagactcttcttgggaaagtcaagataaagtccactttccaaaaattaaacagagaatggttaaaagataaaagtcaagttagctttctaatttatattctaatcaccaggaagaaatgcaatttttcatttttaaacaaaaaagatcacaatcagtaggtaagaaaatggaacacagtgttacagatagtaagtatgggcaagattgacagatacaagatgactttgtctaccagaggaaaatgaattatactaaaaatgtttaatatatttcaagactaatatatgtgattaactcagaataactgagatgaatacagaaatctaaaataaaataaaacatggagaaaggactcgtaatgttcaactgtgtagtttttaggattccagatttcactataatgcctttaaacagtcaccacctaaaactattcatttgaaaggttctgctagtgtaaatagctactgacaatacaagtattttaggcaacaacccatgaaatctatacatgaatatatacacttttcaaaattcactacaccaaaatgaagggtccactcagcatttacagacaaattaaaaacgaagacaaccaaaacaagacaacaattttgggaaacaattaaacacataattcctggccaggcgtcggggctcacgcctgtaatcccagtgctttgggaggctgaggcgggaggatcacttgaggccagcagtttgagagcagcctgggtaacagcgagactgtctcttaaggaaataataataataactcctagaaaattgactccaaagtggtatacccacaaccatttacacaagctccatctccatattcactagtcaaggctctagactccatggcttacaaccttgatgtaccatttgatattttagtgtcctctgaccataagttacaagatcatactcttttttttcccctttaaaatgccatttattccttcctctctatcctcactgtaactctcaaaatttcatgctgagtttccaaccatgccttccagctaaggaaagaggaataagattgagagacaaaagtaaaaggtaaagaggggatggcctctccacctaagtgccccatcccagatattctgagggtagtcagtcccctttcatccgagtctcagcacagacacacctttcaggtgtgccctgaaccccagaggagttagccttcacttcccagccctaagcaagtaactatttaacgcacaactgttttactttcttcacagtaattgctactatatgaaataatcctatgcttttattggtttctttttttgtgcattcatcttctctctagaatgtacagtatacaaagcaagaacctcctcttgtagacagcatccacagtagtggcaggcaaaagtcaagtcctcaaaaaataattactgaataaataaatggataacattccagacagcaaggatagcaaaagctaacagtagaacacaaacctggaaaagcagcctgcagccagatcataaaagccatgaataccaggaaataaaagtaatcactaacatttattgagatcacctgtcagacacagccctaagcattttatgtggctgaatactataagacagatgtatgtggtactcctatgatcattttatacataagaaagctgcagcctagagaggttaaagagcttgccaaaggtcaatcggctcctaagtggcagggctggcacagaaactcaggagaggtcttccactcccattcaacatcggctgagggtatatcgtgtgccaggtcaacatgaggcactggaaacacaaagatgaaaagcaaaaatatggtctctgcccacacagagctcactctgtggtacaatatacaaacaaatataagatttcgtcaggagcggtgctccctcagtagagggtacttaattgtcatattaccatttacatatgccttccaatacggaatctgctccaaaccagttttcttttctggtcactggcaccaagaccattccagtaacctcgcctaaaacatcagaatcacttatctcatccttccattttgcctgctttaatcagtcagtcttcctgtcttcctaaagtatgcatcacttcctctcactacttcctttgacttccaatctacttgctgaccctctgccccgattatgtggaacacttttatgactgggctctacttcagtttctggcatctttaattcatctaaaaattctgctgtcaggatgttactttcctattcagaattctacaggagcttcctttacctacataataagtgtaaactgcctagcatagaagcagatgctaaatctgcagatcaggcctgcattcactaatccattccaaagatctagatgtatattcttgagccaggtattgatttagtgcagctttacatgctttgtatctgcaaagacaaaccagtattatcttttcctcacagaataaaatttaaactaacttacattaactatgtctttcttattgcagatttttactcttggtaaatttaagcttgaaatacaatgttttaaaataaagtcatggccaggcacggtggctcatgtctgtaatcctggcactttgggaggctgaggcaggcagatcacctgaggtcaggagaccagtctggccaacatggtgaaaccccgtctctactaaaaaaatacaaaaattagccaggcatggtggtggttgcctgtaatcccagctactcaggaggctgaggcaggagaatcacttgaacccaggaggcggaggttgcagtgagccgagatcgtgccactgcactccagcctgggcgacggagcaagactccgtctgaaaaaaaaaaaaaagaaaaaaagaaaataaagtcacaatttaaaatataaacagtgccatttttcattttaatatggacaccattcttattttataagtcactgtagtattttacaatcaaatttattaaccacatatttgcttcttaataaagacatgggctggacgcagtggctcacgcctgtaatcccagcactttgggaggctgaggcaggtggatcactcgaggtcaggagttcgagaccatcctggccaacatggtgaaaccccatctctactaaaaaaaaatacaaaaattagccaggtgtggtggcgcgtgccagtaatcccagctactcaggaggctgaggaaggagaatcacttgaatctgggaggcggatgctgcagtgagccaagattgtgccactgcactccagccggggaaacagcgagactcggtcccaaaaattagtaataaaatttttaaaaaaagaacatttatgattcatgggagaaggtctaaatatcattatgaacaggtgattagaagatgctgattctataaagggaaataaaatctcaggattcccaaaactcctatgccaaaacaggaatttaaccttggaggctgagtcatgctaaatggccatcctcttcctggacgaataactcttacaagtttgtgtcgaaacattatatattagccagacccccgtggtaaggcaaaaagcctcagccatttcctgatgactaacccgcctcaaaaagtcactcattcgtaaattctttgctagcctcgaaaccattaaaatgtaaatcctcccataacacaaggacaggtccattgtaactccagatctgtagtctaaagtctagttcctaaaacctaaggtctgctagcatccacctgataagtgtcgattcttagctgataattcccaggcacagagcaaaggcaagatgagagtaatcattccttccctgagatgtctgcacaactgttttcttcttctatttccttttgcttcaaaggtttatcttatataaaatgtagatttactgggcattaattagtctcacaagtaggtaaccatttgcctcactgccaccacccctcatgttttaaggaaaatgtataaacactaaccctcctaagaacctctttggacaaaacagccacagatgcatctgtgccttgcgtttttcctgggagcatccttaagctagctcaataaaccttgattgagacagctgcctcagtcactcaattcagttaacacttccaaccctcatggatgagttagggggtcaagacttcaggggaggaagtgactggaggtgtggtggaaacatcaagagaactcagaagtggatcctgaagatgggactgaattgctgcaatctcatgatataacttgaatggataaggagttgcttcttatggatgagaaagtggtttcttgagacagaatctactcctaataagacggtatgaacattgttgaaatgacaacaaaggattcaaatattacataagcctagctgataaggtggtggcagggtttgagaggactgactccaatttcgtaagaatttctactgcaggtaaaatgctatccaacagcattgcaccctagagagaaatcttttgtgaagaaagagtcaactgatgcagctaacttcattgttgtcttattttaagacattgccacagcctccccaaccttcagcaaccaccaccatgatcagtcagcagccatcaacaccgaggtaagaagactggcaaaaggattacaacttgctgaaggctcaaatgatcaacagcattttttttagcaataaagtaattttaaattaagttgtgcacatttttttagacaatgctactgcacacttaacagactacagtatagcataaacataacttatatgcactgggaaaccaaacaacttgtgtgacttgtcttactgcaatattccctttacatgtggtggtctggaactgaacccacatcatctccaaagtatgcctgtacaagaagattgagaatagaatctacttaagtgaaataccatgtttctggaacaagattatggtagaatgaagtggttaaatggatgggctttggattcagactgatctgggtttaaatcctgcctttgtgattcattagctgagtgaccttcaacaaaatcatgctctcagcattgctttcttcctctgtaaaaaacagagatactaactaactcatatcattttacacacacatacacaaacacatattaaataggctgcaacatttactaaaagttcacaaatagcaccaatttaatagtactaatttagccaggcacagtggctcatgcctgtaatcccagcactttgggagactgaggagggaggactgcttaagctcaggagttcaagaccatcctgggcaacatagtgagacagcatctctacaaaaaatgaacaacattagccaggcatggcggtgcacacctgttgttccagcaactggggagaagggtgttcgaggtgggaggattgctagggcccaggaggctgaggctgcagtgagctgagatcatgcaactacactgcagcctaggtgagatcctgcctcaaaaaataaaaaataaaaaaaaggacaaaataaaagaaagaaaaatagaaaaagaaagagaagcaatccaggcagatggaacagcaccaggaaaggcaggaagatgggagagaccatgggccattaggaaactacaagtaattcaatatgcctagaccatggggaatgcagaacttcaaggggaaaataacccagtaatttatctaacatcgtttgcatcaaacataaaatactgaatgctagagtcaaataagaacatatcgaggggacatgagctgagattttcccactaagtttcatgcaagttgaattttcacattgatctctgttgagattaaacatgtgctacaggttgtaaacaatcagaagaaacagagccatgcaatcgagtacagttttacttttcacagaacgttccacacactccctggctcctaaatacccaccttaccctgactatagacctttccccacagcagagaaaagtccatgtcagagagaatgctttagttttgcatatgtgaatgagaaataggcaataaaaaaattatcctgtcaactactgaatgcaggcaacgctgcttagcttgtctagattttaaaggcacactcacctatataagcagtccatatagtctgcacccttgctgtattcttcccagtacctatgatacataacaagtacttgttcttctgactccaaaactctctatataaagaggaaaaatatttttacttgaaaagcaataatcattttcactgtcaacaataaaatgtatcaaaattaatgttctaaaataatttacataattctagctgtacaaattacatttacacaacacatattaactacacgtattaaaaatgaaacaactgggaaagatgtgagtcttcaaaatgaaagtgaagcatccataatagagaataaactgagccgagcgcagtggctcacgcctgtaattccagcactttgggaggccaaggcgggtggatcacctgaggtcaggagttcaagaccagcctgaccaacatggtgaaaccccgtctctactaaataaaaaaaaattagccagccgtggtggcacatgcctgtaagttccagctacttgggaagttgaggcaggagaatcacttgaacccgatcgcaccgagaccccaccactgcactccaggctgggtgacagagcaagactctgtctcccaaaaaaaaaaaaaaaaatcacacttataatgtaacctaaaatataaaattgcaaaaaaattattaatgtcttacatagttatcacttatggtgttaaccaaagctcactagcttacaatagcagaactttaacatactaaacactttaagaccactttaacacacttgctatcaaaagcacttttataagcagataaatgatcacattagaacactaaaatgcacatgccatatactatcaaaagtagagcattttccaatattttcagggaaacagcacacaatcaattgtgccttacttatgagggttttttttttttttttttggtacaggtagtgtctcactatattgcccaggctgctcttgaactcctggcctcatatgatcctcctgcctcagcctcccaaagtacagagattacaggtgtaagccaccgcaccaggccagttcttaccatttaaaaaagtatctactcctgaccacgtgcagggttagacagtttaaataaaactgtgttgttttattcccattttatagataaagtcaaaactcagtccataaggtagttgttaagtgagttgcccgtggttacaacagctaataaaaagcagagtgaagattcttacgcaggcactaaattatctcatccagttcctgattagatcagtagtctaaattaagttggaaatgctgtctatagcaaaatactgcaaaattcactgtttatacacagatcatgtctgtgatgctgcccctctatgtacagcatactaataaaaaaactggtcacagagacagcttctatcaccatttaccatttctttttaattttagattttgggaagacttcatatagcacatgaaaggcagctaaaaagctgaaaataataaagacagagatttaccaagagataggaataaaaaacgagggaaaatttggctgtataaacactatccagaggacgtaggagcacattttaaaactcaacaaaccctgagctgaccctctccttcatttactaattacgagatgctgagcaagtaaactgatttccctaacacagtgcttgactcaaagatcttaatatgtatatatttttaaaatgctgattaagaagcaaaaacaagggaggccaaggccggaggatcactggagcccaggagtttgagaccagcctaggcaatatagtgagacccccatctctaccaaaaaaaaaaaaaaaaaattgccaggtgtggtggtgtgtgtctgtattcctagctactcgggaggctgaggtgggaggatcacgtaagccagggaagtcggggctgcagtgagccatgatcgcgccactgcaccctagcctgggcaacagagcaagaccctgtatttaaaaaaagcagcagcagcagcaaaacaagctgaccttgataaaagttctacactggaaaacagtaaactagtaaagtatacaactatcaacatatttatatcacgtatgtatcattgcttaccttatgcaaatgccgaacatgattttccaaaaaaatcttagtttctgtataaagtctttctccaaggggttcaggataggccacacataaagcatagatatctctagttaaattattaaggttttcatatttattggagacaattttaaaacataatgagatttaccttgtttggcattaaaaaatgaaaaaacatttctttttgtggtttagcttataatatacataatactgttgtatatatgacaagatagaatacataaccatgcttactttatctaagattcattcacttattcattccacaagtatttattgagaattatttgaagacactgtaaggaaaatggttcttatcagagaggttaaaatccagagggagtttctggaaaatcaaattacccagaatcctacaaaataaggtttatattagaatggatattagtatcaatagtatcaatgatattagtattcatagtatcaatgaagggctatggaatatgacaagaggcagacatgtctaagcaattctgagaaactaaacaaaaattattcatttgacacagcctcctacatcatagcagtcaggatactctaccgttattctatcagaagaaatataccatgaataggaatatcaattaagtttctgaacatcaactaagtaccttgctaagtctcaccggaggtagataacagaaggagtggaaagaagtaagacctgagactttacctttcactagccagtgatcttaaccaagtttcctagcctctctcgggtggcatttccttttttttttttttttttaatatcctttgctttattggatcttctcaacatctccaataattagaaacattataaaccaagaagaacaaaagataagacttaaggcaaagcccatttataactttggggccagacacggtattagattatgattctgggaactaggtgtttcatatgctgcctccaactactgtgacaaggcattttggaggtaacagctcatttgtccacaggaacaatgacaccagagcaacacagaggtcaggacctcctggtggttatactccagactgttccatgataaagctatgccatcttatcagtacgatgaccaccaccaagtgtctccaaggtaaagataatgaatctttccctgacatctccacaggtcctgtaagacccaaataaattcatatatgttaaagtactttataaactgtccatcattaaccaaatatagaagataaaggacctatgagcaacctgagaccagcctaactaaagatgcagatacaaactggaaataaggctgatgattcaggatgaagtcaggtattaaagtttaatagaaagattaggaaatactatgaaataaaaatgttaacttaaaaataaggatgcaaattctttctcctctatgtccccccgacacttcatatacattcttctacaaaatttatttttatacagtaaaatttatttatacttttcccaaccacattagcctattcttcatcaactccatactcccagctcccaggcatggttcctagcacttgatgatttattaaatcctgctgaaggaaaggagatgcaaaatcaatctcacatgctccatttacctagcatccttactccagaaagcgcaagcagccctctccacatttatttacttacttataaattttttatcagttctatttatatatttttaagctttatttatttatatttttacttgaaaaaatttttttgtagaaacagggtctcaccatgttgtctaggctggtctcaaactcttgggctcaggcaatccttctgcctcggcctcccaaagtgctaggattacaggtatgagccaccgctcaatatatccactgcatgtaaatgtaaacaaaatctactggaaggatttgtgccaaatctccagcttaaggagaaaggagctacacaagagaggtggtacagggagactctcccatttcattccatatacagtacttctgcactgttggactccttcagaatatacatatttttttaatgcagtgaatccaccttaataaaattttaaagtttatgttttaactcaccatagttttgggtctcaaatcactgtataattttaaccaattaactatgttctttttctctaacctattcaaatatccaaccaaccaggaaacgtttagcccttatgaagaacacctacgaaaatgagattttcaacctccaacactcagttatgacttgattatagacaagacactttaaaagacaaaaaatgttggctgggcatgatggctgatgcctgtaatcccagcactttgggaagccaaggcgggcagatcaccaggtcaagagatcgaggccagccatgatgactcacgcctgtaatcccagcactttaggaggccaaggtgggcagatcatgaggtcaggagatcgagaccatcctggctaacatggtgaaaccccatctctactaaaacacaaaaaaattagccggcgtggtgacaggtgcctgtagtcccagccactcaagaggctgaggcaggagaatggcgtgaacccgagagatggaggttgcagtgagccaagatcgcaccactgcactccagcctgggctacagagcgagactccatctcaaaaataaataaataaataaaaatttaaaaaaagagattgagaccatcctggccaacatgttgaaaccctatctctactaaaaatacaaaattagccaggtgtggtggcacatgcctgtaatgccagctactcgggaggctgaggcaggagaattgcttaaactcaggaggcggaggttgcagtgagccgagatcacaccactgcattccagcctggcaacagagcgagacaccatctcaaaaaagaaaaaaaacacaaaataactaggtcagatttcaacttaaacattctttcactagacttatcttttcctaagtcattttttagggagccagaatacaaaaactcctctatttatgaactttccagtttaaaaatgtctcagtcagaaactaagctgttccagaatgaaagctcatagctgcaaccaaaagacagtcctaaccagcagcaaagttacttattttatttcatgttctctattaaaaggtgtttcctacgcttggcttaattttgagttttaacagtatgaactctattatgccatgggtcaaaaacaatgagagttttgcaatgggaataaaaggaaaggttacctaaaaaaatgaaaatgtaagacaaccaaaaaaggatttgacaattaaaaaaaatatataataaaattaacagtaaaaaagaatttgctgactttttttttttttgagacggagtttcgctcttttgcccaggcagtgcggtggcgtgatctcggctcactgcaaacttcaccctccgggttcaagcaattatcctgcctacctcctgagtagctgggattacagttgagcgccaccatgcctggctaatttttttgtatttttagtaaagatggggtttaaccatgttggccaggctggtctcaaactcctgacctcaggtgatccacccgcctcaacctcccaagtgctgggattacaggcgtgagccactgcgccccgccagatttgctggcatttctaatgagaaagaatacagatgcagtatctacgaaatcatgcattagcaaacaaggataaaaaatgactaattaaatcgaaaattttcaagtgcacagctagtgaatcaatgagaacaaatatcaattagcctgatataatttagaatagggtcaggcagttgctgatgcaccaaatacacctgactatagataaaatcttttcccatctgtaaaatctaagaaagaatgatgggctactacacataatctccatggttactaagaccttcttcttctaacacttgtgaaaagtgtcaaggatacaggtacttgcctcaatatttttcaatgacatcaaaactggtctatgtttgaaagagatgcctgatagaatataaactagaaatgataggtgtggtagcgcatgcctgtaatcccagatactagggaggctgaggcaggagaattgcctcccggaggttggagtgagccaagattgcactattgcactccagcctgggcaacaagagcaaaactccatctcaaaaaaaaaaaaaaaaaaagaaatgaagacaacagtatgcctgggtttaaatggtgggaggatgaactcatattcctacctggaagaaatacgttgagggaaggcaatattaagtctcccctaacaatcattttggacttactataacctttagatgccacttctcctccagtaggaaaatgtctacattatgctgctggagtctggaatggaaatctgtcctaacagctactaaaagagagaaaaccttgagtaaaagtaaactagaacagggccaggtacagtctttctatttatacaaagtccaaaaatcaaagaattcaccattggccggtcacagtggctcatacctataatctcagaactttaggaggctgaggtggggggaatcacttaagatcagaagttcaagactagcctggccaacatggtgaaaccccatctctaccaaaaatacaaaaattagccaggtcatgcacatgtaatcccagctacacgggaggatgaggcatgagaatcacttaaacccaggagggggaggctgcagtgagccaagatcacaccactgcactccaacctgggcaacagagtgagaccctgccacaaaaaaaaaaaaaaattcaccattattgtttattctatttatataaagtccaagaaaattcaccatttaagaaccacaaaagggccggacgtggtggctcatacctgtaatcccagcactttgggaggctgaggcaggcggatcacgaggtcaggagatcgagaccatcctggttaacacggtgaaaccctgtctctactaaaaaaatacaaaaaaattagccgggcattgtggtgggcgcctgtagtcccagctactcgggaggctgaggcaggagaatggcatgaacccgggaggcggagcttgcagtgagccgagatcgagccactgcactctagcctgggcgacagagcgagactccgtctcaaaaaaaaaaaaaaaaacgaaccacaaaaggctgggtgcaatggctcacacctgtaatctcagcacttcaggagtgccaaggcacatggaacacatgagcccaggggttcgagaccagcttggccaacatggcaaaaccccatttctaccaaaaatacaaaaattagccaggcatggtggcgggcacttttaatcccagacactcgggaggctgaggtatgagaatcacttgaacctgggaggtggaggctgcaatgagctgagatcactgcactatgcctaacaaaaaaaagaactacaacgcactatgtctaataaaaaaaaagaaccacaaaaacaacaggcacaaaaatcaagatagtagttagctcctagagaaacgggtgggattgtgaacttagagggtcacgtgtttcgggtgggggttatagtgaatgtggacaatgttctattgttcaatgttctattgataatgtaattgcttgcattataattatttgtgcaaaggtgtattttatgaacttgtccatatttgtgttattcacactccccataaatgcatgctaaaagttcaaataataacacatatttgaaacaatgtggagggacctgttttttccttttcaaagtatttacattgtatggcccttaaaatttccacttaagatattaagggtcagaagtgaactttatattcttgggcaaaataacagggaaaatgatggaattttaccttataacaattagtagcatagtcttttatttatttatttttgaaacggagccttgctcttattgcccaggctgtagtgcaatggcccgatcttggctcactgcaacctctgcctcccagggtttaagcaattctcctgcctcagcctcccaagtagctgagattccaggcacccacaaccacgcccagctaatttttgtatttttagtagagacgaggtttcgccatgttggtcaggctggtctcgaactcctgacctcataatccgcctgcctcagcctatcaaactgcttgaattgtaggcgtgagacaacgtgcccggcctgtactctttaatcattatttttgcagactttttattttgggggtgagagaaaattcatgatcaggtgaaaaataactggcccagccaccagctgggcaaggtggctcacacctgtaatcctagcactttgggaggccaaggtgggagaagtgattgagcccaggagctcgagatcagcctgggcaacatagtgagaactcacctctacaaaaaaattttaaaaatcagccaggtgtggtagcacatgcctgtagtcccagctactcaggaggctgagataggaggatctcttgagcctaggaggttgaggctgcagtgagctatagtcacaccactgtactccagcctgggtgacaaagtgagaccctgtctctaaaaagtaaaaattaaaaaaaaaaaaaggataactaaaccatattagatggaccaaacaaataacatcagagaaataacagtgactgaaggggtcactttccagggaagtaatctatttcaaaaccacttaaaaaccaagaaattcactgtcgattctgtacaatgatgaagaacacattttaattattttttctttacctcctgttcattttccctcttcttgctcttcttgtagtcatctataaccaactcctcttccctctctgctccttgttttagctaaaatatccttaaaagcacctatgaacttgcctagcccaatctcactaacacacaagtagcaacactttttcaacttttattaagattcttgccccaaatcaatccataatgttccacagaaaaattagctatctaattcaaaggcagaatctatattggttatcctctagatatactggaaagcataggaaattggatctttaagatactatattcaagtctgtggtccatcaattactacccgtatgaccctgggcaaataagtcccttacctctgagatcagtttccttatccgttacagtcaagtaattatttttgccccactgatctgatagacttgtttgaggtatcaaacaacataaaaaatataaaagatcttttcaaactttgaagccttccaaaatgtcatcacccttttacatatcttcagtgcccagaacatagttggcttaacaaacttttcttactgcctactgcagttgtaatgaattaaatggttttctgttggtctaaagaactttactcttcttgcatccacattcagcttaatattaacaactgaattaggcattcagaacaagctgaactactatcttatgaaatcagagcttttctaaagaatgtacgccccatataatgagggcagcccttctgtagccccagaagattgctagagagggcagcactagttaggtctagcagatcactgtcatggaggaacacaggaaactaggcttcagggcatcctagagaaatcaccaatctgcattgttacataaaactctcaattcacacatgtaggcaatctaatgaaaaacacacttccaccccagtcactgaacttgctgttcactctccagcaagcacactcttccccccaaaatcacatggcttgctccctcgctgcattccagtctctgctctaatgtcaccatcctcagggaggccttccttggccacccattctaaaagagcagcacccacacaggtgctccaagcctcccccacgtccttatcctgctttcatttatcacgacctcttcttgaaagcaatgacattagatttttttttttacctgtttagtgtctatttctatttttataatagaaaggaatttttttttgttcaccaactgtattcccaaagcctaaagtagtccttgacagatactaagtactcaacaaatacttgttgaatgaaaggttatcaaatactgattgccataaaagaggtgatgaacttggaaatgtagatgataatatattagaaaatagttacatgggaaagttcttccataacattgaacatgttctcagttttcaacaaatttatcaattttagaacattgatcaagctgccattaaaaggatacgagaaacggtcattccatgttgctctttcgacgtattccaacatgaccacggcttttattgtcgtcaaaagtttgttccatgtttcatcaaaatctactactcttggtttcaaagacattgtgcaagtgtagtgttgaaatctgtcaattaaaaaacaataacaatgttagcaataattccatgagcttagtttttttgttgttgttttttgtttgtttgctttgagacggagtctcgctctgtcgcccaggctggagtgcaatggcgtgatcttggctcactgcaagctccgcctcccaggttcacgccattctcctgcctcagtctcccaagtagctgggactacaggcacccgccaccatgcccagctaattttttgtatttttttttagtagagacggggtttcactgtgttagccaggatggtcttgatctcctgacctcgtgatccgcccaccttggcctcccaaagtgctgggattacaggcatgaaccatcacacccggccagttatttgtttttaaagcactacataattaaatagcatgatatatgcaaggagtgagaaaagaacccggcacacaacaaaatgttagctaccatcttttcatgactatccagacaagaaatttcacagactatttacattcattacaagctctaggaaatggaaagcttctagtacaaattatttatgatcaagggtatagtttcaaagatttatagtcctcatttaatattgcgagggaaagaaacggggacccacttaaccaaaaggccaacttccatcatgggaaataatgcaggacattcaaccgaaaggttttggccccaaatccttgtggtttgcactcctgaaagtggggaatgaggcagcatgcaagggaatatgagaagacacaagaaaatgaaaggctttaccttcctggagcatcagtataagattagggaagaaatttacatttatattaaaccaaacagggatgaattatggagtagaatataaaattcacatgaccttttaagattaaaaaaaaaagattccacagaaatgtcaggtttgcagtggagagcttaaggctccttcccagattcttggggtatctacctcccagttctaatgaaaagcatggctctagcatggaatccctggctccagtgaacttaatgggcttttttttttttttgagacagagtctcactctgttgcccaggctggagtgcagtggcgcaatctcggctcactgcaaccttcacctcccaggttcaggtgattctcctgcctgaacctcccgagtagctgggactacaggcgcccgccaccatgcccggctcattttttgtatttttagtagagacggggtttcaccatgttagccaggatggccttcatctcctgacctcgtgatccgcccacctcggcctcccaaagtgcagggattacaggcgtgagccactgcacctggcccagaatgggcttttaagggagttcaaagactcctgcctcagacaaactgcatttaggaattagctggtttctggaacaaaagggtcccaaattaaaagagaaactttctaagctaaatgtaattgctcaaaggaacatttttctggcaaatgttttaacagcctccctcatgtctccccttattagcaggactgtaagacaccaacctagtctgtagccaaggccaaaaaaggatgaaacatcttttctcgtctcccatcataggggaaaggggaggcagagaatggggaggagggaatgatgcataaagagaatgggcaaagggagcgggtaggatggcggccgcaccaccagccacggactgggagaggcccttctgtgtttccagatgagaagagagctcaaggaatcccaggaatagactccatggaaaagaatgaaaaaaatcagagaaaagccaaatatccaaaagagggtatgccttgttgaaccacatcctctttcctcaacattccaaagcctccacctcctggccttcaactcattcccgaactatctataacggattagcagcgattttactctgcaaaattgaggggaaggtgagagtggaggaggtgggagaacctactgagtttcctaagctctaaataagggaattaaccatgcctccttctcttccttgtttactacatcctatcatcaactgtgcacatgagtatttcctgaatccatccatacttgtatagccctacaaatgatccggaatcaggccctcagcagaaatagtaacagttaatatttacattgtgtatactgcaagccaagcactagtctaagtaccctgtacaaactcgtttaatcctcccaacattctgacaggtaggtccactgttgtccccattttcttttcttttctttttttttttctttttctttttctttttttttttgagatggagtctcgctgttgtcagcctgggctggggtgcaatggcgcaatctcggctcactgcaacctctgcttcctgggttgaagtgattctccagcctcagcctcccaagtagctgagattacaggcgtctgccaccacacccggctaattttttatttttagtagagacagggtttttcaccatgttggccaggctggtctcaaactcctgacctcaagtgatccacccaccttggcctcccaaagtgctagggttacaggcatgggccactgcgcctgacctgttctccccattttctgaataagaaaactgagtcacaagtgattcagaaacttgcttaaggtcacaaagctatgtaatggtggcatcaggattcagacccgtgctgcggccggtgctctaggctgctgtgtgcaaccatgctacctcactaacatgcttggtgaatacttactccttgccaggcaccattccaagctctgaggatacagtggacaaaacaaagttcttgacttcaagatcagaatctcagatcttgcccttatcaaagacacaaaaataacctacctaagccaaaaagttgaccatgttactctgtacataaagtacaaagtttgttgtttccttctacagacagcattcagtttgggctcaactgcaacatggcacccaagcttcctctcctcctggtactccctactgtgac

SEQ ID NO: 313 - DNA, 65780 bp, Homo sapiens; identical to SEQ ID NO: 312

SEQ ID NO: 314 - DNA, 81833 bp, Homo sapiens
tcaatttggaaaacttttatcaatcaacaagttatcaaaacaagggtttgctttttgacagtgaatgtacaatattatatggtttgccattatttcctcttttggaagaaaggtaaaatgagaaatacattatataagtcattataagttcagtagatttttaaaacacttgagacacgagttagaaaaaatgcaattgaataaaccaattgtaagacccatctcaaaacaacaaatttaaatatgaaccacatattagatgatactaagtaattattgtttttgttaggagtaataatatcactgtggattttttaaaggccttactgaagtattataagtgaaataatttgtgtgatttgctttaaaatattccgattttaaaaattttgtgttggatggatgcagtggctcatgcttgtaatcccagcactttgggagacagagataggattgcttgaggccagaagttccagactagcctgggaaacatggcgaaaccccgtctcttattttttttaaaataaagaaaaattgtatgttgagggaggaggggtgtggtggtggtggtgatggtgtggatagacaataaatatgataatagatcgcagtactcttaacactgctgttgagatatatatatatatatattatatatatatatatatataaaataaacaaaataatgggatttatatatgtggcacccagtacaatgtacaattttcttttttaaaaaagtatttaggttatgcattgctaagcacatctgtgattgatgagagtgactctagtatctaaactgttggaggagggttgtaagggtaacaggtaggggaggcatatagaaggaatatgttggtatcatagatttcctaagactcagggaaggccacagagctagggtactagtctatgctagaattaatggattatgcaaccgaagaaagacaacttttgaatgaaaagctctctctgtgccagacttgaggtcaccaagcatcctgctcacactctgcgatgtctgtggagtagcacaccaccagaaactgctgatggaattacatcttcaagattcaaaatgtttagatccaatatatctaatccataaaaataaagcattctttatgctgaatgcagtcctatgcagtcaagaacaataatctagacatttttcatgtaggatttaaataggagtacaagtgaattaaaccattcagataaaaacgcaactaaagatgcattagctgctttgagtcaatatattttgtggtcaacctgatactccatccacataaaaaaggcattctatttctttattttttttttatttgacaagcagcagtatcatgtttgtcattttaatgtagatacaattattaggttatctgtcatattacaatatttaagtttttaaattttatgtcctttaagatacattaaaaaaaaaaaaaaagacacatcaactgcaaacgtgaaggggagaaaaagcatggtacccaaccgaatttccacttttcagcaatacttcactcattcttttaataaagttttaagaaatgtcataatgacatgagcttgaaatatctctaggcattttctttgacgctcatgacgtggcactggtgatgttgtaaacagcagaaaacaggggctgccaaatgaccaaattatggaggcacagtcctgctttttcccacaggaacacaccaaatggtgatggcaatgatcttctcacaccacgctggaggagagcgacatcacgcgacgtagctgtattcatctgccgacgcctggctgcgttctatgtattgtttgtctatcagaacttcaatacacttcttaatcatgctgatactgggattaaacctagctcttgactggctaatcacctgtggaagagatgtggaagtcaaactactgccagttcttcagctattaagtaatgacttttaaccaatcagtttaaagtgcctcaaatgtactgaggtttcaacaaatgggccaaattaagtatgaaaataggaactacaatgtggaaaatggatacagcaaaatctaataatgatacataattaagtgaaacaataaactaattaacctaagtactcacacacaaccccaagcttctatttaactcaactctcagctcttagttcaaacactttctcaagaaagttttccccagcagcccctaggccaggatatttaaatacattctcatagtactgtatacgtttccttcagtgcatgctaatgtaattttacatttatttgcatatcatttcaatagtgtatttcttcccccattaaactgtgaactccaaaaaagcctgccatatcttcagctgctctgtgctatatcccagggaccagcccagctgtctatcacatggtaggctcagatagttatggaatgaatgaatatctgatgggtcaatttccttcaataactggacagaagactcaatgaatcagcaagttttagacctctaaaataaagccaaagcaaatatgaatttattattatcatttgagatagcatctcactgtgtcacacaggctcaatccctgggctcaagcaatcctcccgcctcagcctcccaagtagttggtactacaagtgtgccgccacaactggctaattttttaattttttaatttttttttttttttttttttaggtgagatggggtctccctgtgttgcccaggctggtctgaaactcctggactcaagtgatcctcctgtcttggcctaacaagacattcagattacaggtgtccactgggcatggtggctcacacctgtaaccccagcacttttggaggccgaggcaggtggatcacctgaggtcaggagttcgagaccagcctggccaacatggtgaaaccctgtctctacgaaaaatacaaaaattagccaagtatggtggtgcacgcctgtattcccaactactcgggaggctgaggcaggagactcacttgaacctgggaggcagaggttgcagtgagccaagatcacgccactgtactccagcctgggcgacagagcaagactctgtctcaacaacaacaacaaaaaggattacaggcatgagccactgtgcccagcctgcaaatctgaatttaatactgaaattgtgagtgagtacgattctgattaagtatgaaacatttctttatgctatctgaggatcaggttatttctgtatcctctttaagaagaaagagactgaatctgtacaatgacaatgccctctaccctaagaagccctgaggactgccctccttttacctcttgaataagggcattgtgccgaagcacttttcgtgctttcatgatacgaactatagcagcttggagatacattttccggtcctcatcaactgcacttctagtctgctccatttcctgttttacagaagaaaagaaaaaagacccaacaagacattaagtcactgaacttgttttcaattcattttatcagtgagtgcaaatacttttttttttttttttttgagacagggtttcactctgtcgtcctggctggagttcagtgactcgctctcagctcaccgcaacctccatctcctgggttcatgtgattctcatgcctcagactcctgagcagctgggattacaggtatgcaccacaatattgagcaaattatatagttatgttgtgccaatatcacataaccactgctaaaacatctacaatttctagggttaaagttgaaagattagaaaaaaatttacattattgtaaactgtactgttaaggtaaagaggcaataaaggaggacacagcaataatttgcaagatcattttcttatcagtgattacagaatctttcatgacgcttttagatggagttgtgtcaactgcagtaattagctccaaatgcatactggatcaggcttcaaagggaagagctgtgaagtggcattttatgtggctcaagcagagaagccaggagagggggcctatctccacggagctcaagaaacacagaagcaaggcatagaagcagaccatgccacattaagaggatctcctcacagcgtttcaaagacaaaatacaatctatatattgcaaattattatttattagcctggaggaaaatggaatcttgaccattttaggtttcaaagtaaatggcagttaatatttgtctccccccatcgggaattaagtttctggagagggtctaacatcttatattatcttcacatcctgcatcagcccaaggactgcacaccggaggcaatcaggaagcataagtgatagaaacagtctatcccagaccaaagcaacaatcactgctgagttaaaataatgaagagcagaagtcccctcctcacactggcctgtcagtacctcactccacacccactagatcacaatctgcatttgaacaagatgcccaggtggctcatttgcatatgaaagtttaagaagcattttctactgacaaattttctttgaaagaaatgagctgtaggccaggcgcggtggttcacacctgtaatcccagcactttggcaggctgaggcgggcggatcacgatgtcaggagatcgagaccaccctggctaacacagtgaaaccccgtctatactaaaagtacaaaaaacaaaattagccaggcatagtggtgggcgcctgtagtcccagctactcaggaggctgaggcaggagaatggcgtgaacccgggaggcagagcttgcagtgagccgagatcacaccactgcactccagcctgggcgagagagcaagactccgtctcaaaaaaaaaaaaaaaaatgaactggagaactttcccttattttacaaatgaaaaatatgaaattttattacttctcaatgtgggaattttcggagagaatgcatagttacacattctaatggtttaagagcaaatacaacaaaaccatacccttttccttagaaaaaactaaaatacaagtagagatttctgtttgactgtaaggttaataaatgccaacaacaaaccagaaaagacatatcccattattaattttgctgtgcaaagttttgcacaatctcaatgtaaacacttgtaaagtccaatgcttaaatgtttccccctcaaaaaaaacttgacattaaaagcacttacttgtggtgtgtctttctgcattgatgtagtaattttaaattttgttcttttactgctaaagttcatatttaatgaaaacgaagattctgcatcaatatcttcctacatttaaaaataaaacatttatatttataaaaaccaaaatctttaaataagagtttgctgcaagcaattctgctaaattaatgaccaagcaaaaaagcctccactctcataacttttatattatagattaccaaatttaagagaaaaataattcttttgttcaaacaaacaggaaaaaacccaattattttctacttttacatctgccagaatcttaagcagtttatgtttgggaataagctattttctggtcctactattctatatacactactttttgataaaataagagtcaagctcattgcctagagtttgacattttaatttttatgaaacaccaaagtgcgtaacttttccatcaccccattttgaaaaagcaaccacatttttttttacaaatgccgcagtaacaaaatacccactgtaaatggcctgatgacaagagaaagctgtgcctccagtagcacacagcatcaatttgctgtgacctggggtgatggtgaaaacatttatttcaatccatgttttattcactcttcaagaagcaagtggcctttgctcaggggaaaactgtttaggcaatttttagaataacaacttctgtatcaggcttaagaaagccactgatatcatagagtggaatttctctggcagcagaatcaaaaggcacttggaagatgaaataattctcaataataatctaagacattctgctaaggaatggacagattcataattaaatttaaaggccaggcatggtggctcacgtctgtaatcccaccactttgggaggctgaggtgggcagattacttgagctcaggagtttgagaccagcctggccaacaaagcaaaacccggtctctactaaaaattaaaaaattagcctggcatagtggcttacacctgtggtcccagctacttggaaggctgaggcaggattatcacttgagcccaggaggtggggattgcagtgagctgagatggcaccactgcactccaacctgggtggcacagcaagatctcatctcaaaaataaataaacataaaataaaatttaaagtgcaaacaaggaatctatgtttactttgtcaatttctgggcagcaaaaatagcatgttttagaaaaaaatataaaacctttaagaatttactagcctaaaattagaaaccataattaattaaccttaagaaatccctattttggccaggcacagtggctcacgcctgtaatcccagaactttgggaaagacaggtggatcacctgaggtcaggagttcgagaccagcctgaccagcctggccaacattgtgaaaccctatctctactaaaaatacaaaattagctgggcatggtggcacgtgcctgtagtcccagctactcaggaggctgagacaggagaatcatttgaacccaggaggtggaggttgcagtgagccaagatcacgccattgcactccaccctgggcaacaagagtggaactccgtctcaaaaaaaaaaaaaaaaaatccatattttgctaagattctgatgccagataaatcatttctcaaaattatgaaaacattgatttgaatttcagaatatgccttttacagttgttcagttatagactataaaatgtcatcataatcctagggatgtcagcaaaatgaattaatgagagaaataaactgtaggctattaactttacaaaaataaaaacaaaacattatttataggaattttttcttataagcacaataatttgaaggagatataatcccacctctgttgcatttttaactatttaaacatctaggatatactatgacaacaaaacagcaaaatcttgtaactagaaaaaaagttacagagaaaaaaagtaatatactaatggcttgttattcttgtgacagatattaaaaatatatggtggttaaaaacagatgacagttaattgagtgctgacattaagaacacttggaatggagttacacatattaaatatgtgtacaaacagacatcaacaggctgtcatttcctgttatagaaccatgaaattaagcacatttataaaaccaaaaacctggaaagtctttaaaggctagtttcaaaatctcaattaatcaaaatcttccagatggcaattcttttacaattattcaataagctgtaacagtataggacaaataaaatcaaactataaacggcacatggcaccaactcacacagcatgctctgtgatgccttaacgctcgcagctctatggagcgtacagtaacgtagtgaatacaagtgctttccagagcacaataacaattacagccttattttaaaactgcaaacatctcatgaaaaagctttaatgctgatgatgcttaaattctttggaatattactacataccttttctgaatcatggttaatcattttcacatcaagtaatgatttgattgtttttgtcagttccttttcattcatctgagtgctgtcctgaagctctttataactgacagtttcactgttgttaaaggcaagaagaactgccatttggtatgttgtaaccatggctacatatggtttgcccaaatagttcattttaacttcacctacaattaaaacaaaaactgacagtgaattgaccattcaaagaaacatttcaaatttactttatttcagacattttcttcggaaagagtgaaccaataattttattaaattgttgtaaagccactgctgttaacaaggtagtcattttgtttcttggggaggtgaggatggaagtctattagttttgagtatatggtataaatcagtaaaactatcataacttcaccagtaggttaaaacagtctttaaggccaggcgcagcggctcacgcctgtaatcccagcactgtgggaggccgaggcagacagatcactttaggtcaggagctcgagaccagcctggtcaacatagtaaaaccccatctttactaaaagtacaaaaattagccaggcatggtggctcatgcttgtaatcctagccacttgggaggctgaggcaggaaaatcacttgaacctgggaggcggaggttgcagcaagccaagatcacaccactgcactccagcacgggtgacagagcgagactctgtctcaaaaaaaaaaaaaaaacaaaaaaaaaagtctttaaatattaatagaaatgctaagacttaggcagaaaaagaaaagaacaaaaaacccaaacaataaaaggaggtgggagaaggagaaatggacagacaaagggcaaagtgatatcagcaacagcctcaagtgctgtcgatagctgggctctcccaggtaaggttcaagcctcctgggaggtccacagccacatggaaaatgcttttgaggccctgtctaagctgtaatttctgccaaaattaatgctattatgtctcataaacaacatttttctttccagtaacttcctagaggcaaacaggtatgaaaggagagacaaacaggcagacccattctcttgctgaaagttgatagcaaaagaatctgaatgttttcataaaaatgtttaatctgaatgttttcataaaaatgaaaaacatttaatctgaatgttttcataaatatgttctatatgtgctgggcacggtagcttatgcctgtaatcccagcactttgaaaggccgaggtgggcagatcacttaaacccaggagttcgagaccagcctggtcaacatggcgaaaccttgtctctactaaaaatacaaaaattcgccgggcatgatggcatatgcctgtaaacccagctactcgggaggctaaggtataagaatccttgaacctgggaggcagaagttgcagtgagccaagatcacaccactgcactcaaacctgggcgacagaatgagtatctgtctcaaaaaaaaaaaaaaaattctatatgctaaatgaccctgggagctctaagagatagagcaagtattatgtatactacagttctgcaacatcctgggagacagcagcatgacatcagcacactgaaagctcataatgaataatatggcaaacatgtctacactctgtaatgttccatacgtgtttaaaaaaaaaaaaaaagaaaagaaaaaagatgcagatcaaagagctgcttcctaaagcacgaagttgtggtttgacgactaacacacacacggcctgcattatttgattgttgaatggattataaatgaaattgggccaggcgtggtggctcacgcctgtaatcccagcattttgggaggtggaggcaggcggatcacgaggtcaggagatcgagaccacggtgaaacccctgctctactaaaaatacaaaaaaaaaaaaaaactagcagggcgcagtggcggacacctgtaatcccagctactcgggaggctgaggcaggagaatggcgtgaacccgggaggcggagcttgcagtgagccgagatcgcaccactgcactccagcctgggcaacagagcaagactccatctcacaaaaaaaaaaaaaaaaaaaaaaaaaagatgaaatcaacatgagatttgattttaaagctcttcattgttaactcaaggaagctgtatttctcataaaattaccccagagactgcattttccctctcaaggataattagtaactctgattaaggttttctgctttatgtattcattacctcattaaagattttaggccgggcgcagtggctcacgcctgtaatcccagcactttgggaggccgaggcaggtggatcacctgaggtctggagttcaagaccagcctgaccaacatggagaaaccccgtctctactaaaaatacaaaattagccgggtgtggtggtgcatgcctgtaatctcatctactccggaggctgaggcaggagaatggcttgaacccgggaggtggaggttgctgtgagccgagatcgcgccattgcactccagcctgggtaacaagagcgaaactccgtctcaaaaaaaaaaaaaaaaaagattttaaaggctatgagtgaattcattagcttaatatcaccataaatgcaatattatcttgattattatcatttatgccttgacatttcagataaaactgatatttagaaacatttttcagaattatctggatgggaataccaagagaaaaaattcatagccctctaaattttcacaaaaggaggtttaatatattaaattcaatatccaattcatagaaacagcttgtgcaaaaaattatcatttggagtatactattaacaatttctataaaaaggactcttatcaacatttaagtttggaaaatgtaagtaaaacattacataaattgcattttgttatttctgcaatgacgacttaatcatatgcagaaataagtagagaattatgcatcaagcaccaagatgattaagtggcaccatcagccaggatgtcactgatgctgtaatatgctgccgtgggtttgaaagcagaatgagtcttctgccgtctttcagcaccacgagacccaaagagcattaggagatcatgcgaggggccaaagcatcatttacttcttattgagttcattctttcattgtgccctttcttgctatttttcaatactctaccagggatcaggggtacactgacctcttcccacttttcttagcaccatactcttactgaaaagactggggaaggggtgggaagacacgacaggggaaaggaaacttcaaacttggatgattcatttaattactgtggtgtaaacacaaatgagaaacaacaagagtggtgatttaccctgcagaataggttggcaaaccctaagagactaaaaactaaaataaaacattctgatacatgcatacttaaagtaagccaacaataaataattcaagcagcatttacaatgacaggaaataaagagcgggcagaactctcacaatagtttcatccaagtcactccccagtatctgtgtcagctctctactctctcagggcaagttgaaggcatgataggatatcaccattttgcaaccagtaatgaaacaactgattctggcaaggatcatcagtggaggctaaaactacattaggttcctggaacagggtattcatgccaaagtatcatccctcagactgtctgctaagctaactgaagaggggaaagagtgcctctacaatggagatatctggtggttaccgccttcatcaagtgaccaaatttagcatctctaatagtgagacaatctgacattagatgcctttgaaatatgcaatatgaaatacacaggaccacctatgaaatatccttgccaataatacttaactgaatataatcaaacctttagaactaatttccactttccagaacatacaaggaatagaaaacaaatttaaaaaaaaaaaaaataaatcacaaataagtaatccaaagtactggatattctacaagacaactggcctggtctgttcaaaacagtgtgtcaaagaatgctgagaagtggggaggtggaagggaaatgtaacaaccaaatacaattagtgacctctgacagtcaagcaagtcaccttgggacagtcagggaaatttgaatatggactggacattagacaatactaacatccctccctatttttagctgttggaattatttgaaaacaaaagcaggacaaatttagtcaatagaatcgttatcttttaaggtatgcacaatgatatggtgttacttttattctggcaaacactagtaactaccaacacatactatgatgtagggttcacaaaattctagcctgatccatactatgtactgtctggtgaagttttttttatcttccttgagttcatcatttctcaacgtgtctttcagcaactgaccagcaatctctacaacttcttgctctgccacaaataaaacttatttatacaaagacagtgtaatggtttctgtcacactgtctggttatatctctttatcaagtatctgtatgtctttatcaaactgttccttatcgttaattctatccaaagccttagtcataaatccagtggaattttcaggatttttctcactctgtcacatctggcatcacagattgcttcttaaaattcttcctctgttggaaatacactctcaacactctcctttacgtagcttggttaagtcctattcattctttttattttatgggtttttttttttttttttcaagacagggtctcactatgttgcccaggctgatcttgaactcctgggctcaagtgatactcctgcctcagcctcccacagtgctagattactatgaccttatttaaccttgatcaccttctcatggaccttaggggttagagcttcaacagaagactttgtagggagcacattacagtctctgcaagccatggacatggtgacaattttattccattctaactgcagattaaattaacctccatgttaatctgcagcatgttttctttctttctttctttcttttttttttttgagacggagtcttgctctgtcgcccaggctggagtgcagtggcgtgatctcggctcactgcaatctccgccacccgggttcatgccattctcctgcctcagagaatcttattttctgcacactgctgtgtataaacatacatttttttatatatgtatgtatatatatacacacacacacatacatacacacacacaaatatgtagtgataaaactatatagatgatatttccataattaatacatgtttatattaatgtcaattttaatgtatgaatatgtattaaataaaaacccatttcatttacatatacatgtatatccttccttccttccttctttcatttattattttttattttcatttatttattttctttttgggcctgcctggtcttctcactctgggctctggtgacctcagcctcccaagtagctgggactacagggatctcttaagcccgggaggcagaggctaatgtgggctgtgatcgcgcacctccactccagcttacgtgaggtggggtgaggagaggcgaggtggggtgaggtgaggcgaggtgaggtgaggtgaggtgaggtgaggtggggtggggtgaggtggggtgaggtggggtgaggtggggtgaggtggggcgaagtggggcgagggggcacccggccctattagctcttgaaaacaagttgagatgtgatttccccagaagacttccctcgcaaggacctgactgccaccaccattctgtgatatgccctgggctggcctctatcacattcaaaacaccgtactgtaactatgtacgtatgtctgtcttcctactagacatgagttttttttgagggccaaggctctgtattttatttctgtccacttggcgtttagaagtacctgagacatagaaaatgttctttgagttgatcaatgaattttacaacaataaagagaaggaaacaggctcaaaggagttaagtaatttgcttaagattacacagctaataagttgtgagctaataactccagccacaggtcttctgattctaaattcccccaaacaccaccttgtgcaccatcaaccatttgtgaagactcttcatttacaatacaaaaattaaccttttcttgggtattccatgagctgggaatgtagaaatagactaggcaagaataattttcattctatgtttaagcagaagtaacaggggttctcaagaaacagaactctgagagatctgtccagcctcagagccagtgttttaaagaagtcctggagccttaggccatatatgggtaatctagaacaagtatcttcaatacacatagcgtgtgagaaactttttgttaaatgaataaatggagaacaaaaataaaatgaaaaatgttgatcaaaggggacaaagtttcagttaggaccagtaagttctggagatctatcatatagcatggtgactgttaatctactgtggagtaaacttgaaaattactgtgacaaggctgggcacggtggctcatgcctgtaatcccagcactttaggaggccgaggtgggtggatcacgaggtcaggcgttcgagaccagcctggccaacatggtgaaacaccgtctctactaaaaatacaaaaattagctgggagtggtagtgtgtgcctgtaatcccagctactcagaaggctgaggcaggagaatcacttgaacccagaaggtggaggttgcagtgagccgagatcgccactgcactccagcctgggtgacagagcaagaccccatctcaaagaaaaaaagaaaaagaaaattgctgtgacagtaattgctgtgacagtagatgttaaatgctctcaccacaaataaagataagtgagaagctacttatgttaattagcttgagttaatcattttacaatataaacataacaaagcatcacactgtacactgtaaacagatacaatttttatgtgtcaattgtatcttatcaaagttgggaagaaaaacaactctaactcctggtttcactgataggtcacaggtgttttcagtaccttcggtgactcaaaacaaaaaaataaacttataaggttctctttccaaaggaagtaactatttggttttaactaaaacacaaataatattaaataaaagaaatgaacaaacaaaagagctccccaaatcaacttatgtatcagcttagaaatttagtatagctcaaaaacagaaagaaagttattctctttcctatttaggtgatattggtgactattttcaaactaaattccaatggctaaaaaactatgtgcataaatttattttcttcttatacaccactggttgttaaaatgagccccttactaaaattactttaggagacacattgattattgctgaaataatgagaataaccaagaatgtttaaactcccccagacagatattcatggaaagtaaaagcaagctaaatcgaactgcactaagatatattagttttcttaggggaaaaaaaaaaaatctaaaaccctggtccagcatttttttcttaaaatcaattatgtttactaaatgaaaatagaacatattgattgactggttgagacagggtcttgctctgttgcccaggctggagtgcagtggcacgatcatggctcactgcagcctccagctcgtgggctcaagtgatcctcccatctcagcctctcgagtagctgggactacaggtgtgctccaccacgcctggctaatttttggattttttagtagagacaggttttgtcatgttgcccaggctggtctcaaactcctgggattaagtgacccacctgtctcagcctccccaagtgctggggttacaggtgtgagccactgcacctagccaaaagtcaaattaaaatttgacctttgactaccactaagagtatcagtaaaaaatctcatttcaaaaattattttaaaaattagaatgtccaacttgctcagtaaagatcgacttatataagtaatgcaaaatgtattactaatacaatgagccatcacgttcccaagatgtaaattagtcaaataaacaccaagtatcatagttacttggataaagtaactcttggggaggggatagaaaacatttcctaataaaggttatggcaaatgattttcttgtaccatctctaagaaatattagcatatataccctttccttcttgtacaaagaaaaagtgattcaatgaacttgtcaaagcatagtttagcaaaaaaagagaaaattcaagtgtctgctttggcttacatcttcaggcaactccacacacagtccacaataattcaggtattaatcctactgtaagtaagtggactccattgttccagaaagaagcaaaggaaattagattgtgataaaagttttttaaaattggaaactattgaaaattaagtaggactttctgcaaaaagctttactattgcattcactgcagtatcacaagtaaaaatcaaatggttaggtctccttatgatgctataataaagaaactggcaagaggatctggcatacttagagaacaagtttctaagtgtgtctgccccatcaaatgtgagtttctaaatacatttgctaatgaagtggttggctagagaaatgtaataaatcagtataaagtcagaacatttctttaaaagcagcaagattataaacagtgtaattataaaatactatgaaaaagtgctatacttggatttcattgttagttgctttaatggggaaaggttgatggaggagaaaaggttaaaaactgtaattgggccatagaaaacctctttctaaattaatataatcatcaggtaaatttcattaagccagatataattaaatgcattttacctgtacacagataatgtaaccatgtaagtttccttccactgaaatgttggctataaaataattcaaactgtaaaaaaaaaaaaaaaacacacattatttttagctactataacttgcctagttaattaacacaatactacaaaagcaatgaaaaccattcatattagaagagacattaaagcccatctggtttacctccttcttttacagaggagaaagcacgttcctgtggtccctaatcaaggctatacacatatattccagctcttttaattgacaacttgttctagagttctctccactaaaccacagcactgcaaatttgactttctgtatgacacagtgattcattatcatttctgaataatactaacatggactttataaattctactaaccaaacacagcaacatatatatttcaccatgaaaagagaaaccctaccttcatctctaatctcccatttgccaacatatagcttccacattcaattagacacaaatacgaagttttagggtatatctctggattattcttttgctgatattattgtgaacaattaaatttaaattctattaatgtagccttcaaattttaaacattcctccctggactgaatgtgtaattacagaacaaaaatacagagttcttttttctttaataaagagctagtatacaataaaaagtggaaaaatgatactggatgtgaaaaagataaaaactcaatttctttataaaactaaaaaataaactgcattatgccagttcagaattctgaataaacttttagcatgatgtaccatatataacatacttaaagcttttatttgtatatcaaactttaccttttgtactttaaaaaggaagttcacataaagcagtcagcaatgactgacctatcagctatattatgaccactccttaacagcaaaagttaatagctccagccaagaaaatgagtcaattccttcagcagttactctaagtttgcctagtcctgggaagctgaaatatgttgagcctattttccctctaatggtgcagcatcctcctctaccagcagatccaccaatccctttgcaggatgaacaggagatgactagcacctggaatacttcagattgcctgcttagttctaatccagacaaacagcaaattgaaatatgtcataagaggatttcagaagtatgatctgactaactaataactcccagggatatcaataaaattcaatcactactatataattcacaatttataacacatttacaatgaatctggacaaaagcaaaataaaagttaaaaaaactttcatttttttctcaaaacactttcggaaatgagaaattccagctttaaaatgctcataatttaaagtgcaaagctggctttaaaaggtatattccaagctctaaaaacatgttttacctcttcagtagtactatttggtaaagttttattgacgataatatcaatatgccaaaagaagatactgattcatccttacatttaaaatctgactacaaagactctcgtatctatagctagtcaagaacaaacagactccaataaattcatcaattcatatggcactacaaagaccaaagttataaaaccttccttgattatatcattaaaataattgtgttagcaaagcttattagtaaaaaatatatgttgactaaacttattttatttttttaaattttattattattatactttaagttttagggtacatgtgcacaatgtgcaggttagttacatatgcatacatgtgccatgctggtgtgctgcacccactaactcgtcatttagcattaggtatatctcctaatgctatccctcccccctcctcccagactaaacttattttaaaataaacaggataaaaaacagcatttttcaaacactgtttaagggcattaattagatctcaaagagccttaaaaattcaatgagtttatttacctttaatagatagctacattaatatacactactttagatactttttttttttttttttttgaggcggagtctcgctctatcacccaggctaaagtgcagtggcgcaaactcggctcactgcaacctccacctcctgggttcaaccgattctcttgcctcagcctccagagtagctgggactacaggtgcatgccaccatgcccggctaattttttctatttttagtagagacggggtttcactgtgttagccaggatggtctcaatctcctgacctcatgatccgcccgcctcggcctcccaaggtgctgggattacaggcgtgagccaccgcgcccggcaactttagatacttctaatattattcaggtttttggcctaggtaaaaaagaaatgtaacaattaagattgactggcctaaagtataaaataaattacttttaattacagctttaattccacagttttgagatactttggtgtaaaataaaggtaattcttgatagttatatttaagattaagatgtaaaaaatgcaaatcatcactaaggcaggatggattaatttacatgagaaaactgtacactattaagtatacaaatggatttcaatcctatgtatctgaaaacttggacttactagaaaaaaaataaaggacaaactccctctactggtaattggagacaattcaaatggagagaatagtatttttggaatcagaattttacagacagaaactcacttcctatttgtaaatggggaaactaaaacctgaggaagactatacatcaacaaataaagtttaaagagttaaaaactataaatagaaaataattatttcaaggaaagaggaaagaaaaaactaaaggaaaacttcatttctgccagctcctattctctcccttaatttcaatcagggacacatgatatttaaaaagaaatgtaaaagactgccaaggccaggcatggtggctcatgcctgaaatcccagcactttgggatgtatcctttctgcaaaatttgtaataaccttggattatagtctgccccatccaatgaatgtctgcacaaatgctcttcttcacatagtttctaaaatagtctgtgctacaatctcttttcaaagaagatgtaagaagtcctaatttagcctcctattctgaaagtctatcatgcttgccttcctgaaacctacctgactggttacaggactctcctctattagttattaccacgaaactaataaccactatcaatcactgttactacttactctactagcagttacttcacatatatttacctacattacaggacagaaataaaaatattacaagggctgaatgaggtatttggtcaaaattcaaaaggaaaactggtaagtgatattttaggtgttgaattctaagctttcttctgatatcaacatttttataatttaaaactgcttaatagcagatgatagacttactcagaataagagacatgctttgacaaagaactgtatgacattcttcttagcattttagtatcaatattagtaactacaataacttacattcttcctaaagggcagactgactataatttctgaatctatttttatcacatgaacccttaagactctgaaaaaatattaaaggtgatataatatgaagacaattattaaaattcctttagtcttctaatatatttcctgcaaacttaccatctgtacacttttttctaattcctggggaattgcaaacgtagatgaaggagcctgagtaagaggccacgcaccagcctagaaggaaaaaaataaaataaaataagctaaatggatcaacatctaaattcaaagtaaatatttattaaataatctaagcatctaaaacatttttttcttcctcaaaatgttgatgaaatctgagtatttctatcatggcacatttcattccaaaccaataggacctttttttgttttttttttttgagatggagtctcactccatcacccaggcttcaatgcagtggcacgatctccgctcactgcaacctccgcctctggggttcaagcaattctcctgcctctgcctccccagtaactgggattacaggcacgcaccaccacacctggctaatttttgcatttttagtagagacgggttttcacatgttggccaggctggtctggaactcctgagctcaagagatctgcctgctttggcctctgaaagtgctgggattacaggcataagccaccacgcccagcccaaatcaataggactttagaagccacaatctactcacagaaccaaacgtaatcaggcatccatttatgaatcatttgtatcaacgtactgaaatgattagtaaatgctcatagtaaaacacatattcatacctgtagaacatatatttgaaaactaattcccaaatctattactgtgtcttggtttttgataaaattgttgaacttattgttgagatcagcgctgacactcatatctgtatacatccgatgtagcttgctggtaaactcataaccacaggcttgctataaaaaagttttagaaaatacatgaattcaaaagaaaaataataagtcatattggttaataataatgtgtcggtattgctaggtctttgatcaaaggttcttgcatatacacttatacccaaggactagtaatatattcttcataagtcaaagcaactaatcaaaacctttcaaactttctttttaaagacgtattttaaataagtgaataaaaaccacctatctaggaacaataaatctccccttaaacaaaaacttttttatacattcatctcttatttcagcactgcaaaatgccccgttactatacataagataccttaaaaggattttatgttgtgttttgttttaaagacttggggtctcactgttgcccatgctgcaacgcagtggctattcattggagccatcatggtgcactacaacttcgaacacctgggctcaagtgatcctcctatctcactctcccagtagctgggactattggcacatgccacagctgctggctcttataaggtttacagatagtatcaaatgaaagattacataaatgattactgggaatactccagcctgtagtcaattgaaaaagttctatttaggcatatttttaatagcatctactgagtgctgaagaaaactatttctttaaaattattcaaaattctgttgttaccaggtcagaaaatctgaatctctaatcttgaaatataaaaagctcattaacactactttttttttgtaattaatctatttagaggcaggatcttgctctgtcactcaggatggagtgcagtggtatgatcatggctcacagcagccttgatgtcccaggctccagcaatcctcccacctcagccacctgagtaactgggactagaggaacacgccaccaagcccagctaacttttgtatttttggtagagacagggttttgccatgtttcccaggctggtcttgaactactgagctcaaacaatctacatgccttggcctcccaaagtgctactattataggcatgaaccaccacacctggccaacactacttttagaaattaaaaattaagtttctttttggaggtttaaaaaagagcacacagcaactgggtgcagtggtgcacacctattgtcccagctgctcaggaggctgaggcgggaggatcgcttgagcccaggagttagagtccagcctgggcaacatagtgagaccctatctcttaaaaaaagaaaaaggaaaaaaggaatgcatattatattcaaaatgtctactatgcaagaaaatttattgaataacacaggataaatatgaacctgctaccacttatcggtatgtaagcaagctgaaatgatgtaaaaataaattgaaatggaattgcactccaaaatctgtacttaaaggaatattttaggtgtattcatttataagtagtaataatcttttatcattaatactgattatcttgtgaatcttcatatataaacatatacattttgtccttttaatacagtatttgtatatcccactgtgtgactacacaaatacacatttaaccagatgaattgtttcctgttactgtacacaatgctgcaatgaacatctttatgtgcttgtgaatgaatttctaggacaataccacattaaagacttacattacctttaatttgttgatcatggcttcttcagagtccatagacatggataacccatgaattaaacgttttgccagcattcttgcgtagaactacatttaaaaatattttaaaagattacttcctttctaatgatttagcattcagaaataaagttgaccaaaatacaaatgaaacttttctgttcacaacataccttttgaaagacgtccttgtcatcaatgtatttgaacactgtgatgaagctcgtgagcctgtcttccacttcattctctgtcatccctttcgctgacttcttcagtaagttgtcacagtacttagcaagctcatgtagaaattgataataaatcttacaaagggtgcttctgtatatatcacgcctcaaaggaggcaaagtggtgatacaaggtaagatcagcggacagaatttttgctgttttttttagagaccgggtcttgctctgttgccaggctggattgcagtggacaagatcatagctcactgcagcctcaaactcctaggctcaaaggatcctcctgcctcagcctcccaagtagttgggactacaggcatgcacaaccacaccaggcttctaaagctttatgtaataatcataaatgtaaactaaataaaatatacatcataaggtaaatttttaaaaagaacaagtcaaatatcaaatcatcacttattgaccaataaagcaactgatataagtaatacaaatttttaaaagaacacctaggtgagtttcgagtggttttataatttttgacattgaacaagtactttaaaaaaaagttacaaaaatcttgtaagcaagtttccttcaaaggttacccaaactttatcatcagatttcctttagatttcagatgtaacagaatctacatgaaaagtattgcaaattatttcaaagtagatatacattaaaacccaaactttgtaaaatggttattctttaagacacatagtatattgcattccttacataaatgccaaactatatacaatgtagataattttccttctatttttctgaaaaatgctacaaaaaccaaattaatttgatattctgagttctcattttctaatactgacttttcataagattacttttcagcaaccaccaaacttaccagttcaggtgctttgcaaacagacttaggttctctgtaatttacaactgacgtaagggcctgaataaaaaaacacgccataattaaccaccagccatagggaaaaagtacagctagttcaatataagccataatctgtacatccaaaaattaccccgccacataaaacacagcattgccggtagtttgttaatattttcatgcctaacatggtagactcctctgactttattctctaattacaaaatatctatatatcctgttgctattccaagatattctgtaactcattatcgaaatttgaacagataaaataacgttacttaaaaaaaaacttacaatcttgtaagcagctttcctttaacgtatgcaaaagttcatgtaaaacatatctattctcttttcaaatattattcaatatagcctaagtattatggccaaagaaaaaaaatcagtactaaaaattgcaaaattatgcatgtctatccagaacatatcagattaaaaattccccttatatagcataatcacgggacattctacaagcattcaatttaactattcagttaataatttaaaaattatattatttctattttgaatttcatatcaaaattacttaatctccatgtctacatcagaaacctcatactagaattctgatcttgaaactgcctaaagaatgatagagttttatgtacatatatagtatatatgtatttaaaacttaccttatccaacgcactcataaaatgctgatcaccattcaaaacagtgttgataagctgaacaaatttaccatgcacttccaaaactgactccacaaatagtgttggcatctaaaaatgaaatataagtacaaaaccacattttaagaggttcaaggatatccaaactatgaggtttattagacttattagtaaatttttcctcaaggaaattatgtttcacacatgcacacttctcagaaaatggttttagctaagacggtcttagaaatttacaactttggtgttgaaggctgggcacagtggctcacacctgtaatcccagcacttctgggaggctgaggcgggcggatcatgaggtcaggagatcgagaccatcctggccaacacggtgaaaccccgtctctactaaaaatacaaaaaaattagccagacgtggtggcgtccacctgtaatcccagctacacgggaggctgaggcaggggaactgctggaaccagggaggtggaggttgcagtgagcagagatcgcaccactgcactccagcttgggcgacagagtgagactccgtctcagaaaaacaacaacaacaacaaaaaaaaaaaaaaaggaagaaagaaaatagcttgtcattcaacacaacaagctgtcatagactgtctagtacctgtcagaagaacccaccaaaagcatacttttctactgtgttggaataacttatcttaaggataacaagacctgaactaccaggtctatcactttcatagaggcttaaataagcaaagactgcctgcaaagtcactaaaggctgagagaaaggagagttaaaaagccaataatcctgagaacagagaccccttgaactcggcaagacaatccctcacatctcagagagaagaaatacctaatagtacaaaagtgagttttccctcttaatggagataaccatgaagaagttactacctaagacttaactaagtcagttggatttgagtctaccacaaatgtattcacttatgtttccatctcccagccttgacacaaaattcgatgcttctatgcccaatgtcattggacatggaatctataaacgtaataatgtaaactagtaagtttgacaaataatagagtaataaacctgaatactataaactaatagttctacaaaaaatagaaaactgtggtaaagggaatttgaagaaataaaaaaatagaaaacttacacattattgtggcataacataaaaactaaaaattattacttgccaaaaaccaatctgcagctaaggtaacagcctctaaaaagtgctcctgaacagtgacgtctatacacagatactatcttatagatgaagggcaaacagctctacttaagaagagacagtaacatttgaagttatttctctcttgctcatcaaacattaccagtaataacaagatttggtgatgggaaagacaaactgttacagtacaaactgttacagtcatgtgattggcaaagtattcgagaaagatgagtattagggatatgagggttattgttttgggtatttggggcagcaagcatatacttacagaagattattttaatctaaatttgcttcctggacaaccaaattcagaggatatggaaaggaggcaaattgcaagtcgtctatattaccactgattaatactactaccatgacaacaaactacgttatcaatgccaattacacaaaaacacagttatttaaaaatggcgagcttattttcctgtggaaagttaacaactgttcaatggacaccctccgtatggctaagcagcagcctatcaatagctttctaataatctgataattccaaaatgagtccaacaaattctaggtttaaaacatttgaataaagacatttctttcgttggcatggtaagactttttctttcatctttcaaaacaataaagtcaaaggaaaggctccacgctggatctgattaggaggaaaacattgcagtttcccacacaactcacgttttcctgagtaaggttgctggttgctcgaaggccctcatcatggatgtggttttgcagctcctgaatcatatgaggtaaaccagtggacacagcacggagtaagacgtacatatttgccatgtctgagaggaaaaagacatctgagggttaactcccaaatattttcatttattaggtaatatatggatccaagtgcaggagtacaatatacggatccaagtgcagagcacccagagaaaagtcccccatgcccacctcccagccacccaagcccctctccccacaggaaagggatgtggttatttaacatcttcccaaagatattttgtgcaaattcaagtgaatacatatattcttccctttgccccttttaatacagtgtactgtattttgtatattatttgtagcttcagaacacattttaacttagtggtcttttcctatcagtacacaaagcatttctatgtattttacagctgcacagtactccattatgtggatataatttcttaacaactgatggaaatttaggtggtttccagtctcttgatattgcaatgttgcaatcaataatcttatacatgagcaagaatatatgcaatataagttcccaaaagtgaggttactgtgtcaaagtttaatcttgtagacagatccttctaaccacagctgccaacagcagagagttcctttgccaacaatgtgttgccaaatgttttgatctctaacactgggaggtgaataatgatctctcagtgtagtaggtttaattttaaacgtttcattaaagcatcatacatatacagaaaagtatacaaaccataagtgtatatcttactgaattatcacaagtgaacacacaacacacccatgtaatcacacgcaggataagaaacaggcattacctacacccaggagtccccttcatgcctccttccaatcacacactcttgctcctctgcaaaggtaaccactgctgtgacttctaaatcacagatgagtttgaactacgtataaaaatgggatcacacaattctttcgtgtctggcttcttgtgttcaacatgtgtataaggatcatctatgttgttgtgcatggctttaatttgttcatttccactcctctataatattccattgtatgaatatactgtactattctacagtaactggacatttgagctgttccagtttatggagctattacaaacactactatgaacattcctgtatgtctttttgtatatatgtccaggcattggcagtggggaggtaaagctggggggtggttatatgtttaggagaactgctggatcataaaatatgcataatatatcccacttagcggtcagtgccagtttcccaaagtagttgcatcaatttatactctcacttcagtgttcaacaagttcctgctacttcacacttctttctatgtttattggccatctgggtatcttctattctgcagtgcctgttttttgagcattttatattttggatataaatctttagtattgcaggtacattaccctataactgtcttctgatgatccagtggttttaatggctttttttgagacagggtcttactctgtcacccaggctggagtgcagtggcaggatctcggctcactgcaaccaccacctcccagattcaagtgatcctcccacctcagcctcccaagtagatgggaccacaggtgcacaccaccccgcctggctaatgcttgtatttttttgcagagatgggatactgtcatgttgcccaggctggtcttgtactcctgagctcaagcaatcttcctccctcttaatggccttttaataatccaaagtttttcattttaatgtagttcactggatcaatcgttcctttgtggttagggctttttgtgtcctatttaaaatatctttccctgtctcaaggttatgaagatattcttctatattatcttctagaagtgttatttttttaccttgtacatttagagaaaaaactcaatagtgaattgattttgtatatggtatcttgaggtagtgatcaaatttcattttcttctgaaatggatatccaattgactgagcaatgcgtgttgaaaagaccatcttttacctgccgctctgcagcgccaccttggtcttacatcaagtggccacatatgcttgggttgtttctaggatctcttattttattaggatatctgtctgtccttgtaccaatgcctcactgtcttaattactataggttttacaataagtcttgctggtcattaaagtctttccatcatactcttcaagacagtgactttcggaattaaaatgaaattattgggttttgactacattgccctggatctatgaaattaatgttgctgtaaaaaacacggggccaagggtggtggctcgtgtctataatcccagcactttgggaggccaaggcaggtggatcacgagctcaggagttcgagaccagccggccaacatagtgaaacctcgtctctactaaaaatacaaaaattagccaggtgtgggggcggatgcctgtagtcccagctactcaggaggctgaggcaggagaatcgcttgaacccaggaggcagaggttatagtgaacagagatcgcgccactgcattatagcctgggccacagagcgggactccgtctcaaaaaacaaaaacaaaaagcctgattaatggccgggcgcggtgactcacacctgtaatcccagcacttcgggaggccggggcaagcagattatctgaggtcaggagctcaagaccaggaggccaacatggtgacaccccgtctctactaaaaatacaaaaattagctggatgtgatggcacacacctgcaatcccagctacttgggaggctgaggcagaattgcttgaacctgggaggcaggggttgcaatgagccaagatcatgccattgcactccagcctgggcgacggagcgagactccatctcaaaaaaattaattaattaaataaaatatacatatttattatctttcctgcctataaaagtaatgcatgttttttgtttttttaaaaatcagagaggccgggcgcagtggctcacgcctgtaatcccagcactttgggaggctgaggcgggcggaccacaaggtcaggagtccgagaccagcctgaccaacatggtgaaaccctgtctctactaaaagtacaaaaaaattagccaggtgtggtgatgagcgcctgtaatcccagctactcaggagtctgaggcaggagaatcacttgaatctgggaggcggaggttgcagcgagccaagagcacgccgctgcactccagcctgggcgacagagtgagactctgtctcaaaaaaaaaaaaaaaaaaaaaaaaatcagatatagctgattttttatattatataaattattacatttattacataatatttgtatttcctttttatagtctttgcctttattcctactgtttatcaggaattctaaatgcattaaggaaattagctcttgtaatatataaaaatgtataaacacaatttcccactttttcttctgattttagaacactctgaaaacactttcctaaaatagtctttcaaaataaagtattaataatctgtaaaaggttatttaaaatattttaaagactattactaaaataggcattaaatcaagggtgactagaggatgatataaaaggtggatttataatttaatttctactcatgtttggtgtcacttaccattttttttctcttgtcgaattatattatgacattctgcatgtaaaaactgtaagtggtctgctaccattcgttgttgacattcatgaatcaccttagtatatgaacttggatgtaggtattttcgacatcgaatttcttcatcttttaatctacctagaacctataaaaatattttcttacagtcatgaacacaaagttttactatgaggaaaaatctgtaatatcagcaagtaactcagccaaattttaatggctgaattaaacatggcaaaggtaataagggttacataagcaatttaaacccacattctataaatcatttcaaatttttatttaagctactagctgtcatctacattccaccagtcttataagcaagaactaaagttaaatagtctgcattttgtcttcatttacctacaccattcatcctattacatggacaacataacatgtaacaggaaaagtgggtacagatgattaaattcagaacaggtgatctctgttatgaataactatcaaactaaaaaataaattatattgaaatcaagtagatgaatctaattattttacgttggtttctcttcttgtaaatggaactgtatgtgcatgatagttaactaccatattaaagatttaattaaaatttttgaaagtaggggctggacatggtggctcacacctgtaatcccagtactttgggaggccaaggcaggtggatcatctgaggtcaggagtttgagaccagcatggccaatatggcgaaaccctgtctctactaaaaatataaaaattagccgggcatgcctgtaatcccagctccttgggaggccagggcaagagaatcacttcatcccgggaggtgggggttgtaacgagccaagatcgcaccactgcactccagcctgtgtgacagagtgagacactgtctcaaaaaaataaaaataaggccaggcaaggtggctcatgcctgcaatcccagcactttgggaggccgaggtgggtggatcacatgaggtcaggagtttgagaccagcctggccaacatggtgaaaccccgtctctacaaaaatacaaaaaattagccaggtgtggtggcaggtgcctgtagcaccagctactcgggaggctgaggcagaagaactgcttgaacccaggaggaggaggttgcagtgagccgacatcacgccactgcactctagcctaggcaataagagcgaggctctgtctcaaaaaataaatataaataaaaaataaaaaatttgaaagtaaatataatttagtcatagtcaagtatgtcaatcaagacttttattaaagtttatcctacataaagcgctgagctacaaataacactggttaatatcaacaagaactagcccataaggaaaataaccaaagaatttgactaatttctgtctcaagacaaaacaacaacatatacacagacaaatgcaccggcttggaaacactctggaacataaagctgtgtaattagagtttctgaaattaagtgttcccggggaactacatacacctggcactttggagagtgctgctgagttggcctgggcacaaggagtgaaaatcattcctggaaagcggatcagaaattttcaataaaaatgaggctccagacagtaggttcccacagtcctgtctttcctattgtgcgaccctttgaagccaggagttcagggcaaagtcacagactcaggtcgggcaagaaggggtctagagcagcagtccctaaccttttaggcaccaggctctgcttttgtggaagacaatttttccacagacggagtgcgggcggcattggtgggggcaggtggcttccaggtgaagtattccacctcagatcctcaggcattagattcttctaaagagcgcacatcctagaccccttgcatgcagagttcacaatggagtttgcgctctgtgagaatctatgagaatctaatgctgctgctgatgtgacaggaggcggagctcaggcagtaggtaatgctcacacagtggctgctcactccctgctgtgcagcccggttcctcctaacaggccacaggtcagtactggtcctccccagttcctaacaggccacaggtcagtactggtcctcagcctgagggtcagggacccctggtctagaggacaaaagtgttcaccacatattacatcagctaagaaaggcactttgattaacaataaatcctttaagggctatttttataacaaaaaggattaagtctattagtcattcagagcatactatagtgactttaatctgcttgccaagttaatgcaacaggaattacagtgggtctgagagaggtgaaggaggatggaagaaggaaaaaataaaacaatgataacttgggagagagaggcgcatatcaagagaaatgtagagaaggttggactgccccagtgcagggcttcaaacagctgtaaaacccctgggggaaagaaaggccaaagctataagaggaacgcagcaaggaggcaggaaggctgtactgactcattccccaattaactaaatggagagcaaagcccagggttttgcccttgaagctaatatggtccaacattatttcctgaaatgagcttttctttttctttcttttgtcagacaggatctcgctctctggcccaggcaggagggcagtggtgcaatctcggctcactgcaacttccgcctctcaggctcaagtgatcttcccacctcagcgtcccaagagctatgaccagacgactacaccaccatgtgtggctagttttttaattttttgtagagatggggttttgccacgttgcccaggcttgtcctgaactcctggacttgcgtaatctgcccgcctcagcctcccaaagtgctgcaattacaggtctgagccaccgtgcccagcctgaaataagcttttctaataaacattcttttccaaacataatttattccaatgtccctccttcccttttaacaccttgagatgtaatttacatattaaataattcacccatttaaagtgtgcaattcaatggttttggtatattacattatcaatgtttttaaattgtggtaaaaacatagataataaaatttacattagccatttttatgtgggcaattcagtggcattaaataacgctcactatgttgtgtaatcacccccattgtctacttccaaatatttttcattaccccatcagaaactttataaccattaagtaacaactcctcacatcctcctcccctgataacctctaatctatcttctgtccttttgaatttgtctgttctagatatttcctataaattgaaccacagaatatttgcccttttgtgtctgtctttttccacttagcataacattttcatggttcatccatgttgtatcatgtataacttcaattctttttaaagactgtgtggtgttgtgatatgtaagtacattggttttcatctgtggttcctggttcataactcccttagccctagttacagtctttagttataatgttgagtgtgttaggtctcaggaaacagaatttctctcctactctcctttcacctgcctcaaggcaggactctaatcttgccctacctttctgactgtgggtcataagaccctccccagagaaagccccaccctgtacgctgggggaaagactactgacatcatgaagcttccacaaaaatccaagaagactgggttccacagggatagaagctcctgcactcatggtgatttcagaccttcccttatgtgtctcctcaagtggttgtttatttgtatcctctaaaatatccttcttaatgaactagtaaacattaagtgagtgtttccctaagttctgtgagctgctctagcaaattaatggaacccaaacagtgtactgtaggacttcaacttgaaagccagtcggtcagtagtccggaggcccagacttgtgactggtgtctgggggtgtgcagggcagtcttggagactcagtccccaaactgtgggattagccactatctcaagtagatggtgttagagttgaactggaggacacctagctggtgtctgctgcttggtgtgtgggagaagagagccacacctttgtttacagaagccttctgtgctgatgattgttgctgtggtgtgagagtagaggaaaaacatggtttgagagagtttttcactacacacgatgaataatattccaatgcacatatgtatcacattttgcttattctttcaacttctaacagacatctgggctactgccaccacttgccagtggcatatttttgacagccagacagagcaaagtgcatgtatcacagataatctgtgtgtgattcttggggctggatctagaggcttcaacaaaagtctaaggtgcaataagggctaagagcttagaaccactgatctagtgtaacctgaacttaattgatgggggaaaagttccagataatttgctcaggggacagagctaactagtaagaaaagcaggaagataatcaaacaactaagacctctagatctgggctttgtggatgacacaacagtgtatcggtaagcacggatgctttgtgacttgtggcctagggatgtaggatgacagctcacccacttaaactactcgacctttcttggctacataaactaacacaaaccatcccaaaataaaatgcttgaaatccaacactgcagatttaaaaacctggctagaagttctaatatatcttacatatggtggtttaatttgtatgaacacttttttcttctactactgagaaaataaacatgggatttaacatatgataaccaatatgtactggtttagtgatcaattaaaatttcttggctgggtgcaatggctcacatctaaaatcccagcgctttgggaggctgaggcaggaggactgctcaagttgaggagttctgagaccagcctgggcaacacagcaagaccccatctctataacaaattttaaaagttgctgggcgtggtggtgtgtgcctgtagtcccagctacttcgtaggctgagacaggaggaccacttgagcctgggagccatgatcaagccactgcactctagtctgggcaccagagcaagaccacatctccaaaaaaaaaaaaaaaaaaaaaaaacacctcacgtggggttgtctctcagcctttcaagaacttaacagaccaaaagagtgactcatccaaatgtctagaattactatattttcctcatatttttcctctcattttaaaggaagaaaaaaacctcaacacagagcttctgcacttatcctattctctaaactaaccactaagcatgaaatccagtataaactgattattctgccaagaatgtgcatatatattaatttcaaggacaagtaaaccaagcagtcaggatttatcaaaaagcatcaattatgatgaaaactggaagggtattgtaaagagcaatgacttatcaatcgatattatataataactgtaactcagagttaatgattaaatagattaaataaacagaatatttttccaccaagaaacaaaacaagaaaactaagaacgatgttaaataaaaccaggccagatacaaaatagataaatgtattcgatatgttttatttcttaccttttccatatactgtgagcagtttgattcttgtaataaatttgaagcttcttgtttgtaatactctcctgtttcagtcagaaagggagactcaaaaatttcctgataaaactgaataaatcaattacatcatattagaagaaattagaacaagcagtttaagaaattaacagtctgattatttgtttttaaaggaggctgtttacctttaaggggaattttttcttatactgttcaacatgaacaaaggagttaataaccccatggattactttctggtttgggtcttctccaccacgatcactaaaacaaggtataacacaaaatattcttgagaatacaaattatctatggaaatatacccaaaatatgccaaaatatggctccttattctattggtctaatcaaagtgtaaagaactataaaaaggtacatgcatgaatcttaacaatgattttttttatatcacagctgagttaatattcatgatagttaatgtatacattagatgtcatttcaagaaataaaaagaaaactgattgtaaagttcaagatactatgtcagtaataagataacacttctttaattttaacaaagtagatacgagcccatcaattcaaaactttaatactggcggttaagaatgcttgattttcactcactacaaactacaaagtcttaatcatattaagacatgtaggtgaaatgttagcttttctaataaaaggaatatgaaatagaaccaggcaccgtggctcgtgcctgtaatcccaacactttgggaggccaaggtgggaggatccctgagtgctgaatttgtgagctgcctgggcaatagagcgagacctcattcaaaaaaaaaattagccatgcatggtggcacacacctgtggtcccagctactctggaggctgaggtgggatgatcccttgagtcctgagtttgagactagcctgggcaacatagcaagaccccatacaaaaaaaaaaaaaaaacaacttagctgtgcatggtggcacatgcttgtggtcccagctactctggaggctgaggtgggaggatcgtttgagcccaggaggagtcgaggctacagtgagccacgattgcaccactgcactccagcctgggtgacagagcaagaccctgtctcaaaaattaaaaaataaaaataaaaataaaatagaaaaaaagtttgcttaaagccacagtaaaataatctagctctaaattgggattttgtgactctagtaccaatgctcaaatcaaaccattatggtttacctcactacacactcttccaacctactttaaaataatttcttctttgcattaataatgtcacaaagagagcaacagaaaacttattatcatcattccctagtaagagcttgttgctctatatataggatgtaagaattttctatcattgaagaaaagcatcaaggaaaagcatccaggcaattacctttacatactagagtccttccctgcctctgaacccctctagtcctctttgattcttcctttaattatttggatattctgagaactattttttggacatgaattaatatggctacagtaattctgtcagtcatagagaatcttgatatcttgatatcactgactagttcatataataaggtcacacatgtgagctcatttccttggcttgggtcacatgcgtgacctcacataagcccacattcaatctggtgagatactgatctgaactgttacctattttctcatgttctgcttatggtggaagaacagatactgtggaggacatactggcaaaactctaagtatacacaccctatgaccccaagcaaacatctacatatgtgtacaacagaaacaagagtggtgttagtggaaaaactggaaggaacctaatatacgccactaggagaagagtttaataaagtgaggtaggcctctctagtttaagtctgagttcatcctggtaaagtttaaaaagctaactggtcacctaaggatgacagcaaaccaactcattatcttaaaaactgggttattggccaggcgcagtggctcacactggtaatcccagcactttaggaggctgaggtgggcagatcatctgaggtcgggagttagagagcagcctggccaacatggtgaaatccagtctctactaaaaatacaaaaattagctgggcatggtggcgcatgtctataatcccagctgctcaggaggctgaggtaggaaaattggcttgaacctgggaggaggaggttacagtgagccaagatcgtgccacggcattctagcctgggcaacagagtgagactctgtctcaaaacaaaacaaaacaaaacaaaacaaaacaaaacaaaaacaaaaaactgggttattaaaaaggaaagaaacaaacagttattttgcttttcctatatgaactctaccattgggtaactaaacagtaggtgagaagaagcatatcttgataaaattttccaggtaataaagaagaacaaaatgatagatggctctaacaagcagctctataatatgctgactaaattactaatttcttcatttcctttaactgacattcccacctagaaaacaattttaaatatcaggaattctattcactgtaaaagaaagatgtggctcacatcagaaaccctacctcaacctccatatttgcttaattctctatgatagttcctcaattctgtgagtgaacacattagattacaataaaaaataatttggttaaagatttctgggccaggcgcagtggctcacgcctgtaatcccagcactttggaaggccgaggcgggtggatcacgaggtcaggagatagagaccatcctggctaaaacggtgaaaccccgtctccactaaaaaaaaaaaaaaatagccgggtgtggtggtgcgcgtctgtagtcccagctactcgggaggctgaggcagaagaatcgcttgaacccagcaggcagaagttgcaatgagctaagatcgtgcaattgcactccaacctgggcaacagagcaagactgtctcaaaaaaaaaaaaaaaatacaggcataaaggccgggtgcggtggctcactcctgtaatccccacacttttggaggccgagaaagttggatctcttgaggtaggagctcgagaccaacctggccaacatggtgaaaaccggtctctactaaaaatacaaaaattagcagggcgtggtggtgcccagctactcgggaggctgaggcaggagaattgcttgaacccaggaggcggaggctgcagtgagctgaaatcatgtcaccgcactccagcctagtagacagagtgggaatcctgtctcaaaaaaaaaaaggaaaaaaggacaggcataatgaattcagagttagattagcccagatgtgaatccctagaattattattagatggaggctggagtcaaatgatctgagtcagatcaccaccattgacttttgcatgtcaaggatgtcatgcatgtaaaatggtgacactaatagtattagccttccagtgttgtgaggattaaatgggaagatggatgtaaaatttttagcacaatgcttggtatgtagttcccatgtttaatttctattattaatatgccttagtttccttaactttaacatgcaaaactctaagagagctgtcatgaagaataagtgagatcttagtaaagcatgtgaaacaatgctttaatggaagccgattataacaacaaaaataagacaagcagaccagataatctatcttttccagaactaatatgctttagttgtattatttttcttacattgtttccttcattttttatcatattgatttttagcaaactaacaatcacactaaaaatttactaggttgggacaaaattatattaaaaaagatatttcacaaaagtacatttagaaagtataacagtattgtcattatacttttaaatacttgaattccaagtcaaaagaaaagttagtatattttagcaggagaaattatattagaacttagaagttttgttgggagtgttcttttagttcacagttttgtaaagaaaagaggaagaaaaacaacgggttacaccctactgcttcagtattgcctttcctctccagctctctatctctaaaaacaatggaatcactcaaacggtcagtgacaatttttaaaaatcaagttactagttgttaccacctactttctattgggtatcaaaaatttaaaaatattctcttatcttcttatgtgaggcataggggtgggtgtgtgtgtttaatcccttacttcctcccaggagtcccatactaaataccacggctttgacaaagtattcctcatataaaaaaaactccttatttaggtcttcttgatgagcacagatataggtggagtggccattattacactacaattcactggtctagataattcctataacatcagttccagtaacctggaatttactggatatatatttgtgtgactgacagagtgcttctgagagtctttgagccagagctaatccaaggatgttctattctagactccacaggaaaatgttctttgtactaaattgtattcacacagcactagggtaaaaagtgttaaccactctgagccatgggtagagtgggaaaccattttcccataaatttatctcacagaattaggcaagttattgattataacactgaggctaagaggtagccaactaactagaagaatgtcttcctcaataggtggtcctcacgaggatttaaacaggtaatatgtacaagcaactcagggcactgcctagaaagtctaagagttttcagctctgaaaagcaataagtcacttccctcagatacttatttatatactaagcatattagggtataagaaaagaccagagctccccccaccaaaaagaaaaaaaaagaaagaagaagaagaagaagaaaataaaacaacttaaaaaatgctggcattggaagtaaaatgaggctcattacagtaaaaccagccccaaggctagtcactggctctgcaattgtacactattttaaaaccatatcaaacaacaaaataaaattgactcagtaagataaatgtcagcactcactttttgatttctcggagcagcattcggataaggatggcctgaagtggttcaaccatcaatttcctccacatatccaatgctagctgccgggaaaaacgaaaatcatcagggctgaattacttagtatatgtttaacatttcctcaaggttttttttaactaaaaatactcatcaaaagaagtatttatactaatacttcaaaattcaaataaaacctgaacaaaaatttaaaaactcaaagaaaacaaatttctaatttgaaatatcagtgaccactctactagccttatcaacattaaggttttattattagttgaaaatcttaagaaataattgattattataaaaccttaatttaggccaggtacagtgggtaacgtctgtaatcccagcactttgggaggccaaggtgggcacatcacgaggtcaggagatcaagaccatcctggctaacatggcaaaaccctgtctctactaaaaatacaaaaatgagcctggtgtggtggcatgcgcctgtaatcccagctactcgggaggctgaggcaggagaattgcttgaacctgggaggtggaggttgcagtgagcccagatcgtgccactgcactccagcctggtgacaacagtgcgagactccgtctcaaaaaaaaaaaaaaaacttaattttttgattgttaaaatgctcaacactataaatgggctatagatacctagaccgtaacagaaacaaaggatttatgttaaatgaaataatgtgatttggctgtagactgatttttttaattatgaaaaattttataccaacataaaaagagcaagtcggttaaaagagtaataaaacattcctgtattcactacccagtttaagaaatacaacttcatcattaccattgtcccagatatcctcctcctttcccctcaggttattacaatccacaattttgtgaaacccatccagtggaaacatacagccatagctcaatcattggcactgctatacagcatcctgttgcataaatatgccatgatttatttttccactctactgctgatgactgctgatgtgtctgtgattcctattttctgctactggaaacaatgctgtgattcctgtatgcatcatttggcccacataagcaacagattctctgatatacatctacaagttgagatcctgtactgaacaatcaagtgctcatgcagctttactaaatcaagccaaatgattttccaatttatacttgcatagcaaagcacaagatttcccattagtccccatccttgacaacaagtggtactgccaggctttagtcaaattttgccagtctgctggacataaaatagtgtctccttggccaggcacagtggctcacgcctgtaatcccagcactttgggaggctgagacgggcggatcacgaggtcaggagattgaaaccatcctggctaacagggtgaaaccccatctctactaaaaatacaaaaaattagcggggcgtggtggcgggtgcctatagtcccagctatgcgggaggctgaggcaggagaacggtgtgaacccgggaggcggagcttgcagtgagccgagatcgcgccactgcactcccgcccaggtgacagagcgagactccgtctcaaaaaagaaaaaaaaccggccaggcgcggtggctcacgcctgtaatcccagcactttgggaggccgaggcgggcggatcacaaggtcaggagatggagaccatcctggctaacatagtgaaatcccgtctctactaaaaatacaaaaaattagccgggcgaggtggcgggcgcctgtagtcccagctactcgggaggctgaggcaggagaatggcgtgaaccggccgggcggagcctgcagtgagccgagatcgtgccactgcactccagcctgggcgacagcaagactccgtctcaaaacaacaacaacaacaacaaaaaatagtgtctccttgtggttttaactctcattttactgaatgaagctgggaattctttaatgtttattgtccattttgggttcttccctgtgaaacgcccattcctaattttgcccgttagtctgttaaagtttgtcttgttcttaataaaagctagagttttttatatattgtggaaattaatcccttgaaagtttcacagtctgtcccagtaaatcaactgctcggtttctttattgtgttttggtaaaaatatattaaagtttaatatactcaaatttaccaatcttctttatcatgggtattttttaagaaatccttctctgccctaaggtaataggcatatgtgtggtcctactctgccttccaagttttcaagctttgcctttcacatttaggcctttaaacttcaaatatattttccccacatagagtataaattattccagtactgaaaaccaattttttgtttgtttgactcttctctttttccaccctaactacatccagataggctgttgctagcctccctattgtttccctagggtaattttattctgatccattggtaattaagcatctgtcttcccacaaggaacactgttcaagttttgcctttctttcttaatagcatgaatgggggttggggaggcaatacatgaaaaactggtattttacacatgtggtggaagggcaaactggtaaaggcccttctgaaaggcaatggggcagagctgcgaaacttcaggatgtgcttcgacagaggctccacttcctgacacccagtctataaaaagttctgctcatgtaccaagagatacacataaatataactccatgagcataagatttttctctattttgttcactgttgtattcaacatatataacacagacgggttcaaaaatacttaatgaatgaataaatgaatagtggtgttcactgcagtgttgtttgtaataacaaaaaattaaaaattggggggcgcggtggctcatacctgtaatcccagcactttgagaagcggaggcaggcggatcacaaggtcaggagatcgagaccatcctggctaacacggtgaaaccccgcctctactaaatatacaaaaaattagccgggtgtggtggcaggcgcctgtagtcccagctacttgggaggctgaggcaggagactagtgtgaacctgggaggcagagcttgcagtgagccaagatcacaccactgcactccagcctgggtgacacagcgagactccgtctcaaaaaaaaaaaagaaaaaaaaaaattaaagggatagtttaaaaaattattctgtatctctacagaatattaagctttcacaaaaaacaaacttatgtaaaaagacagacagtaacaaataacaaaaaaaaaggcaagaaatataggctgtagaactttatgtgtgccgttttatcgcagtttgaaaaataaaatcaaaactgctgtgtgtgtgtgtgtttatgtaaatatttataaatacacaggtaaagttcagaaaagatgcgaactaaattgtttacagtgattttctgggaagagaagtgtgcttgacagtgctggtgataagggaatgatttattcacttacaatgctactaactaaaagcaactactgttaatattttggtatttctcattgatctttttctctatatcatcttttccctataattgtatttgtattcaacatatacctataattttgtgtccaaattttttcataaacaatgtcccctttgttaaagtttctatgaacaattttctgctattaatttatccatttgcctacttttataacaaaatcatatcatatataatacattcttcttccatgctttttattgctgaatgttggatgctgaaattttacactgttcagccattaggcaccctattaacaatgattgcaaagaatacttttaaacattaaactcttttctaatatttattattttccaagtatggatcactaggcttaggacttgggattacttggtcaaaaggtattaagtattttaaactgtactgaaagaaagacactgatcaatttctttcggaaaggattacactaccttaaatgtctcctaatgctgcctcttagcctgtttatttccttcattaacataaatcacaagttaacattaatttcctatttggcatctgcttcccttacatgaacttacaagcttttgtgtgcagggaccttctgtctgttcaccattgtatccccaatgcctggctactcaataaagatgtattaaatgaataaacaagcttgtacaataatacttctttcacaatcagcataattttccatattttaatttgcactgtacctcaagaacttgaatggaccaaactgcccatttaattgtttcactctgaatttaattacttttaaagtaaagttacaataaatttgttgtatccataaatttgtgtttcctctcctctagcctgtcttttaagtacttgtcccctgcactttttaactacagggccgtcaacactttataattgtttctgagttttttcacaatgcagaaccattaactctatcattcatccattataaatttaattatcaaaagagtagttgtcacatctttttcgttcctgaggattcttaggaaatcactatagcattttatttaggatcttttaaatcttgaccattttaagctagccaaatcagtgtccttaaaaaatgatgtgcaatcaaattacctcagtgtataaaaacatacttatgtttgctagtcacttaaagaatgtcctacctctcctatttccataagtggttcattcatatctacaccaccatagccatactgaaggtccgcttctgttaatttattctttttaataaactgggtgttgagatacctggaaaataaatgtaatatcaatggatattaagttaaagtcagtaggaaagcaaatgacttgcaactttagaagaatatttttaagattacatataagccatggaatagcctactaacaaatccaaaagaaatgaattatgtagagattagaaatataataaaaattaaaattatcagcccacctttctctgcaagcccttacaatacccttctagcccaacagctcttatccaagtttcagaatttctataatctcgtttgctacttcccagactcttcttgggaaagtcaagataaagtccactttccaaaaattaaacagagaatggttaaaagataaaagtcaagttagctttctaatttatattctaatcaccaggaagaaatgcaatttttcatttttaaacaaaaaagatcacaatcagtaggtaagaaaatggaacacagtgttacagatagtaagtatgggcaagattgacagatacaagatgactttgtctaccagaggaaaatgaattatactaaaaatgtttaatatatttcaagactaatatatgtgattaactcagaataactgagatgaatacagaaatctaaaataaaataaaacatggagaaaggactcgtaatgttcaactgtgtagtttttaggattccagatttcactataatgcctttaaacagtcaccacctaaaactattcatttgaaaggttctgctagtgtaaatagctactgacaatacaagtattttaggcaacaacccatgaaatctatacatgaatatatacacttttcaaaattcactacaccaaaatgaagggtccactcagcatttacagacaaattaaaaacgaagacaaccaaaacaagacaacaattttgggaaacaattaaacacataattcctggccaggcgtcggggctcacgcctgtaatcccagtgctttgggaggctgaggcgggaggatcacttgaggccagcagtttgagagcagcctgggtaacagcgagactgtctcttaaggaaataataataataactcctagaaaattgactccaaagtggtatacccacaaccatttacacaagctccatctccatattcactagtcaaggctctagactccatggcttacaaccttgatgtaccatttgatattttagtgtcctctgaccataagttacaagatcatactcttttttttcccctttaaaatgccatttattccttcctctctatcctcactgtaactctcaaaatttcatgctgagtttccaaccatgccttccagctaaggaaagaggaataagattgagagacaaaagtaaaaggtaaagaggggatggcctctccacctaagtgccccatcccagatattctgagggtagtcagtcccctttcatccgagtctcagcacagacacacctttcaggtgtgccctgaaccccagaggagttagccttcacttcccagccctaagcaagtaactatttaacgcacaactgttttactttcttcacagtaattgctactatatgaaataatcctatgcttttattggtttctttttttgtgcattcatcttctctctagaatgtacagtatacaaagcaagaacctcctcttgtagacagcatccacagtagtggcaggcaaaagtcaagtcctcaaaaaataattactgaataaataaatggataacattccagacagcaaggatagcaaaagctaacagtagaacacaaacctggaaaagcagcctgcagccagatcataaaagccatgaataccaggaaataaaagtaatcactaacatttattgagatcacctgtcagacacagccctaagcattttatgtggctgaatactataagacagatgtatgtggtactcctatgatcattttatacataagaaagctgcagcctagagaggttaaagagcttgccaaaggtcaatcggctcctaagtggcagggctggcacagaaactcaggagaggtcttccactcccattcaacatcggctgagggtatatcgtgtgccaggtcaacatgaggcactggaaacacaaagatgaaaagcaaaaatatggtctctgcccacacagagctcactctgtggtacaatatacaaacaaatataagatttcgtcaggagcggtgctccctcagtagagggtacttaattgtcatattaccatttacatatgccttccaatacggaatctgctccaaaccagttttcttttctggtcactggcaccaagaccattccagtaacctcgcctaaaacatcagaatcacttatctcatccttccattttgcctgctttaatcagtcagtcttcctgtcttcctaaagtatgcatcacttcctctcactacttcctttgacttccaatctacttgctgaccctctgccccgattatgtggaacacttttatgactgggctctacttcagtttctggcatctttaattcatctaaaaattctgctgtcaggatgttactttcctattcagaattctacaggagcttcctttacctacataataagtgtaaactgcctagcatagaagcagatgctaaatctgcagatcaggcctgcattcactaatccattccaaagatctagatgtatattcttgagccaggtattgatttagtgcagctttacatgctttgtatctgcaaagacaaaccagtattatcttttcctcacagaataaaatttaaactaacttacattaactatgtctttcttattgcagatttttactcttggtaaatttaagcttgaaatacaatgttttaaaataaagtcatggccaggcacggtggctcatgtctgtaatcctggcactttgggaggctgaggcaggcagatcacctgaggtcaggagaccagtctggccaacatggtgaaaccccgtctctactaaaaaaatacaaaaattagccaggcatggtggtggttgcctgtaatcccagctactcaggaggctgaggcaggagaatcacttgaacccaggaggcggaggttgcagtgagccgagatcgtgccactgcactccagcctgggcgacggagcaagactccgtctgaaaaaaaaaaaaaagaaaaaaagaaaataaagtcacaatttaaaatataaacagtgccatttttcattttaatatggacaccattcttattttataagtcactgtagtattttacaatcaaatttattaaccacatatttgcttcttaataaagacatgggctggacgcagtggctcacgcctgtaatcccagcactttgggaggctgaggcaggtggatcactcgaggtcaggagttcgagaccatcctggccaacatggtgaaaccccatctctactaaaaaaaaatacaaaaattagccaggtgtggtggcgcgtgccagtaatcccagctactcaggaggctgaggaaggagaatcacttgaatctgggaggcggatgctgcagtgagccaagattgtgccactgcactccagccggggaaacagcgagactcggtcccaaaaattagtaataaaatttttaaaaaaagaacatttatgattcatgggagaaggtctaaatatcattatgaacaggtgattagaagatgctgattctataaagggaaataaaatctcaggattcccaaaactcctatgccaaaacaggaatttaaccttggaggctgagtcatgctaaatggccatcctcttcctggacgaataactcttacaagtttgtgtcgaaacattatatattagccagacccccgtggtaaggcaaaaagcctcagccatttcctgatgactaacccgcctcaaaaagtcactcattcgtaaattctttgctagcctcgaaaccattaaaatgtaaatcctcccataacacaaggacaggtccattgtaactccagatctgtagtctaaagtctagttcctaaaacctaaggtctgctagcatccacctgataagtgtcgattcttagctgataattcccaggcacagagcaaaggcaagatgagagtaatcattccttccctgagatgtctgcacaactgttttcttcttctatttccttttgcttcaaaggtttatcttatataaaatgtagatttactgggcattaattagtctcacaagtaggtaaccatttgcctcactgccaccacccctcatgttttaaggaaaatgtataaacactaaccctcctaagaacctctttggacaaaacagccacagatgcatctgtgccttgcgtttttcctgggagcatccttaagctagctcaataaaccttgattgagacagctgcctcagtcactcaattcagttaacacttccaaccctcatggatgagttagggggtcaagacttcaggggaggaagtgactggaggtgtggtggaaacatcaagagaactcagaagtggatcctgaagatgggactgaattgctgcaatctcatgatataacttgaatggataaggagttgcttcttatggatgagaaagtggtttcttgagacagaatctactcctaataagacggtatgaacattgttgaaatgacaacaaaggattcaaatattacataagcctagctgataaggtggtggcagggtttgagaggactgactccaatttcgtaagaatttctactgcaggtaaaatgctatccaacagcattgcaccctagagagaaatcttttgtgaagaaagagtcaactgatgcagctaacttcattgttgtcttattttaagacattgccacagcctccccaaccttcagcaaccaccaccatgatcagtcagcagccatcaacaccgaggtaagaagactggcaaaaggattacaacttgctgaaggctcaaatgatcaacagcattttttttagcaataaagtaattttaaattaagttgtgcacatttttttagacaatgctactgcacacttaacagactacagtatagcataaacataacttatatgcactgggaaaccaaacaacttgtgtgacttgtcttactgcaatattccctttacatgtggtggtctggaactgaacccacatcatctccaaagtatgcctgtacaagaagattgagaatagaatctacttaagtgaaataccatgtttctggaacaagattatggtagaatgaagtggttaaatggatgggctttggattcagactgatctgggtttaaatcctgcctttgtgattcattagctgagtgaccttcaacaaaatcatgctctcagcattgctttcttcctctgtaaaaaacagagatactaactaactcatatcattttacacacacatacacaaacacatattaaataggctgcaacatttactaaaagttcacaaatagcaccaatttaatagtactaatttagccaggcacagtggctcatgcctgtaatcccagcactttgggagactgaggagggaggactgcttaagctcaggagttcaagaccatcctgggcaacatagtgagacagcatctctacaaaaaatgaacaacattagccaggcatggcggtgcacacctgttgttccagcaactggggagaagggtgttcgaggtgggaggattgctagggcccaggaggctgaggctgcagtgagctgagatcatgcaactacactgcagcctaggtgagatcctgcctcaaaaaataaaaaataaaaaaaaggacaaaataaaagaaagaaaaatagaaaaagaaagagaagcaatccaggcagatggaacagcaccaggaaaggcaggaagatgggagagaccatgggccattaggaaactacaagtaattcaatatgcctagaccatggggaatgcagaacttcaaggggaaaataacccagtaatttatctaacatcgtttgcatcaaacataaaatactgaatgctagagtcaaataagaacatatcgaggggacatgagctgagattttcccactaagtttcatgcaagttgaattttcacattgatctctgttgagattaaacatgtgctacaggttgtaaacaatcagaagaaacagagccatgcaatcgagtacagttttacttttcacagaacgttccacacactccctggctcctaaatacccaccttaccctgactatagacctttccccacagcagagaaaagtccatgtcagagagaatgctttagttttgcatatgtgaatgagaaataggcaataaaaaaattatcctgtcaactactgaatgcaggcaacgctgcttagcttgtctagattttaaaggcacactcacctatataagcagtccatatagtctgcacccttgctgtattcttcccagtacctatgatacataacaagtacttgttcttctgactccaaaactctctatataaagaggaaaaatatttttacttgaaaagcaataatcattttcactgtcaacaataaaatgtatcaaaattaatgttctaaaataatttacataattctagctgtacaaattacatttacacaacacatattaactacacgtattaaaaatgaaacaactgggaaagatgtgagtcttcaaaatgaaagtgaagcatccataatagagaataaactgagccgagcgcagtggctcacgcctgtaattccagcactttgggaggccaaggcgggtggatcacctgaggtcaggagttcaagaccagcctgaccaacatggtgaaaccccgtctctactaaataaaaaaaaattagccagccgtggtggcacatgcctgtaagttccagctacttgggaagttgaggcaggagaatcacttgaacccgatcgcaccgagaccccaccactgcactccaggctgggtgacagagcaagactctgtctcccaaaaaaaaaaaaaaaaatcacacttataatgtaacctaaaatataaaattgcaaaaaaattattaatgtcttacatagttatcacttatggtgttaaccaaagctcactagcttacaatagcagaactttaacatactaaacactttaagaccactttaacacacttgctatcaaaagcacttttataagcagataaatgatcacattagaacactaaaatgcacatgccatatactatcaaaagtagagcattttccaatattttcagggaaacagcacacaatcaattgtgccttacttatgagggttttttttttttttttttggtacaggtagtgtctcactatattgcccaggctgctcttgaactcctggcctcatatgatcctcctgcctcagcctcccaaagtacagagattacaggtgtaagccaccgcaccaggccagttcttaccatttaaaaaagtatctactcctgaccacgtgcagggttagacagtttaaataaaactgtgttgttttattcccattttatagataaagtcaaaactcagtccataaggtagttgttaagtgagttgcccgtggttacaacagctaataaaaagcagagtgaagattcttacgcaggcactaaattatctcatccagttcctgattagatcagtagtctaaattaagttggaaatgctgtctatagcaaaatactgcaaaattcactgtttatacacagatcatgtctgtgatgctgcccctctatgtacagcatactaataaaaaaactggtcacagagacagcttctatcaccatttaccatttctttttaattttagattttgggaagacttcatatagcacatgaaaggcagctaaaaagctgaaaataataaagacagagatttaccaagagataggaataaaaaacgagggaaaatttggctgtataaacactatccagaggacgtaggagcacattttaaaactcaacaaaccctgagctgaccctctccttcatttactaattacgagatgctgagcaagtaaactgatttccctaacacagtgcttgactcaaagatcttaatatgtatatatttttaaaatgctgattaagaagcaaaaacaagggaggccaaggccggaggatcactggagcccaggagtttgagaccagcctaggcaatatagtgagacccccatctctaccaaaaaaaaaaaaaaaaaattgccaggtgtggtggtgtgtgtctgtattcctagctactcgggaggctgaggtgggaggatcacgtaagccagggaagtcggggctgcagtgagccatgatcgcgccactgcaccctagcctgggcaacagagcaagaccctgtatttaaaaaaagcagcagcagcagcaaaacaagctgaccttgataaaagttctacactggaaaacagtaaactagtaaagtatacaactatcaacatatttatatcacgtatgtatcattgcttaccttatgcaaatgccgaacatgattttccaaaaaaatcttagtttctgtataaagtctttctccaaggggttcaggataggccacacataaagcatagatatctctagttaaattattaaggttttcatatttattggagacaattttaaaacataatgagatttaccttgtttggcattaaaaaatgaaaaaacatttctttttgtggtttagcttataatatacataatactgttgtatatatgacaagatagaatacataaccatgcttactttatctaagattcattcacttattcattccacaagtatttattgagaattatttgaagacactgtaaggaaaatggttcttatcagagaggttaaaatccagagggagtttctggaaaatcaaattacccagaatcctacaaaataaggtttatattagaatggatattagtatcaatagtatcaatgatattagtattcatagtatcaatgaagggctatggaatatgacaagaggcagacatgtctaagcaattctgagaaactaaacaaaaattattcatttgacacagcctcctacatcatagcagtcaggatactctaccgttattctatcagaagaaatataccatgaataggaatatcaattaagtttctgaacatcaactaagtaccttgctaagtctcaccggaggtagataacagaaggagtggaaagaagtaagacctgagactttacctttcactagccagtgatcttaaccaagtttcctagcctctctcgggtggcatttccttttttttttttttttttaatatcctttgctttattggatcttctcaacatctccaataattagaaacattataaaccaagaagaacaaaagataagacttaaggcaaagcccatttataactttggggccagacacggtattagattatgattctgggaactaggtgtttcatatgctgcctccaactactgtgacaaggcattttggaggtaacagctcatttgtccacaggaacaatgacaccagagcaacacagaggtcaggacctcctggtggttatactccagactgttccatgataaagctatgccatcttatcagtacgatgaccaccaccaagtgtctccaaggtaaagataatgaatctttccctgacatctccacaggtcctgtaagacccaaataaattcatatatgttaaagtactttataaactgtccatcattaaccaaatatagaagataaaggacctatgagcaacctgagaccagcctaactaaagatgcagatacaaactggaaataaggctgatgattcaggatgaagtcaggtattaaagtttaatagaaagattaggaaatactatgaaataaaaatgttaacttaaaaataaggatgcaaattctttctcctctatgtccccccgacacttcatatacattcttctacaaaatttatttttatacagtaaaatttatttatacttttcccaaccacattagcctattcttcatcaactccatactcccagctcccaggcatggttcctagcacttgatgatttattaaatcctgctgaaggaaaggagatgcaaaatcaatctcacatgctccatttacctagcatccttactccagaaagcgcaagcagccctctccacatttatttacttacttataaattttttatcagttctatttatatatttttaagctttatttatttatatttttacttgaaaaaatttttttgtagaaacagggtctcaccatgttgtctaggctggtctcaaactcttgggctcaggcaatccttctgcctcggcctcccaaagtgctaggattacaggtatgagccaccgctcaatatatccactgcatgtaaatgtaaacaaaatctactggaaggatttgtgccaaatctccagcttaaggagaaaggagctacacaagagaggtggtacagggagactctcccatttcattccatatacagtacttctgcactgttggactccttcagaatatacatatttttttaatgcagtgaatccaccttaataaaattttaaagtttatgttttaactcaccatagttttgggtctcaaatcactgtataattttaaccaattaactatgttctttttctctaacctattcaaatatccaaccaaccaggaaacgtttagcccttatgaagaacacctacgaaaatgagattttcaacctccaacactcagttatgacttgattatagacaagacactttaaaagacaaaaaatgttggctgggcatgatggctgatgcctgtaatcccagcactttgggaagccaaggcgggcagatcaccaggtcaagagatcgaggccagccatgatgactcacgcctgtaatcccagcactttaggaggccaaggtgggcagatcatgaggtcaggagatcgagaccatcctggctaacatggtgaaaccccatctctactaaaacacaaaaaaattagccggcgtggtgacaggtgcctgtagtcccagccactcaagaggctgaggcaggagaatggcgtgaacccgagagatggaggttgcagtgagccaagatcgcaccactgcactccagcctgggctacagagcgagactccatctcaaaaataaataaataaataaaaatttaaaaaaagagattgagaccatcctggccaacatgttgaaaccctatctctactaaaaatacaaaattagccaggtgtggtggcacatgcctgtaatgccagctactcgggaggctgaggcaggagaattgcttaaactcaggaggcggaggttgcagtgagccgagatcacaccactgcattccagcctggcaacagagcgagacaccatctcaaaaaagaaaaaaaacacaaaataactaggtcagatttcaacttaaacattctttcactagacttatcttttcctaagtcattttttagggagccagaatacaaaaactcctctatttatgaactttccagtttaaaaatgtctcagtcagaaactaagctgttccagaatgaaagctcatagctgcaaccaaaagacagtcctaaccagcagcaaagttacttattttatttcatgttctctattaaaaggtgtttcctacgcttggcttaattttgagttttaacagtatgaactctattatgccatgggtcaaaaacaatgagagttttgcaatgggaataaaaggaaaggttacctaaaaaaatgaaaatgtaagacaaccaaaaaaggatttgacaattaaaaaaaatatataataaaattaacagtaaaaaagaatttgctgactttttttttttttgagacggagtttcgctcttttgcccaggcagtgcggtggcgtgatctcggctcactgcaaacttcaccctccgggttcaagcaattatcctgcctacctcctgagtagctgggattacagttgagcgccaccatgcctggctaatttttttgtatttttagtaaagatggggtttaaccatgttggccaggctggtctcaaactcctgacctcaggtgatccacccgcctcaacctcccaagtgctgggattacaggcgtgagccactgcgccccgccagatttgctggcatttctaatgagaaagaatacagatgcagtatctacgaaatcatgcattagcaaacaaggataaaaaatgactaattaaatcgaaaattttcaagtgcacagctagtgaatcaatgagaacaaatatcaattagcctgatataatttagaatagggtcaggcagttgctgatgcaccaaatacacctgactatagataaaatcttttcccatctgtaaaatctaagaaagaatgatgggctactacacataatctccatggttactaagaccttcttcttctaacacttgtgaaaagtgtcaaggatacaggtacttgcctcaatatttttcaatgacatcaaaactggtctatgtttgaaagagatgcctgatagaatataaactagaaatgataggtgtggtagcgcatgcctgtaatcccagatactagggaggctgaggcaggagaattgcctcccggaggttggagtgagccaagattgcactattgcactccagcctgggcaacaagagcaaaactccatctcaaaaaaaaaaaaaaaaaaagaaatgaagacaacagtatgcctgggtttaaatggtgggaggatgaactcatattcctacctggaagaaatacgttgagggaaggcaatattaagtctcccctaacaatcattttggacttactataacctttagatgccacttctcctccagtaggaaaatgtctacattatgctgctggagtctggaatggaaatctgtcctaacagctactaaaagagagaaaaccttgagtaaaagtaaactagaacagggccaggtacagtctttctatttatacaaagtccaaaaatcaaagaattcaccattggccggtcacagtggctcatacctataatctcagaactttaggaggctgaggtggggggaatcacttaagatcagaagttcaagactagcctggccaacatggtgaaaccccatctctaccaaaaatacaaaaattagccaggtcatgcacatgtaatcccagctacacgggaggatgaggcatgagaatcacttaaacccaggagggggaggctgcagtgagccaagatcacaccactgcactccaacctgggcaacagagtgagaccctgccacaaaaaaaaaaaaaaattcaccattattgtttattctatttatataaagtccaagaaaattcaccatttaagaaccacaaaagggccggacgtggtggctcatacctgtaatcccagcactttgggaggctgaggcaggcggatcacgaggtcaggagatcgagaccatcctggttaacacggtgaaaccctgtctctactaaaaaaatacaaaaaaattagccgggcattgtggtgggcgcctgtagtcccagctactcgggaggctgaggcaggagaatggcatgaacccgggaggcggagcttgcagtgagccgagatcgagccactgcactctagcctgggcgacagagcgagactccgtctcaaaaaaaaaaaaaaaaacgaaccacaaaaggctgggtgcaatggctcacacctgtaatctcagcacttcaggagtgccaaggcacatggaacacatgagcccaggggttcgagaccagcttggccaacatggcaaaaccccatttctaccaaaaatacaaaaattagccaggcatggtggcgggcacttttaatcccagacactcgggaggctgaggtatgagaatcacttgaacctgggaggtggaggctgcaatgagctgagatcactgcactatgcctaacaaaaaaaagaactacaacgcactatgtctaataaaaaaaaagaaccacaaaaacaacaggcacaaaaatcaagatagtagttagctcctagagaaacgggtgggattgtgaacttagagggtcacgtgtttcgggtgggggttatagtgaatgtggacaatgttctattgttcaatgttctattgataatgtaattgcttgcattataattatttgtgcaaaggtgtattttatgaacttgtccatatttgtgttattcacactccccataaatgcatgctaaaagttcaaataataacacatatttgaaacaatgtggagggacctgttttttccttttcaaagtatttacattgtatggcccttaaaatttccacttaagatattaagggtcagaagtgaactttatattcttgggcaaaataacagggaaaatgatggaattttaccttataacaattagtagcatagtcttttatttatttatttttgaaacggagccttgctcttattgcccaggctgtagtgcaatggcccgatcttggctcactgcaacctctgcctcccagggtttaagcaattctcctgcctcagcctcccaagtagctgagattccaggcacccacaaccacgcccagctaatttttgtatttttagtagagacgaggtttcgccatgttggtcaggctggtctcgaactcctgacctcataatccgcctgcctcagcctatcaaactgcttgaattgtaggcgtgagacaacgtgcccggcctgtactctttaatcattatttttgcagactttttattttgggggtgagagaaaattcatgatcaggtgaaaaataactggcccagccaccagctgggcaaggtggctcacacctgtaatcctagcactttgggaggccaaggtgggagaagtgattgagcccaggagctcgagatcagcctgggcaacatagtgagaactcacctctacaaaaaaattttaaaaatcagccaggtgtggtagcacatgcctgtagtcccagctactcaggaggctgagataggaggatctcttgagcctaggaggttgaggctgcagtgagctatagtcacaccactgtactccagcctgggtgacaaagtgagaccctgtctctaaaaagtaaaaattaaaaaaaaaaaaaggataactaaaccatattagatggaccaaacaaataacatcagagaaataacagtgactgaaggggtcactttccagggaagtaatctatttcaaaaccacttaaaaaccaagaaattcactgtcgattctgtacaatgatgaagaacacattttaattattttttctttacctcctgttcattttccctcttcttgctcttcttgtagtcatctataaccaactcctcttccctctctgctccttgttttagctaaaatatccttaaaagcacctatgaacttgcctagcccaatctcactaacacacaagtagcaacactttttcaacttttattaagattcttgccccaaatcaatccataatgttccacagaaaaattagctatctaattcaaaggcagaatctatattggttatcctctagatatactggaaagcataggaaattggatctttaagatactatattcaagtctgtggtccatcaattactacccgtatgaccctgggcaaataagtcccttacctctgagatcagtttccttatccgttacagtcaagtaattatttttgccccactgatctgatagacttgtttgaggtatcaaacaacataaaaaatataaaagatcttttcaaactttgaagccttccaaaatgtcatcacccttttacatatcttcagtgcccagaacatagttggcttaacaaacttttcttactgcctactgcagttgtaatgaattaaatggttttctgttggtctaaagaactttactcttcttgcatccacattcagcttaatattaacaactgaattaggcattcagaacaagctgaactactatcttatgaaatcagagcttttctaaagaatgtacgccccatataatgagggcagcccttctgtagccccagaagattgctagagagggcagcactagttaggtctagcagatcactgtcatggaggaacacaggaaactaggcttcagggcatcctagagaaatcaccaatctgcattgttacataaaactctcaattcacacatgtaggcaatctaatgaaaaacacacttccaccccagtcactgaacttgctgttcactctccagcaagcacactcttccccccaaaatcacatggcttgctccctcgctgcattccagtctctgctctaatgtcaccatcctcagggaggccttccttggccacccattctaaaagagcagcacccacacaggtgctccaagcctcccccacgtccttatcctgctttcatttatcacgacctcttcttgaaagcaatgacattagatttttttttttacctgtttagtgtctatttctatttttataatagaaaggaatttttttttgttcaccaactgtattcccaaagcctaaagtagtccttgacagatactaagtactcaacaaatacttgttgaatgaaaggttatcaaatactgattgccataaaagaggtgatgaacttggaaatgtagatgataatatattagaaaatagttacatgggaaagttcttccataacattgaacatgttctcagttttcaacaaatttatcaattttagaacattgatcaagctgccattaaaaggatacgagaaacggtcattccatgttgctctttcgacgtattccaacatgaccacggcttttattgtcgtcaaaagtttgttccatgtttcatcaaaatctactactcttggtttcaaagacattgtgcaagtgtagtgttgaaatctgtcaattaaaaaacaataacaatgttagcaataattccatgagcttagtttttttgttgttgttttttgtttgtttgctttgagacggagtctcgctctgtcgcccaggctggagtgcaatggcgtgatcttggctcactgcaagctccgcctcccaggttcacgccattctcctgcctcagtctcccaagtagctgggactacaggcacccgccaccatgcccagctaattttttgtatttttttttagtagagacggggtttcactgtgttagccaggatggtcttgatctcctgacctcgtgatccgcccaccttggcctcccaaagtgctgggattacaggcatgaaccatcacacccggccagttatttgtttttaaagcactacataattaaatagcatgatatatgcaaggagtgagaaaagaacccggcacacaacaaaatgttagctaccatcttttcatgactatccagacaagaaatttcacagactatttacattcattacaagctctaggaaatggaaagcttctagtacaaattatttatgatcaagggtatagtttcaaagatttatagtcctcatttaatattgcgagggaaagaaacggggacccacttaaccaaaaggccaacttccatcatgggaaataatgcaggacattcaaccgaaaggttttggccccaaatccttgtggtttgcactcctgaaagtggggaatgaggcagcatgcaagggaatatgagaagacacaagaaaatgaaaggctttaccttcctggagcatcagtataagattagggaagaaatttacatttatattaaaccaaacagggatgaattatggagtagaatataaaattcacatgaccttttaagattaaaaaaaaaagattccacagaaatgtcaggtttgcagtggagagcttaaggctccttcccagattcttggggtatctacctcccagttctaatgaaaagcatggctctagcatggaatccctggctccagtgaacttaatgggcttttttttttttttgagacagagtctcactctgttgcccaggctggagtgcagtggcgcaatctcggctcactgcaaccttcacctcccaggttcaggtgattctcctgcctgaacctcccgagtagctgggactacaggcgcccgccaccatgcccggctcattttttgtatttttagtagagacggggtttcaccatgttagccaggatggccttcatctcctgacctcgtgatccgcccacctcggcctcccaaagtgcagggattacaggcgtgagccactgcacctggcccagaatgggcttttaagggagttcaaagactcctgcctcagacaaactgcatttaggaattagctggtttctggaacaaaagggtcccaaattaaaagagaaactttctaagctaaatgtaattgctcaaaggaacatttttctggcaaatgttttaacagcctccctcatgtctccccttattagcaggactgtaagacaccaacctagtctgtagccaaggccaaaaaaggatgaaacatcttttctcgtctcccatcataggggaaaggggaggcagagaatggggaggagggaatgatgcataaagagaatgggcaaagggagcgggtaggatggcggccgcaccaccagccacggactgggagaggcccttctgtgtttccagatgagaagagagctcaaggaatcccaggaatagactccatggaaaagaatgaaaaaaatcagagaaaagccaaatatccaaaagagggtatgccttgttgaaccacatcctctttcctcaacattccaaagcctccacctcctggccttcaactcattcccgaactatctataacggattagcagcgattttactctgcaaaattgaggggaaggtgagagtggaggaggtgggagaacctactgagtttcctaagctctaaataagggaattaaccatgcctccttctcttccttgtttactacatcctatcatcaactgtgcacatgagtatttcctgaatccatccatacttgtatagccctacaaatgatccggaatcaggccctcagcagaaatagtaacagttaatatttacattgtgtatactgcaagccaagcactagtctaagtaccctgtacaaactcgtttaatcctcccaacattctgacaggtaggtccactgttgtccccattttcttttcttttctttttttttttctttttctttttctttttttttttgagatggagtctcgctgttgtcagcctgggctggggtgcaatggcgcaatctcggctcactgcaacctctgcttcctgggttgaagtgattctccagcctcagcctcccaagtagctgagattacaggcgtctgccaccacacccggctaattttttatttttagtagagacagggtttttcaccatgttggccaggctggtctcaaactcctgacctcaagtgatccacccaccttggcctcccaaagtgctagggttacaggcatgggccactgcgcctgacctgttctccccattttctgaataagaaaactgagtcacaagtgattcagaaacttgcttaaggtcacaaagctatgtaatggtggcatcaggattcagacccgtgctgcggccggtgctctaggctgctgtgtgcaaccatgctacctcactaacatgcttggtgaatacttactccttgccaggcaccattccaagctctgaggatacagtggacaaaacaaagttcttgacttcaagatcagaatctcagatcttgcccttatcaaagacacaaaaataacctacctaagccaaaaagttgaccatgttactctgtacataaagtacaaagtttgttgtttccttctacagacagcattcagtttgggctcaactgcaacatggcacccaagcttcctctcctcctggtactccctactgtgacatcataatctaggaacttctctctgcttagagatcactgaacacatcagcctgattcatacacttgcctttacccttactattttctctacctaaagtgcttatcttttccttagctgccccctccacccattccacctaactcccactgatagtctaaccttggtccactagctttttttttgtttgttcctgagacagagtctccctctgtcacccaggctcgagtgcactgcaacctccacctcccacgttcaagtgattcacctgccacagcctctcaaggagctgggggattacaggcgtgagccatcgcaccctaatttttgtattgttaatagagacagggtttcaccatgttggccaggctggtctcgaactcctgaggctcaagtgatccgcccgccttggcctcccaaagtgctgggattataggtgtgagccattgtgcccggccttcatctgcttttaagaaactttcttggaccatttaagctaggtaaggtgtcctatcataggtattacctgagaactccacactttcctctattagagtacttcatcgctctgaactgtaattacctgagtgtttctgagagtggggacaattctgtaactgcgtaccaaaaagctagcgatgctcccctcacattcgctttctcctcttataaaatggaatcatattatacacactgcttgtaaattagtttaacagttgcacagactttttttgctttatggaatcagactgacactgacttctctgttgagactgatagatttctggtaccataggaaaatacagttacaatccatgcttggatggatagcaaatctggaagccaacgtgcaagaagcaccagcctcgtgaaacacaccaaaaactgacaaaccaatagcaggaaggtatgctgagacagtctgtcaagattctctgcttgcccagcagaaagctcatataactaggaaaattaagtttcttaaaaatgtttaataataacattcagggaaagtttacacaaggatgtgaaagagacagggcaaagaagaaaaaggaccacagtcacactatttctaccccccaagctgtcaaacaactcataaatctatcagtcttgttcttcattcctgtgccttaacgagattcccacgcgcactcagattgtgtcccatcaagttaactgcaaaaatccaaatctcctgaaatcaccacagtcccttttagtttccttgtgagttccactcttgcaacaatggggttttagacacacaggtccagtggctagggccacttatgggccctaaaacacacacacacacacacacacacacacacacacacacacacacacacgcacgctccacatttttaaaaattgcaaaataaaaatttatatttaattacctgtttccagaaaacattatgtcaacattaatacaatatttgcaacatttttattacatttgaaaacacttgtagatttgatttcctcacagcataatttctaaatatgcatgattgtcaataataattacaaaagtgaattataaaacgcagctaccatatgacccagcaattccactccgaagtataaagagaaataaaactcccaagagaaatacaacatattcacataaaaactggtacacaaatgttcactgtagtattattcataaaggcccttgaaatagctcaagtgtctatcaactgataaatggttaaaatgcaatatagccatacaataaattattatttggcaatacgaggaaatgaagtactgatacacactatcacatggatgaccctcaaaaacattctactaagtgaatgaagagggccacaaaatagccacataacgtatgaatctatttatatagattatcaagaataggcaaatctagagacagaaagtatgtgagtggttgactagggaacttggggggaaaatgggaaatgactgccaacagggtgaggaaaatgctctaaagttgattgtcatgatagttgcacaactctgggaatatactaaaaaccattaaattgtatatttcaaataggtaaactgaatggtatgtgacgtatatctcaataaagctgctatacatttaacaatgaattataaaatcctgccaaaaattttagagcaatttaacggggatgaggtggaagtaagtatcaatacatccatatggtcatttagcataaaattctgaaatctcaatctctctcccaccactcccgtgtacgacctcattgccacctcccattgaatgaggcaataaatgttatatgttcctgggtgtattttatacatatatgtgatttgttactcccttttacataatataaacatggtatttttttcatctgttttacataaatggtatactattcagattgttatatatctgcttttttctcttaaaagtatatttgtggccaggcacggtggctcacgcctgtaagcccaacacttcgggaggccaaggtgggtggatcacctgaggtcaggagttcgagatcagctggctgacatggtgaaaccccatctctactaaaaatacaaaaaaaattagccaggtgtggttgtgggcacctgtagtcccagctactccggaggctgaggcaggagaatggcgtgaacccaggaggcggagcttgcaatgagccgagataaaactcccaagagaaatacaacatattcacataaaaactggtacacaaatgttcactgtagtattattcataaaggcccttgaaatagctcaagtgtctatcaactgataaatggttaaaatgcaatatatccatacaataaattattatttggcaatacgaggaaatgaagtactgatacacactatcacatggatgaccctcaaaaacattctactaagtgaatgaagagggccacaaaatagccactgcactccagtctgggcaacagagcaagactccgtctcaaaaaaaaaaacaaaaaacaaaaacaaacaaacaaacaaaaaaaacaaacaaaaattagccgggtgtggtggtggctgcctataatcccagctactcaagaggctgaggaggagaatcgcttgaacctgagaggtggaggttgtggtgagccaagatcatgccactgcactccactctggacaacagagcaagactccgtctcaaaaaataataataataaaataaaaagaaataaaaatgaggccagatgtggtggctcacacctgtaatcccagcactttgggaggccgaggcaggcgcattacctgaggtcacgagttcaagaccagcctgaccaacatggagaaacccggtctctactaaaaatacaaaattagccgggcacggtggcacatgcctataatcccagctactcaggaggctgaggcaggagaatcgcttgaacccaggaggcgggggttgcggtgagtcgagatcgtgccattgcattccagcctgggcaacaagagtgaaactccgtctcaaaaaaaaaaaaagaaaagaaataaaaataatattaaaaatatatatttacagatgtaatgatatgctgtctgaaatctgcttcacaattaaacagcttgctcatgagttgataactgttaaggatgaataaaagggacatggggatttattacaatattctttttttgtatgtgtttacaattttccataataaaggaatttaaaaatcctactcctcataaacattaatattttcataaatttaggggagaaagcacatcatctctaactgaaagccgttactaaccttcccttctgagaatcttaactttcctgtgagttttaggtttccaaagttgtaggagagctcacaaaacacatggtactgtccctaaatgtgatgtgttaacatagcctgacaaaatgtccacccctaaaaaacttaaattactaatagcagaaataaaaaatatatatgtttgttaagatcaggtgaatttttttttttttttttgagatggagtttctgtcttgttgcccaggctggagtgcaatggcatgatctcggctcaccacaaccttcacatcccaggtgtgagcaattctcctgcctcagcctcccaagtagctggaattacaggcttgcgccaccacaccggtgtaattttgtatttttttttttagtagagacggggtttctccatgttggtcaggctggtctcaaactcccaacctcaggtgatccccctgcctcaacctcccaaagtgctgggattacaggcgtgagctactgcacccagcccgacatttttcatataaagagatttgttcctgtgaactcacttgctggagcaaaaaaacaatttagataatttcagcaggtaaaagttacagtatctcaaaagatgcattttggtgttttgtattttacttaccttctaaaagtataattatcaataatgtaaatggctaaccacttactattttgattctctttatagtgaacaaaactcctgaatgacgatttatttcagtactgatcagcagcaccaataaaaatttggcatccaaaaattatcagtaagatacaatagagtggtctaagttgacttcagatagttaagacaccataattagttttttaaatgccactcaataggcttagagcagatttccttccaaatgcataaaatgagaaaatactgaagacccaataaagagccttacagcagtcccctgccttatccaaggggatacgtttcaagatccccaggaatgcccgaaactatgttttttcatatacatacatacctatgataaagtttattatataaatcaagcacagtaagagattaacaaaaactagcagtaagatataacaattataacaatatgctataataaaagttacatgaccatggtctctcagaatatctcactgtgctgtactcgcccttcttgtgaaggtgtgagacaatacaatgcctatgtaatgagatgaagtgaggtgagtgacacatgcatcggaaggtcggcattgggctacttactactgaccttctgtattcctgaatatgtgttacagtccctgacttagagtaaatggtttggtgtcattcgtctctggggatcccttgctgagtcttcaaataggctcaatgctttctggcacagtatgttgccatcaagtggaacttgtctctgctcatgtcttccacccaccagtgtaatgccttttccaaattaactaagcacttattacacgatataactatcacttttacagattgagatttgacagcaaaactagtaagaatttctttcttcacaatttcttttctttcataattgtgaagaaaaagaaattcttattagacctgcttacagtaggtcttagcaatctcagtctattatttttttctttcctcattgagaactttcaacttttcgtgtaaaggaagcactctatggcagaagcctctctggtgtatccatattgctaggatcactactcctgtactttgggggcccttactaagtaaaatcagggtgacttgaacacaaatactgcaaaactgcaacagtctatctgataatcaagacagctactaagtgactaatggcaggaggcatccacagcgtagagatgctggacaaagggatgattcacgtctgagcaggacagtgcaagatttcatcacactactgaggacagtacagaatttaattatgagttatttctgaaattttccatttaatatttgcagaccccattgaccgtgggtaactaaaatgcagaaaacaaaactgtgaataagggaggcagggaagtggaataccatattaacttggcattattttccatttccataggtgggcccaaagctgccaatggtgcacaatgaccaaatatgttgccatcatttaatattaaaataagctccaagaatgcatctaaacattttcatcttgctgtatcaaatgagcaagccactggatgtaactaagaatgccctttcttatttggaggttaagggtgcaatgttttttgttgcactaaggtttgacccacagagctctaagtactccataaacaacatttccatcatgactttctggctttagaattcctatttttatttatttatttatttatttatttatttatttatttatttatttttgagacagggtcttgttctgtcacccagtgcagtggtgtgatcctggttcactgcagccttgacctcctgggctcaagtgatcctcccgcctcagcctcctgagcagctgggactacaggcacacaccactgcactgagctacttttttgtatttgtagagatggggtttcactatgttgcccaggctggtcttgaactcctgagctcaagcttccaccagccttggcctcccaaattactaggattacaggcgtgtgccaccgcacccagcctagaatttctagtaggttttttacaaaaacaaatgagttggggaaaaaagagtgaacagacatatggtgtgtgccaaaatgtatactgcaggaaaacatcttgaagtctcaaaaagggtgacacggtggggagtagggaatgtattcataatacaataagttacagaagccatttgcacccaggtgtggtggctcacacctgtaatcctagtactttgggaggctgaggtgggaggatcacttgagcctgggagtttgaaaacagccttagcaacatagacagacctggtctttaaaaaaaaataaaattatagtagctgggccctctggtaacatgcgcccgcagggagtcccagctactcaggaggctaaggtgggagcttggcttgagcaaaggagacttcaaggttacattaagctacaatggcaccaccacactccagcctgggccaaaagaccaagatcttgtcacaaaaaagcagctacctgcttccaaaaataaacccactgcaccagaataaaagacccctctctgcaatgaactttagactcccataagactgcacagcctatactttgtttcttaagttttcacatcgctcttatcagcttgaagtttaacgccattttcacttgctttctcattttttgttcaataatctagtcaacgaatttaagaaactgacatttttaaaaaaaactattctcatatatgtatccccgatctcaggtaaattagagaatttgaatttctgagtccttcatgactaggcaagcccatcgtgtatgaatactagacaaagctagaaccaaccagcctttacacaaattatcaaaacattgagaacaaattttttggctgtgtgcagtggcccatacctacaatcccagcactttgcgaggccaagatgggcagactgcttgagcccaggagttcgcagccaacctgggcaacatggtgaaccccgcctgtacaaaatacaaacagatcagccaggtgtggtggcatgcacctgtagtcccagctactagggaggctgggatgggaggatcacttgagcccaagatgtgaccgcaccactacaatctactgtatttgctgactgctatataatacattaaatcctgcctatgtcctgacactgctatagaagacacaggcatggaagaataattaaaaaggggatacagttatggcagatgcatatcaattaaccctctagcaactttcttgacacctcctgtttacaatcccaaagagagccagtgagttggatcaagtttgtaatcccagcattttgggaggccaacgtgggaggatcacttgagctcaggagttcaagaccagcctgggaacacagcaagacatcatcttgactgaaaaaaaaaaaaaatttgcctgcagtgagttatgatcacaccactgcactccagcctgggcaacagagccagaccttgtctctcaaaataaaaagttccgatatatgctacgacaaggattaaccttgaagatattacgctaagtcaaatacactagacacaaggtgaaaaatatcttatggtcctatttaaacaaaagtatgtatgtgggcaaattcataaagacagaaagaaggatgagatgttatcagatgctgggggaaggggaaatggggagctactgcctaatggttgtacagtttctgtctagtaacgaaaaagttttggaaatggtggttttggaaatggtggtgagggtcacaatgacactgtaaatgcagttaacaccactaaactatacccttaatgacggttaaaatggtaaattttatgtcatgtatgttttaagtgcttaaaaactagatcacaggtacaaagttctgatgtcagagaagtatctgaatctcactgcaaaatgctctctaaaaatttttaaatggatgcattctaatcaaaataatacttggtactatgatgacaaaatactatttttggttcagacagacttttatcaaataaaagagaaatatcttgagataaaatttttctgaaggctcaggactacttggggatctttctcttgatgtcacattattcattattttggtaactatacacttacataattacaaaggtatctttggctgagcatggtggctcatgcttgtaatcccagcagtttgggaggccaaggcgggcagatcacttgaggtcaggagtttgagaccagcctggccaacatggtgaaaccccatctctactaaaaatacaaaaattagtcggtgtggtggcaggtgcctgtaatcccagctactcaggaggctgaggcaggagaatcgcttgaacccaggaggcaaaggttgcagtgagccaagatcgagccactgcactccagcctgcatgagagcaagactccatctcaaaaaaaaaaaaaaagaaagaaaaagaaaaaaagaaagctatcttctatttcccaccgtcagaaaatagcagttataaataaaggggaaaggcaagcattaatcctgtggtaatgagttgtaatcaaaggtatcatttacaaactcatggttttgaatacacaaacacacatatacatgcagataaaaagatataaacatagatgtttgtgtatgcatggttgaatatacatatatttctagctctgttcactgagaagggcctaggaggaatgacaccacagtggcaatgggcacacatagaacttagatcttggtttctaaatatcattctccaaaaaaaggaaccagagctcctccttggaaaagtgattgattccagggctgaagcaggaaaaatacaagttgaacctagaacacctatgatgtcagaaaatagaaggtgctttccccccacaaagagggtgggggcatatcgaaaggacacaagttaaactaaaggtcaaaactggaacaaatcagagcaacaaaataatgaatgataggattagattataaaccataggcgggtcacagtgactcatgcctgctgtaatcccaacactttgggaaaccaaggcaagaggactgcttgagccaaggagttcaaaaccagcctggagcatagcctgtactttctctccttcaactgaattaaaacaaggctgagatatttttaaaaatttacatatggcaaatccatgtttcattctttgaaaagcaacctacaatagagaaagactaagtcactgaattaatagatgtaactaacattatttataatgttaaactatataaaagaggccaggcacagtggctcacacctgtaatcccagcaccttggaaggccaaagagggcggatctcttgaggtcaggagttcaagaccagcctggtcaacatggcaaaaccctatctctactaaaaatataaaaattagtcaggtgtggtggcagacacctatagtcccagctacttgggaggctgaggcaggagaatcacttgaacccaggaggcagaggttgcagtgagctgagatcgcgccactgcactacagcttgggtgacgagtgaaactctgtctcaaacaagcaaacaagacacagtatcagtctgaatttttaattctccagaataacaaagcttaaagcaaaaggaaatattccacctctcctcctccaaaagaaaaatcaacagggttcaaggcaccccggaagtttctacagatccaacaccacaatcttaacctaacactactactgtctcaaaacttttaagaatcaaagggattgtctccaataagcctttcccaatgaaaagccaaatataaagtactgatatagaaatctatacattcttaaaggtaacccaaagattatgctaactgcaatatgacagatacgttaccagtaagattcaaacccaggcacagagccaaatcactctgaatagatattgtgattaactgattactgagagagggttcagtcatacatctcatagatcaataacttgttataaatctcataacattccaaatcgctgcttgtttttccaagatttaacatgagccagtcataagtcctcataatattaagattctagggctgatcctgtcatcaatttacttaaaaacaactgatagttggacaggcctggtggctcacacttgtaatcccagcactttggtaagccgaggcaagtgaatcatgaggtcaggagttcaagaccagcctggccaacatggtgaaaccccgtctctactaaaaatacaaaaaaattagctgggggtggtggtgggcgcctgtaatcccagttacttgggaagctgaggcaggagagtctcttaaatgccagaggcggagaatgcagtcagccgagattgtgccactgcactccagcctgggtgacagtgtgagactccatctcaaaaaataataataataaaaaataactggctgggtgtggtggctcacacctgtaatcccagcactctgggaggctgaggcaggcagatcacaaggtcaggagattgagaccatcctggctaacacagtgaaaccccgtctctactaaaaaaatacaaaaaattagccaggcatggtggcggctgcctgtagtcccagctactttggagactgaggcaggagaatggcgtagacccaggaggcagagcttgcagtgagctgagatcgcgccactgcgctccagcctgggcgacaaagcgagacaccgtcccaaaaaaaaataaaaataaaaataactgttagggccaggcgcggtgtggctcacacctgtaatcccagcactttgggacactgaggaaggcggaccacaaggtcaggagatcaagaccatcctggctaacacggtgaaactccatctctatgaaaaatacaaaaaattagccgggcatggtggcaggcgcctgtagtcccagctactcgggaggctgaggcagaatggtgtgaacccgggaaccagagacacagccagactctgtctcaaaaaaaaaaaaaaaaaaaaaactgatagtgcatatgaaacattgctttcaatcacagccagacatttttccagaatacacaaagaacaggcagataaggtagaacacaaaacaaacagtgcaaacttttgtaaagtctcacaaaaagaaacagctttttacagcgagggaggaagggcataagggttgaaaaacggttgggtactatgttcagcacctgagtgacgggatcattgtatcctaaacctcagcatcacacaatatacccgggtaacaaacctacgtgtgtacctcctgaatctaaaatgaaagttgaaaaagataaaaataaagaaacaagcagcctggccaacatagtgaaaccttgtctctactaaaaatacaaaaattagctgagagtggtggagggcgcctgtagtcccagctcgggaagtggaggctgcagtgggctgagattgagcccctgcactccagactgagagactctgtctcaaaaaaaaaaaagaaacaagaaacaaggccgggcacagtggatcacgcctgtaatcctaacacttagggaggctgaggtgggagaattgtttgagcccaggagttcgagaccagcctgggcaacacaatgaaactctcttagttctgtcacccaggctggagtatagtggctcactgcagcctccacctcctgggttcaagtaatcctctcacctcaacctccctagcagctgggattacaggcctgcaccaccacacctggctaatttctgtattttttgtacagacagggttcgccatgttgcccaagctggtctcaagctgctgggctcaagtgatccacccacctcaacctcccaaagtgctgggattacaggcctgagccaccgtacgtggccggaaacagctttttaaacaactccacacctgtaggtcaaaaacttaacgagaccagcctggccaacatggtgaagccccatctctactaaaaatacaaactccagcctgggtgacagagcgaacaccatctcaaaataaataaataaataaataaatgaacttaacaagggcagggaccaaatcagaaaatgctgcagtactccacagttttatcctctttctacattctctgtgttctcatcctatttcataacttaactactatttaacactctaaaaaatacaaatgtcaaagtaaagtgtactactgtttctgcaaagtgggaacaatatttgcttatatgtccacaaatatttttttccaaggagatctaagaaacagctaacaatgtttggctccaaggaaagctggatgacaagggtacaagaagtggagggagattttcattctattccctactgacaattttatattttggttttctgtttgttttagagacagggtctcactctgtcactcaggctggagtgcagtggtgcaatcacagatcactgccacttccaacctggtcatctggcctcagcttcccaacagcgggtactacaggcgtgcgccaccacgcctggctaatgttttttaaattattttttgtagacatggggtctcaccatgttgcccagactaacatcttaaattttgagccatgtgaatacagtttttgttcaaaacattagtataccaataaataaatgctgatgactctccatatccattttcctctcttcactagaacttaagttccatgaagccagaaattttttaaccactatatccacacatctggtttaaagctggtgcttgagaagccctcgttggatggctgaatcactccttaacctctaagttccacacttatttccaatcacctacttctcacctccacttgaacaacgaaatccaacttaacatgtccaatccaaccccatcccatacaacagcctgcttcccccaacctcttcttcatctcagtacacagcatcatcatcctccagcagaagccaaaaacccagaattgacccatcccaactgcatgctcatccaaaacatgacaatttcaataagtatcttcaactccaaaataaatctcaaaacgttttcacttgtaccttaaccctccacagccactgctcttctcactggtctccttgtgtctctcttctccaatcaacagtctgattctcaatcagacctctcagtttagaagagttccaaaagccttttaatgtatctaagaacaaagccaacatgatccagcccctggctaggacccacctttaatctcttactagggtccaccttaagccaatttcagtttgttcaatccaagtttgatagcacctcagggtttttccatttgttcctccctaaaataggaaaactgttccctcagaatttcaaacttcacctcaggaagttcttttctggttacagtatctgaagtaatctcccaatcactaccacaactccttaccttatttcccacacagcacttattctctgagattatttcttatatactgtctgtctctccatcccaagccagaagtgacactccaagaggatagaaatttaatgggttggacaggtgtggtggctcacgcctataatcccagcactctgggaggctgaggagggcggatcatgaggtcaagagatcaagaccaccctggccaacatgttgaaacccagtctctactaaaaatacaaaaattagctgggcgtggtgacgtgcgcctgtagtgccagctactcaggaggctgaggcaggagaattgcttgaactgggaggttgcagtgagcccagatcgtgccaccgcacttcagcctggtgacagagcgagactccgcctcaaaaaaaaaaaaaaaaaaaaaagaaatgtaatgtgtcttgtttacccttgtaaccttaatgcctgcagccctgcttgacaaataaaccaggtgcttaataaatatctgtcaactgccagacaacgcaaaaatgactttaaagaaggtccataacgtttaatctagtgacaaactggtgagggtaaaagacatggataatcttcacatttatagaacactgaaagccaccagcaaggatggagaatgaagagtatttcagatgcaggagaacatccaaatactcaaaaagcaattgaaaaggaatttttcccacgctatgtgcatgcacattgtagaaatgttcccccaactcataaacagcaattgaaaaaaacaagtaattcaaaacactgtgggctgggcgcagtagctcaggcctgtaatcccagcactttgggaggcctaagcaggcgaatcacctgaggtcaggagttcaagaccagcctggccaacatggtgaaaccccatctccactaaaaatacaaaattagccgggcatggtggcgcatgccagtaatcccagctacatggaaggctaaggcagaagaattgcttgaacccgggaggcggaggttgcagtgagccgagatcgcaccactgcactccagcctgggtgacaagagcaaaactccatctcaaaacaaaaaaactgtgtacttctcttatctcacgcgactcttttggaaggatcttccagatactgtataagggcaaaagaagcaaagtatagctcatttgttcatgtgtctgtcttgaaaaggaatgtaagattctaaagggtaggcaacagtgttttgaatgtttttaagcgattattatgtagtcagttgtcaatcagatcaaagtgattatttccgatactttactacgaaggtaggcttggccaggtctagttcaaagacgtttatgttgaacagtcacaatctatagcgaacgttaatattttgcatcttatcttcaaaatttaaacgcccagggtactggccttcaactgttaatattaatccatggggcaaagatgtggacttaacattaataacagtctgcaattcacagatgttttatttgcatgcacgtaatggtagggaatggtccagactctctagagggtaagcaagtgctagaaagcgtgtgaggatcttatttcaccagaccctaagggttgagacaagaagtctagcatgcacgtaggatactcctccccaaagctatcaatctttgcagtctgcggaaacaaaagtgaaaacactcggggtaaggatgcatgagatgcccccccccacacacacacacaaacacacagagttgtgtattcgtgtgagcacgtaaatatgtagaagaatacacgcactctcaccttccctccttcgaaggaaaatggggccgcgggagaggcggccaagatcgggttggggaggcccgggatccagtccagggggtggcagggcttacgggtcagcgctctggggagccgaggtcacttacaggataccatcttcccgggcctccccctttcatccctctccccacacctcgtcgcccccaactcctctcctccgccccagccccgccacccattaaccgggaagggaagtttcccggcgcctgcagcccggctccccgaccctcagcggggttaccttctgcagaagcagggcaaggggcaggggacaaggggagggggaggcagcccgaaggagtgaaagacgaagccccggcgaggaaggtgggcggaggcggcggcggcggcggctgtcagctcgcgttcccctgctcacagcgctgccattactgtgcgccgaggccgcctccccggccggccgccgccaccggccccggagacgc

SEQ ID NO: 315 - DNA, 82092 bp, Homo sapiens
tcaatttggaaaacttttatcaatcaacaagttatcaaaacaagggtttgctttttgacagtgaatgtacaatattatatggtttgccattatttcctcttttggaagaaaggtaaaatgagaaatacattatataagtcattataagttcagtagatttttaaaacacttgagacacgagttagaaaaaatgcaattgaataaaccaattgtaagacccatctcaaaacaacaaatttaaatatgaaccacatattagatgatactaagtaattattgtttttgttaggagtaataatatcactgtggattttttaaaggccttactgaagtattataagtgaaataatttgtgtgatttgctttaaaatattccgattttaaaaattttgtgttggatggatgcagtggctcatgcttgtaatcccagcactttgggagacagagataggattgcttgaggccagaagttccagactagcctgggaaacatggcgaaaccccgtctcttattttttttaaaataaagaaaaattgtatgttgagggaggaggggtgtggtggtggtggtgatggtgtggatagacaataaatatgataatagatcgcagtactcttaacactgctgttgagatatatatatatatatattatatatatatatatatataaaataaacaaaataatgggatttatatatgtggcacccagtacaatgtacaattttcttttttaaaaaagtatttaggttatgcattgctaagcacatctgtgattgatgagagtgactctagtatctaaactgttggaggagggttgtaagggtaacaggtaggggaggcatatagaaggaatatgttggtatcatagatttcctaagactcagggaaggccacagagctagggtactagtctatgctagaattaatggattatgcaaccgaagaaagacaacttttgaatgaaaagctctctctgtgccagacttgaggtcaccaagcatcctgctcacactctgcgatgtctgtggagtagcacaccaccagaaactgctgatggaattacatcttcaagattcaaaatgtttagatccaatatatctaatccataaaaataaagcattctttatgctgaatgcagtcctatgcagtcaagaacaataatctagacatttttcatgtaggatttaaataggagtacaagtgaattaaaccattcagataaaaacgcaactaaagatgcattagctgctttgagtcaatatattttgtggtcaacctgatactccatccacataaaaaaggcattctatttctttattttttttttatttgacaagcagcagtatcatgtttgtcattttaatgtagatacaattattaggttatctgtcatattacaatatttaagtttttaaattttatgtcctttaagatacattaaaaaaaaaaaaaaagacacatcaactgcaaacgtgaaggggagaaaaagcatggtacccaaccgaatttccacttttcagcaatacttcactcattcttttaataaagttttaagaaatgtcataatgacatgagcttgaaatatctctaggcattttctttgacgctcatgacgtggcactggtgatgttgtaaacagcagaaaacaggggctgccaaatgaccaaattatggaggcacagtcctgctttttcccacaggaacacaccaaatggtgatggcaatgatcttctcacaccacgctggaggagagcgacatcacgcgacgtagctgtattcatctgccgacgcctggctgcgttctatgtattgtttgtctatcagaacttcaatacacttcttaatcatgctgatactgggattaaacctagctcttgactggctaatcacctgtggaagagatgtggaagtcaaactactgccagttcttcagctattaagtaatgacttttaaccaatcagtttaaagtgcctcaaatgtactgaggtttcaacaaatgggccaaattaagtatgaaaataggaactacaatgtggaaaatggatacagcaaaatctaataatgatacataattaagtgaaacaataaactaattaacctaagtactcacacacaaccccaagcttctatttaactcaactctcagctcttagttcaaacactttctcaagaaagttttccccagcagcccctaggccaggatatttaaatacattctcatagtactgtatacgtttccttcagtgcatgctaatgtaattttacatttatttgcatatcatttcaatagtgtatttcttcccccattaaactgtgaactccaaaaaagcctgccatatcttcagctgctctgtgctatatcccagggaccagcccagctgtctatcacatggtaggctcagatagttatggaatgaatgaatatctgatgggtcaatttccttcaataactggacagaagactcaatgaatcagcaagttttagacctctaaaataaagccaaagcaaatatgaatttattattatcatttgagatagcatctcactgtgtcacacaggctcaatccctgggctcaagcaatcctcccgcctcagcctcccaagtagttggtactacaagtgtgccgccacaactggctaattttttaattttttaatttttttttttttttttttttaggtgagatggggtctccctgtgttgcccaggctggtctgaaactcctggactcaagtgatcctcctgtcttggcctaacaagacattcagattacaggtgtccactgggcatggtggctcacacctgtaaccccagcacttttggaggccgaggcaggtggatcacctgaggtcaggagttcgagaccagcctggccaacatggtgaaaccctgtctctacgaaaaatacaaaaattagccaagtatggtggtgcacgcctgtattcccaactactcgggaggctgaggcaggagactcacttgaacctgggaggcagaggttgcagtgagccaagatcacgccactgtactccagcctgggcgacagagcaagactctgtctcaacaacaacaacaaaaaggattacaggcatgagccactgtgcccagcctgcaaatctgaatttaatactgaaattgtgagtgagtacgattctgattaagtatgaaacatttctttatgctatctgaggatcaggttatttctgtatcctctttaagaagaaagagactgaatctgtacaatgacaatgccctctaccctaagaagccctgaggactgccctccttttacctcttgaataagggcattgtgccgaagcacttttcgtgctttcatgatacgaactatagcagcttggagatacattttccggtcctcatcaactgcacttctagtctgctccatttcctgttttacagaagaaaagaaaaaagacccaacaagacattaagtcactgaacttgttttcaattcattttatcagtgagtgcaaatacttttttttttttttttttgagacagggtttcactctgtcgtcctggctggagttcagtgactcgctctcagctcaccgcaacctccatctcctgggttcatgtgattctcatgcctcagactcctgagcagctgggattacaggtatgcaccacaatattgagcaaattatatagttatgttgtgccaatatcacataaccactgctaaaacatctacaatttctagggttaaagttgaaagattagaaaaaaatttacattattgtaaactgtactgttaaggtaaagaggcaataaaggaggacacagcaataatttgcaagatcattttcttatcagtgattacagaatctttcatgacgcttttagatggagttgtgtcaactgcagtaattagctccaaatgcatactggatcaggcttcaaagggaagagctgtgaagtggcattttatgtggctcaagcagagaagccaggagagggggcctatctccacggagctcaagaaacacagaagcaaggcatagaagcagaccatgccacattaagaggatctcctcacagcgtttcaaagacaaaatacaatctatatattgcaaattattatttattagcctggaggaaaatggaatcttgaccattttaggtttcaaagtaaatggcagttaatatttgtctccccccatcgggaattaagtttctggagagggtctaacatcttatattatcttcacatcctgcatcagcccaaggactgcacaccggaggcaatcaggaagcataagtgatagaaacagtctatcccagaccaaagcaacaatcactgctgagttaaaataatgaagagcagaagtcccctcctcacactggcctgtcagtacctcactccacacccactagatcacaatctgcatttgaacaagatgcccaggtggctcatttgcatatgaaagtttaagaagcattttctactgacaaattttctttgaaagaaatgagctgtaggccaggcgcggtggttcacacctgtaatcccagcactttggcaggctgaggcgggcggatcacgatgtcaggagatcgagaccaccctggctaacacagtgaaaccccgtctatactaaaagtacaaaaaacaaaattagccaggcatagtggtgggcgcctgtagtcccagctactcaggaggctgaggcaggagaatggcgtgaacccgggaggcagagcttgcagtgagccgagatcacaccactgcactccagcctgggcgagagagcaagactccgtctcaaaaaaaaaaaaaaaaatgaactggagaactttcccttattttacaaatgaaaaatatgaaattttattacttctcaatgtgggaattttcggagagaatgcatagttacacattctaatggtttaagagcaaatacaacaaaaccatacccttttccttagaaaaaactaaaatacaagtagagatttctgtttgactgtaaggttaataaatgccaacaacaaaccagaaaagacatatcccattattaattttgctgtgcaaagttttgcacaatctcaatgtaaacacttgtaaagtccaatgcttaaatgtttccccctcaaaaaaaacttgacattaaaagcacttacttgtggtgtgtctttctgcattgatgtagtaattttaaattttgttcttttactgctaaagttcatatttaatgaaaacgaagattctgcatcaatatcttcctacatttaaaaataaaacatttatatttataaaaaccaaaatctttaaataagagtttgctgcaagcaattctgctaaattaatgaccaagcaaaaaagcctccactctcataacttttatattatagattaccaaatttaagagaaaaataattcttttgttcaaacaaacaggaaaaaacccaattattttctacttttacatctgccagaatcttaagcagtttatgtttgggaataagctattttctggtcctactattctatatacactactttttgataaaataagagtcaagctcattgcctagagtttgacattttaatttttatgaaacaccaaagtgcgtaacttttccatcaccccattttgaaaaagcaaccacatttttttttacaaatgccgcagtaacaaaatacccactgtaaatggcctgatgacaagagaaagctgtgcctccagtagcacacagcatcaatttgctgtgacctggggtgatggtgaaaacatttatttcaatccatgttttattcactcttcaagaagcaagtggcctttgctcaggggaaaactgtttaggcaatttttagaataacaacttctgtatcaggcttaagaaagccactgatatcatagagtggaatttctctggcagcagaatcaaaaggcacttggaagatgaaataattctcaataataatctaagacattctgctaaggaatggacagattcataattaaatttaaaggccaggcatggtggctcacgtctgtaatcccaccactttgggaggctgaggtgggcagattacttgagctcaggagtttgagaccagcctggccaacaaagcaaaacccggtctctactaaaaattaaaaaattagcctggcatagtggcttacacctgtggtcccagctacttggaaggctgaggcaggattatcacttgagcccaggaggtggggattgcagtgagctgagatggcaccactgcactccaacctgggtggcacagcaagatctcatctcaaaaataaataaacataaaataaaatttaaagtgcaaacaaggaatctatgtttactttgtcaatttctgggcagcaaaaatagcatgttttagaaaaaaatataaaacctttaagaatttactagcctaaaattagaaaccataattaattaaccttaagaaatccctattttggccaggcacagtggctcacgcctgtaatcccagaactttgggaaagacaggtggatcacctgaggtcaggagttcgagaccagcctgaccagcctggccaacattgtgaaaccctatctctactaaaaatacaaaattagctgggcatggtggcacgtgcctgtagtcccagctactcaggaggctgagacaggagaatcatttgaacccaggaggtggaggttgcagtgagccaagatcacgccattgcactccaccctgggcaacaagagtggaactccgtctcaaaaaaaaaaaaaaaaaatccatattttgctaagattctgatgccagataaatcatttctcaaaattatgaaaacattgatttgaatttcagaatatgccttttacagttgttcagttatagactataaaatgtcatcataatcctagggatgtcagcaaaatgaattaatgagagaaataaactgtaggctattaactttacaaaaataaaaacaaaacattatttataggaattttttcttataagcacaataatttgaaggagatataatcccacctctgttgcatttttaactatttaaacatctaggatatactatgacaacaaaacagcaaaatcttgtaactagaaaaaaagttacagagaaaaaaagtaatatactaatggcttgttattcttgtgacagatattaaaaatatatggtggttaaaaacagatgacagttaattgagtgctgacattaagaacacttggaatggagttacacatattaaatatgtgtacaaacagacatcaacaggctgtcatttcctgttatagaaccatgaaattaagcacatttataaaaccaaaaacctggaaagtctttaaaggctagtttcaaaatctcaattaatcaaaatcttccagatggcaattcttttacaattattcaataagctgtaacagtataggacaaataaaatcaaactataaacggcacatggcaccaactcacacagcatgctctgtgatgccttaacgctcgcagctctatggagcgtacagtaacgtagtgaatacaagtgctttccagagcacaataacaattacagccttattttaaaactgcaaacatctcatgaaaaagctttaatgctgatgatgcttaaattctttggaatattactacataccttttctgaatcatggttaatcattttcacatcaagtaatgatttgattgtttttgtcagttccttttcattcatctgagtgctgtcctgaagctctttataactgacagtttcactgttgttaaaggcaagaagaactgccatttggtatgttgtaaccatggctacatatggtttgcccaaatagttcattttaacttcacctacaattaaaacaaaaactgacagtgaattgaccattcaaagaaacatttcaaatttactttatttcagacattttcttcggaaagagtgaaccaataattttattaaattgttgtaaagccactgctgttaacaaggtagtcattttgtttcttggggaggtgaggatggaagtctattagttttgagtatatggtataaatcagtaaaactatcataacttcaccagtaggttaaaacagtctttaaggccaggcgcagcggctcacgcctgtaatcccagcactgtgggaggccgaggcagacagatcactttaggtcaggagctcgagaccagcctggtcaacatagtaaaaccccatctttactaaaagtacaaaaattagccaggcatggtggctcatgcttgtaatcctagccacttgggaggctgaggcaggaaaatcacttgaacctgggaggcggaggttgcagcaagccaagatcacaccactgcactccagcacgggtgacagagcgagactctgtctcaaaaaaaaaaaaaaaacaaaaaaaaaagtctttaaatattaatagaaatgctaagacttaggcagaaaaagaaaagaacaaaaaacccaaacaataaaaggaggtgggagaaggagaaatggacagacaaagggcaaagtgatatcagcaacagcctcaagtgctgtcgatagctgggctctcccaggtaaggttcaagcctcctgggaggtccacagccacatggaaaatgcttttgaggccctgtctaagctgtaatttctgccaaaattaatgctattatgtctcataaacaacatttttctttccagtaacttcctagaggcaaacaggtatgaaaggagagacaaacaggcagacccattctcttgctgaaagttgatagcaaaagaatctgaatgttttcataaaaatgtttaatctgaatgttttcataaaaatgaaaaacatttaatctgaatgttttcataaatatgttctatatgtgctgggcacggtagcttatgcctgtaatcccagcactttgaaaggccgaggtgggcagatcacttaaacccaggagttcgagaccagcctggtcaacatggcgaaaccttgtctctactaaaaatacaaaaattcgccgggcatgatggcatatgcctgtaaacccagctactcgggaggctaaggtataagaatccttgaacctgggaggcagaagttgcagtgagccaagatcacaccactgcactcaaacctgggcgacagaatgagtatctgtctcaaaaaaaaaaaaaaaattctatatgctaaatgaccctgggagctctaagagatagagcaagtattatgtatactacagttctgcaacatcctgggagacagcagcatgacatcagcacactgaaagctcataatgaataatatggcaaacatgtctacactctgtaatgttccatacgtgtttaaaaaaaaaaaaaaagaaaagaaaaaagatgcagatcaaagagctgcttcctaaagcacgaagttgtggtttgacgactaacacacacacggcctgcattatttgattgttgaatggattataaatgaaattgggccaggcgtggtggctcacgcctgtaatcccagcattttgggaggtggaggcaggcggatcacgaggtcaggagatcgagaccacggtgaaacccctgctctactaaaaatacaaaaaaaaaaaaaaactagcagggcgcagtggcggacacctgtaatcccagctactcgggaggctgaggcaggagaatggcgtgaacccgggaggcggagcttgcagtgagccgagatcgcaccactgcactccagcctgggcaacagagcaagactccatctcacaaaaaaaaaaaaaaaaaaaaaaaaaagatgaaatcaacatgagatttgattttaaagctcttcattgttaactcaaggaagctgtatttctcataaaattaccccagagactgcattttccctctcaaggataattagtaactctgattaaggttttctgctttatgtattcattacctcattaaagattttaggccgggcgcagtggctcacgcctgtaatcccagcactttgggaggccgaggcaggtggatcacctgaggtctggagttcaagaccagcctgaccaacatggagaaaccccgtctctactaaaaatacaaaattagccgggtgtggtggtgcatgcctgtaatctcatctactccggaggctgaggcaggagaatggcttgaacccgggaggtggaggttgctgtgagccgagatcgcgccattgcactccagcctgggtaacaagagcgaaactccgtctcaaaaaaaaaaaaaaaaaagattttaaaggctatgagtgaattcattagcttaatatcaccataaatgcaatattatcttgattattatcatttatgccttgacatttcagataaaactgatatttagaaacatttttcagaattatctggatgggaataccaagagaaaaaattcatagccctctaaattttcacaaaaggaggtttaatatattaaattcaatatccaattcatagaaacagcttgtgcaaaaaattatcatttggagtatactattaacaatttctataaaaaggactcttatcaacatttaagtttggaaaatgtaagtaaaacattacataaattgcattttgttatttctgcaatgacgacttaatcatatgcagaaataagtagagaattatgcatcaagcaccaagatgattaagtggcaccatcagccaggatgtcactgatgctgtaatatgctgccgtgggtttgaaagcagaatgagtcttctgccgtctttcagcaccacgagacccaaagagcattaggagatcatgcgaggggccaaagcatcatttacttcttattgagttcattctttcattgtgccctttcttgctatttttcaatactctaccagggatcaggggtacactgacctcttcccacttttcttagcaccatactcttactgaaaagactggggaaggggtgggaagacacgacaggggaaaggaaacttcaaacttggatgattcatttaattactgtggtgtaaacacaaatgagaaacaacaagagtggtgatttaccctgcagaataggttggcaaaccctaagagactaaaaactaaaataaaacattctgatacatgcatacttaaagtaagccaacaataaataattcaagcagcatttacaatgacaggaaataaagagcgggcagaactctcacaatagtttcatccaagtcactccccagtatctgtgtcagctctctactctctcagggcaagttgaaggcatgataggatatcaccattttgcaaccagtaatgaaacaactgattctggcaaggatcatcagtggaggctaaaactacattaggttcctggaacagggtattcatgccaaagtatcatccctcagactgtctgctaagctaactgaagaggggaaagagtgcctctacaatggagatatctggtggttaccgccttcatcaagtgaccaaatttagcatctctaatagtgagacaatctgacattagatgcctttgaaatatgcaatatgaaatacacaggaccacctatgaaatatccttgccaataatacttaactgaatataatcaaacctttagaactaatttccactttccagaacatacaaggaatagaaaacaaatttaaaaaaaaaaaaaataaatcacaaataagtaatccaaagtactggatattctacaagacaactggcctggtctgttcaaaacagtgtgtcaaagaatgctgagaagtggggaggtggaagggaaatgtaacaaccaaatacaattagtgacctctgacagtcaagcaagtcaccttgggacagtcagggaaatttgaatatggactggacattagacaatactaacatccctccctatttttagctgttggaattatttgaaaacaaaagcaggacaaatttagtcaatagaatcgttatcttttaaggtatgcacaatgatatggtgttacttttattctggcaaacactagtaactaccaacacatactatgatgtagggttcacaaaattctagcctgatccatactatgtactgtctggtgaagttttttttatcttccttgagttcatcatttctcaacgtgtctttcagcaactgaccagcaatctctacaacttcttgctctgccacaaataaaacttatttatacaaagacagtgtaatggtttctgtcacactgtctggttatatctctttatcaagtatctgtatgtctttatcaaactgttccttatcgttaattctatccaaagccttagtcataaatccagtggaattttcaggatttttctcactctgtcacatctggcatcacagattgcttcttaaaattcttcctctgttggaaatacactctcaacactctcctttacgtagcttggttaagtcctattcattctttttattttatgggtttttttttttttttttcaagacagggtctcactatgttgcccaggctgatcttgaactcctgggctcaagtgatactcctgcctcagcctcccacagtgctagattactatgaccttatttaaccttgatcaccttctcatggaccttaggggttagagcttcaacagaagactttgtagggagcacattacagtctctgcaagccatggacatggtgacaattttattccattctaactgcagattaaattaacctccatgttaatctgcagcatgttttctttctttctttctttcttttttttttttgagacggagtcttgctctgtcgcccaggctggagtgcagtggcgtgatctcggctcactgcaatctccgccacccgggttcatgccattctcctgcctcagagaatcttattttctgcacactgctgtgtataaacatacatttttttatatatgtatgtatatatatacacacacacacatacatacacacacacaaatatgtagtgataaaactatatagatgatatttccataattaatacatgtttatattaatgtcaattttaatgtatgaatatgtattaaataaaaacccatttcatttacatatacatgtatatccttccttccttccttctttcatttattattttttattttcatttatttattttctttttgggcctgcctggtcttctcactctgggctctggtgacctcagcctcccaagtagctgggactacagggatctcttaagcccgggaggcagaggctaatgtgggctgtgatcgcgcacctccactccagcttacgtgaggtggggtgaggagaggcgaggtggggtgaggtgaggcgaggtgaggtgaggtgaggtgaggtgaggtggggtggggtgaggtggggtgaggtggggtgaggtggggtgaggtggggcgaagtggggcgagggggcacccggccctattagctcttgaaaacaagttgagatgtgatttccccagaagacttccctcgcaaggacctgactgccaccaccattctgtgatatgccctgggctggcctctatcacattcaaaacaccgtactgtaactatgtacgtatgtctgtcttcctactagacatgagttttttttgagggccaaggctctgtattttatttctgtccacttggcgtttagaagtacctgagacatagaaaatgttctttgagttgatcaatgaattttacaacaataaagagaaggaaacaggctcaaaggagttaagtaatttgcttaagattacacagctaataagttgtgagctaataactccagccacaggtcttctgattctaaattcccccaaacaccaccttgtgcaccatcaaccatttgtgaagactcttcatttacaatacaaaaattaaccttttcttgggtattccatgagctgggaatgtagaaatagactaggcaagaataattttcattctatgtttaagcagaagtaacaggggttctcaagaaacagaactctgagagatctgtccagcctcagagccagtgttttaaagaagtcctggagccttaggccatatatgggtaatctagaacaagtatcttcaatacacatagcgtgtgagaaactttttgttaaatgaataaatggagaacaaaaataaaatgaaaaatgttgatcaaaggggacaaagtttcagttaggaccagtaagttctggagatctatcatatagcatggtgactgttaatctactgtggagtaaacttgaaaattactgtgacaaggctgggcacggtggctcatgcctgtaatcccagcactttaggaggccgaggtgggtggatcacgaggtcaggcgttcgagaccagcctggccaacatggtgaaacaccgtctctactaaaaatacaaaaattagctgggagtggtagtgtgtgcctgtaatcccagctactcagaaggctgaggcaggagaatcacttgaacccagaaggtggaggttgcagtgagccgagatcgccactgcactccagcctgggtgacagagcaagaccccatctcaaagaaaaaaagaaaaagaaaattgctgtgacagtaattgctgtgacagtagatgttaaatgctctcaccacaaataaagataagtgagaagctacttatgttaattagcttgagttaatcattttacaatataaacataacaaagcatcacactgtacactgtaaacagatacaatttttatgtgtcaattgtatcttatcaaagttgggaagaaaaacaactctaactcctggtttcactgataggtcacaggtgttttcagtaccttcggtgactcaaaacaaaaaaataaacttataaggttctctttccaaaggaagtaactatttggttttaactaaaacacaaataatattaaataaaagaaatgaacaaacaaaagagctccccaaatcaacttatgtatcagcttagaaatttagtatagctcaaaaacagaaagaaagttattctctttcctatttaggtgatattggtgactattttcaaactaaattccaatggctaaaaaactatgtgcataaatttattttcttcttatacaccactggttgttaaaatgagccccttactaaaattactttaggagacacattgattattgctgaaataatgagaataaccaagaatgtttaaactcccccagacagatattcatggaaagtaaaagcaagctaaatcgaactgcactaagatatattagttttcttaggggaaaaaaaaaaaatctaaaaccctggtccagcatttttttcttaaaatcaattatgtttactaaatgaaaatagaacatattgattgactggttgagacagggtcttgctctgttgcccaggctggagtgcagtggcacgatcatggctcactgcagcctccagctcgtgggctcaagtgatcctcccatctcagcctctcgagtagctgggactacaggtgtgctccaccacgcctggctaatttttggattttttagtagagacaggttttgtcatgttgcccaggctggtctcaaactcctgggattaagtgacccacctgtctcagcctccccaagtgctggggttacaggtgtgagccactgcacctagccaaaagtcaaattaaaatttgacctttgactaccactaagagtatcagtaaaaaatctcatttcaaaaattattttaaaaattagaatgtccaacttgctcagtaaagatcgacttatataagtaatgcaaaatgtattactaatacaatgagccatcacgttcccaagatgtaaattagtcaaataaacaccaagtatcatagttacttggataaagtaactcttggggaggggatagaaaacatttcctaataaaggttatggcaaatgattttcttgtaccatctctaagaaatattagcatatataccctttccttcttgtacaaagaaaaagtgattcaatgaacttgtcaaagcatagtttagcaaaaaaagagaaaattcaagtgtctgctttggcttacatcttcaggcaactccacacacagtccacaataattcaggtattaatcctactgtaagtaagtggactccattgttccagaaagaagcaaaggaaattagattgtgataaaagttttttaaaattggaaactattgaaaattaagtaggactttctgcaaaaagctttactattgcattcactgcagtatcacaagtaaaaatcaaatggttaggtctccttatgatgctataataaagaaactggcaagaggatctggcatacttagagaacaagtttctaagtgtgtctgccccatcaaatgtgagtttctaaatacatttgctaatgaagtggttggctagagaaatgtaataaatcagtataaagtcagaacatttctttaaaagcagcaagattataaacagtgtaattataaaatactatgaaaaagtgctatacttggatttcattgttagttgctttaatggggaaaggttgatggaggagaaaaggttaaaaactgtaattgggccatagaaaacctctttctaaattaatataatcatcaggtaaatttcattaagccagatataattaaatgcattttacctgtacacagataatgtaaccatgtaagtttccttccactgaaatgttggctataaaataattcaaactgtaaaaaaaaaaaaaaaacacacattatttttagctactataacttgcctagttaattaacacaatactacaaaagcaatgaaaaccattcatattagaagagacattaaagcccatctggtttacctccttcttttacagaggagaaagcacgttcctgtggtccctaatcaaggctatacacatatattccagctcttttaattgacaacttgttctagagttctctccactaaaccacagcactgcaaatttgactttctgtatgacacagtgattcattatcatttctgaataatactaacatggactttataaattctactaaccaaacacagcaacatatatatttcaccatgaaaagagaaaccctaccttcatctctaatctcccatttgccaacatatagcttccacattcaattagacacaaatacgaagttttagggtatatctctggattattcttttgctgatattattgtgaacaattaaatttaaattctattaatgtagccttcaaattttaaacattcctccctggactgaatgtgtaattacagaacaaaaatacagagttcttttttctttaataaagagctagtatacaataaaaagtggaaaaatgatactggatgtgaaaaagataaaaactcaatttctttataaaactaaaaaataaactgcattatgccagttcagaattctgaataaacttttagcatgatgtaccatatataacatacttaaagcttttatttgtatatcaaactttaccttttgtactttaaaaaggaagttcacataaagcagtcagcaatgactgacctatcagctatattatgaccactccttaacagcaaaagttaatagctccagccaagaaaatgagtcaattccttcagcagttactctaagtttgcctagtcctgggaagctgaaatatgttgagcctattttccctctaatggtgcagcatcctcctctaccagcagatccaccaatccctttgcaggatgaacaggagatgactagcacctggaatacttcagattgcctgcttagttctaatccagacaaacagcaaattgaaatatgtcataagaggatttcagaagtatgatctgactaactaataactcccagggatatcaataaaattcaatcactactatataattcacaatttataacacatttacaatgaatctggacaaaagcaaaataaaagttaaaaaaactttcatttttttctcaaaacactttcggaaatgagaaattccagctttaaaatgctcataatttaaagtgcaaagctggctttaaaaggtatattccaagctctaaaaacatgttttacctcttcagtagtactatttggtaaagttttattgacgataatatcaatatgccaaaagaagatactgattcatccttacatttaaaatctgactacaaagactctcgtatctatagctagtcaagaacaaacagactccaataaattcatcaattcatatggcactacaaagaccaaagttataaaaccttccttgattatatcattaaaataattgtgttagcaaagcttattagtaaaaaatatatgttgactaaacttattttatttttttaaattttattattattatactttaagttttagggtacatgtgcacaatgtgcaggttagttacatatgcatacatgtgccatgctggtgtgctgcacccactaactcgtcatttagcattaggtatatctcctaatgctatccctcccccctcctcccagactaaacttattttaaaataaacaggataaaaaacagcatttttcaaacactgtttaagggcattaattagatctcaaagagccttaaaaattcaatgagtttatttacctttaatagatagctacattaatatacactactttagatactttttttttttttttttttgaggcggagtctcgctctatcacccaggctaaagtgcagtggcgcaaactcggctcactgcaacctccacctcctgggttcaaccgattctcttgcctcagcctccagagtagctgggactacaggtgcatgccaccatgcccggctaattttttctatttttagtagagacggggtttcactgtgttagccaggatggtctcaatctcctgacctcatgatccgcccgcctcggcctcccaaggtgctgggattacaggcgtgagccaccgcgcccggcaactttagatacttctaatattattcaggtttttggcctaggtaaaaaagaaatgtaacaattaagattgactggcctaaagtataaaataaattacttttaattacagctttaattccacagttttgagatactttggtgtaaaataaaggtaattcttgatagttatatttaagattaagatgtaaaaaatgcaaatcatcactaaggcaggatggattaatttacatgagaaaactgtacactattaagtatacaaatggatttcaatcctatgtatctgaaaacttggacttactagaaaaaaaataaaggacaaactccctctactggtaattggagacaattcaaatggagagaatagtatttttggaatcagaattttacagacagaaactcacttcctatttgtaaatggggaaactaaaacctgaggaagactatacatcaacaaataaagtttaaagagttaaaaactataaatagaaaataattatttcaaggaaagaggaaagaaaaaactaaaggaaaacttcatttctgccagctcctattctctcccttaatttcaatcagggacacatgatatttaaaaagaaatgtaaaagactgccaaggccaggcatggtggctcatgcctgaaatcccagcactttgggatgtatcctttctgcaaaatttgtaataaccttggattatagtctgccccatccaatgaatgtctgcacaaatgctcttcttcacatagtttctaaaatagtctgtgctacaatctcttttcaaagaagatgtaagaagtcctaatttagcctcctattctgaaagtctatcatgcttgccttcctgaaacctacctgactggttacaggactctcctctattagttattaccacgaaactaataaccactatcaatcactgttactacttactctactagcagttacttcacatatatttacctacattacaggacagaaataaaaatattacaagggctgaatgaggtatttggtcaaaattcaaaaggaaaactggtaagtgatattttaggtgttgaattctaagctttcttctgatatcaacatttttataatttaaaactgcttaatagcagatgatagacttactcagaataagagacatgctttgacaaagaactgtatgacattcttcttagcattttagtatcaatattagtaactacaataacttacattcttcctaaagggcagactgactataatttctgaatctatttttatcacatgaacccttaagactctgaaaaaatattaaaggtgatataatatgaagacaattattaaaattcctttagtcttctaatatatttcctgcaaacttaccatctgtacacttttttctaattcctggggaattgcaaacgtagatgaaggagcctgagtaagaggccacgcaccagcctagaaggaaaaaaataaaataaaataagctaaatggatcaacatctaaattcaaagtaaatatttattaaataatctaagcatctaaaacatttttttcttcctcaaaatgttgatgaaatctgagtatttctatcatggcacatttcattccaaaccaataggacctttttttgttttttttttttgagatggagtctcactccatcacccaggcttcaatgcagtggcacgatctccgctcactgcaacctccgcctctggggttcaagcaattctcctgcctctgcctccccagtaactgggattacaggcacgcaccaccacacctggctaatttttgcatttttagtagagacgggttttcacatgttggccaggctggtctggaactcctgagctcaagagatctgcctgctttggcctctgaaagtgctgggattacaggcataagccaccacgcccagcccaaatcaataggactttagaagccacaatctactcacagaaccaaacgtaatcaggcatccatttatgaatcatttgtatcaacgtactgaaatgattagtaaatgctcatagtaaaacacatattcatacctgtagaacatatatttgaaaactaattcccaaatctattactgtgtcttggtttttgataaaattgttgaacttattgttgagatcagcgctgacactcatatctgtatacatccgatgtagcttgctggtaaactcataaccacaggcttgctataaaaaagttttagaaaatacatgaattcaaaagaaaaataataagtcatattggttaataataatgtgtcggtattgctaggtctttgatcaaaggttcttgcatatacacttatacccaaggactagtaatatattcttcataagtcaaagcaactaatcaaaacctttcaaactttctttttaaagacgtattttaaataagtgaataaaaaccacctatctaggaacaataaatctccccttaaacaaaaacttttttatacattcatctcttatttcagcactgcaaaatgccccgttactatacataagataccttaaaaggattttatgttgtgttttgttttaaagacttggggtctcactgttgcccatgctgcaacgcagtggctattcattggagccatcatggtgcactacaacttcgaacacctgggctcaagtgatcctcctatctcactctcccagtagctgggactattggcacatgccacagctgctggctcttataaggtttacagatagtatcaaatgaaagattacataaatgattactgggaatactccagcctgtagtcaattgaaaaagttctatttaggcatatttttaatagcatctactgagtgctgaagaaaactatttctttaaaattattcaaaattctgttgttaccaggtcagaaaatctgaatctctaatcttgaaatataaaaagctcattaacactactttttttttgtaattaatctatttagaggcaggatcttgctctgtcactcaggatggagtgcagtggtatgatcatggctcacagcagccttgatgtcccaggctccagcaatcctcccacctcagccacctgagtaactgggactagaggaacacgccaccaagcccagctaacttttgtatttttggtagagacagggttttgccatgtttcccaggctggtcttgaactactgagctcaaacaatctacatgccttggcctcccaaagtgctactattataggcatgaaccaccacacctggccaacactacttttagaaattaaaaattaagtttctttttggaggtttaaaaaagagcacacagcaactgggtgcagtggtgcacacctattgtcccagctgctcaggaggctgaggcgggaggatcgcttgagcccaggagttagagtccagcctgggcaacatagtgagaccctatctcttaaaaaaagaaaaaggaaaaaaggaatgcatattatattcaaaatgtctactatgcaagaaaatttattgaataacacaggataaatatgaacctgctaccacttatcggtatgtaagcaagctgaaatgatgtaaaaataaattgaaatggaattgcactccaaaatctgtacttaaaggaatattttaggtgtattcatttataagtagtaataatcttttatcattaatactgattatcttgtgaatcttcatatataaacatatacattttgtccttttaatacagtatttgtatatcccactgtgtgactacacaaatacacatttaaccagatgaattgtttcctgttactgtacacaatgctgcaatgaacatctttatgtgcttgtgaatgaatttctaggacaataccacattaaagacttacattacctttaatttgttgatcatggcttcttcagagtccatagacatggataacccatgaattaaacgttttgccagcattcttgcgtagaactacatttaaaaatattttaaaagattacttcctttctaatgatttagcattcagaaataaagttgaccaaaatacaaatgaaacttttctgttcacaacataccttttgaaagacgtccttgtcatcaatgtatttgaacactgtgatgaagctcgtgagcctgtcttccacttcattctctgtcatccctttcgctgacttcttcagtaagttgtcacagtacttagcaagctcatgtagaaattgataataaatcttacaaagggtgcttctgtatatatcacgcctcaaaggaggcaaagtggtgatacaaggtaagatcagcggacagaatttttgctgttttttttagagaccgggtcttgctctgttgccaggctggattgcagtggacaagatcatagctcactgcagcctcaaactcctaggctcaaaggatcctcctgcctcagcctcccaagtagttgggactacaggcatgcacaaccacaccaggcttctaaagctttatgtaataatcataaatgtaaactaaataaaatatacatcataaggtaaatttttaaaaagaacaagtcaaatatcaaatcatcacttattgaccaataaagcaactgatataagtaatacaaatttttaaaagaacacctaggtgagtttcgagtggttttataatttttgacattgaacaagtactttaaaaaaaagttacaaaaatcttgtaagcaagtttccttcaaaggttacccaaactttatcatcagatttcctttagatttcagatgtaacagaatctacatgaaaagtattgcaaattatttcaaagtagatatacattaaaacccaaactttgtaaaatggttattctttaagacacatagtatattgcattccttacataaatgccaaactatatacaatgtagataattttccttctatttttctgaaaaatgctacaaaaaccaaattaatttgatattctgagttctcattttctaatactgacttttcataagattacttttcagcaaccaccaaacttaccagttcaggtgctttgcaaacagacttaggttctctgtaatttacaactgacgtaagggcctgaataaaaaaacacgccataattaaccaccagccatagggaaaaagtacagctagttcaatataagccataatctgtacatccaaaaattaccccgccacataaaacacagcattgccggtagtttgttaatattttcatgcctaacatggtagactcctctgactttattctctaattacaaaatatctatatatcctgttgctattccaagatattctgtaactcattatcgaaatttgaacagataaaataacgttacttaaaaaaaaacttacaatcttgtaagcagctttcctttaacgtatgcaaaagttcatgtaaaacatatctattctcttttcaaatattattcaatatagcctaagtattatggccaaagaaaaaaaatcagtactaaaaattgcaaaattatgcatgtctatccagaacatatcagattaaaaattccccttatatagcataatcacgggacattctacaagcattcaatttaactattcagttaataatttaaaaattatattatttctattttgaatttcatatcaaaattacttaatctccatgtctacatcagaaacctcatactagaattctgatcttgaaactgcctaaagaatgatagagttttatgtacatatatagtatatatgtatttaaaacttaccttatccaacgcactcataaaatgctgatcaccattcaaaacagtgttgataagctgaacaaatttaccatgcacttccaaaactgactccacaaatagtgttggcatctaaaaatgaaatataagtacaaaaccacattttaagaggttcaaggatatccaaactatgaggtttattagacttattagtaaatttttcctcaaggaaattatgtttcacacatgcacacttctcagaaaatggttttagctaagacggtcttagaaatttacaactttggtgttgaaggctgggcacagtggctcacacctgtaatcccagcacttctgggaggctgaggcgggcggatcatgaggtcaggagatcgagaccatcctggccaacacggtgaaaccccgtctctactaaaaatacaaaaaaattagccagacgtggtggcgtccacctgtaatcccagctacacgggaggctgaggcaggggaactgctggaaccagggaggtggaggttgcagtgagcagagatcgcaccactgcactccagcttgggcgacagagtgagactccgtctcagaaaaacaacaacaacaacaaaaaaaaaaaaaaaggaagaaagaaaatagcttgtcattcaacacaacaagctgtcatagactgtctagtacctgtcagaagaacccaccaaaagcatacttttctactgtgttggaataacttatcttaaggataacaagacctgaactaccaggtctatcactttcatagaggcttaaataagcaaagactgcctgcaaagtcactaaaggctgagagaaaggagagttaaaaagccaataatcctgagaacagagaccccttgaactcggcaagacaatccctcacatctcagagagaagaaatacctaatagtacaaaagtgagttttccctcttaatggagataaccatgaagaagttactacctaagacttaactaagtcagttggatttgagtctaccacaaatgtattcacttatgtttccatctcccagccttgacacaaaattcgatgcttctatgcccaatgtcattggacatggaatctataaacgtaataatgtaaactagtaagtttgacaaataatagagtaataaacctgaatactataaactaatagttctacaaaaaatagaaaactgtggtaaagggaatttgaagaaataaaaaaatagaaaacttacacattattgtggcataacataaaaactaaaaattattacttgccaaaaaccaatctgcagctaaggtaacagcctctaaaaagtgctcctgaacagtgacgtctatacacagatactatcttatagatgaagggcaaacagctctacttaagaagagacagtaacatttgaagttatttctctcttgctcatcaaacattaccagtaataacaagatttggtgatgggaaagacaaactgttacagtacaaactgttacagtcatgtgattggcaaagtattcgagaaagatgagtattagggatatgagggttattgttttgggtatttggggcagcaagcatatacttacagaagattattttaatctaaatttgcttcctggacaaccaaattcagaggatatggaaaggaggcaaattgcaagtcgtctatattaccactgattaatactactaccatgacaacaaactacgttatcaatgccaattacacaaaaacacagttatttaaaaatggcgagcttattttcctgtggaaagttaacaactgttcaatggacaccctccgtatggctaagcagcagcctatcaatagctttctaataatctgataattccaaaatgagtccaacaaattctaggtttaaaacatttgaataaagacatttctttcgttggcatggtaagactttttctttcatctttcaaaacaataaagtcaaaggaaaggctccacgctggatctgattaggaggaaaacattgcagtttcccacacaactcacgttttcctgagtaaggttgctggttgctcgaaggccctcatcatggatgtggttttgcagctcctgaatcatatgaggtaaaccagtggacacagcacggagtaagacgtacatatttgccatgtctgagaggaaaaagacatctgagggttaactcccaaatattttcatttattaggtaatatatggatccaagtgcaggagtacaatatacggatccaagtgcagagcacccagagaaaagtcccccatgcccacctcccagccacccaagcccctctccccacaggaaagggatgtggttatttaacatcttcccaaagatattttgtgcaaattcaagtgaatacatatattcttccctttgccccttttaatacagtgtactgtattttgtatattatttgtagcttcagaacacattttaacttagtggtcttttcctatcagtacacaaagcatttctatgtattttacagctgcacagtactccattatgtggatataatttcttaacaactgatggaaatttaggtggtttccagtctcttgatattgcaatgttgcaatcaataatcttatacatgagcaagaatatatgcaatataagttcccaaaagtgaggttactgtgtcaaagtttaatcttgtagacagatccttctaaccacagctgccaacagcagagagttcctttgccaacaatgtgttgccaaatgttttgatctctaacactgggaggtgaataatgatctctcagtgtagtaggtttaattttaaacgtttcattaaagcatcatacatatacagaaaagtatacaaaccataagtgtatatcttactgaattatcacaagtgaacacacaacacacccatgtaatcacacgcaggataagaaacaggcattacctacacccaggagtccccttcatgcctccttccaatcacacactcttgctcctctgcaaaggtaaccactgctgtgacttctaaatcacagatgagtttgaactacgtataaaaatgggatcacacaattctttcgtgtctggcttcttgtgttcaacatgtgtataaggatcatctatgttgttgtgcatggctttaatttgttcatttccactcctctataatattccattgtatgaatatactgtactattctacagtaactggacatttgagctgttccagtttatggagctattacaaacactactatgaacattcctgtatgtctttttgtatatatgtccaggcattggcagtggggaggtaaagctggggggtggttatatgtttaggagaactgctggatcataaaatatgcataatatatcccacttagcggtcagtgccagtttcccaaagtagttgcatcaatttatactctcacttcagtgttcaacaagttcctgctacttcacacttctttctatgtttattggccatctgggtatcttctattctgcagtgcctgttttttgagcattttatattttggatataaatctttagtattgcaggtacattaccctataactgtcttctgatgatccagtggttttaatggctttttttgagacagggtcttactctgtcacccaggctggagtgcagtggcaggatctcggctcactgcaaccaccacctcccagattcaagtgatcctcccacctcagcctcccaagtagatgggaccacaggtgcacaccaccccgcctggctaatgcttgtatttttttgcagagatgggatactgtcatgttgcccaggctggtcttgtactcctgagctcaagcaatcttcctccctcttaatggccttttaataatccaaagtttttcattttaatgtagttcactggatcaatcgttcctttgtggttagggctttttgtgtcctatttaaaatatctttccctgtctcaaggttatgaagatattcttctatattatcttctagaagtgttatttttttaccttgtacatttagagaaaaaactcaatagtgaattgattttgtatatggtatcttgaggtagtgatcaaatttcattttcttctgaaatggatatccaattgactgagcaatgcgtgttgaaaagaccatcttttacctgccgctctgcagcgccaccttggtcttacatcaagtggccacatatgcttgggttgtttctaggatctcttattttattaggatatctgtctgtccttgtaccaatgcctcactgtcttaattactataggttttacaataagtcttgctggtcattaaagtctttccatcatactcttcaagacagtgactttcggaattaaaatgaaattattgggttttgactacattgccctggatctatgaaattaatgttgctgtaaaaaacacggggccaagggtggtggctcgtgtctataatcccagcactttgggaggccaaggcaggtggatcacgagctcaggagttcgagaccagccggccaacatagtgaaacctcgtctctactaaaaatacaaaaattagccaggtgtgggggcggatgcctgtagtcccagctactcaggaggctgaggcaggagaatcgcttgaacccaggaggcagaggttatagtgaacagagatcgcgccactgcattatagcctgggccacagagcgggactccgtctcaaaaaacaaaaacaaaaagcctgattaatggccgggcgcggtgactcacacctgtaatcccagcacttcgggaggccggggcaagcagattatctgaggtcaggagctcaagaccaggaggccaacatggtgacaccccgtctctactaaaaatacaaaaattagctggatgtgatggcacacacctgcaatcccagctacttgggaggctgaggcagaattgcttgaacctgggaggcaggggttgcaatgagccaagatcatgccattgcactccagcctgggcgacggagcgagactccatctcaaaaaaattaattaattaaataaaatatacatatttattatctttcctgcctataaaagtaatgcatgttttttgtttttttaaaaatcagagaggccgggcgcagtggctcacgcctgtaatcccagcactttgggaggctgaggcgggcggaccacaaggtcaggagtccgagaccagcctgaccaacatggtgaaaccctgtctctactaaaagtacaaaaaaattagccaggtgtggtgatgagcgcctgtaatcccagctactcaggagtctgaggcaggagaatcacttgaatctgggaggcggaggttgcagcgagccaagagcacgccgctgcactccagcctgggcgacagagtgagactctgtctcaaaaaaaaaaaaaaaaaaaaaaaaatcagatatagctgattttttatattatataaattattacatttattacataatatttgtatttcctttttatagtctttgcctttattcctactgtttatcaggaattctaaatgcattaaggaaattagctcttgtaatatataaaaatgtataaacacaatttcccactttttcttctgattttagaacactctgaaaacactttcctaaaatagtctttcaaaataaagtattaataatctgtaaaaggttatttaaaatattttaaagactattactaaaataggcattaaatcaagggtgactagaggatgatataaaaggtggatttataatttaatttctactcatgtttggtgtcacttaccattttttttctcttgtcgaattatattatgacattctgcatgtaaaaactgtaagtggtctgctaccattcgttgttgacattcatgaatcaccttagtatatgaacttggatgtaggtattttcgacatcgaatttcttcatcttttaatctacctagaacctataaaaatattttcttacagtcatgaacacaaagttttactatgaggaaaaatctgtaatatcagcaagtaactcagccaaattttaatggctgaattaaacatggcaaaggtaataagggttacataagcaatttaaacccacattctataaatcatttcaaatttttatttaagctactagctgtcatctacattccaccagtcttataagcaagaactaaagttaaatagtctgcattttgtcttcatttacctacaccattcatcctattacatggacaacataacatgtaacaggaaaagtgggtacagatgattaaattcagaacaggtgatctctgttatgaataactatcaaactaaaaaataaattatattgaaatcaagtagatgaatctaattattttacgttggtttctcttcttgtaaatggaactgtatgtgcatgatagttaactaccatattaaagatttaattaaaatttttgaaagtaggggctggacatggtggctcacacctgtaatcccagtactttgggaggccaaggcaggtggatcatctgaggtcaggagtttgagaccagcatggccaatatggcgaaaccctgtctctactaaaaatataaaaattagccgggcatgcctgtaatcccagctccttgggaggccagggcaagagaatcacttcatcccgggaggtgggggttgtaacgagccaagatcgcaccactgcactccagcctgtgtgacagagtgagacactgtctcaaaaaaataaaaataaggccaggcaaggtggctcatgcctgcaatcccagcactttgggaggccgaggtgggtggatcacatgaggtcaggagtttgagaccagcctggccaacatggtgaaaccccgtctctacaaaaatacaaaaaattagccaggtgtggtggcaggtgcctgtagcaccagctactcgggaggctgaggcagaagaactgcttgaacccaggaggaggaggttgcagtgagccgacatcacgccactgcactctagcctaggcaataagagcgaggctctgtctcaaaaaataaatataaataaaaaataaaaaatttgaaagtaaatataatttagtcatagtcaagtatgtcaatcaagacttttattaaagtttatcctacataaagcgctgagctacaaataacactggttaatatcaacaagaactagcccataaggaaaataaccaaagaatttgactaatttctgtctcaagacaaaacaacaacatatacacagacaaatgcaccggcttggaaacactctggaacataaagctgtgtaattagagtttctgaaattaagtgttcccggggaactacatacacctggcactttggagagtgctgctgagttggcctgggcacaaggagtgaaaatcattcctggaaagcggatcagaaattttcaataaaaatgaggctccagacagtaggttcccacagtcctgtctttcctattgtgcgaccctttgaagccaggagttcagggcaaagtcacagactcaggtcgggcaagaaggggtctagagcagcagtccctaaccttttaggcaccaggctctgcttttgtggaagacaatttttccacagacggagtgcgggcggcattggtgggggcaggtggcttccaggtgaagtattccacctcagatcctcaggcattagattcttctaaagagcgcacatcctagaccccttgcatgcagagttcacaatggagtttgcgctctgtgagaatctatgagaatctaatgctgctgctgatgtgacaggaggcggagctcaggcagtaggtaatgctcacacagtggctgctcactccctgctgtgcagcccggttcctcctaacaggccacaggtcagtactggtcctccccagttcctaacaggccacaggtcagtactggtcctcagcctgagggtcagggacccctggtctagaggacaaaagtgttcaccacatattacatcagctaagaaaggcactttgattaacaataaatcctttaagggctatttttataacaaaaaggattaagtctattagtcattcagagcatactatagtgactttaatctgcttgccaagttaatgcaacaggaattacagtgggtctgagagaggtgaaggaggatggaagaaggaaaaaataaaacaatgataacttgggagagagaggcgcatatcaagagaaatgtagagaaggttggactgccccagtgcagggcttcaaacagctgtaaaacccctgggggaaagaaaggccaaagctataagaggaacgcagcaaggaggcaggaaggctgtactgactcattccccaattaactaaatggagagcaaagcccagggttttgcccttgaagctaatatggtccaacattatttcctgaaatgagcttttctttttctttcttttgtcagacaggatctcgctctctggcccaggcaggagggcagtggtgcaatctcggctcactgcaacttccgcctctcaggctcaagtgatcttcccacctcagcgtcccaagagctatgaccagacgactacaccaccatgtgtggctagttttttaattttttgtagagatggggttttgccacgttgcccaggcttgtcctgaactcctggacttgcgtaatctgcccgcctcagcctcccaaagtgctgcaattacaggtctgagccaccgtgcccagcctgaaataagcttttctaataaacattcttttccaaacataatttattccaatgtccctccttcccttttaacaccttgagatgtaatttacatattaaataattcacccatttaaagtgtgcaattcaatggttttggtatattacattatcaatgtttttaaattgtggtaaaaacatagataataaaatttacattagccatttttatgtgggcaattcagtggcattaaataacgctcactatgttgtgtaatcacccccattgtctacttccaaatatttttcattaccccatcagaaactttataaccattaagtaacaactcctcacatcctcctcccctgataacctctaatctatcttctgtccttttgaatttgtctgttctagatatttcctataaattgaaccacagaatatttgcccttttgtgtctgtctttttccacttagcataacattttcatggttcatccatgttgtatcatgtataacttcaattctttttaaagactgtgtggtgttgtgatatgtaagtacattggttttcatctgtggttcctggttcataactcccttagccctagttacagtctttagttataatgttgagtgtgttaggtctcaggaaacagaatttctctcctactctcctttcacctgcctcaaggcaggactctaatcttgccctacctttctgactgtgggtcataagaccctccccagagaaagccccaccctgtacgctgggggaaagactactgacatcatgaagcttccacaaaaatccaagaagactgggttccacagggatagaagctcctgcactcatggtgatttcagaccttcccttatgtgtctcctcaagtggttgtttatttgtatcctctaaaatatccttcttaatgaactagtaaacattaagtgagtgtttccctaagttctgtgagctgctctagcaaattaatggaacccaaacagtgtactgtaggacttcaacttgaaagccagtcggtcagtagtccggaggcccagacttgtgactggtgtctgggggtgtgcagggcagtcttggagactcagtccccaaactgtgggattagccactatctcaagtagatggtgttagagttgaactggaggacacctagctggtgtctgctgcttggtgtgtgggagaagagagccacacctttgtttacagaagccttctgtgctgatgattgttgctgtggtgtgagagtagaggaaaaacatggtttgagagagtttttcactacacacgatgaataatattccaatgcacatatgtatcacattttgcttattctttcaacttctaacagacatctgggctactgccaccacttgccagtggcatatttttgacagccagacagagcaaagtgcatgtatcacagataatctgtgtgtgattcttggggctggatctagaggcttcaacaaaagtctaaggtgcaataagggctaagagcttagaaccactgatctagtgtaacctgaacttaattgatgggggaaaagttccagataatttgctcaggggacagagctaactagtaagaaaagcaggaagataatcaaacaactaagacctctagatctgggctttgtggatgacacaacagtgtatcggtaagcacggatgctttgtgacttgtggcctagggatgtaggatgacagctcacccacttaaactactcgacctttcttggctacataaactaacacaaaccatcccaaaataaaatgcttgaaatccaacactgcagatttaaaaacctggctagaagttctaatatatcttacatatggtggtttaatttgtatgaacacttttttcttctactactgagaaaataaacatgggatttaacatatgataaccaatatgtactggtttagtgatcaattaaaatttcttggctgggtgcaatggctcacatctaaaatcccagcgctttgggaggctgaggcaggaggactgctcaagttgaggagttctgagaccagcctgggcaacacagcaagaccccatctctataacaaattttaaaagttgctgggcgtggtggtgtgtgcctgtagtcccagctacttcgtaggctgagacaggaggaccacttgagcctgggagccatgatcaagccactgcactctagtctgggcaccagagcaagaccacatctccaaaaaaaaaaaaaaaaaaaaaaaacacctcacgtggggttgtctctcagcctttcaagaacttaacagaccaaaagagtgactcatccaaatgtctagaattactatattttcctcatatttttcctctcattttaaaggaagaaaaaaacctcaacacagagcttctgcacttatcctattctctaaactaaccactaagcatgaaatccagtataaactgattattctgccaagaatgtgcatatatattaatttcaaggacaagtaaaccaagcagtcaggatttatcaaaaagcatcaattatgatgaaaactggaagggtattgtaaagagcaatgacttatcaatcgatattatataataactgtaactcagagttaatgattaaatagattaaataaacagaatatttttccaccaagaaacaaaacaagaaaactaagaacgatgttaaataaaaccaggccagatacaaaatagataaatgtattcgatatgttttatttcttaccttttccatatactgtgagcagtttgattcttgtaataaatttgaagcttcttgtttgtaatactctcctgtttcagtcagaaagggagactcaaaaatttcctgataaaactgaataaatcaattacatcatattagaagaaattagaacaagcagtttaagaaattaacagtctgattatttgtttttaaaggaggctgtttacctttaaggggaattttttcttatactgttcaacatgaacaaaggagttaataaccccatggattactttctggtttgggtcttctccaccacgatcactaaaacaaggtataacacaaaatattcttgagaatacaaattatctatggaaatatacccaaaatatgccaaaatatggctccttattctattggtctaatcaaagtgtaaagaactataaaaaggtacatgcatgaatcttaacaatgattttttttatatcacagctgagttaatattcatgatagttaatgtatacattagatgtcatttcaagaaataaaaagaaaactgattgtaaagttcaagatactatgtcagtaataagataacacttctttaattttaacaaagtagatacgagcccatcaattcaaaactttaatactggcggttaagaatgcttgattttcactcactacaaactacaaagtcttaatcatattaagacatgtaggtgaaatgttagcttttctaataaaaggaatatgaaatagaaccaggcaccgtggctcgtgcctgtaatcccaacactttgggaggccaaggtgggaggatccctgagtgctgaatttgtgagctgcctgggcaatagagcgagacctcattcaaaaaaaaaattagccatgcatggtggcacacacctgtggtcccagctactctggaggctgaggtgggatgatcccttgagtcctgagtttgagactagcctgggcaacatagcaagaccccatacaaaaaaaaaaaaaaaacaacttagctgtgcatggtggcacatgcttgtggtcccagctactctggaggctgaggtgggaggatcgtttgagcccaggaggagtcgaggctacagtgagccacgattgcaccactgcactccagcctgggtgacagagcaagaccctgtctcaaaaattaaaaaataaaaataaaaataaaatagaaaaaaagtttgcttaaagccacagtaaaataatctagctctaaattgggattttgtgactctagtaccaatgctcaaatcaaaccattatggtttacctcactacacactcttccaacctactttaaaataatttcttctttgcattaataatgtcacaaagagagcaacagaaaacttattatcatcattccctagtaagagcttgttgctctatatataggatgtaagaattttctatcattgaagaaaagcatcaaggaaaagcatccaggcaattacctttacatactagagtccttccctgcctctgaacccctctagtcctctttgattcttcctttaattatttggatattctgagaactattttttggacatgaattaatatggctacagtaattctgtcagtcatagagaatcttgatatcttgatatcactgactagttcatataataaggtcacacatgtgagctcatttccttggcttgggtcacatgcgtgacctcacataagcccacattcaatctggtgagatactgatctgaactgttacctattttctcatgttctgcttatggtggaagaacagatactgtggaggacatactggcaaaactctaagtatacacaccctatgaccccaagcaaacatctacatatgtgtacaacagaaacaagagtggtgttagtggaaaaactggaaggaacctaatatacgccactaggagaagagtttaataaagtgaggtaggcctctctagtttaagtctgagttcatcctggtaaagtttaaaaagctaactggtcacctaaggatgacagcaaaccaactcattatcttaaaaactgggttattggccaggcgcagtggctcacactggtaatcccagcactttaggaggctgaggtgggcagatcatctgaggtcgggagttagagagcagcctggccaacatggtgaaatccagtctctactaaaaatacaaaaattagctgggcatggtggcgcatgtctataatcccagctgctcaggaggctgaggtaggaaaattggcttgaacctgggaggaggaggttacagtgagccaagatcgtgccacggcattctagcctgggcaacagagtgagactctgtctcaaaacaaaacaaaacaaaacaaaacaaaacaaaacaaaaacaaaaaactgggttattaaaaaggaaagaaacaaacagttattttgcttttcctatatgaactctaccattgggtaactaaacagtaggtgagaagaagcatatcttgataaaattttccaggtaataaagaagaacaaaatgatagatggctctaacaagcagctctataatatgctgactaaattactaatttcttcatttcctttaactgacattcccacctagaaaacaattttaaatatcaggaattctattcactgtaaaagaaagatgtggctcacatcagaaaccctacctcaacctccatatttgcttaattctctatgatagttcctcaattctgtgagtgaacacattagattacaataaaaaataatttggttaaagatttctgggccaggcgcagtggctcacgcctgtaatcccagcactttggaaggccgaggcgggtggatcacgaggtcaggagatagagaccatcctggctaaaacggtgaaaccccgtctccactaaaaaaaaaaaaaaatagccgggtgtggtggtgcgcgtctgtagtcccagctactcgggaggctgaggcagaagaatcgcttgaacccagcaggcagaagttgcaatgagctaagatcgtgcaattgcactccaacctgggcaacagagcaagactgtctcaaaaaaaaaaaaaaaatacaggcataaaggccgggtgcggtggctcactcctgtaatccccacacttttggaggccgagaaagttggatctcttgaggtaggagctcgagaccaacctggccaacatggtgaaaaccggtctctactaaaaatacaaaaattagcagggcgtggtggtgcccagctactcgggaggctgaggcaggagaattgcttgaacccaggaggcggaggctgcagtgagctgaaatcatgtcaccgcactccagcctagtagacagagtgggaatcctgtctcaaaaaaaaaaaggaaaaaaggacaggcataatgaattcagagttagattagcccagatgtgaatccctagaattattattagatggaggctggagtcaaatgatctgagtcagatcaccaccattgacttttgcatgtcaaggatgtcatgcatgtaaaatggtgacactaatagtattagccttccagtgttgtgaggattaaatgggaagatggatgtaaaatttttagcacaatgcttggtatgtagttcccatgtttaatttctattattaatatgccttagtttccttaactttaacatgcaaaactctaagagagctgtcatgaagaataagtgagatcttagtaaagcatgtgaaacaatgctttaatggaagccgattataacaacaaaaataagacaagcagaccagataatctatcttttccagaactaatatgctttagttgtattatttttcttacattgtttccttcattttttatcatattgatttttagcaaactaacaatcacactaaaaatttactaggttgggacaaaattatattaaaaaagatatttcacaaaagtacatttagaaagtataacagtattgtcattatacttttaaatacttgaattccaagtcaaaagaaaagttagtatattttagcaggagaaattatattagaacttagaagttttgttgggagtgttcttttagttcacagttttgtaaagaaaagaggaagaaaaacaacgggttacaccctactgcttcagtattgcctttcctctccagctctctatctctaaaaacaatggaatcactcaaacggtcagtgacaatttttaaaaatcaagttactagttgttaccacctactttctattgggtatcaaaaatttaaaaatattctcttatcttcttatgtgaggcataggggtgggtgtgtgtgtttaatcccttacttcctcccaggagtcccatactaaataccacggctttgacaaagtattcctcatataaaaaaaactccttatttaggtcttcttgatgagcacagatataggtggagtggccattattacactacaattcactggtctagataattcctataacatcagttccagtaacctggaatttactggatatatatttgtgtgactgacagagtgcttctgagagtctttgagccagagctaatccaaggatgttctattctagactccacaggaaaatgttctttgtactaaattgtattcacacagcactagggtaaaaagtgttaaccactctgagccatgggtagagtgggaaaccattttcccataaatttatctcacagaattaggcaagttattgattataacactgaggctaagaggtagccaactaactagaagaatgtcttcctcaataggtggtcctcacgaggatttaaacaggtaatatgtacaagcaactcagggcactgcctagaaagtctaagagttttcagctctgaaaagcaataagtcacttccctcagatacttatttatatactaagcatattagggtataagaaaagaccagagctccccccaccaaaaagaaaaaaaaagaaagaagaagaagaagaagaaaataaaacaacttaaaaaatgctggcattggaagtaaaatgaggctcattacagtaaaaccagccccaaggctagtcactggctctgcaattgtacactattttaaaaccatatcaaacaacaaaataaaattgactcagtaagataaatgtcagcactcactttttgatttctcggagcagcattcggataaggatggcctgaagtggttcaaccatcaatttcctccacatatccaatgctagctgccgggaaaaacgaaaatcatcagggctgaattacttagtatatgtttaacatttcctcaaggttttttttaactaaaaatactcatcaaaagaagtatttatactaatacttcaaaattcaaataaaacctgaacaaaaatttaaaaactcaaagaaaacaaatttctaatttgaaatatcagtgaccactctactagccttatcaacattaaggttttattattagttgaaaatcttaagaaataattgattattataaaaccttaatttaggccaggtacagtgggtaacgtctgtaatcccagcactttgggaggccaaggtgggcacatcacgaggtcaggagatcaagaccatcctggctaacatggcaaaaccctgtctctactaaaaatacaaaaatgagcctggtgtggtggcatgcgcctgtaatcccagctactcgggaggctgaggcaggagaattgcttgaacctgggaggtggaggttgcagtgagcccagatcgtgccactgcactccagcctggtgacaacagtgcgagactccgtctcaaaaaaaaaaaaaaaacttaattttttgattgttaaaatgctcaacactataaatgggctatagatacctagaccgtaacagaaacaaaggatttatgttaaatgaaataatgtgatttggctgtagactgatttttttaattatgaaaaattttataccaacataaaaagagcaagtcggttaaaagagtaataaaacattcctgtattcactacccagtttaagaaatacaacttcatcattaccattgtcccagatatcctcctcctttcccctcaggttattacaatccacaattttgtgaaacccatccagtggaaacatacagccatagctcaatcattggcactgctatacagcatcctgttgcataaatatgccatgatttatttttccactctactgctgatgactgctgatgtgtctgtgattcctattttctgctactggaaacaatgctgtgattcctgtatgcatcatttggcccacataagcaacagattctctgatatacatctacaagttgagatcctgtactgaacaatcaagtgctcatgcagctttactaaatcaagccaaatgattttccaatttatacttgcatagcaaagcacaagatttcccattagtccccatccttgacaacaagtggtactgccaggctttagtcaaattttgccagtctgctggacataaaatagtgtctccttggccaggcacagtggctcacgcctgtaatcccagcactttgggaggctgagacgggcggatcacgaggtcaggagattgaaaccatcctggctaacagggtgaaaccccatctctactaaaaatacaaaaaattagcggggcgtggtggcgggtgcctatagtcccagctatgcgggaggctgaggcaggagaacggtgtgaacccgggaggcggagcttgcagtgagccgagatcgcgccactgcactcccgcccaggtgacagagcgagactccgtctcaaaaaagaaaaaaaaccggccaggcgcggtggctcacgcctgtaatcccagcactttgggaggccgaggcgggcggatcacaaggtcaggagatggagaccatcctggctaacatagtgaaatcccgtctctactaaaaatacaaaaaattagccgggcgaggtggcgggcgcctgtagtcccagctactcgggaggctgaggcaggagaatggcgtgaaccggccgggcggagcctgcagtgagccgagatcgtgccactgcactccagcctgggcgacagcaagactccgtctcaaaacaacaacaacaacaacaaaaaatagtgtctccttgtggttttaactctcattttactgaatgaagctgggaattctttaatgtttattgtccattttgggttcttccctgtgaaacgcccattcctaattttgcccgttagtctgttaaagtttgtcttgttcttaataaaagctagagttttttatatattgtggaaattaatcccttgaaagtttcacagtctgtcccagtaaatcaactgctcggtttctttattgtgttttggtaaaaatatattaaagtttaatatactcaaatttaccaatcttctttatcatgggtattttttaagaaatccttctctgccctaaggtaataggcatatgtgtggtcctactctgccttccaagttttcaagctttgcctttcacatttaggcctttaaacttcaaatatattttccccacatagagtataaattattccagtactgaaaaccaattttttgtttgtttgactcttctctttttccaccctaactacatccagataggctgttgctagcctccctattgtttccctagggtaattttattctgatccattggtaattaagcatctgtcttcccacaaggaacactgttcaagttttgcctttctttcttaatagcatgaatgggggttggggaggcaatacatgaaaaactggtattttacacatgtggtggaagggcaaactggtaaaggcccttctgaaaggcaatggggcagagctgcgaaacttcaggatgtgcttcgacagaggctccacttcctgacacccagtctataaaaagttctgctcatgtaccaagagatacacataaatataactccatgagcataagatttttctctattttgttcactgttgtattcaacatatataacacagacgggttcaaaaatacttaatgaatgaataaatgaatagtggtgttcactgcagtgttgtttgtaataacaaaaaattaaaaattggggggcgcggtggctcatacctgtaatcccagcactttgagaagcggaggcaggcggatcacaaggtcaggagatcgagaccatcctggctaacacggtgaaaccccgcctctactaaatatacaaaaaattagccgggtgtggtggcaggcgcctgtagtcccagctacttgggaggctgaggcaggagactagtgtgaacctgggaggcagagcttgcagtgagccaagatcacaccactgcactccagcctgggtgacacagcgagactccgtctcaaaaaaaaaaaagaaaaaaaaaaattaaagggatagtttaaaaaattattctgtatctctacagaatattaagctttcacaaaaaacaaacttatgtaaaaagacagacagtaacaaataacaaaaaaaaaggcaagaaatataggctgtagaactttatgtgtgccgttttatcgcagtttgaaaaataaaatcaaaactgctgtgtgtgtgtgtgtttatgtaaatatttataaatacacaggtaaagttcagaaaagatgcgaactaaattgtttacagtgattttctgggaagagaagtgtgcttgacagtgctggtgataagggaatgatttattcacttacaatgctactaactaaaagcaactactgttaatattttggtatttctcattgatctttttctctatatcatcttttccctataattgtatttgtattcaacatatacctataattttgtgtccaaattttttcataaacaatgtcccctttgttaaagtttctatgaacaattttctgctattaatttatccatttgcctacttttataacaaaatcatatcatatataatacattcttcttccatgctttttattgctgaatgttggatgctgaaattttacactgttcagccattaggcaccctattaacaatgattgcaaagaatacttttaaacattaaactcttttctaatatttattattttccaagtatggatcactaggcttaggacttgggattacttggtcaaaaggtattaagtattttaaactgtactgaaagaaagacactgatcaatttctttcggaaaggattacactaccttaaatgtctcctaatgctgcctcttagcctgtttatttccttcattaacataaatcacaagttaacattaatttcctatttggcatctgcttcccttacatgaacttacaagcttttgtgtgcagggaccttctgtctgttcaccattgtatccccaatgcctggctactcaataaagatgtattaaatgaataaacaagcttgtacaataatacttctttcacaatcagcataattttccatattttaatttgcactgtacctcaagaacttgaatggaccaaactgcccatttaattgtttcactctgaatttaattacttttaaagtaaagttacaataaatttgttgtatccataaatttgtgtttcctctcctctagcctgtcttttaagtacttgtcccctgcactttttaactacagggccgtcaacactttataattgtttctgagttttttcacaatgcagaaccattaactctatcattcatccattataaatttaattatcaaaagagtagttgtcacatctttttcgttcctgaggattcttaggaaatcactatagcattttatttaggatcttttaaatcttgaccattttaagctagccaaatcagtgtccttaaaaaatgatgtgcaatcaaattacctcagtgtataaaaacatacttatgtttgctagtcacttaaagaatgtcctacctctcctatttccataagtggttcattcatatctacaccaccatagccatactgaaggtccgcttctgttaatttattctttttaataaactgggtgttgagatacctggaaaataaatgtaatatcaatggatattaagttaaagtcagtaggaaagcaaatgacttgcaactttagaagaatatttttaagattacatataagccatggaatagcctactaacaaatccaaaagaaatgaattatgtagagattagaaatataataaaaattaaaattatcagcccacctttctctgcaagcccttacaatacccttctagcccaacagctcttatccaagtttcagaatttctataatctcgtttgctacttcccagactcttcttgggaaagtcaagataaagtccactttccaaaaattaaacagagaatggttaaaagataaaagtcaagttagctttctaatttatattctaatcaccaggaagaaatgcaatttttcatttttaaacaaaaaagatcacaatcagtaggtaagaaaatggaacacagtgttacagatagtaagtatgggcaagattgacagatacaagatgactttgtctaccagaggaaaatgaattatactaaaaatgtttaatatatttcaagactaatatatgtgattaactcagaataactgagatgaatacagaaatctaaaataaaataaaacatggagaaaggactcgtaatgttcaactgtgtagtttttaggattccagatttcactataatgcctttaaacagtcaccacctaaaactattcatttgaaaggttctgctagtgtaaatagctactgacaatacaagtattttaggcaacaacccatgaaatctatacatgaatatatacacttttcaaaattcactacaccaaaatgaagggtccactcagcatttacagacaaattaaaaacgaagacaaccaaaacaagacaacaattttgggaaacaattaaacacataattcctggccaggcgtcggggctcacgcctgtaatcccagtgctttgggaggctgaggcgggaggatcacttgaggccagcagtttgagagcagcctgggtaacagcgagactgtctcttaaggaaataataataataactcctagaaaattgactccaaagtggtatacccacaaccatttacacaagctccatctccatattcactagtcaaggctctagactccatggcttacaaccttgatgtaccatttgatattttagtgtcctctgaccataagttacaagatcatactcttttttttcccctttaaaatgccatttattccttcctctctatcctcactgtaactctcaaaatttcatgctgagtttccaaccatgccttccagctaaggaaagaggaataagattgagagacaaaagtaaaaggtaaagaggggatggcctctccacctaagtgccccatcccagatattctgagggtagtcagtcccctttcatccgagtctcagcacagacacacctttcaggtgtgccctgaaccccagaggagttagccttcacttcccagccctaagcaagtaactatttaacgcacaactgttttactttcttcacagtaattgctactatatgaaataatcctatgcttttattggtttctttttttgtgcattcatcttctctctagaatgtacagtatacaaagcaagaacctcctcttgtagacagcatccacagtagtggcaggcaaaagtcaagtcctcaaaaaataattactgaataaataaatggataacattccagacagcaaggatagcaaaagctaacagtagaacacaaacctggaaaagcagcctgcagccagatcataaaagccatgaataccaggaaataaaagtaatcactaacatttattgagatcacctgtcagacacagccctaagcattttatgtggctgaatactataagacagatgtatgtggtactcctatgatcattttatacataagaaagctgcagcctagagaggttaaagagcttgccaaaggtcaatcggctcctaagtggcagggctggcacagaaactcaggagaggtcttccactcccattcaacatcggctgagggtatatcgtgtgccaggtcaacatgaggcactggaaacacaaagatgaaaagcaaaaatatggtctctgcccacacagagctcactctgtggtacaatatacaaacaaatataagatttcgtcaggagcggtgctccctcagtagagggtacttaattgtcatattaccatttacatatgccttccaatacggaatctgctccaaaccagttttcttttctggtcactggcaccaagaccattccagtaacctcgcctaaaacatcagaatcacttatctcatccttccattttgcctgctttaatcagtcagtcttcctgtcttcctaaagtatgcatcacttcctctcactacttcctttgacttccaatctacttgctgaccctctgccccgattatgtggaacacttttatgactgggctctacttcagtttctggcatctttaattcatctaaaaattctgctgtcaggatgttactttcctattcagaattctacaggagcttcctttacctacataataagtgtaaactgcctagcatagaagcagatgctaaatctgcagatcaggcctgcattcactaatccattccaaagatctagatgtatattcttgagccaggtattgatttagtgcagctttacatgctttgtatctgcaaagacaaaccagtattatcttttcctcacagaataaaatttaaactaacttacattaactatgtctttcttattgcagatttttactcttggtaaatttaagcttgaaatacaatgttttaaaataaagtcatggccaggcacggtggctcatgtctgtaatcctggcactttgggaggctgaggcaggcagatcacctgaggtcaggagaccagtctggccaacatggtgaaaccccgtctctactaaaaaaatacaaaaattagccaggcatggtggtggttgcctgtaatcccagctactcaggaggctgaggcaggagaatcacttgaacccaggaggcggaggttgcagtgagccgagatcgtgccactgcactccagcctgggcgacggagcaagactccgtctgaaaaaaaaaaaaaagaaaaaaagaaaataaagtcacaatttaaaatataaacagtgccatttttcattttaatatggacaccattcttattttataagtcactgtagtattttacaatcaaatttattaaccacatatttgcttcttaataaagacatgggctggacgcagtggctcacgcctgtaatcccagcactttgggaggctgaggcaggtggatcactcgaggtcaggagttcgagaccatcctggccaacatggtgaaaccccatctctactaaaaaaaaatacaaaaattagccaggtgtggtggcgcgtgccagtaatcccagctactcaggaggctgaggaaggagaatcacttgaatctgggaggcggatgctgcagtgagccaagattgtgccactgcactccagccggggaaacagcgagactcggtcccaaaaattagtaataaaatttttaaaaaaagaacatttatgattcatgggagaaggtctaaatatcattatgaacaggtgattagaagatgctgattctataaagggaaataaaatctcaggattcccaaaactcctatgccaaaacaggaatttaaccttggaggctgagtcatgctaaatggccatcctcttcctggacgaataactcttacaagtttgtgtcgaaacattatatattagccagacccccgtggtaaggcaaaaagcctcagccatttcctgatgactaacccgcctcaaaaagtcactcattcgtaaattctttgctagcctcgaaaccattaaaatgtaaatcctcccataacacaaggacaggtccattgtaactccagatctgtagtctaaagtctagttcctaaaacctaaggtctgctagcatccacctgataagtgtcgattcttagctgataattcccaggcacagagcaaaggcaagatgagagtaatcattccttccctgagatgtctgcacaactgttttcttcttctatttccttttgcttcaaaggtttatcttatataaaatgtagatttactgggcattaattagtctcacaagtaggtaaccatttgcctcactgccaccacccctcatgttttaaggaaaatgtataaacactaaccctcctaagaacctctttggacaaaacagccacagatgcatctgtgccttgcgtttttcctgggagcatccttaagctagctcaataaaccttgattgagacagctgcctcagtcactcaattcagttaacacttccaaccctcatggatgagttagggggtcaagacttcaggggaggaagtgactggaggtgtggtggaaacatcaagagaactcagaagtggatcctgaagatgggactgaattgctgcaatctcatgatataacttgaatggataaggagttgcttcttatggatgagaaagtggtttcttgagacagaatctactcctaataagacggtatgaacattgttgaaatgacaacaaaggattcaaatattacataagcctagctgataaggtggtggcagggtttgagaggactgactccaatttcgtaagaatttctactgcaggtaaaatgctatccaacagcattgcaccctagagagaaatcttttgtgaagaaagagtcaactgatgcagctaacttcattgttgtcttattttaagacattgccacagcctccccaaccttcagcaaccaccaccatgatcagtcagcagccatcaacaccgaggtaagaagactggcaaaaggattacaacttgctgaaggctcaaatgatcaacagcattttttttagcaataaagtaattttaaattaagttgtgcacatttttttagacaatgctactgcacacttaacagactacagtatagcataaacataacttatatgcactgggaaaccaaacaacttgtgtgacttgtcttactgcaatattccctttacatgtggtggtctggaactgaacccacatcatctccaaagtatgcctgtacaagaagattgagaatagaatctacttaagtgaaataccatgtttctggaacaagattatggtagaatgaagtggttaaatggatgggctttggattcagactgatctgggtttaaatcctgcctttgtgattcattagctgagtgaccttcaacaaaatcatgctctcagcattgctttcttcctctgtaaaaaacagagatactaactaactcatatcattttacacacacatacacaaacacatattaaataggctgcaacatttactaaaagttcacaaatagcaccaatttaatagtactaatttagccaggcacagtggctcatgcctgtaatcccagcactttgggagactgaggagggaggactgcttaagctcaggagttcaagaccatcctgggcaacatagtgagacagcatctctacaaaaaatgaacaacattagccaggcatggcggtgcacacctgttgttccagcaactggggagaagggtgttcgaggtgggaggattgctagggcccaggaggctgaggctgcagtgagctgagatcatgcaactacactgcagcctaggtgagatcctgcctcaaaaaataaaaaataaaaaaaaggacaaaataaaagaaagaaaaatagaaaaagaaagagaagcaatccaggcagatggaacagcaccaggaaaggcaggaagatgggagagaccatgggccattaggaaactacaagtaattcaatatgcctagaccatggggaatgcagaacttcaaggggaaaataacccagtaatttatctaacatcgtttgcatcaaacataaaatactgaatgctagagtcaaataagaacatatcgaggggacatgagctgagattttcccactaagtttcatgcaagttgaattttcacattgatctctgttgagattaaacatgtgctacaggttgtaaacaatcagaagaaacagagccatgcaatcgagtacagttttacttttcacagaacgttccacacactccctggctcctaaatacccaccttaccctgactatagacctttccccacagcagagaaaagtccatgtcagagagaatgctttagttttgcatatgtgaatgagaaataggcaataaaaaaattatcctgtcaactactgaatgcaggcaacgctgcttagcttgtctagattttaaaggcacactcacctatataagcagtccatatagtctgcacccttgctgtattcttcccagtacctatgatacataacaagtacttgttcttctgactccaaaactctctatataaagaggaaaaatatttttacttgaaaagcaataatcattttcactgtcaacaataaaatgtatcaaaattaatgttctaaaataatttacataattctagctgtacaaattacatttacacaacacatattaactacacgtattaaaaatgaaacaactgggaaagatgtgagtcttcaaaatgaaagtgaagcatccataatagagaataaactgagccgagcgcagtggctcacgcctgtaattccagcactttgggaggccaaggcgggtggatcacctgaggtcaggagttcaagaccagcctgaccaacatggtgaaaccccgtctctactaaataaaaaaaaattagccagccgtggtggcacatgcctgtaagttccagctacttgggaagttgaggcaggagaatcacttgaacccgatcgcaccgagaccccaccactgcactccaggctgggtgacagagcaagactctgtctcccaaaaaaaaaaaaaaaaatcacacttataatgtaacctaaaatataaaattgcaaaaaaattattaatgtcttacatagttatcacttatggtgttaaccaaagctcactagcttacaatagcagaactttaacatactaaacactttaagaccactttaacacacttgctatcaaaagcacttttataagcagataaatgatcacattagaacactaaaatgcacatgccatatactatcaaaagtagagcattttccaatattttcagggaaacagcacacaatcaattgtgccttacttatgagggttttttttttttttttttggtacaggtagtgtctcactatattgcccaggctgctcttgaactcctggcctcatatgatcctcctgcctcagcctcccaaagtacagagattacaggtgtaagccaccgcaccaggccagttcttaccatttaaaaaagtatctactcctgaccacgtgcagggttagacagtttaaataaaactgtgttgttttattcccattttatagataaagtcaaaactcagtccataaggtagttgttaagtgagttgcccgtggttacaacagctaataaaaagcagagtgaagattcttacgcaggcactaaattatctcatccagttcctgattagatcagtagtctaaattaagttggaaatgctgtctatagcaaaatactgcaaaattcactgtttatacacagatcatgtctgtgatgctgcccctctatgtacagcatactaataaaaaaactggtcacagagacagcttctatcaccatttaccatttctttttaattttagattttgggaagacttcatatagcacatgaaaggcagctaaaaagctgaaaataataaagacagagatttaccaagagataggaataaaaaacgagggaaaatttggctgtataaacactatccagaggacgtaggagcacattttaaaactcaacaaaccctgagctgaccctctccttcatttactaattacgagatgctgagcaagtaaactgatttccctaacacagtgcttgactcaaagatcttaatatgtatatatttttaaaatgctgattaagaagcaaaaacaagggaggccaaggccggaggatcactggagcccaggagtttgagaccagcctaggcaatatagtgagacccccatctctaccaaaaaaaaaaaaaaaaaattgccaggtgtggtggtgtgtgtctgtattcctagctactcgggaggctgaggtgggaggatcacgtaagccagggaagtcggggctgcagtgagccatgatcgcgccactgcaccctagcctgggcaacagagcaagaccctgtatttaaaaaaagcagcagcagcagcaaaacaagctgaccttgataaaagttctacactggaaaacagtaaactagtaaagtatacaactatcaacatatttatatcacgtatgtatcattgcttaccttatgcaaatgccgaacatgattttccaaaaaaatcttagtttctgtataaagtctttctccaaggggttcaggataggccacacataaagcatagatatctctagttaaattattaaggttttcatatttattggagacaattttaaaacataatgagatttaccttgtttggcattaaaaaatgaaaaaacatttctttttgtggtttagcttataatatacataatactgttgtatatatgacaagatagaatacataaccatgcttactttatctaagattcattcacttattcattccacaagtatttattgagaattatttgaagacactgtaaggaaaatggttcttatcagagaggttaaaatccagagggagtttctggaaaatcaaattacccagaatcctacaaaataaggtttatattagaatggatattagtatcaatagtatcaatgatattagtattcatagtatcaatgaagggctatggaatatgacaagaggcagacatgtctaagcaattctgagaaactaaacaaaaattattcatttgacacagcctcctacatcatagcagtcaggatactctaccgttattctatcagaagaaatataccatgaataggaatatcaattaagtttctgaacatcaactaagtaccttgctaagtctcaccggaggtagataacagaaggagtggaaagaagtaagacctgagactttacctttcactagccagtgatcttaaccaagtttcctagcctctctcgggtggcatttccttttttttttttttttttaatatcctttgctttattggatcttctcaacatctccaataattagaaacattataaaccaagaagaacaaaagataagacttaaggcaaagcccatttataactttggggccagacacggtattagattatgattctgggaactaggtgtttcatatgctgcctccaactactgtgacaaggcattttggaggtaacagctcatttgtccacaggaacaatgacaccagagcaacacagaggtcaggacctcctggtggttatactccagactgttccatgataaagctatgccatcttatcagtacgatgaccaccaccaagtgtctccaaggtaaagataatgaatctttccctgacatctccacaggtcctgtaagacccaaataaattcatatatgttaaagtactttataaactgtccatcattaaccaaatatagaagataaaggacctatgagcaacctgagaccagcctaactaaagatgcagatacaaactggaaataaggctgatgattcaggatgaagtcaggtattaaagtttaatagaaagattaggaaatactatgaaataaaaatgttaacttaaaaataaggatgcaaattctttctcctctatgtccccccgacacttcatatacattcttctacaaaatttatttttatacagtaaaatttatttatacttttcccaaccacattagcctattcttcatcaactccatactcccagctcccaggcatggttcctagcacttgatgatttattaaatcctgctgaaggaaaggagatgcaaaatcaatctcacatgctccatttacctagcatccttactccagaaagcgcaagcagccctctccacatttatttacttacttataaattttttatcagttctatttatatatttttaagctttatttatttatatttttacttgaaaaaatttttttgtagaaacagggtctcaccatgttgtctaggctggtctcaaactcttgggctcaggcaatccttctgcctcggcctcccaaagtgctaggattacaggtatgagccaccgctcaatatatccactgcatgtaaatgtaaacaaaatctactggaaggatttgtgccaaatctccagcttaaggagaaaggagctacacaagagaggtggtacagggagactctcccatttcattccatatacagtacttctgcactgttggactccttcagaatatacatatttttttaatgcagtgaatccaccttaataaaattttaaagtttatgttttaactcaccatagttttgggtctcaaatcactgtataattttaaccaattaactatgttctttttctctaacctattcaaatatccaaccaaccaggaaacgtttagcccttatgaagaacacctacgaaaatgagattttcaacctccaacactcagttatgacttgattatagacaagacactttaaaagacaaaaaatgttggctgggcatgatggctgatgcctgtaatcccagcactttgggaagccaaggcgggcagatcaccaggtcaagagatcgaggccagccatgatgactcacgcctgtaatcccagcactttaggaggccaaggtgggcagatcatgaggtcaggagatcgagaccatcctggctaacatggtgaaaccccatctctactaaaacacaaaaaaattagccggcgtggtgacaggtgcctgtagtcccagccactcaagaggctgaggcaggagaatggcgtgaacccgagagatggaggttgcagtgagccaagatcgcaccactgcactccagcctgggctacagagcgagactccatctcaaaaataaataaataaataaaaatttaaaaaaagagattgagaccatcctggccaacatgttgaaaccctatctctactaaaaatacaaaattagccaggtgtggtggcacatgcctgtaatgccagctactcgggaggctgaggcaggagaattgcttaaactcaggaggcggaggttgcagtgagccgagatcacaccactgcattccagcctggcaacagagcgagacaccatctcaaaaaagaaaaaaaacacaaaataactaggtcagatttcaacttaaacattctttcactagacttatcttttcctaagtcattttttagggagccagaatacaaaaactcctctatttatgaactttccagtttaaaaatgtctcagtcagaaactaagctgttccagaatgaaagctcatagctgcaaccaaaagacagtcctaaccagcagcaaagttacttattttatttcatgttctctattaaaaggtgtttcctacgcttggcttaattttgagttttaacagtatgaactctattatgccatgggtcaaaaacaatgagagttttgcaatgggaataaaaggaaaggttacctaaaaaaatgaaaatgtaagacaaccaaaaaaggatttgacaattaaaaaaaatatataataaaattaacagtaaaaaagaatttgctgactttttttttttttgagacggagtttcgctcttttgcccaggcagtgcggtggcgtgatctcggctcactgcaaacttcaccctccgggttcaagcaattatcctgcctacctcctgagtagctgggattacagttgagcgccaccatgcctggctaatttttttgtatttttagtaaagatggggtttaaccatgttggccaggctggtctcaaactcctgacctcaggtgatccacccgcctcaacctcccaagtgctgggattacaggcgtgagccactgcgccccgccagatttgctggcatttctaatgagaaagaatacagatgcagtatctacgaaatcatgcattagcaaacaaggataaaaaatgactaattaaatcgaaaattttcaagtgcacagctagtgaatcaatgagaacaaatatcaattagcctgatataatttagaatagggtcaggcagttgctgatgcaccaaatacacctgactatagataaaatcttttcccatctgtaaaatctaagaaagaatgatgggctactacacataatctccatggttactaagaccttcttcttctaacacttgtgaaaagtgtcaaggatacaggtacttgcctcaatatttttcaatgacatcaaaactggtctatgtttgaaagagatgcctgatagaatataaactagaaatgataggtgtggtagcgcatgcctgtaatcccagatactagggaggctgaggcaggagaattgcctcccggaggttggagtgagccaagattgcactattgcactccagcctgggcaacaagagcaaaactccatctcaaaaaaaaaaaaaaaaaaagaaatgaagacaacagtatgcctgggtttaaatggtgggaggatgaactcatattcctacctggaagaaatacgttgagggaaggcaatattaagtctcccctaacaatcattttggacttactataacctttagatgccacttctcctccagtaggaaaatgtctacattatgctgctggagtctggaatggaaatctgtcctaacagctactaaaagagagaaaaccttgagtaaaagtaaactagaacagggccaggtacagtctttctatttatacaaagtccaaaaatcaaagaattcaccattggccggtcacagtggctcatacctataatctcagaactttaggaggctgaggtggggggaatcacttaagatcagaagttcaagactagcctggccaacatggtgaaaccccatctctaccaaaaatacaaaaattagccaggtcatgcacatgtaatcccagctacacgggaggatgaggcatgagaatcacttaaacccaggagggggaggctgcagtgagccaagatcacaccactgcactccaacctgggcaacagagtgagaccctgccacaaaaaaaaaaaaaaattcaccattattgtttattctatttatataaagtccaagaaaattcaccatttaagaaccacaaaagggccggacgtggtggctcatacctgtaatcccagcactttgggaggctgaggcaggcggatcacgaggtcaggagatcgagaccatcctggttaacacggtgaaaccctgtctctactaaaaaaatacaaaaaaattagccgggcattgtggtgggcgcctgtagtcccagctactcgggaggctgaggcaggagaatggcatgaacccgggaggcggagcttgcagtgagccgagatcgagccactgcactctagcctgggcgacagagcgagactccgtctcaaaaaaaaaaaaaaaaacgaaccacaaaaggctgggtgcaatggctcacacctgtaatctcagcacttcaggagtgccaaggcacatggaacacatgagcccaggggttcgagaccagcttggccaacatggcaaaaccccatttctaccaaaaatacaaaaattagccaggcatggtggcgggcacttttaatcccagacactcgggaggctgaggtatgagaatcacttgaacctgggaggtggaggctgcaatgagctgagatcactgcactatgcctaacaaaaaaaagaactacaacgcactatgtctaataaaaaaaaagaaccacaaaaacaacaggcacaaaaatcaagatagtagttagctcctagagaaacgggtgggattgtgaacttagagggtcacgtgtttcgggtgggggttatagtgaatgtggacaatgttctattgttcaatgttctattgataatgtaattgcttgcattataattatttgtgcaaaggtgtattttatgaacttgtccatatttgtgttattcacactccccataaatgcatgctaaaagttcaaataataacacatatttgaaacaatgtggagggacctgttttttccttttcaaagtatttacattgtatggcccttaaaatttccacttaagatattaagggtcagaagtgaactttatattcttgggcaaaataacagggaaaatgatggaattttaccttataacaattagtagcatagtcttttatttatttatttttgaaacggagccttgctcttattgcccaggctgtagtgcaatggcccgatcttggctcactgcaacctctgcctcccagggtttaagcaattctcctgcctcagcctcccaagtagctgagattccaggcacccacaaccacgcccagctaatttttgtatttttagtagagacgaggtttcgccatgttggtcaggctggtctcgaactcctgacctcataatccgcctgcctcagcctatcaaactgcttgaattgtaggcgtgagacaacgtgcccggcctgtactctttaatcattatttttgcagactttttattttgggggtgagagaaaattcatgatcaggtgaaaaataactggcccagccaccagctgggcaaggtggctcacacctgtaatcctagcactttgggaggccaaggtgggagaagtgattgagcccaggagctcgagatcagcctgggcaacatagtgagaactcacctctacaaaaaaattttaaaaatcagccaggtgtggtagcacatgcctgtagtcccagctactcaggaggctgagataggaggatctcttgagcctaggaggttgaggctgcagtgagctatagtcacaccactgtactccagcctgggtgacaaagtgagaccctgtctctaaaaagtaaaaattaaaaaaaaaaaaaggataactaaaccatattagatggaccaaacaaataacatcagagaaataacagtgactgaaggggtcactttccagggaagtaatctatttcaaaaccacttaaaaaccaagaaattcactgtcgattctgtacaatgatgaagaacacattttaattattttttctttacctcctgttcattttccctcttcttgctcttcttgtagtcatctataaccaactcctcttccctctctgctccttgttttagctaaaatatccttaaaagcacctatgaacttgcctagcccaatctcactaacacacaagtagcaacactttttcaacttttattaagattcttgccccaaatcaatccataatgttccacagaaaaattagctatctaattcaaaggcagaatctatattggttatcctctagatatactggaaagcataggaaattggatctttaagatactatattcaagtctgtggtccatcaattactacccgtatgaccctgggcaaataagtcccttacctctgagatcagtttccttatccgttacagtcaagtaattatttttgccccactgatctgatagacttgtttgaggtatcaaacaacataaaaaatataaaagatcttttcaaactttgaagccttccaaaatgtcatcacccttttacatatcttcagtgcccagaacatagttggcttaacaaacttttcttactgcctactgcagttgtaatgaattaaatggttttctgttggtctaaagaactttactcttcttgcatccacattcagcttaatattaacaactgaattaggcattcagaacaagctgaactactatcttatgaaatcagagcttttctaaagaatgtacgccccatataatgagggcagcccttctgtagccccagaagattgctagagagggcagcactagttaggtctagcagatcactgtcatggaggaacacaggaaactaggcttcagggcatcctagagaaatcaccaatctgcattgttacataaaactctcaattcacacatgtaggcaatctaatgaaaaacacacttccaccccagtcactgaacttgctgttcactctccagcaagcacactcttccccccaaaatcacatggcttgctccctcgctgcattccagtctctgctctaatgtcaccatcctcagggaggccttccttggccacccattctaaaagagcagcacccacacaggtgctccaagcctcccccacgtccttatcctgctttcatttatcacgacctcttcttgaaagcaatgacattagatttttttttttacctgtttagtgtctatttctatttttataatagaaaggaatttttttttgttcaccaactgtattcccaaagcctaaagtagtccttgacagatactaagtactcaacaaatacttgttgaatgaaaggttatcaaatactgattgccataaaagaggtgatgaacttggaaatgtagatgataatatattagaaaatagttacatgggaaagttcttccataacattgaacatgttctcagttttcaacaaatttatcaattttagaacattgatcaagctgccattaaaaggatacgagaaacggtcattccatgttgctctttcgacgtattccaacatgaccacggcttttattgtcgtcaaaagtttgttccatgtttcatcaaaatctactactcttggtttcaaagacattgtgcaagtgtagtgttgaaatctgtcaattaaaaaacaataacaatgttagcaataattccatgagcttagtttttttgttgttgttttttgtttgtttgctttgagacggagtctcgctctgtcgcccaggctggagtgcaatggcgtgatcttggctcactgcaagctccgcctcccaggttcacgccattctcctgcctcagtctcccaagtagctgggactacaggcacccgccaccatgcccagctaattttttgtatttttttttagtagagacggggtttcactgtgttagccaggatggtcttgatctcctgacctcgtgatccgcccaccttggcctcccaaagtgctgggattacaggcatgaaccatcacacccggccagttatttgtttttaaagcactacataattaaatagcatgatatatgcaaggagtgagaaaagaacccggcacacaacaaaatgttagctaccatcttttcatgactatccagacaagaaatttcacagactatttacattcattacaagctctaggaaatggaaagcttctagtacaaattatttatgatcaagggtatagtttcaaagatttatagtcctcatttaatattgcgagggaaagaaacggggacccacttaaccaaaaggccaacttccatcatgggaaataatgcaggacattcaaccgaaaggttttggccccaaatccttgtggtttgcactcctgaaagtggggaatgaggcagcatgcaagggaatatgagaagacacaagaaaatgaaaggctttaccttcctggagcatcagtataagattagggaagaaatttacatttatattaaaccaaacagggatgaattatggagtagaatataaaattcacatgaccttttaagattaaaaaaaaaagattccacagaaatgtcaggtttgcagtggagagcttaaggctccttcccagattcttggggtatctacctcccagttctaatgaaaagcatggctctagcatggaatccctggctccagtgaacttaatgggcttttttttttttttgagacagagtctcactctgttgcccaggctggagtgcagtggcgcaatctcggctcactgcaaccttcacctcccaggttcaggtgattctcctgcctgaacctcccgagtagctgggactacaggcgcccgccaccatgcccggctcattttttgtatttttagtagagacggggtttcaccatgttagccaggatggccttcatctcctgacctcgtgatccgcccacctcggcctcccaaagtgcagggattacaggcgtgagccactgcacctggcccagaatgggcttttaagggagttcaaagactcctgcctcagacaaactgcatttaggaattagctggtttctggaacaaaagggtcccaaattaaaagagaaactttctaagctaaatgtaattgctcaaaggaacatttttctggcaaatgttttaacagcctccctcatgtctccccttattagcaggactgtaagacaccaacctagtctgtagccaaggccaaaaaaggatgaaacatcttttctcgtctcccatcataggggaaaggggaggcagagaatggggaggagggaatgatgcataaagagaatgggcaaagggagcgggtaggatggcggccgcaccaccagccacggactgggagaggcccttctgtgtttccagatgagaagagagctcaaggaatcccaggaatagactccatggaaaagaatgaaaaaaatcagagaaaagccaaatatccaaaagagggtatgccttgttgaaccacatcctctttcctcaacattccaaagcctccacctcctggccttcaactcattcccgaactatctataacggattagcagcgattttactctgcaaaattgaggggaaggtgagagtggaggaggtgggagaacctactgagtttcctaagctctaaataagggaattaaccatgcctccttctcttccttgtttactacatcctatcatcaactgtgcacatgagtatttcctgaatccatccatacttgtatagccctacaaatgatccggaatcaggccctcagcagaaatagtaacagttaatatttacattgtgtatactgcaagccaagcactagtctaagtaccctgtacaaactcgtttaatcctcccaacattctgacaggtaggtccactgttgtccccattttcttttcttttctttttttttttctttttctttttctttttttttttgagatggagtctcgctgttgtcagcctgggctggggtgcaatggcgcaatctcggctcactgcaacctctgcttcctgggttgaagtgattctccagcctcagcctcccaagtagctgagattacaggcgtctgccaccacacccggctaattttttatttttagtagagacagggtttttcaccatgttggccaggctggtctcaaactcctgacctcaagtgatccacccaccttggcctcccaaagtgctagggttacaggcatgggccactgcgcctgacctgttctccccattttctgaataagaaaactgagtcacaagtgattcagaaacttgcttaaggtcacaaagctatgtaatggtggcatcaggattcagacccgtgctgcggccggtgctctaggctgctgtgtgcaaccatgctacctcactaacatgcttggtgaatacttactccttgccaggcaccattccaagctctgaggatacagtggacaaaacaaagttcttgacttcaagatcagaatctcagatcttgcccttatcaaagacacaaaaataacctacctaagccaaaaagttgaccatgttactctgtacataaagtacaaagtttgttgtttccttctacagacagcattcagtttgggctcaactgcaacatggcacccaagcttcctctcctcctggtactccctactgtgacatcataatctaggaacttctctctgcttagagatcactgaacacatcagcctgattcatacacttgcctttacccttactattttctctacctaaagtgcttatcttttccttagctgccccctccacccattccacctaactcccactgatagtctaaccttggtccactagctttttttttgtttgttcctgagacagagtctccctctgtcacccaggctcgagtgcactgcaacctccacctcccacgttcaagtgattcacctgccacagcctctcaaggagctgggggattacaggcgtgagccatcgcaccctaatttttgtattgttaatagagacagggtttcaccatgttggccaggctggtctcgaactcctgaggctcaagtgatccgcccgccttggcctcccaaagtgctgggattataggtgtgagccattgtgcccggccttcatctgcttttaagaaactttcttggaccatttaagctaggtaaggtgtcctatcataggtattacctgagaactccacactttcctctattagagtacttcatcgctctgaactgtaattacctgagtgtttctgagagtggggacaattctgtaactgcgtaccaaaaagctagcgatgctcccctcacattcgctttctcctcttataaaatggaatcatattatacacactgcttgtaaattagtttaacagttgcacagactttttttgctttatggaatcagactgacactgacttctctgttgagactgatagatttctggtaccataggaaaatacagttacaatccatgcttggatggatagcaaatctggaagccaacgtgcaagaagcaccagcctcgtgaaacacaccaaaaactgacaaaccaatagcaggaaggtatgctgagacagtctgtcaagattctctgcttgcccagcagaaagctcatataactaggaaaattaagtttcttaaaaatgtttaataataacattcagggaaagtttacacaaggatgtgaaagagacagggcaaagaagaaaaaggaccacagtcacactatttctaccccccaagctgtcaaacaactcataaatctatcagtcttgttcttcattcctgtgccttaacgagattcccacgcgcactcagattgtgtcccatcaagttaactgcaaaaatccaaatctcctgaaatcaccacagtcccttttagtttccttgtgagttccactcttgcaacaatggggttttagacacacaggtccagtggctagggccacttatgggccctaaaacacacacacacacacacacacacacacacacacacacacacacacacgcacgctccacatttttaaaaattgcaaaataaaaatttatatttaattacctgtttccagaaaacattatgtcaacattaatacaatatttgcaacatttttattacatttgaaaacacttgtagatttgatttcctcacagcataatttctaaatatgcatgattgtcaataataattacaaaagtgaattataaaacgcagctaccatatgacccagcaattccactccgaagtataaagagaaataaaactcccaagagaaatacaacatattcacataaaaactggtacacaaatgttcactgtagtattattcataaaggcccttgaaatagctcaagtgtctatcaactgataaatggttaaaatgcaatatagccatacaataaattattatttggcaatacgaggaaatgaagtactgatacacactatcacatggatgaccctcaaaaacattctactaagtgaatgaagagggccacaaaatagccacataacgtatgaatctatttatatagattatcaagaataggcaaatctagagacagaaagtatgtgagtggttgactagggaacttggggggaaaatgggaaatgactgccaacagggtgaggaaaatgctctaaagttgattgtcatgatagttgcacaactctgggaatatactaaaaaccattaaattgtatatttcaaataggtaaactgaatggtatgtgacgtatatctcaataaagctgctatacatttaacaatgaattataaaatcctgccaaaaattttagagcaatttaacggggatgaggtggaagtaagtatcaatacatccatatggtcatttagcataaaattctgaaatctcaatctctctcccaccactcccgtgtacgacctcattgccacctcccattgaatgaggcaataaatgttatatgttcctgggtgtattttatacatatatgtgatttgttactcccttttacataatataaacatggtatttttttcatctgttttacataaatggtatactattcagattgttatatatctgcttttttctcttaaaagtatatttgtggccaggcacggtggctcacgcctgtaagcccaacacttcgggaggccaaggtgggtggatcacctgaggtcaggagttcgagatcagctggctgacatggtgaaaccccatctctactaaaaatacaaaaaaaattagccaggtgtggttgtgggcacctgtagtcccagctactccggaggctgaggcaggagaatggcgtgaacccaggaggcggagcttgcaatgagccgagataaaactcccaagagaaatacaacatattcacataaaaactggtacacaaatgttcactgtagtattattcataaaggcccttgaaatagctcaagtgtctatcaactgataaatggttaaaatgcaatatatccatacaataaattattatttggcaatacgaggaaatgaagtactgatacacactatcacatggatgaccctcaaaaacattctactaagtgaatgaagagggccacaaaatagccactgcactccagtctgggcaacagagcaagactccgtctcaaaaaaaaaaacaaaaaacaaaaacaaacaaacaaacaaaaaaaacaaacaaaaattagccgggtgtggtggtggctgcctataatcccagctactcaagaggctgaggaggagaatcgcttgaacctgagaggtggaggttgtggtgagccaagatcatgccactgcactccactctggacaacagagcaagactccgtctcaaaaaataataataataaaataaaaagaaataaaaatgaggccagatgtggtggctcacacctgtaatcccagcactttgggaggccgaggcaggcgcattacctgaggtcacgagttcaagaccagcctgaccaacatggagaaacccggtctctactaaaaatacaaaattagccgggcacggtggcacatgcctataatcccagctactcaggaggctgaggcaggagaatcgcttgaacccaggaggcgggggttgcggtgagtcgagatcgtgccattgcattccagcctgggcaacaagagtgaaactccgtctcaaaaaaaaaaaaagaaaagaaataaaaataatattaaaaatatatatttacagatgtaatgatatgctgtctgaaatctgcttcacaattaaacagcttgctcatgagttgataactgttaaggatgaataaaagggacatggggatttattacaatattctttttttgtatgtgtttacaattttccataataaaggaatttaaaaatcctactcctcataaacattaatattttcataaatttaggggagaaagcacatcatctctaactgaaagccgttactaaccttcccttctgagaatcttaactttcctgtgagttttaggtttccaaagttgtaggagagctcacaaaacacatggtactgtccctaaatgtgatgtgttaacatagcctgacaaaatgtccacccctaaaaaacttaaattactaatagcagaaataaaaaatatatatgtttgttaagatcaggtgaatttttttttttttttttgagatggagtttctgtcttgttgcccaggctggagtgcaatggcatgatctcggctcaccacaaccttcacatcccaggtgtgagcaattctcctgcctcagcctcccaagtagctggaattacaggcttgcgccaccacaccggtgtaattttgtatttttttttttagtagagacggggtttctccatgttggtcaggctggtctcaaactcccaacctcaggtgatccccctgcctcaacctcccaaagtgctgggattacaggcgtgagctactgcacccagcccgacatttttcatataaagagatttgttcctgtgaactcacttgctggagcaaaaaaacaatttagataatttcagcaggtaaaagttacagtatctcaaaagatgcattttggtgttttgtattttacttaccttctaaaagtataattatcaataatgtaaatggctaaccacttactattttgattctctttatagtgaacaaaactcctgaatgacgatttatttcagtactgatcagcagcaccaataaaaatttggcatccaaaaattatcagtaagatacaatagagtggtctaagttgacttcagatagttaagacaccataattagttttttaaatgccactcaataggcttagagcagatttccttccaaatgcataaaatgagaaaatactgaagacccaataaagagccttacagcagtcccctgccttatccaaggggatacgtttcaagatccccaggaatgcccgaaactatgttttttcatatacatacatacctatgataaagtttattatataaatcaagcacagtaagagattaacaaaaactagcagtaagatataacaattataacaatatgctataataaaagttacatgaccatggtctctcagaatatctcactgtgctgtactcgcccttcttgtgaaggtgtgagacaatacaatgcctatgtaatgagatgaagtgaggtgagtgacacatgcatcggaaggtcggcattgggctacttactactgaccttctgtattcctgaatatgtgttacagtccctgacttagagtaaatggtttggtgtcattcgtctctggggatcccttgctgagtcttcaaataggctcaatgctttctggcacagtatgttgccatcaagtggaacttgtctctgctcatgtcttccacccaccagtgtaatgccttttccaaattaactaagcacttattacacgatataactatcacttttacagattgagatttgacagcaaaactagtaagaatttctttcttcacaatttcttttctttcataattgtgaagaaaaagaaattcttattagacctgcttacagtaggtcttagcaatctcagtctattatttttttctttcctcattgagaactttcaacttttcgtgtaaaggaagcactctatggcagaagcctctctggtgtatccatattgctaggatcactactcctgtactttgggggcccttactaagtaaaatcagggtgacttgaacacaaatactgcaaaactgcaacagtctatctgataatcaagacagctactaagtgactaatggcaggaggcatccacagcgtagagatgctggacaaagggatgattcacgtctgagcaggacagtgcaagatttcatcacactactgaggacagtacagaatttaattatgagttatttctgaaattttccatttaatatttgcagaccccattgaccgtgggtaactaaaatgcagaaaacaaaactgtgaataagggaggcagggaagtggaataccatattaacttggcattattttccatttccataggtgggcccaaagctgccaatggtgcacaatgaccaaatatgttgccatcatttaatattaaaataagctccaagaatgcatctaaacattttcatcttgctgtatcaaatgagcaagccactggatgtaactaagaatgccctttcttatttggaggttaagggtgcaatgttttttgttgcactaaggtttgacccacagagctctaagtactccataaacaacatttccatcatgactttctggctttagaattcctatttttatttatttatttatttatttatttatttatttatttatttatttttgagacagggtcttgttctgtcacccagtgcagtggtgtgatcctggttcactgcagccttgacctcctgggctcaagtgatcctcccgcctcagcctcctgagcagctgggactacaggcacacaccactgcactgagctacttttttgtatttgtagagatggggtttcactatgttgcccaggctggtcttgaactcctgagctcaagcttccaccagccttggcctcccaaattactaggattacaggcgtgtgccaccgcacccagcctagaatttctagtaggttttttacaaaaacaaatgagttggggaaaaaagagtgaacagacatatggtgtgtgccaaaatgtatactgcaggaaaacatcttgaagtctcaaaaagggtgacacggtggggagtagggaatgtattcataatacaataagttacagaagccatttgcacccaggtgtggtggctcacacctgtaatcctagtactttgggaggctgaggtgggaggatcacttgagcctgggagtttgaaaacagccttagcaacatagacagacctggtctttaaaaaaaaataaaattatagtagctgggccctctggtaacatgcgcccgcagggagtcccagctactcaggaggctaaggtgggagcttggcttgagcaaaggagacttcaaggttacattaagctacaatggcaccaccacactccagcctgggccaaaagaccaagatcttgtcacaaaaaagcagctacctgcttccaaaaataaacccactgcaccagaataaaagacccctctctgcaatgaactttagactcccataagactgcacagcctatactttgtttcttaagttttcacatcgctcttatcagcttgaagtttaacgccattttcacttgctttctcattttttgttcaataatctagtcaacgaatttaagaaactgacatttttaaaaaaaactattctcatatatgtatccccgatctcaggtaaattagagaatttgaatttctgagtccttcatgactaggcaagcccatcgtgtatgaatactagacaaagctagaaccaaccagcctttacacaaattatcaaaacattgagaacaaattttttggctgtgtgcagtggcccatacctacaatcccagcactttgcgaggccaagatgggcagactgcttgagcccaggagttcgcagccaacctgggcaacatggtgaaccccgcctgtacaaaatacaaacagatcagccaggtgtggtggcatgcacctgtagtcccagctactagggaggctgggatgggaggatcacttgagcccaagatgtgaccgcaccactacaatctactgtatttgctgactgctatataatacattaaatcctgcctatgtcctgacactgctatagaagacacaggcatggaagaataattaaaaaggggatacagttatggcagatgcatatcaattaaccctctagcaactttcttgacacctcctgtttacaatcccaaagagagccagtgagttggatcaagtttgtaatcccagcattttgggaggccaacgtgggaggatcacttgagctcaggagttcaagaccagcctgggaacacagcaagacatcatcttgactgaaaaaaaaaaaaaatttgcctgcagtgagttatgatcacaccactgcactccagcctgggcaacagagccagaccttgtctctcaaaataaaaagttccgatatatgctacgacaaggattaaccttgaagatattacgctaagtcaaatacactagacacaaggtgaaaaatatcttatggtcctatttaaacaaaagtatgtatgtgggcaaattcataaagacagaaagaaggatgagatgttatcagatgctgggggaaggggaaatggggagctactgcctaatggttgtacagtttctgtctagtaacgaaaaagttttggaaatggtggttttggaaatggtggtgagggtcacaatgacactgtaaatgcagttaacaccactaaactatacccttaatgacggttaaaatggtaaattttatgtcatgtatgttttaagtgcttaaaaactagatcacaggtacaaagttctgatgtcagagaagtatctgaatctcactgcaaaatgctctctaaaaatttttaaatggatgcattctaatcaaaataatacttggtactatgatgacaaaatactatttttggttcagacagacttttatcaaataaaagagaaatatcttgagataaaatttttctgaaggctcaggactacttggggatctttctcttgatgtcacattattcattattttggtaactatacacttacataattacaaaggtatctttggctgagcatggtggctcatgcttgtaatcccagcagtttgggaggccaaggcgggcagatcacttgaggtcaggagtttgagaccagcctggccaacatggtgaaaccccatctctactaaaaatacaaaaattagtcggtgtggtggcaggtgcctgtaatcccagctactcaggaggctgaggcaggagaatcgcttgaacccaggaggcaaaggttgcagtgagccaagatcgagccactgcactccagcctgcatgagagcaagactccatctcaaaaaaaaaaaaaaagaaagaaaaagaaaaaaagaaagctatcttctatttcccaccgtcagaaaatagcagttataaataaaggggaaaggcaagcattaatcctgtggtaatgagttgtaatcaaaggtatcatttacaaactcatggttttgaatacacaaacacacatatacatgcagataaaaagatataaacatagatgtttgtgtatgcatggttgaatatacatatatttctagctctgttcactgagaagggcctaggaggaatgacaccacagtggcaatgggcacacatagaacttagatcttggtttctaaatatcattctccaaaaaaaggaaccagagctcctccttggaaaagtgattgattccagggctgaagcaggaaaaatacaagttgaacctagaacacctatgatgtcagaaaatagaaggtgctttccccccacaaagagggtgggggcatatcgaaaggacacaagttaaactaaaggtcaaaactggaacaaatcagagcaacaaaataatgaatgataggattagattataaaccataggcgggtcacagtgactcatgcctgctgtaatcccaacactttgggaaaccaaggcaagaggactgcttgagccaaggagttcaaaaccagcctggagcatagcctgtactttctctccttcaactgaattaaaacaaggctgagatatttttaaaaatttacatatggcaaatccatgtttcattctttgaaaagcaacctacaatagagaaagactaagtcactgaattaatagatgtaactaacattatttataatgttaaactatataaaagaggccaggcacagtggctcacacctgtaatcccagcaccttggaaggccaaagagggcggatctcttgaggtcaggagttcaagaccagcctggtcaacatggcaaaaccctatctctactaaaaatataaaaattagtcaggtgtggtggcagacacctatagtcccagctacttgggaggctgaggcaggagaatcacttgaacccaggaggcagaggttgcagtgagctgagatcgcgccactgcactacagcttgggtgacgagtgaaactctgtctcaaacaagcaaacaagacacagtatcagtctgaatttttaattctccagaataacaaagcttaaagcaaaaggaaatattccacctctcctcctccaaaagaaaaatcaacagggttcaaggcaccccggaagtttctacagatccaacaccacaatcttaacctaacactactactgtctcaaaacttttaagaatcaaagggattgtctccaataagcctttcccaatgaaaagccaaatataaagtactgatatagaaatctatacattcttaaaggtaacccaaagattatgctaactgcaatatgacagatacgttaccagtaagattcaaacccaggcacagagccaaatcactctgaatagatattgtgattaactgattactgagagagggttcagtcatacatctcatagatcaataacttgttataaatctcataacattccaaatcgctgcttgtttttccaagatttaacatgagccagtcataagtcctcataatattaagattctagggctgatcctgtcatcaatttacttaaaaacaactgatagttggacaggcctggtggctcacacttgtaatcccagcactttggtaagccgaggcaagtgaatcatgaggtcaggagttcaagaccagcctggccaacatggtgaaaccccgtctctactaaaaatacaaaaaaattagctgggggtggtggtgggcgcctgtaatcccagttacttgggaagctgaggcaggagagtctcttaaatgccagaggcggagaatgcagtcagccgagattgtgccactgcactccagcctgggtgacagtgtgagactccatctcaaaaaataataataataaaaaataactggctgggtgtggtggctcacacctgtaatcccagcactctgggaggctgaggcaggcagatcacaaggtcaggagattgagaccatcctggctaacacagtgaaaccccgtctctactaaaaaaatacaaaaaattagccaggcatggtggcggctgcctgtagtcccagctactttggagactgaggcaggagaatggcgtagacccaggaggcagagcttgcagtgagctgagatcgcgccactgcgctccagcctgggcgacaaagcgagacaccgtcccaaaaaaaaataaaaataaaaataactgttagggccaggcgcggtgtggctcacacctgtaatcccagcactttgggacactgaggaaggcggaccacaaggtcaggagatcaagaccatcctggctaacacggtgaaactccatctctatgaaaaatacaaaaaattagccgggcatggtggcaggcgcctgtagtcccagctactcgggaggctgaggcagaatggtgtgaacccgggaaccagagacacagccagactctgtctcaaaaaaaaaaaaaaaaaaaaaactgatagtgcatatgaaacattgctttcaatcacagccagacatttttccagaatacacaaagaacaggcagataaggtagaacacaaaacaaacagtgcaaacttttgtaaagtctcacaaaaagaaacagctttttacagcgagggaggaagggcataagggttgaaaaacggttgggtactatgttcagcacctgagtgacgggatcattgtatcctaaacctcagcatcacacaatatacccgggtaacaaacctacgtgtgtacctcctgaatctaaaatgaaagttgaaaaagataaaaataaagaaacaagcagcctggccaacatagtgaaaccttgtctctactaaaaatacaaaaattagctgagagtggtggagggcgcctgtagtcccagctcgggaagtggaggctgcagtgggctgagattgagcccctgcactccagactgagagactctgtctcaaaaaaaaaaaagaaacaagaaacaaggccgggcacagtggatcacgcctgtaatcctaacacttagggaggctgaggtgggagaattgtttgagcccaggagttcgagaccagcctgggcaacacaatgaaactctcttagttctgtcacccaggctggagtatagtggctcactgcagcctccacctcctgggttcaagtaatcctctcacctcaacctccctagcagctgggattacaggcctgcaccaccacacctggctaatttctgtattttttgtacagacagggttcgccatgttgcccaagctggtctcaagctgctgggctcaagtgatccacccacctcaacctcccaaagtgctgggattacaggcctgagccaccgtacgtggccggaaacagctttttaaacaactccacacctgtaggtcaaaaacttaacgagaccagcctggccaacatggtgaagccccatctctactaaaaatacaaactccagcctgggtgacagagcgaacaccatctcaaaataaataaataaataaataaatgaacttaacaagggcagggaccaaatcagaaaatgctgcagtactccacagttttatcctctttctacattctctgtgttctcatcctatttcataacttaactactatttaacactctaaaaaatacaaatgtcaaagtaaagtgtactactgtttctgcaaagtgggaacaatatttgcttatatgtccacaaatatttttttccaaggagatctaagaaacagctaacaatgtttggctccaaggaaagctggatgacaagggtacaagaagtggagggagattttcattctattccctactgacaattttatattttggttttctgtttgttttagagacagggtctcactctgtcactcaggctggagtgcagtggtgcaatcacagatcactgccacttccaacctggtcatctggcctcagcttcccaacagcgggtactacaggcgtgcgccaccacgcctggctaatgttttttaaattattttttgtagacatggggtctcaccatgttgcccagactaacatcttaaattttgagccatgtgaatacagtttttgttcaaaacattagtataccaataaataaatgctgatgactctccatatccattttcctctcttcactagaacttaagttccatgaagccagaaattttttaaccactatatccacacatctggtttaaagctggtgcttgagaagccctcgttggatggctgaatcactccttaacctctaagttccacacttatttccaatcacctacttctcacctccacttgaacaacgaaatccaacttaacatgtccaatccaaccccatcccatacaacagcctgcttcccccaacctcttcttcatctcagtacacagcatcatcatcctccagcagaagccaaaaacccagaattgacccatcccaactgcatgctcatccaaaacatgacaatttcaataagtatcttcaactccaaaataaatctcaaaacgttttcacttgtaccttaaccctccacagccactgctcttctcactggtctccttgtgtctctcttctccaatcaacagtctgattctcaatcagacctctcagtttagaagagttccaaaagccttttaatgtatctaagaacaaagccaacatgatccagcccctggctaggacccacctttaatctcttactagggtccaccttaagccaatttcagtttgttcaatccaagtttgatagcacctcagggtttttccatttgttcctccctaaaataggaaaactgttccctcagaatttcaaacttcacctcaggaagttcttttctggttacagtatctgaagtaatctcccaatcactaccacaactccttaccttatttcccacacagcacttattctctgagattatttcttatatactgtctgtctctccatcccaagccagaagtgacactccaagaggatagaaatttaatgggttggacaggtgtggtggctcacgcctataatcccagcactctgggaggctgaggagggcggatcatgaggtcaagagatcaagaccaccctggccaacatgttgaaacccagtctctactaaaaatacaaaaattagctgggcgtggtgacgtgcgcctgtagtgccagctactcaggaggctgaggcaggagaattgcttgaactgggaggttgcagtgagcccagatcgtgccaccgcacttcagcctggtgacagagcgagactccgcctcaaaaaaaaaaaaaaaaaaaaaagaaatgtaatgtgtcttgtttacccttgtaaccttaatgcctgcagccctgcttgacaaataaaccaggtgcttaataaatatctgtcaactgccagacaacgcaaaaatgactttaaagaaggtccataacgtttaatctagtgacaaactggtgagggtaaaagacatggataatcttcacatttatagaacactgaaagccaccagcaaggatggagaatgaagagtatttcagatgcaggagaacatccaaatactcaaaaagcaattgaaaaggaatttttcccacgctatgtgcatgcacattgtagaaatgttcccccaactcataaacagcaattgaaaaaaacaagtaattcaaaacactgtgggctgggcgcagtagctcaggcctgtaatcccagcactttgggaggcctaagcaggcgaatcacctgaggtcaggagttcaagaccagcctggccaacatggtgaaaccccatctccactaaaaatacaaaattagccgggcatggtggcgcatgccagtaatcccagctacatggaaggctaaggcagaagaattgcttgaacccgggaggcggaggttgcagtgagccgagatcgcaccactgcactccagcctgggtgacaagagcaaaactccatctcaaaacaaaaaaactgtgtacttctcttatctcacgcgactcttttggaaggatcttccagatactgtataagggcaaaagaagcaaagtatagctcatttgttcatgtgtctgtcttgaaaaggaatgtaagattctaaagggtaggcaacagtgttttgaatgtttttaagcgattattatgtagtcagttgtcaatcagatcaaagtgattatttccgatactttactacgaaggtaggcttggccaggtctagttcaaagacgtttatgttgaacagtcacaatctatagcgaacgttaatattttgcatcttatcttcaaaatttaaacgcccagggtactggccttcaactgttaatattaatccatggggcaaagatgtggacttaacattaataacagtctgcaattcacagatgttttatttgcatgcacgtaatggtagggaatggtccagactctctagagggtaagcaagtgctagaaagcgtgtgaggatcttatttcaccagaccctaagggttgagacaagaagtctagcatgcacgtaggatactcctccccaaagctatcaatctttgcagtctgcggaaacaaaagtgaaaacactcggggtaaggatgcatgagatgcccccccccacacacacacacaaacacacagagttgtgtattcgtgtgagcacgtaaatatgtagaagaatacacgcactctcaccttccctccttcgaaggaaaatggggccgcgggagaggcggccaagatcgggttggggaggcccgggatccagtccagggggtggcagggcttacgggtcagcgctctggggagccgaggtcacttacaggataccatcttcccgggcctccccctttcatccctctccccacacctcgtcgcccccaactcctctcctccgccccagccccgccacccattaaccgggaagggaagtttcccggcgcctgcagcccggctccccgaccctcagcggggttaccttctgcagaagcagggcaaggggcaggggacaaggggagggggaggcagcccgaaggagtgaaagacgaagccccggcgaggaaggtgggcggaggcggcggcggcggcggctgtcagctcgcgttcccctgctcacagcgctgccattactgtgcgccgaggccgcctccccggccggccgccgccaccggccccggagacgcggggggtggggagcgaagcccggggagcccgcgcgccgacactcacctgtctccgcgaggaaagacagcaaagtccaaggccgccgccgctccccggcgggacaggggcggtagggagggggggaaaggggagaaggacgggccgatcacgggatccgtaaaacaatcgtcctcctctgcctccggctttgcccaacacacaccctccggtctccttcttccgctgctgccaaatcccccccgccacccggaaagcaat

SEQ ID NO: 316 - DNA, 134182 bp, Homo sapiens
cggcggcagcagcccatgcctccggtgcaacagctgcgcctcctccggtgccccggcggcgggggcgggagataacctgtccctgctgctccgcacctcctcgcccggcggcgccttccggacccgcacctcctcgccgctgtcgggctcgtcctgctgctgctgctgctgctcgtcgcgccggggcagccagctcaatgtgagcgagctgacgccgtccagccatgccagtgcgctccggcagcagtacgcgcagcagtccgcgcagcagtcggcgtccgcctcccagtaccaccagtgccacagcctgcagcccgccgccagccccacgggcagcctcggcagtctgggctccgggcccccgctctcgcaccaccaccaccacccgcacccggcgcaccaccagcaccaccagccccaggcgcgccgcgagagcaaccccttcaccgaaatagccatgagcagctgcaggtacaacgggggcgtcatgcggccgctcagcaacttgagcgcgtcccgccggaacctgcacgagatggactcagaggcgcagcccctgcagccccccgcgtctgtcggaggaggtggcggcgcgtcctccccgtctgcagccgctgccgccgccgccgctgtttcgtcctcagcccccgagatcgtggtgtctaagcccgagcacaacaactccaacaacctggcgctctatggaaccggcggcggaggcagcactggaggaggcggcggcggtggcgggagcgggcacggcagcagcagtggcaccaagtccagcaaaaagaaaaaccagaacatcggctacaagctgggccaccggcgcgccctgttcgaaaagcgcaagcggctcagcgactacgcgctcatcttcggcatgttcggcatcgtggtcatggtcatcgagaccgagctgtcgtggggcgcctacgacaaggtacaggcttgaaccccagcccacgctaccggagtcgggcactgggtggttgggatgggcactggcggggaccctttgcgtgcggatccctagcctctccgggacgatcaagggagcccgccaggacagcgggcgcgtctaggacgcgcatccgtagtcagctaaacaactcggagatgaaccctttccgcgtgcagccaaagttctcgaggcagttaagagtgctcagcgcattcgggcaccttaagtaagtggttctggaagtcggtggggaaaccatctgtaattcatcccctcgtgaattatgtttagaagggccctttcaacccgctctcttgaactcagaagtaagttcctctggttttgctagcctggaacagcggcgctcgcttcggtcctctatggcgtggacccagcagcccagccacgcgtcttcccagtctttccaggtctactctcgtctcttttggttttgaggccgagtgatctgacagatcacagagccaagacaggtgcacccctctccccttatcttccttctgtgagttcaggtccacctgtgggggactgactgactctggggacgtggaaggcggttaaaagtgcttctttcttaaaagtgcttctgtctgactgtgttgcaggcgtcgctgtattccttagctctgaaatgccttatcagtctctccacgatcatcctgctcggtctgatcatcgtgtaccacgccagggaaatacaggtaacttaggtcctgctgtttatgaatgacccaaagccctacagtcagcctagagaaacgcaaggcagcagaggcttttttcaagccatcatgtccttgcttgaggttacagaagacacatgctgtattgttaccgttagcacctgacctgttctttcaggaagtggaaaacaacacaaggcagggtagcatataaacatgcagcattttctgaggtgtatttgttggacccttaagatttttacttctcttcagtaggtggatccttttctccagatcagtcacattttgttccttaaggccagttatgctctagttttaatctggaatgaacttgtgttcttgtttgagacacctcttcctagtgggtgcgtcattatgggagattgtatctatctatataatcttctgtaatttagcatagagaagaaaactgggtgatgagttgccagctaatttatataaatgagatatgggaaaagatctaaccccttcctaaatcccccaccattaaaaaaaactgttgtaagtttagaatgcaaattctgtgtatccagtcatgaagtattttttaaaatgtaatttaagagttaaggccactgtccttgtgagttcttttttttttttttgaaaatatttcttttgtttaaatgcagccaggagctctatatttgactgttagtatccatatcagaatgctctataaaacttacgggtcatcttgtcagttgttagcctacacaggaatattaaggcttttaaattaaaataagtatagagttttcaaaaattagattgggacttttttcagcttagaatttgcactgtgtgggaggcgcggtggctcagtcctgtggtcctggtgcatgagaatttgcactatgtattttctgagtttttttttttcttttttgagcagttgttagacatttggtggtactttgagacccttaatttaggccatcttcctttagactgcctcagatttaagctgcctttcaatttaaaatcttatataggatttgcctttgaagtaatttagtattaatttaaattaaattaattttaaattagtaattagcaaacacaaagtaaatatggaagaaatcgtttttaatgatgcccagacaaaatagtgatgcacattactccaagtgcagagggagaaattacttcacgttgcctttatacttgtaaaactttgaaaaatgtgtttttgaagggatgaggttggagaatgataattagaaagagtgagactactcagaaataaattacaaaactgcactgacaaaatgagatgaacacacatttgaattttttaaagttttaacagtttacatagattcatctttaattcaatactagtgatggttgggcttttgagattattttgaacattttaaagtgatactaaaatataacttaaacattagaaatttatcttttcattttgacttgaagagtagacaattagagctggaaggaacaaaataggtttaatggtcctttgactcagtttacagataaggaatctgaaatcagcagaggtagcttgccgggccacacagctagacagtgcacagtgagaaccagccctatcctagcttccaggccataatgcttcctctgcgagctgctgctacatgccaaaaactgtgaaacgtgaatatttctttttctgcagtttccctctaaatccaaaagtttggtatataaattcagttaaacttaaaagatcattccaaaatgttcttacatatttttaaaaatcaagttaacttgaaaaatgttttgtttggaggacagagtcgttttgcttaatgattctgaaatgagagatcttgctgggttttattaaatatcagctttgtgttattgcctgttccttgtgaaaatcacacagctaaagaaacattcatgggggaggacatttgctggtattaacatcaaaaacaaagtgtcttgaaaacattgactctttaagaattattgggagattttttgaagtaattcataggagtctaagagctaccaaatgttaactatttgaaaaaattgatgtcatattagaacgcttaaaatttacagaagtttataaaaaatcatatttttatagattaatgcttgaaagcattccactcattggctaattttgaggaccatttcaattatgcatatgcacatatattttgattagggtatgtattgcatgggtgagaaaaatgacatggaatgactctccacggcaaatatgcacagtgaacttccttactgttggtcaacataaacgttatagaatgatatatgttttaaaattcggtttattttatatgatatgtggtttctgttaaacccactatacttaagataatttcaaaatagatgcttgggtcatgtcatttaattaatttggatgtagcttttttactcggtgtattatctagagggatttctcctttaagctgaagctccaaattcttatctgagatgcttttattaaaaaataaataaataaaatggagaagggccaaacaaatgtgaagaccctgaactggaagtcaagaaccagaaaaaggtaaagatgttctaatttgtccagagaagagcgtcagcagggctgtcaaataccttattctgaaacacaatgaaaccaactgctcaggcttatgtatatgcatggaaaatgatgaattgccccccgccctccttttttacttattgatgtcactgctgtgggtatatatgttttttcataaaaagttttaagctaatgagcacttctcagctcacgctaaataattccaaatatatcaattagctttgagttaagaaactaaatgcaaggttatgctgccattcatagcgtgtccttggatgtagcatataatctaaaaggacagtttagctttttctttttagcatatcagtatgataatcagatagtaaaagctcgccagtgcagatttctggtgcatgatatgatttctcactgcattcaggaaaagtaagtgttatagctgactttctggctctatgtcctctggaattgcttaatgaagcaagaggaggccctgacattttcatggagaaccttggaaagcagatccgtgtgaccttttataaaatgtttatacacactctggcaaaacaagatggttcaggtgagtcatggatggaagtgcttgtattaaaacagtatgatggggaggctttgtaagataccagctcagtagatttcagctttggtgtcatttttcagtaccacagacagctcagtgcaccaggcaacaattttgttcattttactaattacttttatacctcactaccaaaaatgaaatcacattttggtcgtaatacttataaaacatcagatttagtaggagtaatttttagctaaggagatgttagactttttcaggtgatattgaacttgttttctatatctatcagtaaagctaaaaaataaatgaacacataaattttaataaatgcctatgtatcatgaccttatgacaaaagaaaacataatagcgattatttttgtacagtttggaaaggtcccttgatattaagtaagtagccttcctacctcaagtctcaaggtcaaattataggtaaaacagaagcatgcttttcagtgacattttttttttttttaccccaccccacagtggggttggagatgcatctctgatggataaagtacaaaacggagttcaactatcctttaagatcttcagcatctgaaattttcagtgtagcttccactgcatcttttcagctttagtatactattatttttcttatagaggtaattttagatgaaagagttgtttagtactttgaggtaggcaaacataagattctaagcagggacagaaaaccccttggactagtgcctgatctttctggttctcatgggtcctggaagaatggcagatgatatactttgaattggaaaacattttcgtttgtttgtttttgtaatgtacagctgacttttgaacaacatgggtgaactgtgtggatccacttatacacagattttttttttccagtaaatatagtgggccctccatatccatgggttctgcatcagcaaaaatacagtattcactagctgtaaaaccctcatacagacggttgacttttcatttatgtgggttgcaaagtgctgaaaatcttaagtatacatggattttggtgtctgtgggattcctggaactaatcccctgtggttaccaagggacaactgtaattatataataaatagcattaggagaagcaacaatgtttatttgtcatcttttatgatggaataactcttttcatcatctttagagttggcttttcagagatggctctatagctctataatcggaagaacagtaatgaaaatttctcttcattcgtgcaccaaggccacagaaaacaggaaagagtgagtgagggtgggggcctcacctggactagttggggaggggtggtccctgtctactagtaggctctgtggtttgctatgtgaaggctcaagtctgaagaagaaagacagagtgttccctttgctacttctacagagagcaaacaggtgtttgcagaccatgcagaaaatactgcatatagtttactatttttattaataaaataaccaatacacataataaaaacagtacagcagactttagaataaaaagtgaaagtcgcattctctcagtcatgtttctcagaggtaaccacttttaagttttatatatataccttcagaatttcaatacggaatatttaggaatacacccataccttgcttatattctgtattatatcttggaggtttatcctcagcagcagtagggacctatttcatttttttttagcaggtacatgagatcctattctatggatgtactgtggtttacttcaccagccctgatctgagagccgataggcaaattggagttttctaagtttttgctgttacaagtaatattaaaatgaacatccttatatatttattttaatctatttagagtatatacatatggtaaattttcagcagtgagactgctgaatcaaagggagtttgcattttaaatggaaaggtattgcccactagtcttctagaaaggccgtcagagtttatgtctctgctttctcacacgttattcctccacagcattgtgaacactggatgctataaaaatatttattaaagaaatctaaaaagtttaccattttcttgcaaaacattttttggtgacaaattgtttaaagacaaagctcaaggcctcaggcttctttgcatctattttgtaatatcagtgcgttatctaatctgccagcaaatggagttatcagaagcaaatgtttcccaagttttattatctcagttaaaaaattttggaggaggttgttgaagatgaaggaagctaaaaaagtagaagaaattatcttggattggtcttaagttttctgctatggtagtttcatgtacctatgaggtggataaaaattatagcaacaggttgaaggtaagactccaaaagatagtgaggtagaaaacttgcctgaattcctttgttgagtggtgttcagctcagtgactgatgtctatattgccagcatcctctatatcagaagtaatgagatgctcagtccctttgactttgtgtatacactgtagtaacgaaatcactcaggactaattttctccgcctgcttgtgtaaagatctctgcattattaatgggtgtaacgctaaataaagctatcctggtgtgtttacagagcagcatcacaaatgaatgaagagtggaactttaggtttaccacaaatgggttttctagagtatccaacctgtttctgggccatgttttgtacagttgagagataagggcactgtgggctgtcatcccaaaccacgtttggcagggagcaccaaggcagcctgcgttgatttaacttcagagaagttatattcagttaggataggaagtggttttgtggggttgttttagagagaatttctactcattaagaaataatataatatttgctactttgggagtacattttcaacctgaaactccttaataattctatttataaaactagaaaacacatggagggatcttaattattattgggcccagtatcccacccagcatgagaatgtcctttatgtcattgttaataaaagtgagtcacccagttcctgcttaaactcttttcccaagattggcagttcatacacgtacaaggctgtttcattcttagctcttatttttagtaagattttacgttcaggtgaagtctcattttatttattccatattcagcattttaaaagtttttgaggtctgcaaatgcaatgaggaataagacaggaggggccctttcctcttggagctgatattccaaggaggaggggttaaagagagacaaaaaattaataataaacaaaatttttggaagttgtgataaattccctagaggagagacaaagggctgagatagaaagttgggaggcaacagttgcatacatcagacaggaccatcaagggaggactttctgagaaagtgacatttaaactgagacataaagggaaagaagtatccagtattgccagagtctgggaactacctgtgtgaaggccttatgaccaggaatttactgtgcttaagcaaatgagagcaaaccagcatagcatagcataggccaagcaggagcagaatggtaccaaacagaatgggaggggataaaggggcctgattttcaaggacttgagaccattgtaaggatttatggattccgccccccacccctcccacatgcagtgggaaagtcagtaaagagtttaaagcaggcaaggctcatgatccagctgaatgtttaagcaggccttgttttgatgctgtgagaattggtctggatactattaggtagttgttggcaagctgattcatagagatgatgctcacctggcttaatagcattcttgcttgtagcagccatagagatgaggagaagtgggctgattggaggtagaacagacttaccagtggatagaatgtggcaggtaagggcaagggccaatacaaagatgattgatggggttctggttggagcaactgagtgtgttgtactgagaagggaagactcaaattgaggagcagggtgtagaatcaggaatttcttttagcataatatatttgaaattatgctgattgtatatgagagtctggagtacagaggaagtctgtaccggatatttaaatttgggagttatcagcacagagactatttaaacccacaggaattgatgaaatcactgagagagaatagaaaaatgagaaggttgagagttgatcattctctgacatctagaggttgagtaaagtaagaagtagaaaaaagagacaagaatgaattgtccctgaggtgaaggagtctaagagataggagtgttttaaggagggcatagcactctatattgaatgctaccaaggtctcttaacatggggtagggaagtgctttttgcatttggaaaattgaaggtcattgctgaccttgatgagccgtttctgtggagtggttgagacagaaacagactgtaagttttagcataaaagaataagttcatttcccttttcacaggatcacagaacaaacattttaacattagatccatttaaatgccctcctagttaaatagtccaatttctttgaatattccttctcagacattgaatgtccctgatcacatccttctggacttactcagttatgttgaatttcctcttcaaatgagaaagtcagaaacatacccagcactttcagataggatcttccagtggggctgttacctctcttcatcaaaaatgctatattatgccgactcttattagtctaaaatggtcattgcttcacagaaatttgcccagtgacacgtaaaattgttattgaactaaatgctcagctttacgtttactaacccttttaaatagcatcttgatttcagaccagcatatcagcctgtcagaattgtttgaatcataatgctaatgtttatttgacaaaacttgtttaggtttggaaaatcctgtgtgtggatgatctatggaattggcaagactccagcgtttaaattggtgctagattctgttccagaaacgtggtcgatattggtggttcttacttggtttggatacctgtcgttgacacatttgactcttctttcctagttttgtgctagctgtgagtttgaaaagtgaatctttggacaagccaaggtcagagtttagaagtaggccctttttgttgttgagccatctgctcatccatgatgtttgaactctatgaactctattagccacctcacatttctctagtttgtgtacaagaattttatgaggacttattaaaaccttattaaaatccacattttctgtgtttactgcagtgtcaggatctttcagtctattagtgatatccaagaaggaaataagactgatttgcttgtaattttagtatataatataagctttatgacctaatccctttactcttaaaaattttattttttcccttcagattataaaattaataactattcatgttagaaaatttgtgaaacataggaaaatatgaaaagtagtataaattagtctaatcttaccacccagtgatgactattatttatgttaccatgtatttatataaagtatatggacatgctatttgatacgttattgtataaggaaattttatattctcttcatgtaactttttattgtttttcctcatgtttaaacattcttaatattgtagatgcaagttttctttcattatgtagatataatcaattttattattttccctattttggacacttaaaaattagaaataacatattttaaacattttttataacaaatacccttgcacattaacttttgtgagcatctcttgtgatttcctaaggataaactgccaagagagaaattactgaattaaagggtattatttaagacaactgatagcttgtaaaattattcttccaaaagtttttatcagtccttttattttttaaatgctttcaaaccactttattaaatgtggtttattgaactatgtggcgaattctgcagtatctaggtccagtgtgccaggttcattgagtactgtgctgtgtaaatctggcaatttgcttccctgtggactcctctaccttcctaattctacatgatcttggttttgaagtattggctaaaaaggcttctaaaagggtatcccttttgaatagttaaaaacaattatatagaaacaatgggaaagcaatattggaagataactgtctccaaatactcccaattgttttcattataggaagctttaaaagtgtgatttctgacaattttctctaaactttcctgctgagcagagcaataggactctcctttgtgttgactgtttttacaacatagtcttgtggctttgtgcattcattcccagctctgccactaatcagctgtgtgaccttggacaggttacttaatctctctgaacttcaattttcttgtctgtaaaatggggaatatagagtacctctctcatggtgttgttatgaagattttatatatatatatatataaaattacttggaacactgcctggcatgtggtaagggctatttacatgtcagctcttggttattgttcactattttggagtttgttggggtggaaggggaggaattggagctcagcttctctgggctttagaaaactgtgatttttttttttccttatgaaacttatgagagagaacaggaaaaaaaaagtggccattcaagcagtctttattagtttattaacacttaatctagggtgtgtgtgcaagcacatgcatatttttaagtgaaagcatttgctgtctattaaggacagccatttgtttttttaaacagatttagttctgaatcttcctgtgagcaggtttgactatcttaggagagaagtaataattttgtctgttaggttttggatctgtagtgattgttcaggtactatgatgttaggctgacagtttgcaccaaaatggccattttccacataaacttaacatggatgtggcttcatcctggaatcaaggccctttctatgttacattaactccttcaggcatcacagctgactgcctctcctcaccactaattaggaccctggtgacttaaaagagttaagtgaagcactcctaaaagtaagcaaggggaataatttggatgatggaaaattctggtattaaactcctgctgaaaggataagaggtagtaaacagcctaaggcatacatgtaaatgactgtagttggcagtatttctgtctgtattctttgtaggtctacaggatatttaaataaaaggtgcttttttctttttctggactgggtttatttctggtgagagttttgttttctttgctacactcaaccacagtgcttggagtacagtggtctgaaagaactgggaagaatttctgtgtgtaaatatgacaagtaacatctcgaaatattctgggtacagtgattgttttgcttttttatcagggagcttgtatcttttctgttttatttcaaataatcattaattgaatctacattctgtccgtcctttgtttagaataaggtgttattgttgagtgagttttggactttgcttttcgaatttataggacacattgggattatacattgtaaacttggaattaattatgtagaccattctaacaactgatattctacatcaataatgtgtcctttgctttctttaatattctgggcatttttgcctgattatgtagctatccgtagtgattatctggttttaagatgggattgtttccaggtagtttgaccactgtgactttattgtctagttactgagttagtcgtcttctgtcaggaggctttcgttttccaggggaaattctgtgcaatatttgcatattagttttgacaaagacatactgatttttcaggagaaagcataaaatactatagtatgcttatcatgcttttcaccttggacagtacttttcttagaatagtgtctccagtcacaaggttaaaaattgcatgggtgctatttcatgaactgtttaattttttactgtgtggctaagggaaactatgccctagctttggatagtagagtatttaagaaattgatagtagagtgtttaagaaattaaaacataataatgaggctgagtattgaagttgtatgcatataatgtgacataaaagtgatggctgtgggatgtataatagtaatctgatgctttttcaaagatacatctaatacttttaggtaggtacccaagcaaaggtattgactgaaaactttgttttatttatgtggaattagctatgaagttttaagacttaaaggtcttagcttttagaaacttgctgtaagtcaattttcataaaggtaaatcatctgtcacttggaaaaagtcatgtcagtttgtctcttgaggtgagaatacctgaagatatatttatttagttatacatgtcattggtttaaaacctttagcttactgcttgaacctcttggtaatgttgcaaattttaatactgttgttgaaaaatattttgagttagaattttacttcatcagtaggattttagtcaagaatttactagttgttcttatttgtcagcatcaaagaggatatttgatggaaacgagtttgagcaggcttctacaatttaagcatgggtgatacaaagagaaatctccaatatgcttattattattattttgcaaaaagaaagcaacaacacaattcagggatgaaaactattttttaaaactatttttgattttgtattcactggctcttgtggagtttttaaatcatttaaaaaaagactcacagtgtatatatatatatatatatatatatgtatttttttcctttagcatatctatttcacacaatctcttttaacctttttgacaactatacctatttttcagttgttaagttttgaccacgttctgcgtctcatctcccaatgtgtcctttggatgtttcttacactggggaatgaagatccagcccactcactgtcatgttcactgtctcagtctgatgctgtgtgtacagattgcttcagtggcagctatttaggaataatgtatccatcaaatgtgtcttatacaagtagccacagaaggaaaggggacatgtgtttaggacttagtccctcaagcccatgtcagaacatccttcctgcacagagaccacacggaacactcagtgggcctgcatctgctctgcagcatttacccagcagcaagaggtctcctctgcactagtgtgcaagaacacaggtggctgcagcaaggtgatcagtgtgatggagggtgagcagaagcctcaccttcaaaactctaattatgacatgctgccatatgggaacacaattcagcaaatgaaaagcaataggatagggaggctgatggtgagaaacgataggctcagatgcccttgtgacatatgctgtagctgcatttgcaggctgaatgtaaattttcattaatttgctcacatttcctctctcctcttttgtgtgaatgatgacctgtacattcagtggggtccaagctattgatgatttttaatctttttcttaaacacaatgggggaaattacaatgaagtgttacaagtgtacttttccttaccgaggagataaagtgaacaggttttaaaatcatctcattggccagccatggtgacttatacctgtaatctcaatgctttgggaggctgaggagagaggattgcttgaaggaagccgggaattggagaccagcctgggcaacatagcaagaccccatctgtgcaaaagtaaataaatgaaacacttagctgggcgtggtggtgcatgcctgtagtcctagctacttgggaagatggcttgagcccaggagtgaagactgcagtgaattatgattgtactaccgccctctagcctgggcagcagagtgagcccgtctcttaaaaaaataaaataaaaataaattatctcattgactttattttaaatttgcctaatggatccttttgaggagcagctcttcctacccagtgctcactgagtccaccactggctgtgtgtacataacctctcccttttttggcctccccagacttgttttcatttaggaatattcctgggaacatctgctgtgttttgagaataccagccacgtcaggattcccactctgcctctgatcctaagggacatattgaggatccctgatgctctctaatccccctatgtgcatcattatgattggagggtggaaaaataagcataagcgtaacattttccagtcatgttggatggtgtctgttgcttgtactcgtgtttatgttgaatgataaaagcttgtgaaaagcagaagagctgctgcttgaatgaaggtgatagatgccacctggctgggcctgtcactgtccagcagggtgtgggtggcagcacagagtgtagaccccaagaggacagtgtaagggaagaagcccgagggacgccttctatctagacagacatttgtgcctctggaaagcagcccagatgtcagtgaagaactttggctctggatccagacagatttgagttagaactcagttttactctgtgtgaccgtaagaagacagtattacccctcccaggctcattttttcatctgtaaaatggaaatgatcattgtacctatctcattagattgtttttgggattcagtaagacagtgtttatgaagaatctagcgtgatacctggcacatcataaatgctcaataagtcttaacttctattattattattctgtcattgttactactcttctgtcattattattaagtaaatactgtagccttcacaaggaagcagagcctagaatctaggagtatctcaaggtgggaagggggaaaggcaataatgcacccatgtgtcaaggtagctgaaagttctcgtaagagggacattgggcagagaaggcaaatatttgcttagttagaacagggactggcaaactgcagcccatgggccaagtccgccccctgaacaaatctggcgtatgtgtttatatataaaaaaaacttttattggaacacagccacgcccacttgttcaggtattgtatattgccgcttttgtgctacgatggcagagttgagtagttgcaacagaggccatgtggctggcaaaatgaaaaatatttgctttctggtcctttacagaaaaagtttgccagcccctgagttagagaagtggatggtcagcaaaggcaagaagaaacatggctgaaagtgtttgttctatctttgcatcaaaagctgttttattcgctctgatttttactaaggaaagtgtgtggtgggcagagattcaggtagatgccgattgggaagtgcagatttttgtaggtgcaaggctttctgctatggcccctatctcgggcttctgtgtaggagtttgtacccctgggattgatgtggaattgtgtgttgaattaggtttacatcatcacatgcaagtgaaatggctgtagttgaaacttctggtgcctcggggttgggagtcatttttgggaggggcagtatgggcagtatgtttgacccatggtgctgcataacttagtgtcagcatctcattgagctaggcatctcattgtggcttataatgttctgtgacactgtcggtgtggcttgcctcaatcatgaagtgagactcatttgttttatgttgtgaagaaagtattttatagctgactgttctctaactctgtattttgccctaagaaagccacaaattaaggtgggaagcagtaaagagtgtttgttattttcttttggtctgaagttctggcagcatgtataatttattaatttgcttattgctgtttctagtgattaaagttatatttcatgcaaataatcttctccattctgagctgcctactggcaactccccttagaagcccctcagggccgcagctcagcacctcccagccttgtcattcctcttagacctcctagtgcttgtcattcctcttagacctcctagtggtagctgacatttgctgtcttagagaagggcaccactgtccacctggggccccagggaagaccctcgccatccgttttcttctgcccatctccccacacacttgcaagagtcctcaggaaactatggccactccctccttagtgtccttggcattacctttgctctctgctgacattcttgtgccttcattctgatttccaaacttattgactcttcccgggtcctcctacaatctcatttatgaatatacttactgaatatttgataaatattatataacatattatatatttatagaatatattatataacatattatatatttatagaatatattatataacatattatatatttatagaatatattatataacatattatatattatagaatatattatataacatattatatattatagaatatattatataacatattatatattttagaatatattatataacatattatatatttgtagaatatattatataacatatatatttatagaatatattatataacatattatatatttatagaatatattatataacatattatatatttatagaatatattatataacatattatatatttatagaatatattatataacatatatatttatagaatatattatataacatattatatatttatagaatatattatatagcttatatattatatagcatattaatattttataaatatatagcataattatattgtgacagtataatgaataacataatatataccatctatattatatgtaaagtgtaaaaatatataagtatagaaaattaatgtgttatacatgtcatttacataatttattttttaatttatatcattttatttttagtttagacttagtattttttttaactcacttattttagtcccatcttaagcaacagtttccatgagattatgggttgtagtacaaattacctgtgttttctaatacacaatacagtaaaagtgtcaataaacaacatgcagcctggactcatcccaaggaacatggaaaactccttttgggaatttctgtgtcaattgttgccgttttcttctaacgtggattaatgtagtctcctgcctccctccccctgcttctttctggtggtccatctctgctgttgcaggaatgtctgccccaaacacaaacatggtgctgtcacaacaattctaaaataatgccctggctctctctcatttcatggtgacagtctgtaatgtagattcctgcagttcaatacagagctacagagcatcaaagagaaagggatcgtgattcaattccaggttttcctaacttcttatcagtgatttcccacaaccttttaataggtgtgagcttcagtttgtcatctggaaaatggggtaataaggcccatctcatgagctactgtgagaattctactatacttagtccagtgctagacacataataatcacacaaacggtaacattagtattttcattattgtattcatcattaatcatgacctctgtgatcctttgtttctcatatgtaactgaggatgaggcatgatgaggtttttgttaggattgcatgaccggtttggggggcagttagggtgggagagagtagtgaaatgcctggtaggacatgtggcctttggggttcactaatgcaggccgttattacagtagcacttatcagactctgtctctcagttgagagggcagctccctgggggcaggcatcatgtttgattctgctggacattctcagggctgagcagcctcgtgaacagacctgaagtggataaatccagggttctcacatcttgtgcgtcatggccatttaaatagtcactgtgttttcatctgtggtgtgggggcagccctccttgttccttctccttggttcacgaaaagctaattaagaatgtggataaaataacctatcttagaggaggtggtatggcaatctaataagctaataatagtctaattaatgtgctttttcttagcataaagtttttctgctctttttctgccataatgttctgtatcactaaagaaatttagcttttaacactagttgtgttgtctgactttaaattattaaagtagataatgaaatggctggcagtacagtcagagatcattggttgaaatcattgcagggcatttgtttctattttttttagctgtattgaaagagacagattttgtagtctggttgtaagacttggttgaaagaaatacaaaaacaaatgtgtctagatgcagtggtgctatgcttacaatgcagtggtaattttaggagagccatgagaatctaagggctctaataagtgacagattagctttagctatctcactggtataataagacacagagactcttctctgggcccgcttgtgtccctccaagaggatcacagcatgtcctactgtgatcgtcctcttctaattcttgattttacaaaatacccttggatttttcagctcatctctaacatcacctcctctgtgaagccttctcattatttcagacgttttattctcttcctttcctgagcaacatttgcgtttgttactggtttttaagcctcctcaagtggttttctgtggctatgctttaccttctcaaggacagttacagatctttttgcttgtaagcaacataagctatgccagtgtatgctgccatccagtgttgctgtgggactgaactaggagaggggcaggacaggagccagtcctcatgatagtgctgggtgatgcagggatgggagttggatacctgtctgttgatggttcagattcttttttaacctggaataatatgatagtattcatggatctggacaattgtacttgcatgaaaatgacagattgttatcctgttaatggattaaccatgaggttaatgttctctcctgtatatgtttcctatattttaatcatggatcagaaataggctttgaaaatggttgcacagaggatagcaacatagaagacctggcatatattttctttttgtttaccgttactattctgcagtgcaatccttgccttcaagagctgttaaaatgggatttccagctttatcagttagtcttaaaagtgaccatccctggcatccatcgtctctaactcccgtcagtgtcacctctttcctttctgtgatatacagccattggagaggtttactaaataaagtaaatttttgtctgtagtggatattccccagcctgaacttgagtcctaattgttcgatgtgtatatatctttgtgaggttatttcttctcttgggaaaatagttactctctagtctcgtgtttactcatatattggcatttatgttttgtgtgccatgtgattacattaggagatgcaagtaactctgctttgaagcactagacatagatggtctctttctgtgggtgttggagacagagaaagaatgctaatggagaaaagccacccaagacaatactacttttccttttaggagtcagtagtcctcttgtcttaggagagacttttattccattttcccatttgtgccacaaaataaactttctaccaaaaaacaaatggatggatggcgtctgctctcacaactccagtcatatgcccaaccctggaaactggccactccaaggattagcagcttgcttcagttaaatccgagtgattgggcctgtctgctcatgttcagaatttctgtctgggttgttggtgtttaatatcacgcctagtttacaaaattgtttcagtgaactttttatcaatgtgtgaaccgtcctgagtatagcagatgaagttaatagaacaaattagtatcttagttaatatgtgtcaattaaaaatcaatcaatctaaagcctcaagggaggggggtgcaaatgaggagctaaaaaaggtgttttctagtttgcccaggtactaagctatgataacttaaccattctgtgacctttagtagaagaactgtttagctgggttttgtgcagttacctgaagggtttgcataagtttttcttagtttaagtcccctgtttccaaattttaccttcctcccaacagtgtagtctgtgtgtgtagaccctgtactttcttattgctctctcattcatgtagtatttggtgattctctcaaatattagatgtggctgtaaaggtaacaagaggaaagtgatattcctcaaggaatatgctaaaagattgattgcctgggtgtgaatatggtcttagaggggaaggtgaggcaaagggaagatgctagaagacatactaagccccactaaatgcttttttttttttttttttttttttgaggcagtcttgctttgtcacccaggctggagtgcagtggtatgatctcggcccactgcaacctccgccttctggatttaagcaattctcctgcctccgcttcccaagtagctgggattacaggcgggcgcagccatgctggctaatttttgtatttttagtagggacagggttttgccatgttggccaggctggtcttgaactcctgacctcaagtgatctgcccacctcagcctcccaaagtgctgggattacaggcatgagccaccatgcctggcccacttaatgcttttaaatgcatgtggcacaggaacaaaggccaccaacatgactaatgaggaaaattgtgatgcagtataagagaagtcaggatgtgtttgcctcatgctttatggctattttttagaaagctaaaataactaatatgtatcacagtaactaatgtgtatcatgtgcctactgagaacaagcactatgctaggtacattatacacattgtctcatttcatctacattgtagttcttattcagccagtgagtagcgaagttgagaatcaaattcaaatctgtgacttcaaaggttcttttgttttctttttgcagtagggcctttactgttaggtgtgattttatctggaatgtatgagaaaagttgtaccacttttttctgtcagttgtaatcataaaacaaataaatacctcttaaaaacttatgatattcaaacacttggtttactttaatatagatgaggaacatagtttcctccgaattttacattatgttaccttcaattcaccacagttgatttaaggagacttgtagaacaatctttatccataattagttgttccatgaaatatgtattatttattctttttgtctctaggggttgttcagaaagagctacagtggtagaatagaagccaatactcaattacccatgaaagtgaagtagaggatgggaaagaatgctgatgactgtaataaaatctcgatgttatcttagtctgtgccgtaagtgtgcttcactctgggattcccatcttaaccttctaattcaagactgagagcattttctttgacatacttctctagagtagacagatattcgaccaaattaagtggcatggtgctccagggaaagatctctggtaatctttataagaatatgaggtacattcttctaattgcatacgaccagtaggttttttctcagatgccagcccctattaattggttgtgactggctggagcatacacagtctgagagtgattctttaggccacagaagggctgcactggaagggaccggattgattcatccagtctgccatgactggagagggaagggagtgggagcctacgtgacacacatttgccatcactttctgccacttctctatgcaaataaattatgagtccttaagtaaaaaagttattcagtttcaaaaataatcattaaggaactggtcttaattatgtttttttctacatgtacagatctgtccctgtctaagaaagtttattttaataaatgtgggatgaatgtggtgagttgaaatgctctatcttattaacattaaaggtatgcagatgtgttgccctattttgtttctgttaaaattagtgagtctgaagtgttaataaactgtcaggccaccaatttctctctttgctgcctgtatttacttccttccttcatttccttccatcttcctcttttttctcttgctttcttccttccctcccttttgttctctttctctccctttctctcttccttcataacatcacagaagttagtccccagccaccaaaccttaaatttttgttgtactgttgcatgtttgaaatttacaaatacttaatttacataactgacatcaaccgtaggcatcatcaatgcctatagtgttgtgccctgtgaaagaaaagccagaatctttcttgtggcgtataatgttctttgtgatcttacctctcccattccttcagcctcattgtttattgacagcatacacacatgcgcgcacacacacacacacacacacacacacacacacacacattattggaatcatgttgatttgtttggagagctagagccaaaactatgccattctttctgctttctgtgccttttacctagaatataccactttcacccaggtgcctttgggctcagcacaggtctccctcttctggcaagcttttcatgaccccaaaggctgacgtagttgtccttcttctgtattagtatcccgtcataatagtaatactaatgtaatgtatgataaataatgatgatgatgcacaacagtgggtaattgttcaggttttttttttgctaagagccatacctggattatcttgtaattatacaactgtttcttaaagtaggtattaaggccgggcgcagtggttcacacctgtaatcccaacactttgggaggccgaggcgggcggatcgtgaggtcaggaaatcgagaccagcctggctaacatggtgaaaccctgtctctattaaaaaaaaatacaaaaaattagccgggcatggtggcaggcacttgtagtcccagctactcgggaggctgaggcagaagaatggcgtgaaccgaggagacagagcttgcggtgagccgaggtcgtgccactgcactgcagcctggggtgacagagcgagactctgtctaaaaaaaaaaaaaaaaaaaaagtgaagtatagagtggttaaatgacttgctcaaaatcacactgcttgagagcagtggaatcttttcaaatggaatagtgattgtggatttacacagatttttctccccttgtattttgagttcttagacatcatggaccattttattgattactgtatctccaccaggggctggtatatgatataagcagaaaaaacaattgttcaattaaatttgattgagttcttatttataatggatataaccagtctttctatcacttccccaaaatttgttatgtagaaatatatagtaaaatggctttctttttaaaaatttccttcagattttttatcttatttgccaatttaaaaatcatgcagcctcaaataccacctttttagtagtatccttaggtttgaatttaatgtgatacaaaaatacagaatttaaaaattcccaccatctgaaaggttgagccaagatttatttctctcattcttactctatgtatttgtaatataagcacctatggaggaatataaggaggggcaagggatgctgtaagttaagggagtagttgactaacatgtcagcgaatacattctgtctgcctctcagaattctgagagatttcagtctctatttactatcccgcatttatcaacaaggttggtgattcttctttttgatggagaacgctccttaagacgtatgtagatttttgctttctactgtccttactttcttcatcctacctttaggatgctgtacttttgtgttaggccagttagcaatcttgaaatacttcctggttatgtgtcattccctacagcatttagggtagaaaaaaatggagcctaacttgtgttgtaaagaaaacctaacttcattgtggccacttgattattttttctttaatcaagatacagcattgaaaaagaatatttgtctggttctgaatccaagtaatacaaatggataatctttattaaaaatcatcaaaaccagctgtgaccaacaggtcttaccatgtgggtattcagagctagtcccatgatttgtgcttaatcactggcatggctgcttgtgacaaacttgccacttaatgtctattttgtcatggtattttaaaatcagggaagtaactattaatgtaacaacatatggcagccattacatggtaaactagaatgttttaaaaaggaagtttttggaattaaacactgagctacagcttagtgcatttttgcttaaccttgactgttatcaaactgggtttaatgtgtttcataatactgtattctaactaagtttgagagcttcagttagaaaaaaatttaaaaactgctaaaaaaaaatattccctgtggtttttgttcttagactttgggctcatgtatcacatgcttctggcatgtgttcccagttgctaaggctctgagcagttcagcccgaagaatcattctggtcactttgttcttttgtagcttcttcattggtttcagctccaatagagcctctttgttgtacataagaaagaacagaagaaaggctctatctacatcctgtagctctgagggagactcagagactagactctctgacatttcagagatgttcattctcagaggctttctagctttttgccagttggcagtagagggctttgctctccccctctgctcccactcagatattatttatcataggagaaaaagaatattacagttgaaataggcttcattttcttcctagtctctttacccgccttctgtctgtagaggcagctgccattcagaaactcatgcatatccttccgttccatgctcttatgtgttcactaaatagaatcgtatttctaaacaatatagtatttgcattctttcaatttcatagatgctatgctgtacctattattttacaacttgcttttttgtactcaacataatgttttggatgtatagtttggttcatttacatttttatggcaactgttatttttgtacttatttctgacattattttgggttcgtaatgttttcactgcttctatctttctcctttctttccttattttgggtgatgtgaaatatttaaacattcatttctttctctggcattttagatgttatgcaatttatatcccatcttctagtggttactcttaaatttttagcaaatatgtatatttaacagtgtttaaggttgatcagaatttctgtttttctgtacagtgtaacaatctttggaggccttcattctgatctcccttcctccttccatcatactattgatgtcccgcattttattcataccttgcttttttgactttctccaaattaatcatatggttatgttgataactataattatatatagtcaatttgtgtttagacttactagcatggttacttgtttctttctttagctccttctttctggtttatgtttacttcttgctgcatgcagagcactccttagcagtcacttctgttctcaatctgtgtatgtctcaaaatgtctttcaccctttccccctgagaaatagttagttctgtatagtcttctaggctgaccatcattttgttttagtactttgaagtttacagtgacttattctatatcagttttttttattttaacaatctggataggaatatttctaaaatttagacataatttaaataatgattttacagcccttctgcatttgaaaagaggatcaattaagtcccagagagtctttgttgaggtcaacactgttatttggaacatgaggctttgcattgtgttgtaatacagtgatgttctctggtaattgaggtgtgcaagaatgtttgatttttcattagatgagttaagactgttggattttttgagaccttgtatctgctttttagtggtgtgtgtatgtgtgtgcgtgtgtgagtgtgtatgtgtctttcctctctgtcaatacttgctgctgtacctgatttacttaatgtaataattgttttcctttaagcacctgttttttccccattgtatatgttcgtttctcctttgctgaaaacaagggccttagataaccaaactggtcaagaatatatgggttcatttgatgttgtcattggcattgtctctgtgtccttcctgaaaagattttataccggctaagtatgtgacaagtcgcagtatgcttattatggacacaggctctgaagccagattgcttgggttcatatgctagccctgtatcatgtaaccctggcaagttccttaacctctaagcctcagttttctcttctccaagatggagataattgtagtatacaccttctagaattgcttcatgttttatatgagttaatacacacaacaggctagaacagtacctggtcctgttaacatgtggttagttaagcatactttaaaacagctttcaagtttcatcccaaataccgtgtgaactgtgaggttctatacaactgaagttaaaaaagttttcagaatgaaaaatatctaacttggaaaaagactaaactaggacgtagtctatttctgttaccatggggcattgaatgtaatgtccaagtttatttaaatatttgcttctgctggaaagcaggaggtcatctaagaccagggatgaagatgtgacattggagaaatcataatgtaaattagtgggtaagcatttttttgctttataaatattgatttgcttccaacttttcagtacagcctgatgcccccatcaaatgatgtgaatgctggaagacctgaactttagcttcaggtttttcaataactcacactgtgaccatgaccaaattctttcaattgcctgtgctttaactggactcttctaagggcaaatgagataataactatgacctagcttttagccagctttttaagtgcttaaaataactaaggtgatgctaatacattttagcaatgtagcaatattattactataatgcttcaaatgaaaatgtagagtttttatcatttcagattaaacttttagaatcaaacacgttggcttatatttaattatttcatggtttgaggccttaccaggcttattttatttatgattggttccccatctacttgcagaaatgatttaatgatacataccaaaatttataaaccattaaaataagtaaaagactgaccatggaggaactttgaatttctcatttcatctaacctttattttcatcatttccagtagctacaatcagtgatgtcagtctttgtgttcatcccttcttattctacctgaagttagttaaggttacatttattggaggccagattttgacacagtgctgaagtgaactattatgaaagaaaataacatttgttgacactatccttgtagtcctatgaccaggcatccttaacaaatgatgaaactggagctcaaaaagtttaagtaacttttctgcagttacagagctcatcaattgtggcatgtcgaaatcaaccctagatctgcttgactcaattccagagtgcaaacacataatccatacaccacagtgctttctgtgatgtcagttctgttgagagaaccaaaaagggtaaaatggttaccttaacagagaagttcaaaagtgatttttagaggcaacttgcataaattccaaagtaatgtgaatgtgaacataattgcatgataatctatcaacatgcatgcattgccttttttgggaccacagaaggtgcgggcctggtggtaagaaacatgtgaaaggggagtaagattctaattaagtcttaagagcagcataacatggatttattatacgtaaccttaactatcactgcatcctggtggataattctaggatttttgacctgtagataaagctcttgcctaagtcaggagaagacaatttcagaaactcattattttaggaaatgacgagaatacttctttcaaaaataggtatagctggagtttctagagcttttcccaatactgacattgctctagatctgtctttccttaccaatttcccttcctcctcttccatggctaattttcccatctttatatcgcaagttattatttaattcatctacttgtccctctctgaaggtccatggaatgctaatacttattcatttggtcacttttactagggacagcagagtgggtgttaatgcatactaatcatgtaaggttgatattatttttatttttttttgtagctgaagaaactgaagtttacatagattaaatatattgccccaaaccactcagctagtaagtggtcaagccagaaattaaatccaagcttttccggctccaaaatgttgtgtgtgtgtgtttcctgtgagtcacactaccagatattcagagcagttggttgatatttaaaaggcatgaacaaaagccacccaccccagaaataactctaccactcaatggttattgtactttaaatttcaatatttgagatgcatttcttctgcattgttggctgctctctccataaagtgttttaagttaataaatgttatttttcttttataaatctttacatagcacattaatgaatattaaattaaatgcaggcatactttcagctgctcaagtaacagaaaatccacctgatggtgactttaacaaatggggtaggtggctgctggttcagtggcttaagatatcagggctggaattactgtgactcttttggtctgtttttcatggtcagagggtggttgctgcagatccaagtatcacctctatttagggctggaggaagggaaagaagaggtctatgtcagccatgtctgtctttttttaatctaaaaaagcaaagatattctactaagttctcaagcaaccgtttgcttatgatttcagattggaactgcatcatatggctacacataactgcaaaggagtctggggaaattgatatttctgtagtgcagataggcaagagagaaggatgggaatactattgggttagccacttgatagtgttgcctacaacatatgatatgtgttcattttattattaaaatgactttctgaaacagcaaataacattatctccatttttacagagagcagaaataaggttaacaaagtttgaaggacttctcaaggtcatgtaacaagttagtagcatatctaggatctaagccttagttttcttcgttctagcaagtttttttcttcatacttttctcctagagaggagttggcaattcagtgattaatacttaattagtttcacattcctcctcctgggtggccagagtgaacagggttgctggaatgggcatgagacttcaagacagaggaaggttccaggatggatggtgagggaatgacaagcatcagctttgctcgtttcttctgagttttgctcaggattggtgaattctgaacatagcttttcaattttttccctcctgcagttctgggctgaggatcttggaggagatctcaacgagaccattgaaaagtcatctctccctttctgtttgtcttttgacctagtctgtgatgggcacctgtagtctcatttctttgttgactgaatcctaacaacacattaataaagaaaacctcattatttggctttcttctgtagtgttttttgtggggtttttttttttttccttcactttgttacatccaaatgctagtttctaaggaaggaggctttttttttgttttttgttttttttaattaatacatttctgtgcatttttgtttggggccatgatcccaaaaatgtcctaaaaatgatattggaagttccttgtcatgggttatgtgaagcttctggtgggaaaagcaccatatactgttccatgatggagcctcctctgatctcctctgtatttcctcagcattttctttgtttctctgttgtagtacttatcacaaggaaacattaagatgtaaatttaaatataaatctttcatgtatattgctcttccacatcaaacactgagaggctttttaatccttgtatccacagaaccttacaaatagaagcattcagtaagtgaatgaaaaaaagagagcttggttttattgaatatttggtttaaaggttaaccaagacatcttatttatttttgttcatgctgttgaaaacagttatgtaatgtaatggctcaaggatttgtcttagtaagcagaatattttagatgtaaattggattcagtgtgtttggctgtgtacactgtcattcagaacgtcagtgattactttctagttttgaagttttgtacatgtagactgtttgttaggatttatttggatgtctgacaacctcatttattctcattcttccctcctctgttttttaaccataaaaactgcttttattattaactaacttatattcatttactcacatctccaaagtaaaaaaaaagcattaaatattatataattaaaagtctcccatccatttctagtgcccagccactcagttcaccttccctaagtgacttttatcattaatttctggagtattctttcagagatactttatgcacatacaaatacaaatataccatctcccctttaacaaatctgcacaaataatagcatgtactttgcttttaaaaaaaaaaccctcagtacttacttgatatctctttttaatagcatataacacgtttcttcatcttttatttaatggcatactattcattttatggccattcataattcatttaacccgtttccctactagattattcatattatttccagttttttgctaatatacaagcaatgctgcaacaaataatcatgtacattcactatttttcactcttgcaaatatattgatatgacagattttattctaaggaaattgaattacattatcaaagagaatgtatgcttataacctgataaattgctctcctccgattgtaccaatttacacttctgcctgagatatgcgtgagtactgtttcctcatacattcaatggtattaacatgtaataaaacttttactgcctattcaatctgacaggtcaaaaagtgatatctcattttcttcttatgattgaggttgggcatttgtttctataagtttaagagccattttcatctcattttccatgacctaaggcttgtatcctgcattcatttttctactgtgctgcttgtctctttcttaatgtttaagaacttttatgtattagggaggttagtcctttgtgataggtgttgtgaacgttttcccatggtttggtccttgtctttttactctctttattgtagttttagttaattgcagaaagcaaaagtttaatgaagtcaagtgcattaaatgcattaaaagataagatgcagtattttatcttgagactctggagtttgtgtcaaaaaggccttcctttctccaaggttatggccaggttcttacctgatttcttttaatatgctagtattttcattttcacatctatgtctttcaaacacttgtatgggtatgaggcatgggtttaactctgcttttctccaggtggttacttagttgtctccaaatcatttttccataagctgtattttccccactgattgagagtctacctttgtattattatgaaattctcagtatattgggtctattttagactttctgttctgttccatcaggctttcagttatattaagtgccagtaccacctgattttaatgattaacttatgttttaaaatttatgtggctgcttctcccttgttactcttccttttcagaattttcctggctattctacttactttcctaacaaatatatgactaaaattatgtttttcagtgtgtaatttttaagccccagttttttgctgagcaatgccctggattattttctagaaggtaaacccaagatgtttaatgaattgtccccgactgcaagagcttgcagttaccttgcagaggaaaagcacatgcagaaggtagataggagaagggttctgcagccgagctccttctggtgtacacaggttacctctttgtgggcaggcccctcctgctaaactccagcccctcttcactgatggctggtcagtgctaactaatctatgatgatgagcttgaagtatattacatttggttatctgagcaaatacaaaacagtcgcactggaaagttcatgctcatggtgggacatattctgagggcacattcagcattatgcctacaagttactttagacctctggccaagactgttaaccatcaccctagaattaaggtagattaaactgttcttctgacctaaaatctttcatctcttaacaacctcagaattgaaaatgaatatagaagaactaaataatattagttcttctcattactttaactcacctacaagtgagcttaaaacagatcatatatattgttaagattatatggactgtaatgagaatagttctacggttagattttcatacttgacaatgaatgagtgttgaatacctgtgatgttgagaatgttttcattttctttatagaattgagtgcattaacatatctctcaacctggcaaataccactggacagtttttaattgacggcacctagccttgtctcctaggacagttctttccttcctgcttcactgcctgctgctttccagatcctcttacgtcctgaccttccaaatgccctccgcatttgggcttcctctggacttggccttgagtactgttttgttctcttcactttgtctaatttttcctttgatctcatacgattacccaaataacagttttctgaaatttacttcagtagtccagacttctcttctgagtgacctgcacttggcatatatactcagatgtaaatggccaaaatgaaaccttttatttcttacattccttgcctccctccagcccttggccctttgtacccaggaaatggcaccaccatccgctgtgtttctcagggtagaaacacaatagccatgtttgcatcttctctttcttttattgctcccacatccagcccatcagcaagttctgacaagatttctacttttgttgttgctgttgttgtttagatggtagtcagtattttattatttggtgaatcaggagaaagggcttttgttttcttaagggagactaggaaaactaattaagagggagaaaccggaaacattacataggtgtttttctgtgccatacagcatttttctttgtggaagaattgaaaactttatgtgtgcctctattaaatggatatttttaaacttttattttggttcaagggtacatgtgcaggtttgttatacagataaattgtgtgtcggggggtttggattatatcatgtatgtaataagcatataagcatagtacccaataggtagtctttttttttttttttgagatggagtcttgctctgttgcccaggctggagtgcactggcgcgatctcgactcactgcaacctctgcctcccaggttcaggtgattctcctgcctcagcctcccgagtagctgggactataggcacgcatcaccacacctggctaatttttgtattttttagagatggggtttcatcatgttggccaggatggtctcgaactcctgaccttgtgatctgcccgccttggcctccaaaagtgctggggttacaggcgtgagccaccacggtcagcctaggtagtcttttgatcttcaccttcctcccaccctctaccctcaggtaggccctggtgtctatcatttccttctttgcgtccatgtgtactcagtgattagctcccacttataagtaagaatatgtggtatttgattttctattcctgcattggttcacttaggataatggcctccagtcccatccacgctgctgcaaatgatatgatctcattctttttatggctgtgcagtattccatagtgtacacataccatattttctttatccctctaccaatgaagggcatttaggttgatttcatgtctttgctattgtgaatactgctgcagtgaacatacgcgtacgtgtatctttatggcgaaatgatttataatcctttgggtatgtactcaataatgggattgctgggtctactggtaattctgttttaagttctttgagaaatcatcaaattgctttccacaatggctgaactcatttacattcctaccagaagtgtgtaagtattcccttttctctgcaacctcaccagcatctgttagttttttatttttttgagacggagttttgctcttgttgcccaggctggagtgcaatggtgctgtcttggctcactgcaacctctgcttcctgggttcaagtgattcttctgtctcagcctcctgagtagctgagattacaagcacgcaacacaatgcccggctaatttttgtatttttagtagagatggggtttcaccatattggccaggctggtcttgaactcttgacctcaagtgatctgccccgcctcggccacccaaagtgctgggattacaggcgtgagctaccatgcctggccacatctattattttttgactttgtaataatagccattctaactggtgtcagatagtatctcattgtggtttcgatttgcctttctctgatgattagtgatgatgaacattttttcatatgcttgttggctgcatgtatgccttatttttgaataaagtctgttcatgtcctttgcctactttttaatggggttgtttgtttcttgtaaatttgtttgtttcttatagatgctggatattagacctttgtcagaggcatagtttgcatatgttttctttctttttataggttgtctgtttactgtgttcatagtttcctttgctctgcagaaactctttagtttaattaggtcccatttgtcaatttttgtttttgttgcaattgcttttggtgtcttcatcatgaaatcttttctaggtcgtatgtccagaatgatatttcctaggttatagtacagggtttttattgtttggggttttacatttaagtctataacccatttagaattgatttttgtatattgtataaagaaggaatccagtttcaatcttctgcatgtggctagccggttttcccagtaccatgtatcaaatagggcgtcctttcttcattgctaggttttgtcaattttgttgaaggttgtagatgtgtcgcattatgtctgcactctgtagaactctgtatttctgctccattgaactatgtgtctgtttttgtaccagtgccatgctgtttgggttactgtagccttgtagtatagtttgaagtcaggtaatgtgatgcttccagtattgttgtttttttttttttgtagttgttgtttaggattgctttggctattcaggctttttttggttccatgtgaattttaaaatagttttttctatttctgtgaagaatgtcattgacagtttgataggaataacactgattctgtaaattgctttgggcagtatggccattttaacattactgattcttgctatccgtggaatgcttttccgtttgtttatgtaatttctgatttctttgggcagtgttttgtaattttcctcacagagatctttcatcttcttgtttggttgtattcctaggtattttattctttttgtagttattatgaatgggattgtgttcttgatttgtctctcaacttgaatgctattggtgtataggaatgctactggtttttatagagtgattttgttttctgaaactttgctgaggttgtttattaaatcattgaacttttgtgcagagactatggagttttctaagtataaaatcatgtcacctgcaaacagggatagtttgaattcctctcttcctattcggattcattttatttctttctcttacatgatcgctctagctaagacttccagtactgtgttgaataggagtggtaagagaggacatctttgttttgtgccagttttctaagggaatgcttccagctttagccttttcagcatgatgttggctgtgggtttgtcatagattgctcttattattttaaagtatgttccttcaatgtctagtttgttgaggggttttaacatgatggcctgttgagttttaccaaaagccttttctgcacgtattggtgagattgtgtgtgttcagggtagtatggccatagaccttttctgcatctattgagatgatcatgtgatttctgtttttacttctgtttatgtgatgaatcatgtttaatgatttacatgtgttgaaccaaccttgcgtcccagagataaagcgtatttgattgtgttagattagctttttgatgtgctgctggattctggttgctagtattttgttgagattttttgcatcaacgttcatcaaggatatttacctgaagttttatttttttgttgtgtctctgccaggttttggtatcaggttgatgctagcctcctggaatgtgatagggagaagtgccttcttctcaatcttttggaatagcttcagtaggaatggtatcagctcttacttatattaatatatctgatagaattcggctatgaattcctctggttctgtgctttttctgattgataggctttttattactgattccattttggaacttgttattggtctgttgaggtatttcatttcttctgggttcgatcttgggagattgtatgtttccaggaatttttctatttcctctaagttttctagcctgtgtgcatagagatgtacatagtagcctttgagggtttttttttttgttttttttttttgtatttctatgtggttggtggtaatgtcccctttgtcatttctgattgtgattatttggatcttctctattttctttattagtctagctagtggtctatctatttattcttgcaaatagccaactccttgattgttgatcttttatatggttttctgcttctcaatttccttcagttcagcctggattttggttatttcttgtcttctattagcttttgggttggtttgctcttgtttctgtagtttccctaggttgatgttaggttttaaatttgagatctttctaactttttcacatgggcatttagtgctataaacttttctcttaacactgctttagctgtgagccagacaatttggtatgctataagatctttatgtccagtgcactcattgtctccatttccatgacagtcccccaatttaggtgacgaggtacaacaaccaatcaaatgcagtagagcttcctaacttttatccttccttccacaactgcccctcttcaccctgttttccccagagcagtatgggtgagcccttcaggctataaatcagatcacatcattcctctgcctaatacccttcaatgggttcccacttggcttagattgaaatcctgtttggataccatgggtcaacaaaggcctgcttatctggtcccagttagtctcttcaaacttatttccagactgatctcctttcatgctgccccttgatcattaagtttcagccactctgatgttccttcatttctttatgtatgctaagcttttatgaagcccagggcctttacatgtgctgtttcctgtgcctagaatattattcctctggttgtttacatgactggcttttctcttaatccagatcttgcatcaaatggtacttatccagaggtttttcctgatgaccacatctactgtcatctctaatgcattattctctatttcatctcttgtttctttccttcataacaatgtccaaaagcgtaattactttattcgatttctttacgtctgctttcttgactatgtttttttttttctttcttttttttttttcctagcaaaagttagtttcaatgggcagattctctgttcatcataaatgctgctgtatggctggtatgtagaccaatacctggcacatagtatttagtacactggataagtaaatgaataaacaagcaacattgagggtcaggattatgtggagaatacaagtaaatatttttcctcaatttcagcattaaaatatatgctatgataaaaaaaaatttcaggtattaagacctttgatagtaaaaaaacaactatgtaatagaacattttagtgaggaagttaccaaagaggaaagttatctggactctatggaactgcaaaattatgctgctgcaatgacttattatttaggtgaatgtgtcttacattcacttgcattatgcttcggtattctcagcttccacaagcacatttaattgatattaggacctatccagtgattaggatagtcactgttaactgagaaataacaaggaagtttatttatcaagcatttcttatcctccactaggtagacacggagtctcactaacaagtaggggagacagtcttattaagaagtcttttattgtcctttatgtgacagcatcaataagaagcacatatgaggatcatggtggaacaaaggagggagtttccagatttttacagggcatctactacatgctagaggagctgacgtggagtttggtcttgaaggaatacaaatttgctagatggagactttccaggccatgggacagaatgtacgaagacccagaagcatgattaggttggtgtgttctggaatctccaactatagggagatgtaagtagaatagtaggcaatgaagttggagagataggcaaaaccagattgcagaatggcttgtgtgctatgggtatagattagattttacccatcaggccatggtgggcctttgaatggtgttaatcttgaattaaattttaaaaaggtcattagacaatggaagataggaggaatatggtaatggagagtgaaggatcagactacccagggaagtatagagtgagagaaaagtcagagatggactctggtagtgtgttggttaatattgtggggacacatccagaccataccaagtagggacacagaatggagagaaagacagtgagatccttaagagtggcagcagatggaaaaagcaacatgtcacagaagccaaggaaagagatccttcttagggaagcaggaatgacaggacaaatgagataaaaattaagatgggaggatcagatttcataatgaaggtatctttagtgaccttagcaagggtagtcttggtaggttaatgggagcaagatctgcctggaagttgtttgagaatgaataagtgagaaaacaaacacaacctagagtaggcatggagccagccctggttctctttgtttgggtgttttgtttttagtcaacagtagaagtttgactttgtagactctactgagagaaaagaggcacaggaactagactataggctattgatgcaagagaactggattttggtgaaacattgctttagacacatgaagcaaaagggacgggaaataaggaggaaagggtgtggctgtaggtaagattgtggctaatgtatcaaatagagggtatttcctctgatactgtggggaaagtgcatgctgagagaaaggggaacaatggcggccctcgaggaaaacaacccatggtggatgtgggaatgatcacaaggtgactctgaggggtcagctgagcttgaaggcacaggtgggtggtggccataggccacctgcagcagcctggatatcaggttccagattgagagtttacctggacaggatcacctaaaggtaaaggatgatgctgctgagaatggcagtaggattatggttgaaggagtgagactcaatagagagaaccagcctagttagggaagtgagcagaggagtagtgaaaagggcctgaaaaaaagagagtagagtgaggtgcgaggagcaagtgcattggggagaatggaaggagggccagtcctagaaggaggaggcttatttgtaagcagtatatcggagtgatacattgagacttgacatttctttaccagataaataccttggaaagtatttatcctgagtttgtattgttgtccaaaacattatggggaataactttattggaactcagctgggactttgccacacagcttttgactatttggagtcttggtgattcttagcccgtttggaagtggatttgatttttgcacactgccgggtcattcagggtcaagtttggtaaataaagtagacaatcaagctggataataacatttttggtaagaatggaaatgtggatttaaagaacagtgctattttatttatgtgacttgtaatagtccctgatagtaatttccaaaggcagcaatgacagtatctttggaatatatatagcttctcaaaacaaaggtcttcctaatacgtgggactctcagcattgaagcatggctggcatccctggcttctgggccctaagtgtcagtatcccttgcaagtccttgtggcagtcagaaaagccatcacacatttccaaatgcttctggttgtctctagactgccagggcctggaggacttgtttacagagagccagggaagagaggaagatactcttttctgtcccttttactctttatctatatatctatttatttactttgctttctcgctggttttttcttcttaaaaaattttgtttgttttcattgattgtggtgtaaggaatgacagaaacaggaggaaaaagggaactttattaaataaagattgaaagtaaatgaataatccaagggaaggctatggacgaatagaagaaaagagacagaaaatagagtagtcgtggggaaactggaagaaatgtttctgccacatttgtctgtggtctcttgtgattttctctgaagccaagaataagatttcctgtaagaacgctcatgtgttgttgcattatagggtataactgattgcagaggcaccctaaatagatttcactgagaatatagttagaattgtgtaaggctttaaatccagactgaaagaggaaaacaacttgttataaggcgagtccatttcgacttcatctgagggggttttcatgactgataggctcaagcccctgttttaaaatgatgatgtttacgtgattgtccaggaactttgaacttcaaaacagttttagctcctgagtaccaagtttttaatttaatttgtacaaaatgaataccaataccctttactaaaaatagtatacctggctagcatttaaaagttataacctttagcttgccatgattgctaaaagtcatctgttgtgtgtttttaaaatctgcactaacacttgtggaccattcatgccatactgaagctgattttctactttattttttcagttgttcatggtggacaatggagcagatgactggagaatagccatgacttatgagcgtattttcttcatctgcttggaaatactggtgtgtgctattcatcccatacctgggaattatacattcacatggacggcccggcttgccttctcctatgccccatccacaaccaccgctgatgtggatattattttatctataccaatgttcttaagactctatctgattgccagagtcatgcttttacatagcaaacttttcactgatgcctcctctagaagcattggagcacttaataagataaacttcaatacacgttttgttatgaagactttaatgactatatgcccaggaactgtactcttggtttttagtatctcattatggataattgccgcatggactgtccgagcttgtgaaaggtaagtttgtttcttttcctgagaacataatttaccatgtggtatcttcacaagtaagaaaaaaaaaattttagacttgagacgtgtagtgtctcactcttaaaaattttggattttctgacaggcttctttgaaatgactgtgacaaagcttttctgaagattttttcgtagagcaaatgccttcatgcttgtgtgttttctttctaatttgatcagttttcagtagagggctgcctttataattttgtgccaaaatttggagacctagaaattgtacaggacacttttattggaaatgtgagtttaatggtaatattgagtcatttctgtgcctgattgcttatgagcgttgtttgttgttgagacagaaatcctgtcaaacagtgttgatgcaaaatgcctgggctttagggaatatcttaaagcggtttgttggttttagtgcctgtatataatagttttcaaatgattacttgataaggaggttatgggtatgcgtattagtttgtactgaactttcaacaattagtaagaacaggcaatgtgtatttgttttaatgtctgcagcgctctggtggtctagacctaggcatatattctcagatttcaggagtggctcagtgatcttaatcagttatacgttaataatgttaactttgccatttaagaaaaatagacttatgacataagcaggaatagttgtctcatagtgggctacagagtaccctcacatgaccttggttaagaaaattcaagttgaaattaacagtagagacataggaatgatttagacatttctaggagtgttgaaagttcagatgttagtctttgtagttttttttgttttgttttgttttgttttttttttttgagacggagtctcgctctgtcgcccaggctagaatgcagtggcccgatctcggctcactgcaagctctgcctcccaggttcacaccattctcctgcctcagcctcccgagtagctgggactacaggtgcctgccaccatacctggctaattttttgtatttttagtagagacggggtttcaccgtgttagctgggatggtctcaatctcctgacctcgtgatctgcctgcctcagcctcccaaagtgctgggattacaggcgtgagccaccgcaccaggccgaatattttttttttaaatttggcttttgaaagtcaaggttatacactcagatagttcaaggaagaaaaacagctatatgagagttgctggaaaaaaaaaaaaaaaaagggtagtgaaccctgaccaccccccagcccattccagctttccagaagcattcactttaaatctgtttagccattctcttggtaactgctttttatagttttgtattttaaatacaaaaataaattgtattttaaatacaattgcttatgttgctgcatctagattttttgttgttgttttggagctatctattaactttcttctgtggaagtcagttttttttttttccccgtatataaacatacccctttcacaacttcactcctccccaaaaaagtgatttttatctccctatctcccagtaagatatataaaccctaaaatctatattctatgtttacattgttattactgtataaactgcatttgtagctgaacaagataatatatcgtaatcatttttcctttcctgcacaatttttttttttttctggaagaaatagttgcctcattttttatttgcttagttttctgtatacttgtcactaaatcatctctaaattctctcacattatataaataccttttactcttttcaaatatattaagcaattcatcaacttcaccttgaagaaatgactcttggaacattctgacttgcatctctatcatgttggggactttctttgccttttttgtatgctcagtagcccctttcttgaaccccatttcaccctctttcttcgttctttattttggtggaatctgtcttccagtagttttgaagcaaaggtagtatataagagagatatttttgagatcttgcagatatgggagtctttagtcttctctcatgcttaactggtaatcagctggatataaaactctagattggaaatcactttacttcagaatattgaagtatccattttcttctggtattcagggtctagcagtctgatgccatgctccttttttatttattttgtttctggaggcttctagtattggtattctaaaattacacaaggatgtaatttaatgcatccttgtaaaatacaaggatgtattttaatccatggtactgggaacttggtggacctgttcaatctcgaaattcatgtccttcaatttttggagatttttctgaattctttaatgatttttgttcctattttctgttgtgtagataatggccctcctatattattccctaattttcttattctttgtttatagttttccatttgtttttgctctatatatggaagataacctcaaatttatctttcacactttctattgggattttacttcttctgtattgtgtattaatttccagtgtctaatttttgatccctgaatgccttttttttaatagcatcatgcttttctttcatagaaacttttctctggagatgttaattatggctttttgaaatttttctctttgcattttgtttccccaaagatgcatttttcttttgttttggcttctgttttaggagctttgcatacatacttcaaatttgtcagctgcaggctttattaaagggtgatttgagtgggggacatagaacagcaatttcaatacctttacatattttgtgtcttctctgaccatctgaccagtgcatcggaagtcttttctgctcttctgccatgaaagcagaagcctgaggtgacagcgtcttgggaattgaaacacagggcaaagaagaggtctcaacagttactatgcaagcatttgcttgttctcctggtatcagtacagtagcttgctctctccagtgtctgatgccctgcagtaggtccacagaccttgtgttgtactgtctccagataatagattttcagacttctgccaggttgcgaaagaacagttagtgtttctacaaagcagaagaggacatctgtgtgtctaactgcctctatgccttttttgaacctgtcctccctttcgaaactctatggttatccccacatgcagaagtactggtgccaacagtgcctaagtcatgggtgaggggtttggttctcagtgcatgtgcggttgcctcttggtttttcaccactgttgccacagaattctgcattctcatgtcaggtaagtcagtggccacctgtcgactggctttctagctttttttttttttttaactactcttctgtcattcattcttgttgtccttatgggtttacatgcttttttgctgtctgcttgttttagtattatttataatcattttaaggttgttaagggaaggagctgaggccagcatgtttgttgagcccacctgtttataccagaaatttggtagtgactagtttttaatatcatgtctctgaacgtttttttagaacttctctgcgtaaatatgccatttgagggattaacgttttctttttaaggaaaggtagactccttatggtaatgctttgtttcctagcaatcatggtatttacaggcttatgatattttctggagcagatgtaccttatgatggttgaagaataaatatggaaaactctagttgacatacctatttactgtataaagataagccctaattaaaaattatgcataacaatgtaacaatgagggaaatagccaggtctgacaatatatacatctccatgggtggtctctagtgcatctgcttccaaaggccaattaagagagcctcaaaattgtgtacatgccatatattttcttttcaaaaatagttcatcttagctgttttaacccattatcactaaatacagaatgccaaggcaagctgtgccacattcgcttagcagccccaagtctgtgtgttttttaacatgctcagattgtgaggtgatgaccattgctgttttcatgtaaagaggcaataaaaggtgaaaactgttcatttcatagcaagaatgagagtgtgtagccagcaggtacataaaggaaacaaatctgtgacagtgtggtggggaagggacagaggccaaaactctggattgggacactgggatttagtctcagttgtgtaatttaggggctgagtgacctcaggccaaacatctcatgtctttttgccttagtttattcatttgccaactaaatggcttgttaagacttcttcccaacgtaacgttttatcattacacaaatgtgtaaaagaaaaaaaaattattaaccagcattgtgttaatagaagattttccacatttggtttttattaaacttcccattttgctgcacaaattctccagattgtggtttgtaagatacaaagataaaaaaaaattgtttttccgtaaatttgcaatttggaacatgatgtcaccagtatcttacgcttccttgataattattttctgacccttttttttcccctcttatatgaagtttacaatactaaatataacacacagcttttctatttatttggtttaggatttggatttgaatgaatcctaccagttccatctttggtccatccaagcatcctctccatgtaaaaaggggagattcacatctgatagaaatttttatttttagttaattagatatctaaaaagagacttagatttttggacttttttaaaaggaaagagctagagaaaaagagaaacagctttctagagaagtttgcattaaaaacctattcctgtccttctaggagcacaagattcaggatttctataagtttctagaaattgttctgtattaatggggagagcatcctatgggaggcatttattccttgtggtattattttccctggcatatcatgtgcctctgaaattttttacctgtaggtaataaaaattctctctctctctctctctctttttggtgaatgataggaggaagcagagaaggaagaatctagcattatttctgtggcctacatttgttaataagcagcttccccagaccagaccacagtaatctactctttctctggttatggtttggctttgtgttaaggtaggcatcagttctaggaagaacactgtcctcttaagcagctgagaagtgtggcctagtgctgctaagcgatctcatgttcatggggtcccaggccaaggcatttaatcacaatgtattaggagaaatttcaggaacatttatgttttagaagaaacctgaaactcagagcttggggtcctgaagattgggaattatccaatcctgacttgtaccttttgagacttctctagttttgtaaagatagcgtacgtaggcagctattcaccccaaagtgtgttttactgggcaccgtttctgagcaagaatagtagctattttgcaacaggtagaactggatattgtgggtcagtgctgtgttacacaaagaaaggagttttgtttctttttcactgtaagagttctcagagcatttagtatatgtatatgcattagaaatcctcaagagggaaaaagagtatttatttggccatgctttctgggaaacatacttgacatatgacaatactgaagttttggagatagaaagaaattgaacttttctgcacagtttggattcaaaataatgtttctgtgttcaatgaaatcttttcctttttgacataggtttgtaatgctgtgttagggggcaaattggggatggaaaggaaaagagagagcaaaggtgagttaggtatttaggtggtagtgttcccaagcagaaaagcaaacattgtgataatatataataaattggagattccaggtaatgtttggaatggaaaagggtcatttggttaaaaaagtggccaactattgtcctttcttttcccattattttatctctcagggcacttaaatatgtattaactaggtatcatttgttaaggaacattttctaaaaatgacttaacaataatttgctctttttgaaagcagacaaactggagaagcataatgcaacttttgaatacctttggataatctaaactgcattttagatgaataaagaataaattcttgtgatcactgaaaactgatagatgaaaataaattaggtatttattctcaaattagcatagagaacctgaggaatagagacttcaatttcagttgtgtttagagtctactattcagtgtcttaaaagtatattttgttctttcattagaataatccaggtagatttcactctattttttgtcaccctgtcactaatactcttctatgttgtattattttgttttcgtttttaatttcctggaagatgatttctgaaatgcagttgaaacataatttattattatatagtctgttagagaagcacaaccaagaggatatagatataaatatatgagaggagatttattagaggaattggctcacaggattatggagactgagaagtcccaaggagaggccatctgcaagctggagacagggtatgctggtatatgtggctcagtccaagtctaaaagcctcagatccaaggaagccagtggtgcaactctcagtccaaagctgaaggcctgtgaatccaaagagatgcaggtgcaagtcctagagtccaaaggctggaatgcctgaagttctgaggcacaggacaggagtctgaagtctaaggacaggagaggaagaatgtcccagctccaggagagagagagagggggcgggagagagaggaactcaccttttctctaccttttttgtcctgtcctagcccccagccaggatggtgctcacccacgttgagggtggatcttcctcactcagttcgctgactcacacaccagtctcctttggaaacaccctcacagacactcagaaataatgctttaccagttctctaggtattccttaatctagttaagttgacacctaaaattaaccatcacatatggtatattgtggaatattacagtcaaatcatgccccataataaaactatatacaacataagttttatataaaatagctgcttttagcacaaggatcagttatgtcttctgacatcagtagtatgaaggagttgctaagggaaagctcctgtaggatgagagaatatctcattttgtaactagacagatttctagtctcttagcactaatttatagaggatatgagatttggggtcccactttctctgtatccctatagagaatatgtaatttggggtcccacttgcatatggaatatgggcattgaatataatcttgtacatactgatttaaaatgaatacccttgttcctgagcaccaataaaacaaaaaataggatggtagttgtttacatctagtaaattaatttagcattgcagtggatgtcttttaataacttaatctgttcctctaacaccacatgtattcattacttctctttgtagaacatgcttttaaatgaactttaagattcaatatgtgatcaactctgtatcttaaatgatctgggttctaattttcaagttttccatttcaaaacagtttcagtgttttttatctgtttatataacataagccagttgtcatggaggaagggatgaatggcatctgaaagtttcacttgttctatttgtgtttttttattatttacataagatgaatgtgaaatagggagccacatattagagtgctagctcattttcctggtctgccagccatgattttattttgtattttcaggagagtcacccagaggcctagcctactcctttcccagcactagccattagaggtgcctatttcctgatgatttacttaaatttgaaacatgttacttgggatcaagtttctttaatagttgtaaaagtagtcataaaatatgcattgcagtgctgggaaaacatatccaccttgatttattacagaatactggatagttattggataatgagattatttcctaccacttgaagattcagctgttgccaagtaaactctaagtatttcatcaatggatttgtaatttgtggttgatggcaatgtaatactttgtaaacttgtacttccaagttggtctgattcatacatacagatatagcattttcaggctcataaatgagtcacaactttaaaatgggccctttcaagttataaaagtcggcagtttgaaagcattcatcctgcatctgtgacttgcaaaacatcaatgctaagtataatgtttgccaaataaattggtcattaaagtcttttatggaaagaaaaaccagtactccctcaaattcaattttctcttctttcttatgtagatatgcttcttgttttgttttgttttgttttttgtagttttattttttgagttggagtcttgctcttgtcactcaggctggagtgcagtggcacaatcttggctcactgcaacctctgcctcctgcgttcaagcgattctcctgcctcagcctcccaagtagctgggactacaggtgcccgccaccatgcctggctaattttttatgtatttttagtagaaatggggtttcaccatgttggccaggctggtcttgaattcttgacctcaggtgatttgcccactaggcctctcaaagtgctgggattacaggcgtgagccaccacacctggccttgtttttattttttaactctttttggtctacctcctgagagaataatgaggaatagtatttgttggcaaggggctttgagatcctggtttaaagaatgcagattgaaaataccagcactgttaaattcacgtagaaaaaacatgaaaagctcagcagctcaggaatccaacctcaatgatctcatagccagttcattatggtcctcctcatcctgtcatccatgctgatgtacagatttcatggaatagaggtcctaagtgttttctgactttgaaaatccctgtaattatccatatatacatcagcagcatgcatgtgtgcactcctgggtagcattctcatgtaattcagcttcagaaccactgtgccagataaaaagaaggaacataaagtctaaatgtaaacatgctgacattcaagccattttgtctttaaggaaattaatacatttcttagacataaatagggcttggttggagaaaatgcaagtgcttcctacttcctgctggattttctgcattgtattttttttaattttatactctttattttaaaatgtttccttaatgtaagattgtattaatacaatcatagaaatgcaagacaaaagtgcctttacatgccataaaaaaagacattttatatcttgctgagcttcgatggatctgccttctattataatgttaagcttttataaccttagtccatgttaatggacttgcttactattatgagaattaaatggggaatgaggtagattttagtattgtatccccaagctggtgtcaggtaataaagcacctactgtctttcaagggagcctcttggcttgagtctcttaggagggactatgtgaactgtttctccgctgcttgctgactggtagagcaatgtctagtctatggatggttcctgaggctctgcggagaggggcatcagtctgtcccaccctgatagttccaatgctgttttgtctctcattcaaaatcccatgagtcaataaatagtctgatcactgtcaaataattaaggatactaaaaaaggcccaggcatcagatatttaaaccatagtgtggtggtaaagtcaaagccattttgggtttgtggccattattcagtgactgtttggtgaataaatattagaatttaaaaactttgtgtagaattttaccatgatttttggttacagtgtaaaaagacaaaaggatctttgtcattttttaaaacaactttattgaggtataatttacgcaccgtaaactccatctatttaaagtgtacaagccaagaattttaggggctatgcaaccatcactacaatccagttttagaacagttccatcaccctccaaaactttcatcatctccgtgcccatttgcaataaatccctgctccctcttgcagtcttccaggtgaccactaatatactatctgtctccatagatttgcctttctgaggctgtcatataaattgaatcaaataatatatagtcttttacatccagtcttttttacttaaagattttgatgtttgcctatgttgtagtatgtattgaagtttgttcctttttattgatgaatactattctgttgtaagaatatgccacaatttggtcactcattcaccagttgatctacatttagtttgttttctgtttttggctactaagaatagggttgctttgaacttgtgcacacaattctctggatgaacttgtttttctcctcttaggtagccatctaagagtatataattttacaaacccaccagcaatcggcaatgtatgaaggttccagttttatcacatccttgacaacattgtcagttgtgtgcgtgtgtgtgtgtattatatatattgtcatatctggatatgggtatatagcattgccagtatgtctgaatatacacatatgtgtatgtcttaatgtgtgtatataaacatacagaaatatatggtcttaatatacgtttatttatagtcttataaccattctagtgagtataaagtggtatcttattgtggttgtaatttgcaatcctctaatgactaataatggtgaatatcttttaagtgatcattagttctttgtgtatcttctttggcaaaatggcaattcaaattgcccatttttaaactggggcatttgtcttattaaattttaagagttctttgtatattctggttactagtatgttatcaaatatatgatttgcaaatattttccatggcttgtgttgtaattttcattttcattgtttttgaatgtgctgaggctgtgtacccttggctttctctaagtcagtcttgccttgcctcccaaagccatgcaggaaaaaagccagctacacacacacagctgactgtgagctctttgaagaggcttaactcccttgttcagttctgtgcttcacatgcctcttcttgctgcccttttcctaccctgaagtctttcttttctagtaaccactattttctagtaacagcaaagagaggaaagagcaaaaaaagactgtttttcaatcctgcttaaaaagtctttccagttcttgcgttgctttgatggttgtagtagctgcgaaaaatgaagcccagagaatatccgtcattttttcacttaggattaagtgttcctgacttgcctccaatgggaattttaagattctttttgttttctctcctagttgaggtagtaatttgttttgattgatccacagctttcttcatgaccaaaagcaaacatttgcaatgtgtctgaccccgttttagggatgtagctagacattgtgaaaaaccaagctcctccgtcccttttaggtgaccttgctggtttttatgaccgtccacagtcatgactttggaaggatgatgctctagccatgggctgcttgaccaaatgatcactgtgtgactgttctttatactgtgctttgtatcacagtgacaggatattatagtacaggtcatagggatgtggcaattgattttgacatacgatattctcagtgccacaggagcaaaagatgtttgagtgactactgtctaatatctttgctttcatgtctctgctcatgatttagtcttctaaaagctttctgtgtcatataaaatatactgtttcagtttattaaattgtatttaatattctaacagaagatataatttaaaaataagattttacggacttttgtatttaatgttgtggttttagaacttcatataaaacctcatgtaggaatcatggtttgtaaatatgaaagccacaaagtaaggcacatattattcagaaccaatttattagcagaaaatatcttttatatcagtgatcatggggaaaattaaatttagtgactttcttgcgttaaagaaatggttgtgattgagcatattagtaattataaactcctgtttttgaacaaaactgggttatactaggcatatgtggagaatcatcctaaatgcccatttggtattatttggaataataccttttatgccagagggcatcttacgaaatgaaacatccagtagacaaaaatcagtaattttaatctggtttaaatattaatctgtttttgtcccagaggacataatgttatcaaatgaaatacccaatataaaaagatcagctttagtcattagtttttatctaatttaatggtgaccagcccttagaatttctggcttactacatgtctggaagggaatgagtattcttatatttattgttgttatgataatctgcctactgtgctttctactatttagtaaggtgtttttattgttttattttgttttgcttttaagatgggttctgagaagtttggaggtgtcggtgtgaagtgagaagccactctgctaggttttttatccctgtttaaagattccatttttgaaatatcacactgataccttttgttcctcctcttaaccatcattcaccgactatatcatctagatctctgttctttcagccctaccaaggtcactggcatttattgtgacgtaggtgcctgatagatagttgggtggtaaaagggatgaaggtgccacattaggcaggtttgatgtggtcaggaaaagaaccagggggactgttgtagtcagtaatcagtggtgtagttgcctaaaacttttgtctggctctgattaggttaggagatgagttccctctgcaggttaaaggtgttcattaagtgcttatggtattctataccatgtaaaaatgggggtacaaaagccttatctgaatcaagctcctcaatggtaaaaggtgtatttgataccatctgaatagccacagagcccagagccctttaatatctgggtcagataaaaccttacaagtcatctaatcctatcaggccaagaggaacaccaactgctgtcattacatgaggacttgtggggtaaatgtttctgcacagatgtgtacctatcagttataacaatagaagaatgataattaacacttaatgagtgacttaaagtgttgaaatttaaccctacaaagggtcgttatgaagaagattactaatgggaatattatacattaagtgtgaaaaaaattcttacacctttattttatctggttcatttgcaagtaattagggttttaccatttagtaagttaacaaaggttaataaggaaatctgcattaatttaaaatttctgtgattcaggagcaaaaatagcacttactgaatatctgaaagactgcagacaaattggtcttggaaaactgaagccttccttatgtgctggactgacaggaggagggcttcacagaaacgtgacaggcatggttcagcactgcttgaaacccttctgtgtgttcagcctggaagtatttccatttactctgctggagcacacagacttcagacagagttttcttcgtcttttatcttggatgttgccttacgggctctcagcaactgtgcagctgccatcattgtctgggatttgcaatggggcaagtggggctggcggggagttggggggcagtggcaagcaagggaaccccattctgaggcagcagtagtgacagagctccaaagtttttgtgactattttgagtaaccctaaagcagcatttcaactttcctttcatgaaactgtccatgtgctaagatcactgccactcaacttaggtcctgctgtgcatttaatttcttgggtatttcctgaaagccccactaataggaacagcgatctagaattgctccttttggaaatgcactctgcagatgctgctcactaaggtctgcagaacttctgctaattcccaccaactgcctctggggaaaaaaaggatcatgagttttaaacccccacgtttcacttcctcatacaagcatatcttcaagtaatcacataactgaatgtgcctgagtagactaaatttgaaagagaacgtaataatttttttcgtagctctttatccagttttagtttgtattagagattttacctggtttagactttgtcttaatttgtgcttcttattgataatgttttgaagggaaaaatagcagcaaggattaagaaaatgaaaatattctttattagtgtggtacactagttaaagcaggggttggtaaaccatggcccttgggccaaatctggcccaccacttgtttttgtaaagcctatgagctaagaatagttttcacattttttaattgtttggcgaaaaagagattatgtgatagagactatatgtagtctacaaagcctaaaatatttattacctagccttatgctgaacaagtttgccaacctcttatctaaagtagcatcattttgtcaaatttgttttaagcacaatgtgatattttcaattacaaagcatttaaaaatttttactttggggtcagacaatggatttctatttgttatagcttaaatctggaggcaccaccccctaccaaataatcactataatatctttaggactaaatataaactacttttggtaccaatgatcaaacattgacattagttccagtgatgataggtgcaagtaccatactcagtaacctaagtctttctgactagtactagctagatgcataagtaatttatttttacatatactaaataaaaactaccttattggcctgtgcagtggctcatgcctgttatcccagcaattgggaggccaaggtgggaggattgctttaggcaaggaattcaagaccagcctgggcaacatagtgagactcccgtctctgcaaaagtaaaaaaaaataagaattagccagatgtggtggcatgtgccttcaggcccaaatacttaagaggctgaggcagcaggatcacttgagcccaggagtttgaggctgcaatgagctatgatcacgaggctatactccagcctgggaaacatagtgagaccctgtctcaaaacaaagctaccttctccattcatctacagagaatgcagtaagatatgaaagaattgctctgatctcttgaggaatctggtctcctagattttaacttcattgaccttgggtaacatcagtacaacactgagtcattaagaaatctaatctgaaagctgtggaggagcaggtcttgggatggacttggaacagtagcctctaaaacatagtcattggacattggcagaatgcctttcctttgactagggaaataatgtaaagtctttttgcaatatctctctctgcaagcatgtaaactgagctatgcaaaaagcagtagctccaggctagttattcctagggcagttataaggataaaataacctttattgctactgtttagtggagtactgtaatgaaatactgtgattgtctttgtcccctggtctctgcttccaaatgcaggactgcttctaccaagtatagcctatgttacttaacatgggagaaattgaccagcaaaagattaaaataattcctgtttgattttcttataggagtctctactaagacctcttatgaagtttgcctgctatctctcttaagcaatactaccttttccataaacaacgttcattccttagaagagtataaaagaagacgctataatttgtctaagataccagatatcagagacaatgccatggttgtgataacatttttactttaaattaagaaagcattcacagaacatgttttataggcaatctagaactttaatggcatgataagaattccatattatgttcagatggtagctttcctctccccacttcttcatgctatttgatccttcagacaggctgtaggtctggctcattttggctgggcctgctgtgggccaaaggactatcattttatggcaattttcaagttaggtaaaaataatattccccttccacattatttttgatggccatatttttcatatttaagacagtttgggatatgactaaaaattgtggtggtgattctttggcaaaacaagttgatttcttgaatgctgcagatttttgtacctttccaatacagcctaatttgtcttagctacttttcgatctattttgcgcatagccttggatattcttgattttagtatatgtttcctttttatagaatggtctttgctaggaaggaataaatcctgacatatggtttttagtgaaccaacatacatgaaattttacaaaaaaaaaagccaacatgttggttaggtgttaagacaaatttaattaattaattaattaattttattttttaaacatttttgagacagagtctcgctctgtggcccaagctggagtgcagtggcacgatcccagctcactgcaaccaccacctcttgggttcaagtgattctcctgcctcagcctcccgagtagctgggattacaggcacctgccaccatgcccggctaatttttgtatttttagtagagatgcagtttcaccatgtcggccacgctggtctcgaactcctgacctcaggtgatctacctgcctaatttatattcctaccagaagtgtataagtattctcttttctctacaacctccccagcatctgtttttgttttgttttgttttttgagacggaatttcactcttgttacccaggctggagtgcaatggcatgttctcggctcactgcaacctctgcttcccaggttcaagtgattctgttgcctcagcctcctgagtagctgggattacaggcacccgccaccatgcccagctaatttttgtatttttagtagagacagggtttcaccatgttgtccaggtgggtctcgaactcctgacctcaggttatccacccgcctcggcctcccaaagtgtttacaggtgtgattacaggcgtgagccaccacacgtggccataaattaaaaagaatgtatctgtaatttggccaccttgattcacattcaaattaatctttttggtcttttttgtaagaagccaaggtatttgaaccacccttatgtttcccagctttttatatcagtagtcactggtattctaccaaaaccattctgctaattagttttttccaacatcagtgctaggcacaaagagagaatgtgagttaatcagaaagcgaacttgtgctgctacaggagatgtctcaaatcaagggggctattttagacacgtcttactgctatagattaaatttttatgttcccccaaaattcatgttgaaacctaatttccagtgtgataatatttaaaactggggtctttcatagatgattgggtcatgagggtggagccctcatgaatgggattagtgttcttataaaaagagaccccagagagctccctagccccttgctctgtgaggacacagagagaaggtgattgtctgtgaaccatgaaatgggccctcacccgacactgaatcttcctgtgaattgatcttggacttctcagccttgagaactgtgagaaataaatgtctgttttatataagccagtcagcttatggtattctgatatagcagctcaaacagactaagacaattactcttccctaaaaagagaaaaaagactgaatgtacaagtctgttatggattacaaatggctaggcattccaaaacaaagcaaaataaaaaaaacgaggatcatatattatttaagtgtcgtcttttaaatacccttcagtaagtctgaccatgtggtctcctggatttgctttgtgtacagctgtgggctgttttttttgagcaaatgtgggcagaccatcgtcagagactcatagatgactgacactaatctgactggaacttctcagaaagcacattctgttaaagttggttgtcctattgccagacaaatgattagcacttttataataagttttatcagccttggggctattctttggccagatacagtcttagaaggtaaaagttacaattcatgttatgtggcaaataaagttaaaacatagaagtatccacatctcccagcacataagctggcacaaagctggtgttcaattaatgcattgtctgttaagcattacctgaagtaaaacaagggatattttcccaaattttcatggagtactataccactgattcacagcttgactccttgagggcagggatgatagctcttattttctctgtgcctggcaccaagcactaaacctggaacagaaccagtgatcagaaaatagttgttggataagagaatcgggctaatttttgatattttgctgatttttaaggttcatttctcatggtgtcctcagatttaattaaatgggaatatgggttcctactcacccccacagcccccaaaaaagacacaagaagaaaaacagaatggtacgatatgagcctaaataaagaggctaatcaaaagctaacttctccagggacttaggaagtgtttcataagttgcattgcaatcagtaagttagatttgcccttacttatattaagacctatttctaaaggtattcatttattaggagaggaaaaaaaaccctgcaaacaggtccaggggcagcaatgaaaagagatataaaatttcttacccattatcttatttacaaatatatatattggcatttcttcttggttgtggggaccatgaataaaaaaatggcatagtgtttgccctgtaggagcttacaatataataggtatatgcatgtgtaaacaaactgtcatttgagagagaagcagtcactataatcaagggacaagcaaacaggtcattaagtcataatttcaaaactcaggggaagactttctagaaagaaaacttgatttgaggcttcagaataaatccaatttcaaaaggccaaaaagtgaggcaggatatcccagacagaaggaacagcataaatacaggcatggagaaagggaaggtgcagggcagtttcgagggtcagagaagtatctgtgtccaagtgaagaatttatgaagaagggttgcagttggaaattaagctaaattggaactgatgcatgggaaaatacggagtctggattttagtccataggtatgttcccaaattctttcttggtgatgtttatgccaaaggcattattatttattagaacttttattacattgacatttttcttaaatactttgacttaccataactatggataataatcctgtattacttgccctgaataaattcaaaaaaccaaacacttataacattttaatttgacactgttctttcactaatgctctgaactgaacctgcaggcttgttaaaaagggagatgagcacacatcagaagcatgatcctgacctatgagcactaaactgacaccttttcttagctatactgaaagaatcagaagaggatcaaaacgaaaataaatcactaagagatactatatttttaaatcttgaggttctatgctactgaaattcatctcaaatacctcctaaaaatttagcctgtgccactgcctacatcttatgccttcagaaactcagctagagacactggagcaggcctaaagtgttttaggtatctgagtaatataaatgctgctcatattttagaaggaaaaccctggcagcattgtaaagggcagttcggagaggccaggcactggaaacaggaaagccagctgagaggctatcatgtagcctaggctagtggggaggggtctccattaaagggtgcatcctttaatattcagtactgagagagtaggaccaagtgacccagacagaggccagagagaaagtttgaagaggagtctaaggtttctaacatatgtgaagtagcaaatgtagtaggtacttacaatatacactgaacacaggaggagagagttgaagaaggggcaatgatggattttatcttgtagatgcccagatgttgaaaggtagaagggaagaaggtggtcaagacaagcctgagtatacctccatctaaagacgttgtttatataatgggggaagaagaaaggacaaatacgtcaaggctcaagtcacagaaagggaagttaagggaattcacatcaaatggcccttggcatctgtgaaatgaaagataaagttatgtatgaaaggcaagcctggtgaagaaatgatgaaaattctaaattcagtaaatgaaagatactacaatttgttctacccaaggccatggtgtgaagaaggggcttaactatcatgcttttaaatattacagattctgcataaatcccaaaatactgcaacttccaattcacatggcagttactagggaaattcagctaggagctaatatatcatgcatgtctgaagggtcccacattgctaattccataggacctacaccaacagtcagaaatttctggactgtgctaatttctggacacctcctactactttacaaaatatttacacccctgtgtcaaatgccaatctgttgaccttcccagcttagtttacatggtccatagtgattgacaatccctcctttgcacacatcctcaataaccttgcaccctctcccttcatcatacctacctggaaaaaccagccttggttaaatcaaatgctccacctgctctgcctggacccaacctcagatcagagctgcaggaaaaacacacaaacatgctgacaggctcactttaaatttttgtctatctgcaaatcctgttggctctcccttcaaaattatgccctgaattcaaccacttcttagtacctcctcagctgccattgtagtccaagtcaccaccattctcattattaagggaaaatagattgtcaagcatttctcctgtaattgccttccaccttggctccctgtggccatccctgttcccatggtcaggtccccaccagcagccaaagatccttttaaaaaacgtgaaaaaaggctgggtgcagtggctcacacctgcaatcctagcactttgtgaggccgaggtgggtgaatgacttgagcttaggagtttgagaccagcctgggcaacattacaaaaccccatctctaccaaaaaaaaaaaaaaattagctgggcatggtggcacatacctgtagtcccagctacttggggagctgaggcaggagggttgcttggcccaggacattgagattgcagtaagccaagatcatgccactgccctccaccctgtctcaaaaaaaaaatgtgaaaaagatcatataaccttcctaatcacaagcctccagtgacttcccaattatattttgaacaaatccaaagggtggtagattttgtcaaatacttttcttgtgtctatcaagatgcttatatgtttttcagatgttaatccaagcttgcattcctgtcataaatcctacttggtcattttgtataattctttttacctgtatgtgttgctgaatttggtttgctagtattttgttgagttttttaaaatccatattcataaaagatactggtctatagtttttttctgatgatgtctttgatttaatctcaggttaatattgactcagagaattaattaaatgaagtgttccttccatttttttaaagtatttgtgaagagtgagtataattcttctttaaacataaggtagaattcattgatgattttataggcctctcatttttaaaatttatgctgaatatgaatatttagaacatttgtggtcattggaactaagtttttaaactgtagtcatttttactgctgttagagaatgaagaataacagccaaatgagagttctttttagatgtttgtattgaatggtatcatataggggaggggaaagaatcacccggactgctcatagtatattatgtcttacaggattccctttgcgattgtagttttatcttcccaatcatttccctcagcttttagttagattctctaacggaagcatataaaattaactttctgaattgttccatgggatgaagcattacacactcacagcggaaaggaaagtttcacattttgtagactacaagaaaagtttgcttattgtggaatggggaactttttaatgatgccatctaaattgaaccaagtgggaacatgaccaccagccacccacctgcacctggagtcatctccatcctgccacagcactcaccatgtttcctttacttgttctcttctccccctgcaccttctcctctttcaagagcaaacttgtcctgggacttccctgacttctagctcaccaagttcccaattttctactcacctggtactttaagaatcttgccatttctttgaaatattttccaattaacaataataaaaaaattttgacatgtgggtttgatgggagtattcagactgcaggggagaaagaagacaagggaggaacattcactaggaccttggaccaactgaggggagtgggactggcccctgtggggacaatcccataggtggagctaaagggtgatagatgacgcagacagcccaagtggctgtttgggtatttggctggcttctaaattcccatcaaaccaatcccactcttgtttattagagtcctattatgttaatattggtcccagtgtttatagaatttgtactctggagcagtttacaccatttggtgataaaagcactatacaagaatattcttcatgtatgtgctcatttctcctggaacatttccttgcagctgtcagtaaatggggccttccccagataaaggaaatctctttcttggaaaatctttgaaaataagtatggaatgctaagggatagccttattaataaggtggggaataaattaaatgacccatagacctttggaagctaagtgttttattctgcttaatattttaatgatggctttgggccttcttagcactgcattataacagagtcattccattatacataaattggtactattaatctaaaagtgctaattcagacttatatttactgtgcttctatttcttgtgagatcaaaacacatcataatgggcatttgctcctaggaaagggcgttatatgtatgagaaggtaaaggagaaaagctgtaatacctcgggcctgttctgtctgaagttaagagtaagctgtactcatttcatttcatttaagagcgggtcaaggattcttctctcttcctctgtttatatctttcatatttattcaatgaaaagtttatagctctttaatctgtattatgtctcaattttacaaagtaattttgttagaccataatttttcatttcactctctgttttatgaagagtttctcattagaataatgaatgtatgtgttttaataacaaatagaaagaataaaaatcccttaaagggaaaagtattaaatgaatctgctccatcatttaatgggaatttctagttattcagatatatttgcagtaccttattatgctaatggaatagttgatatctcctaaagtataatcctattccttatatctagaaaatagtagttttgaactctttagaaaaacatgttttaagccttagttttttatctataaaagtatgcatatttattataaaagcattttgaaaacacaggtaaagatcaaataaaataatttcattgatatattctattttaatactaatgtctttgtgaaaattatgtaaaaatgtatttctgtttgttggtttttaatttctcaagaaataatcttttcatacagtgaatatatccactgccctaaaaagtctcatcagtctacctattaatccctttcttctctattctgcccccataatcccctggcaatcactgatcttttcattgtcttcatatttttatctgttttaacatgtcatatagttgaattcatagagtatgtacccctttcagattggcttctttcacttagcaatatgcatttaagattcttccatatctttttgtggcttgatagctcatttctttttaatgctaaataatccattgtctgaatgtactacagtttattcatgtactcattagagggcatcttggtggcttccaagtttgggcaattataaatataactgttatagacatttcatgtgtaggtttttgagtggacataagttttcaagtcatttggattaatacctgggagcatgattgatggatcatatggaaagaatatgtttagttttgtaaggaactgaaaaactgtcttccaaagtgacataccattttgtaattccaccagcaatgaatgagagttccttttctccacatccttgtcagcatttgtttttgcaacaacaaatactggtaaatacaaatcaaaatacaatgagataccactatgtatctattagaatggccaaaatctaaaaagaatagaaaggatcaattttggcttttctagtatgtatgtagtggtatttcattgttgtttggatttctgtttccctaatgacagatgatgtggcgcatcttttcatttgctcatttgccatctgtatatcttctttaatgtggtgccgttcagatcttttgcccattttctaaatcgggttgttcattttcttattgtagagttttaagtgttctttgtatctcttggatactcccagtctgtggcttgtactttgtgtcctcagcagagaagcttttaagtttaatgaaggccagcacaatcaatgttttcttccgtggattgtgcctttggagttgtatctaaaaagttcttggcaaacccaagtttacctagattttctcctaatatattttccaggatttttatagttttgcattttacatttgagtctatgatccattttgaaggttttgggggtttttttgtgggtagaaaggtgtaaggtctgtatatagatgctttttttttttttttttttttttaacatgtggatgccctgttgttctagcatcatttgtggaaaagattgtcctttccctctgttgatttgcctgtatcaatgatcagttgattatacttgtatgagtgtattttctacctcgcctattctgttacattggtctatttgtatattttttcactattaacacactgtcttgattaatggcacattatactaagtctcgaagtcaaatagtgttattcctctaaacttattcttctccttcaaaattatgttggttattctggctcctttgtttctccatagaaactttagaatcaatttgttgatatccacaaaataacttgctgtaattttggttgggattgcactgaatctttagatcaagttagaagaactgaaatctcaacaattgttagcttttctgtctatgaacatagagtatttatttagctcttcttggatttctttcctcagtgttttgtagtgttcatcatagaacttgtacatactttgttagatgtacaactattattcatttatttgctgctaatgtaaatggtgttgtgttttttattttaaattctatttcattgctgatacatagaaaagtaatagacttggatattatctttgtatcctgcaaccttgcaatacttacttattagttccagtgttcttgtcccttccttgggatttacagagaaaattgtttatctgtgaaaaagatggttttatttctcccttctcaatctgtgtactattttttcttgtctttattagctagaactttcagtacaaagttgaataggaatgatgagaacagacatccttgccttgttcctgatcttaccaggaaagcacctagtttcttaagtgtgatattaactgtaattatagctgtaggtttttgtggatgttttttaccaagttgaggaaattcccctctattcttagtttcctggtagattttaccatgaatgggtgttagatttttgtcaagtgccttttctgcatctattgatatgattatgtaatttttcttttttaacctgttatgtggttgatggattacattgattttcaaatgttgaactagccttgtatgctcagaataaattccgtttaattgtgatataaaagtgttttgtactttaagtaaacttgctaacattttttgaggatttttgcatctacattcatgagagatattggttgatagtcttacgtccttataatctctttggttttggtattagggtaatcctggctttatacaatgagttagaaacttacccccccatcccggcttctgtctctagaagacgttgtagagaattagtataatttcttctttaaatgtttgggagaattcaccagtgaacccatgtggtcctggggctttctgttttggaaggttattagtagttttctggatttctttaatagatatgggcctctttagttactttttttttcttgtgtgatttttggcagattgtgttgttcaaggaatttttccattttatctaggttgtcaaatgtgtgggcagaatgttgttcataatattactttgctatcctttaaaccttatggaatcagcagtgatgccccctctttcatttctgatgtttgtaatttttgtcttttttccttcatttgcttgtcatgaaatttatcaattttattaatcttttcaaagaactagcttttgatttttctgattttctccattgacttactgttttccacttcattgatatctgctctaattttttaattcttttccttttgcttatcttggggttaaacttctctttttctcattttctaaggtggaagcttgaatgactgattttaaaacttccttcttttctaatatatgtgttcagtgctataaatttccttccaagtactgcttttggtgtatctcacaaattttgatacattgtattttcaatttcatttactttaaaatatttttaaatttctcttgagaattgttctgggacccatgtactatttcagagtttattgtttagtgtccaggtatttgagattttccagttatctttgtgtttttgatttctagtttaattccattttggtctgagagcacatattgtatgatttctattccttaaaaaattttaagttatctttcagggcccagaatatgtctattttagtgaatatgtgtgcttaagaaagtgtattctgctgttgttgtgtaaagtattctataaatgtcagctagatccagttgattgatggtggtcctcaattcaactacgttgttactgattttctgcctgttggatctatgaattactaacagagagatgttgaaatctccaactatgatagtggatttgttcttttctccttgcagttctatcagcttttgctttatatattttgatgctctgttgttaggcccacacccaataaggattgttatgtctccttggaagattgaccttttaacattatgtaatgcccctctttatctctaatcggctcttttgctttgaagtttgctttgtctgaaattaatatagctactccaactttcttttgattagtattaccatggtatatcattctctgttgccttacttttaattcatatgtgtctttattattaaagtgggtttcttgtggacaacacatggttgagaggtgacagcgtgctggcagtcctcacagccctcgctcgctctcggcgcctcctctgcctgggctcccactttggtggcacttgaggagcccttcagcccaccgctgcactgtgggagcccctttctgggctggccaaggccagagccggctccctcagcttgcagggaggtgtagagggagaggcgcgagcgggaaccggggctgtgcgcggcacttgtgggccagctggagttccgggtgggcgtgggcttggcaggccgcgcacgccgagcagccggccagccctgccggcccgggcaatgaggggcttagcacctgggccagcggctgcggtggttgtactgggtcccccagcagtgccagctcaccagcgctgcgcttgatttctcactgggccttagctgccttcccgcggggcatggctggggacctgcagcccgccatgcctgaacctcccaccccctccatgggctcctgtgcggccggagcctccctgatgagcgccaccccctgctccacggtgcccagtcccatcgaccacccaagggctgagtagtgcgggcgcacagcacgggactggcaggcagctccacctgcagcccctgtgcaggatccactgggtgaagccagctgggctcctgagtctggtggggccttggagaacctttatgtctagcccagggattgtaaatacaccaattggcattctgtatctagctcaaggtttgtaaatacaccaatcagcaccctgtgtctagctcagggtttgtgaatgcaccaatcgacactgtatctagctactctggtggggccttggagaacctttgtgtggacactctgtatctgtctaatctggtggggacgtggagaacctttgtgtctagctcagggattgtaaacacaccaatcagtgccctgtcaaaacagaccactcggctctaccaatcagcaggatgtgggtggggccagataagagaataaaagcaggctactggagccagcagtggcaacccgctcgggtcctcttcaacactgtggaagctttgttctttcgctcttttgcaataaatcttgctactgctcactctttgggtccacactgcctttatgagctgtaacactcaccgcgaaaggtctgcagcttcactcctgaagccagcgagcccacgagcccacagggaggaatgaacaactccagatgcaccgccttaagagctgtaacactcacggcgaaggtctgcagcttcactcctgagccagcgagaccaggaacccaccagaaggaagaaactccgaacacatccgaacatcagaaggaacaaactccagacggcgccaccttaagagctgtaacactcaccgccagggtccggggcttcgttcttgaagtcagtgagaccaagaacccaccaattccggacgcagttgggtcttgcttttattcactctgacagcctctttttactaatgtattcagaccattgatgtttaaagtgattattagtatagttgtattattatttatcatatttttctttattttctgttcattgcccttgttctgttttttgttaatttttttgtcttctgcccttcttctgatttctgcagtattaattgagcataatatatgatttcactttttatcctttttagcatatcagttatactactattttttttctgtttgggaggtttctattgaaatatcttcaagctcagagatttttttttccttcgctataaacagtctactactcataagcccatcaagacattctttatttttgatagtgttttgatctctagcatttctttttggttttttcttacaatttctatctctctgcttaccttacccatttattcttgcgtgctgcctctttttcctttagatcccttaacatactaatcatagttattttaaatcccagtctgataaccccaacattcctaccatatctgagtcaggttgatgcttgctctgtcttcacacttttttatttggaatgccttgtaattttgtgttgaaagccagatataagatactgggtaaaaggagctgggataaaccggtctgttgtaatcccctggtattatacaagagccctattgatatcagtagtggttagctgtgagaagaaaggagccattctgtagtccggtgattagttctcagtcgtttaataagtacaggtccctgggctgtgactttcatcagtgcttctcaggtttttttcctctcccatttagatgcaacagtaaggctagaaggggctgaagtgggggtgttttccttccctcaaatgccagatcactccggggggagatggggaatggggtgcctgtaattgggtatttcccttttcccaagtgttttaggctctggtgaaacccaaggtggttacagtctggtaaaataatttcctatgagggcaagctattgttaagaacaaaatgttctgggcttataaaatggttacttttccattttctctgctggaagcaggaggggatttttctgtgatctttatcctaagatcctattggagctcctggaaattaaacttagaaaaatgtgatgccactctctacccgtcactccccacccctcacccctcaccccttacccctcaccccaggaccaggccttcctgagtttgttttctctctcaagctagtgagtgcacagtctctagcaattagtcaattaccttttaagtatcattacctgaggctggcttcagaggtggtttttgggtggtttttgttccaagtaagctgtgggttttccttatctacctgtgtccctagttttgagggtggtggtttgtcttgtgaccttaattctctgctagatctaagaaaatttgttggtttttagtttgtcacctttttttattttcttgttgtgaggataggaacgatgagtctcaaactcctttgggccagaaactggtagtaatgaaaaataatgtttctagacttcatagtattctatcaggtggattgtgtctcactctaaacaaaactccttttgaaagcaggagaaaatcctttagtttgatcaaagagccaaatataggcatcacagaatttgctttatttttactctaaaaaaaaaagatgatttagatagtatttagatcattataatgttatttgggtgattataattttatatattaagttatacattttacattcttttcatttaagcattctacatcatgagtaaatgtgaaatgttaagtgataatcattttaaattaaagtcttttaattttatgtttttacatgaatatgaaaacaaactttagtcactgcttctaaagtgaaactatattttgggttatcttcaagaaggcacaattccttaagtagataagttaatgagcatttggacttttacttttggtcattatgcttctttgtaagggtgccttaaatttggctagtttctgttttctctgaagtaggggtttttatctctgaccaccttgaactgatttgcattgtaacttgtttgtcgtaatctttttgcatttgctctgcaaagctgcatttcacacctctgactgtaatgggtcagtcagggtcacctcattatacttgaaatatgaaatgacaccctgtaggtcatcatcaccctgcatgtctaccagaaatgagaaattgtccttaagaatacactttgtcagcttggtgttacaagtaccaaagtggttacagtattttacattgggttttgaagtattttttaagttttaggtgtttaatcagtgtaacagatttaggaatggtttcctatcaactatgagatagtctgtaacacagttttttggattttagtgtataatcagttcaactgattctttttgttccccttatggaatcattaaatgatcgtaaaattagagcaacaaatgcctcagattaaacaatcttgatttacttgtatgtcatttgatcagatgaataaggccttagaaaatcaactaaataaagtcagcattcagagtcctgactttggccttgctatttattatgaaattccacctaggcatacatacttggacggttgtttggttttttcctcacgatactttgtttcttcatcttttggactatgtgtataacattgacatttaatgaaacgtatctgtacatttttcatttggctaaataaaggcatacaagtatgaaagggaaaaaatcgatgaatgaatcatgcagttcagcttcctaccattttttctaaaatctatagaagctttgaaacagtgctatccaatagaactttctgcagtgatggcagtgctctttgacactatccaatgtgatatccactagccaaatgaggttattgagcctctgaaatgtggctggcattattgaggaattgtattttttattttatttaattttacttaaatgtaagtagcactttgagctagaggctaccatattggacagcacagatttaggttttatttgtgggttgtttttttcttatctataaaatgtgtgtgtgtttgtgtgtgtgtgtttgtgtgtgtgtatgcgtgcatgcatgcatgtgttgcaagaaaaactgagctttaagtacaagtctttcattcaaggaaaggtatcaagaagagaaattggcaccaaaacagtagaattggatatatatatagaatctgtccaagaaatcatttaaaacatagtaaatttggtacacagaattaaatggacttcttcccagaacaatggaacagcagtcgaggaattgaaaacagtgcctgctggagaaaaacaggaagagaaagagacagtgggaacagagagaaggggaggaagagaggacgtgaatgaatgcaagtgttatttattgacattttagaaattttaattgaggtgatattactgtactggctttgtaatctagtaggggaaaaagctaatttagtctagcttctttttgtagtgaagactcaatagttaaataaacagtgctctgcagaatctgtttattccttcaaaacagttaacctttcagattaaagatggcaagagctaaaagtagaaaataaaaaagtgttatattgacaggtttggggactattgaaagtgttacatagttcaaatccttctgattaacttgagttttccaactacatgtgatcacataacatactatagtttgaaattaaagaaccaacatttttgtaggactctctggtgtaaaaggatcttcattctgggaaggtagaaaatcatgagtctggggaagaggacattgagaagcagtcacgtgtctatttgcctgggtgatatttgagtaagattttttctggatcgtcagtaaatttgtttttggcttttctaaactttctttcttagttcattttcttaaatatttctttttctcttggtttttgcctatcccagaaaattatcatccagttctaggagcataataacatgtttaaatgttgtgaccagttaaaacacaaagccccactttatctacaccaatctgttaatataattcctttcacctttatctccttctcagtctttctaaagcaactgtacagcttttccttccttggagaaagaaaacagattgccagcaatctgccacatttgagtgttgtggtctgggtgtgacatttctgagcgtagtgattccagtagaacacacttactatatttacagtttgaaatgtaggagtgccagatagtaacataaagggaggttgaaagttttacataatgagatgcttagcatcagctcggtttggatgaactgctctatggacactaattcccatcactccatgtgactagatggaattttggctgggtcattggcatttgggaggattatgataggggaaagtgtggaattccagagatgggacatagtggtattagaaaaaatatatttctgttgcaacttttgatcttttggggacaggatagaaaaggggcttagcagctagaatctctaatttcacgcctcacttaaaataatttatctagaagatctttgggaaggtgccataatgttcccaggggtagtttagccatgccaacaacagcaacaacaacaacaacaaacagtctctatgatgcttcctcctgtccccatttgttggggaaaatggtgatgtcaccatgcttcagacattccccgagcatgttgtcactatgcctaccagccatcttaccttagcacttggtcaaaaataaattctgccctggtgcctctttaagttctattttcccctatttgcctgtctgaaaactcccgttgctcttacgaactggacaactaaagctgcaaaaccctatgttagagaatctctttctacagataaatgtgacagccttggtacagcaatgagtgcgttggaaagcacatttaataactttctgtggtgtcattataaaatatgttaatagagtgtaattacaacatattttaactgtaaatttaacttagacattatagtgcatgcattcaaataaaattcaaaggaaaaatgtacagtacataaaaaaatctgaaatttcatattcagtaaaatgatagacttgatattctcataaccttttgcgtaacatctagaggagctggacaaatggacgcccatagctaaatgggaagggaaatctccacatgcctacatatatgtatgaaaacatatcagcagaaatgcaagtaataagctggctctcacgcttcagctactctgaggaccacttctaatcttggtaattaagagccttaacttttttaggttctttttttaaagagaaaactgcagtaagaatataatttatattagaacatggtatataatctcacaccccactgaatagcagattttgtagcaatgtgcacagttcttactaaggatcagtgttaactactcttttttacgattgtactccattctgttttattacaaaatgctggtcataatggtggttctcagtcttgacacctaggagccataaaaatatatatgccagggtcccaccctcagtgattctgatttcactggtcttgggttgtggcccaggaatcagggttttaaaagctccctgggtgattctaatgcaccgccaaggttaagaaccatagcaccaaattgatttcactatgtactaatagaacttgacagcatatttcaaaaccattgctctaaagggatatacctataataaaagaatagactaaatataaaatctcccaccacagaaagaaagcaaaccaacaaacaaaaaaacacccttgattcccaggctgggtggggtgtgtgcttggtgaggttataggggtagaaagtggtctaccctaaagaatatgtaaccaaaggcctactcacatatgcttttgaaattatactatgacaagttcagaaatcagcatttaaatccctggtgggtaacaccttgaattgcatggtggaagcaaacactaatctctatgaagggacataccttgactcaggttcagctgggttttttttctgacataagacataagcctccctccacccaaccacccaaggctgcaagctgcaaccaccatgaattctctgtttctggaagtgtaacagatccaaagccaagtaaagaaaaaagaaacctacatgtagacacatgaacgtaaaaggagtcagaaaaagaaaagaaaaaacttgccacaatgattgctgatcctagaacatcctaacataaaaaactagagctggaatatactgcctatttctaaactgctgaaagaagttaactcctaacctagacttctatgccttcctaaatttaatttaaaaacaaaggcaaaataaaggcattaggtaattaaaaagtgagagtatgtaccaccaggtcctcactaaaataacttctaaaggatttccctcaaaaagagggatgagatcccagaaaggatttttgacatcttaaatgtgagaaggaatagggaggaaagaaaaaatagccctctggataaatgtaaacaaacagggtctacaaataacaaaacaacaccaaaaatgagtacttgggagggtaaagaaggttgaactgaggagttgggtgacatggtacaggtgtgattagatttaaagccttctaagggtcatgtacctgcactactcaggggaagtggggtgggggtggggggggctttgaattctaagtctacaatcaagtatgtcttgttaaaagttataagtataacctgtaaagtaataaaaatagaatgtataacatctaagcaaatagaatagaaaaatgtgtagtatgaagggagcatataacaaacagggaattattaatagaaatttgaacacaatgtgatagctaaaacccacagatgttagtgatcacaataaatgatattcttttttttattctaactatataaagcttacaagagttatagctaaaacaagtatgtcagtgggttgaaaataaaagattggaaaagatacaacaggcaactacttaccaaaatgagtttagtgtcactatgttaatatctgataaagatagtgttaaaagcaaaaactagtaggaataaaaaaagatcactacataatgtaaactgcaattcactgcaaagttgtaataattctaaacttgtttgtatatatttaattatatagcctcaaaatatataaaataaaacagtgagcaaactagagaaattaatacatttactattatagtgcaaggttaatacaactcagtatttaatgagtcatgcagatgaaaaagattatagatgatttgaataacacagttaacaagcttaatctagcatacatatattaaaccctgtagccaataactagtaaagatacattcccttccagcacgcatagactgtttcagtaattgaccatatgtgatgccataaaatacatctcagtagatttcatagaattagcatcaatgtgtaattcatgttctcagagaacaatgcagaaaaattagaaatcaaaactccagaagtaactaaactaaaaacatactgttagtcttccctcctccctagcaataaacactatattcctaggaaaaatgtcatgataatatgagggtggcatcctttcaaactgtatataaatgtataatttttttttcaaaacagggacatgtttgtgtgatcatgtaatttggtttctgtttgtttttaactcagcaggctattacagatatgctgccatggcagtacacacaggtatcccactagactagatcactaatatatgtctctaaaacaagagcttagtaaacgaggcacttgactttgggtcacctcactttgctcctaaagatctattatcccacagcctgtccctccagaattcacactgagaaagaaacaagactgccagtgagtagccaaaaatgcatgttttaaaacttaactgctgtattcatagaaaaaataattggtggactcagggatagctttctgcctttcattgcatactattttagtatagctcagaatcccatttctcaaacacaaattaaaaagagaaaaaagccactggagtgaggataacagaagttagtgacaacctggttggttcctggttaggaacaggataaacaaaacagtacaaaagtgacattattagaaaccacaatctagagagatttcacgtggggaagagacatccctctcagtgcatcaccattacagcagaacgaattatatatatacatatatatatataattttcatatatttactgtatatatagagagagagagtcaatatttgtaaatataagaaaagagtaacttctgttcattgaagtttggaggacagggacatttatgtagtgattttaaggaaaaacaatgcatttaaaaatggagttgatgcagaaagttacctggttataggggctgaaatcatcaggaatttacctatgtggggtgaactttggcaagtcccttcaccaggctgaacctcagtttcctcagtgatatgacaagctgctcccatgcttctgtcctgggatacagttgtctctttcctgccctcatgcaatacatctctatgaatacctcctttttgaagtatgcctcgccagatgctattggggcttatgaatggcaaacgacggaagactcagaccataaacctgcccctcgggtttacagtctaggaggaaagatgagagatgtgcaccagtaacagcagtgcagggactaaaggatatgtaagagagggatggaaaatactgtggtgtataaaattaagtctcatcggaacaggaccttcagaatatgaaacacttgtgaactcggagagatgtgggcagggggaaaagaggacacacagtagttctgtttaagaacatagtgcatgagcatggtcagaagggtaaattggaacgtcatttagagggacctcatgccagcacaagagatttttaaaggtgtttttttcacaaaggagtgactatttaaatgcttaaggccgggtgcagtggctcaagtctgtaatcccagcactgtgggaggctgagggggtcagatcacgaggtcaggagtttgagaccagcctgaccaacatggtgaaaccctgtctttgctaaaaatacaaaaattaactgggcgtggtggcgcgtgcctgtaatcccagctactgaggaggctgaggcagaagaattgcttgaacgcaggagggggaggttgcagtgagccgagatcatgccactgactccagcctggcgacagagagagactccgtctcaaaaaaaaagaaacaaagaaaaaagaaaaaaaaaaaagaggcttaagaacatgggggtcattaatacagtactaacagttgatttaaaatttttctgcttcagtggaagacttgtaggttattttcagcatttggtcacataatgttcattgttctcatgtagaaagaactttagaatcattaggctaaatgcttcgttgggattatgtaaggaatgccttgcttccacagtctaaatcagattgaagagttaaaagggaacaagaacacaaggatctcaaattatccattgcataaaatatttaatttcctatgaataagtggattttactaaaattatttttctgccctcaggggctctcaggaaagcagtttaatgaagggtactgattttagaagctcttaaaatttttatagtagaagtaatctgtgaaggcacgtgaaatagatgcacgggtggcaagtattgaaatctatattgtagtgggtgaacctcagatttactaagaagcagcctgaacgtgtgtttggaagtaaagagatctgggttatcactcttctctgctcctaatttgtcatgtggctggtgataagaagaagtgtcaggaaaggtgggttgggacccaattattaatggcttggggtatatgctaaagcaattggacttttcattctaagcagtggggaatcaccttgttttagaaagataactcacagaacaatgagaaggatgatatagagagataggctggagacaaggaaagaggtagactggtaagatgtctgttacaatggactaagcctctgtcttctcatcactagaataaggcagtggaaatgggagttctcccacttattcattcaccaagactctcctttttgagtaccatgtaacaggcatggttctaaccagcacagggcatattgctttgagcaagacagagaccactccttagcacaagtagtggtaattccaggtgccatggaccatacagcaagggatacataaccccttctcaggaggaggaggggttagagtattaagaaatcactgacttcggaatgtgaaggaccaaaatacaggccaaagtggggattaagatacaagaaaaaaaagacagcatatgagaatcctggaggggtaagagcaatatatgccccatgaattgaaactacttcagctggagcttagggtgcaagttcaggacagcaaaaattaagattggagtggcaagcagaggccaggccaaaaagaatgctcaatttgagaatgtttgaaagtggatgccccagaacgtcagggttccttgatttgagggatgagacataggtaaaggtgacttcaacttgtgtgatttgatttcaggcaccttggtatttggaaataccatcttaacagacgaaaggaatatggagggaggacagctgtgtgctgtgtaatggcactgatgagagagcaccatttgggtgtctgggtactatgctgacctgaagcttcacaaaaacaccttcttgtctcaccaaatgagtctggggattggacaaagctgaagaaagcctgctgctcttcctagaacctcccctcactcaaataccccctgaaaaaatttttctccttgcaccccacattgcatcaagtacagtgatttgcacagtgtgggtcttcattgtattatttttctaaaccagcaggttgtttatttagaacacaaagtttagatgggttcatgatttgtatatgatgggaggtcacaattctgaatacagtagtaacataacatatgtgcttgcatgtatatgtgtgtgtctttacatgtatatgtatacatgcaatgtggggtgcaaagagaaaaagtatttcagggactatttgggggatttctaggaagggcagctggccttctttagctgtgcccaagtgatttcaggataagcaccttttatgataaagtgtatgtaaattggatcaaataaatctttaatatgataaaagcaaaaatgccctacaacatgccttacctccgtttactaagaaaaaaggggttatcatgagatcccttttcaattgtagatgtcaacattttaataaagtgttcagctacctttgcatccatgagacactttataaaaatattacttatcagtaaaatacacaagttaagaaacaaacactttaattaaattgcacagagcaaaagaaagctttagttggctgcattattcttcacactgtgttttaaaactatttctatgtaagctaagtagctacacaaatagtcacaccattggaagcatctgtttaaaaatgtttgacatgcatcaaaatacacaaagtaataaaaagatcatctctatatgtattccattacttttttcctgtagtttgctagtattgctatcaatatgcatatcactaaacaatatataaaattatcttgtaaatgtataaattaagccttgcttctgttatttcttcagtagcatgccaggtgagcagaacctcagtactgggtaatgagagacactctcttttattctagttgtttgatttggaaagcaatgcatcccaaaagcatctaccctgcagtaacctttttgtggatcccaccttgggcaccagctgtttcccacagtatgggcaggatcacgggaagtgaccagcataggcttaataggaagaacaagggtgctttgcaagcctgtgaagcctaggataattcttcacttcttgtggatgtcagaatttctggatagacgttactggcctcctcccctggccccagtacttggtacagtcttcctatgaactaggggagtactacctgtctgagtaaactaatatacaaaaatgagtctaaactcatttctttaaagtattcgacttattttccttgtccaagaagcatcacaacaaaataaccaaatgacagaagcgcatagaatactgtgtcaaatatgtatatataaagtcttggaaattggggaaggtattatatcttctgtgtcctattttactttggcaaagaggaagttcttagtgaatcttaatggctaaattgaaatagccctgttatgaaagcatttatatatgtgttctgtggatctcacaacttggctctctggtccttgctgtccaacatggcagccaataacatcatacggctatttaatttatattttattttttgagacagagtctcgccttgttgcccaggctggagtgcagcggtgtgatctcagctccctgccacctccgtctcccaggttcaagctattctcctgcctcagcctcccaagcagctggaattacaggcatgcacctctgtgcccggctaatttttgtaatttttttggtagagacagggtttcaccatgtcggccaggctggtctcgaactcctgacctcaagtgatccagctgcctcagcctcccaaatttctgagattacaggcatgagtcactacacctggcctttaaatttaattttaattgcctgcaatctacttggaaggctgaagcaggataattgcttgaatcagggaggtcgaagttgcagtgagccgagatcacaccactgcgctccagactgggtgacagagcaagactctgtctcagtcgatcaatcaatcaaaattttaatttattaaaatgacataaacttaaaaatctagttcctcatttgacactattcatcttcaggtgctcagtagacacatgtggctagtggccactgtgttgcacagcacagatattgaatattttcattatttttgcagaaagttattttgaacagtgctgtagtgcagctcctatttccttttctaatatgcttccaggtcagatatttcctataagcttcctcaaagcctatgtagaacacatgcaaatacttatttatatcctctagagcacccctgtggctaccaagctgggcacatagtaattcttagcctgattggtagaatggaggagaaagctggttttgatccttttgactttcacctgcctagtggccatttaagttcactgcactgagaactgaatggttttagatccagctattgtatttggctaagagtttgactgtcatcagcctaattttgttattttaatagaaggaaatgtctctgggtttgataggttcttgtttgggaagtatagtttaacagaggtagaatttaagaagatgtcctgtgtttgttttgaagagagatgactgacaaacattttgcacaactgagctcaagctcatgggtctgtttgatttttgtaattctgatcctcgatggcctttggttaactgcaaaacagtcaaagtgcagaggctattctctctccaagcttccctttgcagtattccatcctattgattcctgcattacctatggggaaaaaaaaagtttgttagaccaatttagtgagccagaattgtgattctgttcaggaaaatgtctgctgtatttgtcattgctagtcattttacaagtgtattttgatgagctgagtatgtaccacactttacgaagggtgcgctttttcctttttgcttctacaggtgaaaaccttcaaccaggaagcatttttatcattttaaattccaaaaatactaatatttaagaataatgaaatattgaattgcctttttcttttcacctttttttctggattagttggaaactttataggaactagtgaaagctacatgatctatttgtggatagtgctggaaaacaaggctggctttttaagtaattagtaggctggctggcattgaaagttttggggttttcgtgatttatgtagtgatttttctccaaccattatatgtttacaaaattttacttgcagttattttcactcttttattcactttctcactttcagctcccctatctcatcctttcttgttacccaactcttcttttcttcccttcatttcttattttctgcctgtataaaaatatttttccggctttaacacaacatattgtgtcagttccagatctctacaagggtgttctgaagcctttatggagtaggggactggtgggtcttagcggtgatggtttgagtttgagacagcttcgttcactacactgtgctcctcctgcatgaacctagacctgtgttttaattcagttcctgacattttggcattgaagtctatattttagctgcccatgctgaatcaagcaaggtgcaattaggaggcattctaagactaatttttagaattgaagtgggaaaatttaactggtaaaccttgaaaatgaccttcccagaaaatctgtgctcattctcctcagcctgtctggaatcatcttcatctgagaactctctcagctcgctgggtttggtggctcagttttctgactctgcttcttatctctccccgaggaataatgcaatgacattcaggaatgttctgcttccctagaaacatagcttgaaactgtgaagtgctggaggctaagacttcttgtcattgtttgttctacgtaggaattttcatttgctgtattttgaaaattaaaaatttagaatcaatttgtgataactgcgtactgtagatggggcaccttaagctggttgatttggatcagtggcgcatatttttttctcagttgactgagagccctaaacagaagccctgtcaaaaaattctcaggaatacgtgactgatactagacatagagatgtacgtcctccctcggcctgccaccctggagattgaagtgctagtgttggtaggagaggcagctgagggggcccaaaaatgaaatggcacagaacgatcgtgagctttcttttttcatttggacttcttgtcactgaacttcccactttcttcctggtttcattttgtggcctgctgtaccctcaccctatgttgctcctgcctttccaagggacctctgactaaccttttcctctccctcctctccttctccagccctcttttcagtctttgtcatactagttactgtgctcattggcagtggcagcaaaacgtagtgtagggtagaagggagcaaaaccaaagctgcgcatactctgagcagccctcaggtatgtcaccttgcttctgtgcaagaaggcccacttccaaaagtaatgacttttctttgtatctacttttacgtaaatagagtacttgctgaatatagagcacacagtctgtacactgatgaggacttgggtagcgttttgttatctccgtgctcacagccacctggtgaggtagacagtctgttctcttagagaaaagcgaggctcagacattaggatgcactgctgtgggtcatgcagaacaagaggtggggcagcacctctgaacccagctcagttcctccttgcctcttgtctcagagcaagtgaacaagaccctgacttttatatcttcaaatgcaggttcatttccaacattgcctagttaaaaatatccacagggattttttttttccttacagatttaagagataagatctggtctttgatcttgagaatctcagaggggtgaaatgtacagatgctgcctcctcagatctgctaccttagattggatttagaatagagtaagcatccaaacatacacacacacacacacacacacacacacacgcgcgcgctcgcgtgcgcgcactcttcccttagaagagcccttaacccagaatgggggctttccctgcagggtattcccacaacatcacctcacagccctcctctagcactgatctggctgaactctgcagagcagctgtggggataaactggtgtggcactgccacctagtgactgcccgccacaccgttctttgcctctgaggtgccgtgcatccgtcagctggccgctacccatcatggaaaatcatagtgggggcttctaaaaatagagtctgccaggccagtgtcaacatgctttctctgctatcagcagagcctggcacacatcagacatggattagattaagtgtttttgaaaaagtggttttttgggtaagggaatctttgggcctggtcgagcatggctccatctgtctgctggggttccagtttcctcttggaggagctcacagtgtgcacaggatgcctggcacgcagcaggagctgaatgaatagaggttgccccgcaatgtttaaatatccactggtctggaagttagaaaaggaacaggaggaaagagaaacttggtcagaaatgctagtcctggttaaaacattgttctggattttgatattttttgatttcccagaaagtatcaggggcttgagaatataattctcttcaggcgtttttgccaaattccaagattttccagtttcactactttccagatgtgttgatatgaagccagctccagattgtctgatggccattactagagtcccagctgccctgaaactctaggccagtggttcagaacaggagtaataccgcccccaggggaattatggaaattagtggagaattttttttcttgttgctgccttgggccagggatgctgtgtatctgttacgcatttaacaaaacactgttctacatcccacttgacttcagattgacctactggatattacatataacaaaaacctgtttataattttcttagcttagacctaaattcattttaaataaggacataaaatagttttgctcagtagtaatcaacatttaattttcaaataatgtaattttctaataatatataaattgggggaaattattagtgataccgtctgtgttcttataggtttttaacatagtagtgaaagttatataggtgtaagatttgagacttttaacttattgacagataagtcattgctgaagtcacttattccaatatgacatgtaaatgcatagtgaataatagagttagaaaacaaaacctctttgtcctctcagggaaacacgataaatgtaattcttcaagtttgaaaatttgtggatgttctatcattcccttttccattgggacatcgaactttattttaaagtaagcttatgctcttagaacatagccgctgatggtctggagacaaaaaagtaagttgtctatatcccaagtgtgaatgaaactgtcattagccaaggttaatgcatgaaaagaaaccggacattttacagaaccatgccccgccaaacatacgcacacacacacagggagagagaaaaggggttagctttgacatttttctcaatgaaaagaagagaggaagacattccaaatgtgcaaaattaaaggagcaaaagaaaatcaaggtgaaaatactcactttggcattttagagtcaataaagaattatataatttataaaaattcaaggctggaggcggtggctcaagcctgtaatcccagcactttgggaggccaaggcgggcggattatgaggtcaggagatcaagaccatcctgcctaacatggtgaaaccccatctctactaaaaatacaaaaaaattagccaggcatggtagcgggtgcctgtagtctcagctacttgggaggctgaggcagcagaatggcgtgaacccgggtggcggagcttgcagtgagccaagatcacgccactacactccagcctgggtgacagagcaagacactgtctcaaaaaaaaaaaaaaaagaatcaaatggaatcctgcctaaattaaagctgggctttagatgtagcagcattatactgcctgttgccactgctgcttctctttgtttacttactaatattaaaggaagtctgtattgaaatcctcaagatcctaaagccatgtttatgttttcataactcagttatagggaaaaaataggagtgcaaggaggggactatgagaacgtcaaatagattggggcagtttacattctcatacgttctataaattagttccagagagagtagtttcatacataaaactacagcatttatactttagagcaccctcacttagggaggtttttattaaagtgtttggacttactggattttacattttatttgaatttagaactgtaattttaggtgtcagtgatggaacattattagacactcatgtcatcattttcaatctgttgcatatatttttctttgataggtctttacatctggtgttcacatttattacagcttgcatattaccttactccttgcaaccagttttctgccttaccacattttaagcttctcatgaatgcttactatttttactcatctacatattctcagtgcctccaaaagtttctttacatgtagatgttcaccatgttattgaatgagaaactcctgaaataaagctaattgatggttctcagactagatagcacattaaaatcatctggggagcttttaaaaaatccctgtgccatggcttcacccccggagacctcagcttcattgtttacggatggggctttgcacaggattccttttaacacttcccaggtggctccaatatgcagctacaggtgaatatgccgctacagtgaatagctacgtgtgaatatcagcaacaagtaagagacacgttagctctttcttctgagccattggcagtaagctcttttccttttgaacttagatatgtaccttctttgaatttctttttatgcttatatgttctaattaattgaagcagttattttatttgcctttacttcaaatgaaaactacatgcacatagttgcaatttggaaggagaccatttatcagactccttgcatctctctgagcctgcagctggtggacacggcaatatcagctttgttactgaaattaaacggatttggacaccaccacttgccctacagccacatgggctttctaatgttctgctgatttaccactgaatttgaaaaaagtcgtaggtgtaccctcacactgagggagtcactctgtgtcccaggtgagcttaccacatagaaaaccccatacacctgctttgtgggcaagccaaggaaagagagggcctgatctatgcctgctcagttcctactgccagatttttcatccctcccctgtacaaaacaagagatgcattgcctacctcttttcctcccaacacacatacacactacttaaaacaaataatgttagaggcaagcatttgaatatttagctcggtctatttttctcctcttagaaactttttaagatcttttctttattcctggtatttaaaaatttacagtcatctgccatgacttaggtcatttcttatttcgtatacatattctcagtagaatcttccctttagagatagatgtgtgccttccagttttccagtcaaagaaatagaagaacactatttcttttcttccactgtccatattatccttctggaaagatagttgttggaacctctattttaattgtctgagaatgtatcttttttgttctcctcttctctttttgcttttttctactttctgggaaatttctgtcaacttacattctaactgcattacggttactttttcatcataagttggtgttgtatagttgtattccacttttcctcttcctattaatgcaatttttttttaactttcagttcctgtgatacatgtgctgaatgtgtaggtttgttacattgatatacatgtgtcatggtggtttgctgcacctgtcaacccgtcatctaggttttaagccccacacgcattaggtatttgtcctaatgctgtccctgtcctgtctcaccacaccccagtaggccccggtatgtgatgttccctgccctgtgtccacgcattctcattgttgaactcccacttacgagtgagaacatgcggtgtttggttttctgttcccgtgttagtttgctgagaatgatggtttccagcttcatccatgtccctgcaaaggacatgaactcattctttttatggctgcatagtaaagtttttatttagcctttttgtagtataatttacatagttcaggagtcctgtcccctcatcactctacatcatctcaggtttgttctgtttcctcccttcccttcctttctttcttcctccctcctttttgtgtcttttcgatagaaatcagattcaagtgtgtgctgatcatttgccattctctcgtattaagagtggcaattggaagccagttggaagctcggtaagggtaagggtttactgtttgatgacaatcactgtggggtgatagttgagtttttcattagggaattcttgatattattaatacatgaatgtctttcctgagaagttgtcctgtttctccagggaaaaatattctttctctgtattatcaaattctaatattagggtcaggtatgggaagtgaaggaaagagactagaaatgctactgttcagcttagaaacttgaacttaaggccccaaacatttcttctgcccttggctgggccctaagtctctgagtatccagtgtatccccagagaatgaacctatctcctgtgagttgtctgttgataccaggcagggcaggtacgtgcgtatccatcattctgtatacttacagttaatcagttcccctggttttagctttggactttatccacacattttgtggtacttggtttctccaagttgtgacacttccacgggttctatgacaatttgtgccttcgaattgggggtacacagaccatttatatttaatgtggttacagatacgcttatgtaaatctctcctgttgctatttgtttactatttgctccatctctttttttcctttatttctggctctcttgggattttttttaatattcaattttctatcctttattgagttatcagctattctttttcaatgtgttacttcagtggttcctttggggtttatggcacacaggcttacctcattttattgtgcttcactttattgtgtttcacagatactgcattttttacaaactgaaggactgtgtcagtgctgcatcgagctaggcgatcagcatcattttttccatagcacatgctcagttggtgtctttgtgtcacattttggtaattcttgtagcttctcaaactttttcattattgtacctcttatggtgatttatgatcagggatctttgatattacaattctatttatcttggggttccatgaatcaagcccataagagaaggcaaacttaaatgataaatgttgtgtgtgttgactgcttcaccaactagctgttcccccatctctctcacttttatctggctttcctattccctgaaacgcagtgatacttaaatgaggccaactaatgacctacaatggcttccaagtgttcacgtgacaagaaggattgcgtatctctcactttcaatcaaaaactagacatgattaagcttaatgaggaaggcatttcaaaagctgggataagctgaaagctaggcttcttataccaaacatttatccaagttgtgaatgcaaaggaaaagttgaaggaaattaaaagtgctactccagtgaacacatgaataataggaaacaaaacagccttaatgcggttatggagaaagtttgagtagtctggatagaagataaaacaagctgcaacatttcctcaagccaaagcctaatccatacaaggtcctaactctcttcagttctttgaaggctgagagaggtgaggaagctgcagaagaaaagcttgaagccagcagaggttggttcattagatttaaggaaagaaaccatctttataacataaaagcaaggtgaagcaggaagtgctgatgtggcgacagcaaggtgtccacatgtgatctagctaagatcgttgaaggtggctacaataaacaatagattttcaatgtagatgaaacaggcttctattggaaaaatatgtcatctaggaattccatagctagagtggagaagttaatgcctggcttcaaagtttcaaaggacacatgaactgtcttgttaggtactaatgctgctggtgactctgagttgaaggcaatcctgatttaccatgctgaaaaacctagggccgttaagaattatactaaatctactttgcctgtgccctgtaaatggaacaacaaagcctggatgacagcacatctgtttatagcatcatttactgaatattttaagccacttttgagttctgttgctcaaaacaaacaaacaaaaaaagacttctctgaaattattactgatcactgacaatgcacttggtcacccaagatctccgatggagatggacaagattagtgttgttttcatgcctgctaacaaaacatctattctgcagcacacagatcaaggagtaattatgactctcaagtcatattatttcaaaaatacattttgtaaggctatagctgatggagctaggcaaagtaaattgaaaaccttctggaaaggattaatttattctacatgccattaagaacatctgtgattcagggaaggaggtcaaaatagcaacattaacaggagtttggaagaagttgattctaaacctcatggataacttgaaaggattcaaatttcaacagaagaagtagctgcaggtataatggaaatagcaagataactagaaatattaatagaagtagagcctgaataagtgattgaattgctgcaatctcatgatcaaatttgaatgtatggggcgtttgctttgcttcctatggatcagcaaataaactgtttcttgagatggaatctactcctggagaagatgctgtgaacattgttgaaatgacaacaaagactttagaaaatacataaacttagttgataaagctgtgtcacggtttgggaggattgattccaattttgaaagaagttctatgggtaaaatgctatcatatagcatcatatgctatagataaatctttcctgaaagaaagagtccattgatgtggcaaacttcattgctgtgttattttaagaaattgccacagccatctcaaccttcagcaagcaccaccctgatcagtcagcagccatcaacactgaggcaagaccctccaccagaaaaaagattatgactcattgaagacttaaatccatagaatttttgagcaatacagcactcttcaattaaggtatatacattttttaagacatcatgctatagcacacttaatagaactacagtatagtatacacataacaacatttttagaaactgggaaacaaatttgtgtgacttgctttgttgaaatatttgcatgattgcagtgatctgcatctgaacctgcaatatcccccaggtatgactgcacttacacacttaggcatactatacctatgttatcacagtctttcttcacctgatagtatatactatcttttactgcagtctatcttcaagcggtactgtatcacttcacatagatgagttttcagcttaataatcaagcagaaccctatgaagttctctgcatgtgtctctgtacaggtctctcctttttgatttttgcccttttgaattcttaacctccctggatttccagctctgtccttcaacagagggagacctccaggcagtgccaggtttccttccctgagctgcacctgagagattctctttagtcattaaagtgggggccattgtattgctcagttgttttccatctctcaagaatcactgtcctttgttgctagataaccaatgtcttgataaccattgtatcaaatattttatctgcttttttagttgtttcaggagagagtataaatctagttctctgttgctccatcttggctgaaagcaaattacacagtaattgacataagaatgtgttgtttcttcttctctgatgtctcctttcatttccctttgttcttgttggtttacaccttttaaaaaaaatgcattgctgtcactttaatggtatttcaggagagaggtggattccagaaagagaactgatggtggattgatcacatgcatttacatctccataatacttctcactaactatggctgacatttgagaccagagctgacatttgagatgagattttttttccatttttagtattactggtaaatttaatagaaaaggattaatgaacacaatttgttagctgttaacctccacgactgaattatttttacagatataaaaataccttctaagttgcacacagatcttggaacataacacgacaaatccaatttatgttcactgatgagcaagaattatttttatccactttttatatgtctatgtgtataatcctaaaaatctagcatgtggcccaaggcaagtcaacttgaggacatgtttccctttgtcacattaattacttcaaatattacttccctgctatgtttttgtaagcatctgtgactatacaacaatgaataaggcatagtcgttatcttcaaattctttataatttcgattctaagggtatgttagatgagtgaattccacattacctgtcttatgacccaaagtaacgtttatcaaatggtgctagagatatctacaagatgttcctgggatacagagagggaaccaggcttggagtatcatgctgaccaaaagctacagggaatctggagaaggggacccacaaacagatcctcagagtacaaacgagggttagagagaaggggggacgtgtttcccagcagaaggaaatacatctgcagagaaagagagctgtgaaggataacagcatacctcccagccattagtgtgcgggtgctgagggaggcaggagcgcaggccagaggccatcactctcttggggaagaaggcactgattccttgggaaagataacttctgtgaactttgacacacgttatagaaagctgtcatatttgtaatctaagaaagagtgtgagacccttagtcagcaatgaattaagaaatgaattaggaatagaaactaagaaaaggaacagtttgcttcttttaaaacattaaagttgatcttacagtctttgtctctgaagcatgcagttcatgccaaaactccaaagtcctcattttaaaagcttgagattattgggcattccttgcactaattttaatcttattgaatgtgtttttattaaatcagcattcatgttgatcaaaacttgaaatttgtacaaatcatttcttcatgcctttctcagaatagttctccttgtagagaaggttggaattgtctaagtatgtgaagcgaacttctataaaaaatgttttgaaaatttttaaacattgtattaatcattcacagtgatgtgaatctgtcatagattaaaaacctggggatgttcaaaatgataatatcatcctgtgaaaagtctaattttgtttctgagttgctgaaaaacaaaataggggattattctaatagtatctaatttggttcctgattacctcatcttgaatattcacaatcatgtatgtctgagtgcaacataaacattagtatgagatgtcatttttctattctgagctatttttagggcaggtttattattttgtaagcaaaaaggataatttatcattgaatcccaagccctaaaatgccaactcctagaaagatgcatgtttctatttaaagctcttcaatacaggatgacaatctctgatgcaatgtaatgcgaacagcatatagtaaatattaattgagtgatttaatgatgtatttcctgagagtatttggcaaataaggatggaagaaatttgtctatctaagatttgagcatttgttaaaggtaagcgtctaatgagttagcttgcctaaatgttccagtgtatgcttttcattgcagttttcagtcatttactgcccccaactctgaaaaacatttttaataaaaagtgctgcaggagcaggagattagaaagaccttcacacccatgccaaagttgaaatttccctgcaggcaacggccatgaaggtaccccctagaaatctttgtttatcgtatgaaatctcttacttctcttcgtagttacctgctctgtgaaaaccacatgcctaggaaggttgtttttttgtttgtttgtttgttgttttttgacaaggagtctcactctgtcatccaggctggagtgcagtggcagtgcagtcttggctcactgcaacctctgcctcccaggttcaagtgattcccctccctcagcctcccaagtaggtgggactatcggcttacactaccatacctggctaacttttgcatttttagtagagatggggtttcactgtgttggcccaagctggtcccgaactcctgacctcaggagatccacctactttggtctcccaaagtggtaggattccaggtgtgagccaccacacctggctggcctagctagttattaataatagtgttctggtcactcactgtggcagtgaaaaaacaacttgaagatttcactgggacccaggcacattttctaagtgtctagaaactaagtatctaaggacactttgctgatatagagacagtcaagaatataactgtttcagccaaagattgtccatgcattacaacatacgtcaaattagaaaatgcaagttaagttctctgagtacatagtgaacactcagtaagtatggtatgtacatacatatgcatcatggaaccagagccattagctcttaagtgtatcacatcagtgtatgaattgtgctaagaagcagctttgtctcacaattaaaaactgaataggaaatgaactcttttgcctcccctctctttacagaccattcttacgatagggtaatgtatttcctgttttaggaaattgcttggtgaggaatacttactagagagccccaatattattaatagattataatccagagtttatttctaggggttttattttgaaaggaaaaccacgtcctcccattgaagctctgttacatacgcatagcaggctcccagagcagtccacagaatcctgcttagctcatattgtggctgagcatagcactgatcacatagcatcttcctaggtatatattaggtaacaaagattctcaggggaaatgcactcagctgccttcctggaatgctaggaatacatatgactttccttttgacaatgacagcctctacaccaagaccttctggggagaggggactttacagctaggtcatggaggttgtttaggggtgaggaacggtggtgatttctgcacctctgccacagaaacttgcaggatgctcctaatcaggctggctgcctgttcacatgcccttccctttgattccaggagatcagtgattgccctttctctggggttccactcactccagcccggagcctgtttccttagtccacagtagcaggaaacagaatttcttagcttctctattctttggaagaaggcaaagggacaaatgtgataagaatgggtctcttgtatgtccaaagatagagtgtaagatctgctgatattgtggagaaaagcttataccctgtaagataaatctgcattttttatttttgaagcaggaagcttggcatgggatgagggacaggaaaaaaaaaaaaagcatagcgaatgccatggtccagtgtaggttgcatatagggctaatcctggggctctggctaggagcagcctccttgccaccacagccctggcagcacagacacagatggggaattgagttgaaaggcaggactgagtgagcgaagcaggagatgatgagtaccgcgcaattatcagtatattttgcagagcaagaaatgaggaaaggaaagccctctgagtggtatctgagagatgggaaggagtgatggtcctttccaatggtgggtgaaaagtaaggaagtcttctagtgaccagagtctggggcctgactgtcatagaaaccagagcagggcctctctgccccatgaccacacagaatgtgcatctagagcaaattcttctagggtgacaactctgatggccttgctgttgtatgcatacatgctgttgtataaaaccagtgtccacatcacgggcacagagggttactgtttcgtactgttaattcaaccgaagtgtgataggatacctgtttctgatataaaagctttcttccttaccagtaaaatttgacacctcaaagaatgattaggatactttgtatccctctccctcttttcgactgtaagttctttgtgtataactggtaagacaacttctattaagctctggttatgggcagggactctgtgatcagaggtacagtttctgtgttcaaggatgaaggacatccaggtagattgacctattataatatggtcccatgatctagggatgtgcccgatactcagggagcacaggggaagcactgaggggaagagaagacagaaaaggctcccacttgaacttactttgaaggatgaagaggtgttagcccatcgtcaggaaatcgaggtagcaaaggccagtccaagcaaagggaacatcataattcattttggttacaaaggtgtggagtgagattgggcagctgcatattgtctcttaagtctggcacatcagctaggcaaggagtgacgagacacgggcaggggccggaggagtctacaaagataaatgtgcctgtatcatcttacaccagtgaggaaatctgttttatattttacagtctctttcagatgatatataaagttgaggcactttctgatgtcgtggattgcttagatggaacctcaattttgtttatattcacaagctttgaaaacttctaaatatagcagtttatagaagatacagtaaattcgttgaattgaaccaaaccacacttaactatcatattggagattaattataaaggactggttttgtttgctgtttttcaggtaccatgatcaacaggatgttactagcaacttccttggagcgatgtggttgatatcaataacttttctctccattggttatggtgacatggtacctaacacatactgtggaaaaggagtctgcttacttactggaattatggtaagtgtctttatacttcacatctcttttatttacgctcaagaaggcacttaaaccactcagtccacgtgcataagtaattgtgagctacttcttttcccatcagcaggaaatcagtataaataaatcaattttgtgttgagagagaatgtcaacagttttcctcttaattcttctcatcatgaaattctgttgaagaggtagagctgtttgattgccccttgtggggcatgcactaatttgataaactaatttgatcttggagctttggcttcagaatcaggaagtcctttaagactgtgtcctcccatctcctactagctgtgcaaatttgagtaaattgtaaaatatagcccataataactatcttgaaatgtgttgaagggtagaagatatattaattataatatttatttttctttcttttaacaaatgtttgttgagtgctaggcactggcctaggtactaggaatacatcaaaagaagatagaaacttactgccctgccttcatggagcttacaagggaagacttgcattttaaaaataataaataatggttcattacatttgtgaactagtaaagcttctgacctgttttgggcctgggggagagggatgggatctactcagagaaatcatcactagaaaattgatttttacgctgaagtgagaagggtccatacccaggaagggaagtagggagagcattccaggaagaggaaatggtgtatttgaaggcaatgaggcaagaaggagctcagtacagtggagccaggtcattgggccaggagtacacagagcaaaaggggagagcggcctggcatgaggcagggacaggaggccacgtcttgtggagcacttgggaaaggtctgctactgacatgccatcgttcttctggcatgcctcataggctcagacatcttttttgcccctccacacatgactagccaggaccacttttttgctccatttgttttttaggtataggaaatgggaggctagcaagctgtgattataatgtggtatgaacttctaaatatttaagccagaggtagtttcaaattgttgatgcacagttttcaatgacctaggcttgtctgcattctttatctactttttaaagtttgcttacagcaaagagtgtcatcttgatccttgtgtggtttctgtctacatgaggatgtgaacgagtactgcaggttccaaattgtcagaatttctgaaatcaggtaccctgttcaacacctctaactgtattcacccacaggctggtaggagagagcagagggttgtcatttgagggcctctgagtggtggccagtggagggtgcacacctttgcagaagctgcctgggaagactgctccaagagtcacagctaagtggaaggagagcgtgcccttggcatagacaggcaacatccttctcccccctcggtagtgttcaactgggataaggcagctaactttgaaaataagaatccagggtcaattttaatgtcccagtagtaacaagatggccatttcaagtcccaattgtagaaaatatagtttgggggcataatttaacattatttgcctttaaaagaaaaataatagttttaattatagtgaactttaaaaaaaaaaacggtatgctgcattatctgtttgtttactattggatcacttccccttttttcctcaaataatagcattttattatgtggtataatgctttgggaaatgtaatttgcatagattatttttaggaggcccataacaagtccacaagggatataaatgatgctatttataaaaactagtaattgcagagtctttcccctagtgcttcttagaaacaacttccttagtgttactttttgtcaagatggtaccctcttttattctccaatcaggtgtgactcaagggtcatgtgcacaggcttatttgccatggaatctgagccaaatttgaggttaaccttgcctgggttttacaaaatgtttatcgttccttgatattttcttgttcctcgtgtctcaaaaactgttccttcaaagtctcatcagatagtacaaatcttttatttaccttcttgaactgcctcttgctcaggtttcactactgatcttactttgcttaaaaaagagaggttatggcctggcactgtgtcccacgcctgtaatcccaacactttgggaggccgaggcaggtggatcacctgaggttgggagttcgagaccaacctgaccaacatggagaaaccccctctctactaaaaatacagaattagccaggtgtggtggcacatgcctataatcccagctattcaggaggctgaggcaggagaatctcttgaacgtgggaggcggaggttgcagtgagccgagattgcgccatggcactctagcctgggcaacaagagtgaaactccatcatctcaaaaaaaaaaaaagagagaggttatagtaccattaaatatatgtggacacaaaaatgttatatgtaatggaatttatggtgacttcgttccagcccttaagcttatggtaaaagagtccctctattcttaggctgaggagctccattccctctccttcataaggatcagacttatttcctaattaattgacttgatcaaaattggtttacttgcatacagagaaattcactaatatttgagtaacatatttgagatgctctgtagagttggattatctcttcttctagactaagcagattcccatggagtcaggctacggggcagtcttcctgggattcacttctggcagttgattacatcttacatcagctccttagggatcaagagcatatggatgaaagtgacctagacactcctatggagaatgtagaaatttcttcattaccaagaccaatatgggaattaaagcttaagagaccaagatctcttattattatttttataaaataagtcatgagattgcctaatagaagaaataaaagaaaaccactcactacccttcaagagaaaaccattatggttgtaattacttattttctctttttattcttctacccttctgctatttgaggaagtactgaagacctgagggtttactattgtaaaggtcatgataaacaatgggatgatttctgagtagctttgtacttttggttgaagatggtaggcaagtaatatggttagatcacagtgtctatcagcttttggacagcaccagctagtttctcaatgtctccaattttccaataaagtaattgttttacttagcatttacaaagttattttatcttcctagaaatatatatatatatatataaaacacatcctgaaagctatgaattctcccacaactatgaatatatatgattgtttcaagagtgaaaaatagccttgtgggtaagggtatctttcatcttatactggaattaaggttgctcatttgttctttttgcttctctatttctgtaaaattacagtgactcttggtggccttttgactagagtatggatgactggattttttggtttaattatctttaaatatcgagtaatatctgttcattcctagggatgcaggttgttattcaataaatggttctctaatagtgatttataaaccactagactttgacaacatctagcatgactccctcaacaaaactgaggacacttcagatatcagtgatttaggtttcttccatcccactagtagttctatgtaaacaaaagcaatgcgtaaagctttcgcagttcatagcaatttgaaaatcactacgctaattaaattttaaaattttcttcaaggagcaaaaaaacaagtcagttcaggacagaagcctttacacagccttgccttttccttaagatttgataataatcctttccacgttaaatttgccctgtgccgaggaaatcttaatttaacatcacatggtgactccattagttgtcagttaaacaaacagtttgcatcctgaagagcaaaaacactaccctgttaagtcgctaagagggtgttccaaaacagcacgaattagctagagctcataaaaaagaagtgattggtatgaaagaatgcgaaacctaaggtctgattatactcctcttcctgtaacactctctgtttccatttgaggatttgttttcccccgccagtgtacatagaaatcctgcaaaactgatctgaagccattccttagtgttgaatgtttgagaatgtgcaaaacactcaaggatttttaaaaatgtcttacacaatttgacattgggtgtttaattttgaagaggttttaacttttgtattgcttgctttttggttctttctggtgcgttcactgaatctcatcagataaagccccagtgaagagagtatatctttaagttcttacatacaatagtttctattttgtgcagagcagctggaggagatgggccttttcagtcataaggctaaattccccaccaatgtcctttcttgaggaccttcacttcccaccaagaaatttcataagtggatcgcaaaaaaatgtcttaaatatgacagctgccgtcttccgggtacaggaaagtataggtggaagttgttgtgaccttttagcacacagctcatggactccacaatttcacccaatttttctaaactatcagcacttttaattggcagagctgcccttcctatctctgaagtacctgcactcacactggcactgttgctaatcaggagatttaaaccgagggatgattcattgttgatgaccagttttatgaggtacttccttctttctgaccctaaaagtagaagaatgacctgaacaagcaaatcactataaaggaggctcgggttgcccaggcccaggcttaataactgggctcaaacaccacacactctcccctcttttcttacaatgaggacatttgaaattgacctccacccttagtagcaaatatcaacttgtatttgaagacacttagagggcatttttgatagaatttgtcatcaaaacttccttgaaacttatttattttcatgacctgaggaaaccttgtaaaactccaatgggatataatattaaagcagagtgctttataaaatgttacttgccagaattgattgtttcacatgtttttatgaaagaataattatttatgtcagtcaagtatagtaaaaatgtttttatggttctggcacattgagtcagtcagccccagggacagaaaaacaggcaatgtgttcaagtatttgttttaccttccttttggagggcaagctgatttgtgaaagatcttaaagctgttttatttttacataaaagcgtgattttttttcaagttaactattttggataaattttaattataggctaatagtctatttagtctaataaactggctgtcaaactgaattttgaactttgaggagcaggagctattataaatcccacaggaggatactttaagcctagaatattttgaacattagtgttttttatcagagccattctctgtagcagtaaaaattctggaatttgtttaaaaagtataaatttcattattatgttgaatcttttgaagatgtctttttcacagttgaaataatcaaaacctttccacagtgtgttatgtgaaggaatttctctttttcataggcttgtatccttgttattaaagcttgatcccaaaatggtttttcaaaatgattcttggaagtatttgcaggatcagcataagtagatgatttagggcaaaaatgtgtcacattttaatttttcaaatattatgtgatacatgcttttgagggaaatgggatacctgaacttcttttacatccaagggctcaacatggcttacagtttctgcgctataatggagaagaatacagtggagaaaaacactacattttaattttaacttggcagcatctaagactatccacgtgttgggatttccctagaggtacataggtaatagtaactaattgtcatttgtctgttcagtttaatctggcttggcttagggtagtaaacgttaacaacacttgtcattacttaccttttctaaagcaaagtccttctccctctgccccccttaacttatccctttttctctctttcaccatcttctctgttagaaggaaagatgataaacaagccaagcgaaacctgaacctttgcttttaatatattgacttcctaaatacactgtattttcttcattttgtttttaaatgcccaagcatcttgaagtgacaggttagtgattttgcttaagttttttctaagaagataaatgaaatgagagaaaagtaaccaggatacattttctgactttggtgaaaggaatatgactcatcttgttaaatgcatacagggatcttaatttcagagagtaacatatgttagtcccaactgtttctacatcgattgtggtggtgacaagctttggagaaaatgttgtaaaatcgtacttatttccattcttattcactttatgaaacggaatcgtcctggaaatagacactgggtggacaataatattatgccattacttaaattactataaccatgaatatgttggcaggaatttaccttgaacctagaaagctttcggaagtgagccagcttcatcttgcataactctaaaaattaaaaaataaaggttactttcatcagattctcttacgatttattaatctagggaagtataagtttatggttttcttcactaaaataaacagttaaggggtttgtatttgaacaaaaaggtttctaagtggctctggaggtataacttaaaggagtagtgttaggataatggagtgaggtatatagataatagttttgataattactaaatgattggattaatttcttttccactttgcaacagaggtactcatttttaatgcatgtcttagatgacacccggtgagaaatgggccagtagcagaaaagaatggagcctgagaataaacacaaataaaaatccactttccaaggctcttgattccagtgattttccactcctgttaggattttgatttctttccagaaagatctcagcagaggccacctgccaggggagaacaatattcaactttttatgccaactaccctctcatagctgtctctgcagtagttaggaacccctcaggtttttatgacctctgcttattaaagaatcattgctgccctgaaccaccaagttcctgtagaacccagtgattgaggagtagtacctaggagcatatctacaaaaggctagcctgtgtttgtcgagcatacgctataccatacagcaggtagctttatggtggttatcataggtggtcactgatttggtttcatcagcctgctagaactctttctttagacttcatggtagatgtttgaaagtcagtaaaatgggtagagatgcttccaaaggccattcttttctttcattagtacccagatctaaaatacctcgctttcattgtctgcatatggcacaaaatatcaaaataacatcacaccctctgcctttactttccttgtttatcgtgtcttcataagtcagtcaaatgactcttataagaattttgaccctcttgttttaataggtttatggagtttgtcatagtcactgcatatcctcctttatctaaagcagtgactataccttgggatcacctggagagcttttaaaaaatttcagacacctgggttttatccctggagatgaagatttgctgtgaggcacacagctctcagcactaggatttttacaaactctccaagtgattctatagtcaaggttaaaaactaccaatttaaaagttataccagttacacaatagggacaatgttgattattttgataatcatattgcttgatttttagacattcatactttatcatataaaataggtgaatttgaatttcctgtcttgctttgaaatacagtgcttcataatgcattatggctatggaataatcacaaataagaatatacagtcatcccttagtatccatgggggttcagttccagaaccccacttcctgccatgaataccaaaattcacggatgctcaagtcctttataaaatagtgtattacttgcatgtaacctaggtacatcctcctgtgtactttaatctctagattacttataatacttttaatacaatataaatgctctgcaaatagttgctaaacagtattgttattgtttaaagaataattacaaaagaaaacggtctataatgttcagtacaggtgcagccatccatttttttactgaaatattttcaatccagttgaattcatgtatacggaacccatggatatagagattcaagtgtatgtgatcctaaatatagatatagatattatgagatgaagtaaagagtaggaaaaatatcaatgctaatcaaagtttataactgaataatcatttactctgctttagttgtctcatctctaaaatcagaaggctaaatcagaatgtctaaatacttggcaacctctttctctgatcatgtgatcagtagcactttctttctgaggatactgatttcttcatagaactagatggaacaggctatttaagccctctggaaatatattaaagcagtattggctcatcattgtggcaatgtttccatgatcataatgatcaggtcgtgtatttattttctccttttctcctcaatcgtgtccctcctgccagatttgttgcagcaactcattgagtaagcccaaagatggattctttggtctataactgaatagctaaatcacatctactttctgtgcctctgtctagcggactctgcctgtgccctgccatttacattgttatctgtttgttgagactagctgggcaatgtctatggttctgtggtcctctcagggttgagattctatctggaggtgtgacttccctttcacagacccctgaggtagttcctcacatgcccccttccctgctgggaggttggctgtgcccaggactgatgaattggctgcagcaccttgaccttgcctggaccctccaatcggtgccccagcaagtagttgctcgtctttcagcacagaagactctcacaacttggaatgagcacaccttgatcacggagcgggaggactgtaattcttagagtaccacacagagtctctttttcaagagatcagaacaatggtctgtaattcaaaaaggaacactgttggttttttcaaaatgaagatgacccgtgcctttcctagtgtcatgttagtaaacctgtaaaatggtataatggttaccccttaccttcagtacttcatctatctctgttgcccaggttaagatcactgtgatcttcctgttacgcttcctcttgtgtgtgtggaacactgaagcagtgtatatgctgagataatttattgtttttattcctggtgcattgcagttgatcaccttgaaggcctgctgatctcatcttaagattagaggtttattctgtatggaaaaatccttatttctaccccatatacatttatgctaatctactcatttgttatttgttcctattataattataggtatataactgacttgctctgttttttaaaaagtctccaaaaattcaccaagttgcttttaggccatttatttcttagaatggaaatgttttttccaaatatgcttttgttcttaaaatatgtaaactaaatttttaatcccagtttaaggcacattgcttacatgtgttgatcacacattttctgtaatacttattgaagacaatgtttttaatcctgagaaacttttgcatttgatgcaaaacattttctaatgtgtctgagacagaaagtagttagtaatgctttgggtttctcttctctccttgttttcagggtgctggttgcacagccctggtggtagctgtagtggcaaggaagctagaacttaccaaagcagaaaaacacgtgcacaatttcatgatggatactcagctgactaaaagagtaagttactatccatatatcttcaaagagaatattattgtgattttttcagtgttaggaaatatggtttttattttgacatccgaagctgaaatgacatggtttgaaagtataggcattcttggaatcacttccattttatcacattttgagaatagactatttctaccttgaggtcagttaggaagtaattgggcagtcttggtatttggataaagacgagtcacataaatgttaggtatgcctacttgtttagatttcagtatagtatatgaggccaattcttggattgagtaggaaggaaaatactattaatgtaaaatagtaatttgatggaaacgtgattgaaaatgttttactgaacttctaagatcaagtcactgttctcaagacagggttgcaaagacaaaagaaaccaccactaacttttagaagcccaagatagggccagaaacaggctctttccttgacttacaggccataaaagagatgttaaaaatagtataccatccagttgggcaatcgctgtccaaatattagcagaagaaaacagtaatcacaatgtttaagagcactttctgtgccaggcactgttccaagtgtgccatgtgtataaactcacttcatcctcataacagcgttatgagggaagtgctattattctggccattttataaatgtggaaactaagacacaaaggggttaggtaacttgctcaaagtcaccagatccaggtagaaaactgcaagaagagaaaggtttttattagactaaatttttagcctttcttgatagtcacttgagacaaataccaaagtcaaaaaattattttatagtagagtcatcttgctgtgtaactactgctcaatgtggaatgcaatcaggctgtcagtgaaataacaaaatacattgtcaacttggtaactttacccataaatgaatcaatagatatttcaagcatagttccaacttccagtagtgttttcactcactcttgattttggttgtatatttaaaagtaatcttgtttaatttggttgatacttcctaacaggccagtcattttaatgcaaatatatatttatatagattatacttaggaaatgaaaacatgaattgctattgcctgctcatgctaagtcttacctatcagacagtcctgtgatacttcattgcagttagtaggtccacgtttatagtagatggtcagagcctcccaggttcagatgctacattttcagcctacatttaccactttggaatgtcttctactctccatgacttactctcattttcttcaaactcctaaatttgttctcaaaacttgtgaacatccctgtatgagagtgtgcagggaaaaaggtcaatgaggagctgaataaaggcttgggtttcttttactttttaaagatctactagagataaaaatatgtgcatatgagattagactacatctaatccataaattggagcagatgttttgtgtatttcatcatgtgcatgtttggtcctttcagggctctatgctgggacaatttgtgtttaagagtcacaagttttataatattcaaaagaacacttgcattaagacccttgtaatccatattattttaccatgaagattatacatttcctcaggaattaagttaatgccacacttaagatattagggagaaaaataccttaaaataccatgtcgcccatatgtttgcctgtaaatcttaacagaaaaaaaaaaagtgacagaatcacaaataagaaagccaagttagcatgtttgggcagacttctccatgtttcataagcagattttaatttcatcttaagaaggaagcatatagtttctctaaatattactttggaatattgatattccatatcttaattattaaaacattttaagagttagaaaagacaaagagttagaaaagacaaagactttgagtacaaaatttacagtatcacactgccatctaccacctttgataaaaatttttttatgaagttcaccgaggtcaaccagtttcatttgggagacattccaagttggttttatagtgtagttgctgtattccagggcctctcaaccttggcactcgtgacttttttggctgaataattctttttcatgtgggactgtcctgtgtgttctggatgtttctcaccatacttgacttctacacactagatgccagtagcactacccccaacttgtgacaaccagaaatccctcaagagacaaaatcacctgcaggagagaaccaccttttaatgtgctgttccacaaggatttgacatcttagaaaggacagtctctcttaaaagatactgagtctactgaatatattgtaatttccttttttggaataacatataaaaaatatactgtatactaaatatggttgtcatgctatgttaactgttaaggatcaagagctaaagaatcacattcgagtattccaaagattttaagcttttccagtactgaccactcagaaaatcagacgaaatctcagatgcttcctgcttggcagaaaaatgcacgtgtgcttgtgctcatgggtcccctaaagtccggtcagaggcccctttagagaactatggatccaggatctagatctatggattttggtgaccctccttcagtttttatgaatgaaaagcatcttcccaaactgacaaagttttctgatgatgctacagcttttttgttgtaagttcttgtatactttaaacttcctttggataatgttgcctgaattgtcaacttattgcctgttgaaagctttttcattaagtactgttctggtttcaaattttacattttatataatacttaccatgctttaataattctgttatttcattactacttttttttttaaattatactttaagttttagggtacatgtgcacattgtgcaggttagttacatatgtatacatgtgccatgctggtgcgctgcacccactaactcgtcatctagcattaggtatatctcccaatgctatccctccccccaccccaccacagtccccagagtgtgatattccccttcctgtgtccatgtccaacaatgatagactggattaagaaaatgtggcacatatacaccatggaatactatgcagccataaaaaatgatgagttcattactactttttaaaagtagaactactttgcagtatttcttgagactggagtctcttgagaccggagtctcttataggtctgagaaatatactctagtaggcttgctgacagatccatttttttttttttttggagatggagttttgctcttgttgcccaggctgcagtacagtggcgcaacctccacctcctggattcaagtgattctcctgcctcagccccccaaatagctgggattacaggcatgcaccaccatgcccagctaattttttgtatttttagtggagatgggggtttctccatgttggtcaggctggtctggaactcccgacctcaggtgatccgcctgccttagcctcccaaagtgctgggattacaggcgtgagccaccgcacctggccgacagatccatttagtgacatccaagatgtcactaaataaagatattaatgttaaaatgacactagaagaaaacagattgctggtttataatacccattcctgtattatatatactcaacaaggtataggcaaataatagccattttatagtcctctcattattttatacaaagtcatcaacttaatgagtatcatttacttggaatttgattccatttgcttatttatggaaattccaaatggactcatataaatgagtataaactttaaacttttaaaataattctaaaatgctgaatgatttgtgaataattaaaagtaaatagagatctaaaaaccatacctagtaactaagatacaaactcaaggttactacatattgttagagaaaaatacaactattccctgaaacattatctagaaagaaatcattttttctgatggttaacaggagtaatagtcacagatgttctgaaatctgaatatgactctaaagaaaaaagcaatatgaatgttaaaagatagtctgttctcccaggaacagatgtaacattccaagtcttccagtttgtatctttagtgaactgaacaatttctgtgaaaaattattcactatgtacagattttcaggggaacaattttatataaaagttgtttctctgtatgactacattaaccaagtaaaatactgtatttgaaagtagaatactatttattgtacatcagcactgagaagattgttttgtctaatcctaaatatttacatgacattctgcaattcaaaaatggccgacaggtacatgtgtccagaacaaactaatgattttgaagtgaaaacataataccattaccttgtctcctagtttagtaagacaggaccagctatttaatagatttacagtttatcaccttacaggggcaatatatttaccatgcaatatcttttggaaatatattattattactgctcattccattctgagcaaacaggaaatcttgtagtttgatccccagaatacctttttggaaaagaaacttgaaaacaagcaattccaaaacccagacataatttttaaagttgctagataccccacaaaggataattatacatattaatgtccactgtgggtgttgttaatctgttaagaattctcaatcagatccataataagaacactattatgcagttatataattttgtttcctgtatgtctcttaacaagggaacagaaattctaaaggatttatttcacattgtccttggctcacagcccagggggttaacacattaaaatgaatcacttggctatgccctgttccacagctacaacattcacccaggcctcatacacctgacctaaaggaaaactggagagagaggttggagcatgaacaaatctatccctgctgctgcaagggtggttgagagcatatggcaccctggtgcattccccttgaattggcgaggagtggaagtgttatgctaaaaaagcctctgagaaagcagcaggagaaaaaaacaacaacaaagaaatggaagttgaaaatgaagatccaaaatagccttttaaactatgttgtcattacctatatgctataggtttgaacaaagcaaagttttaatgaaaagaatgaatgaaaaagagtgaacaaaacctccgagaatatgggattatgtaaagagatcaaacatacaactgattggggtacctgaaagagatggggagtatggtactaagttggaaaacatacttccggatatcatccaggagaatttcctcagcctagcaagacaggccaacattcaaattcaggaaatgcagagatctccagtaaggtactccacaagaaggtcaacccccaagacacaaaatcatcagattctccaaggtcaaaatgcaagaaaaaaaagttaagggaagccagagagaaaggccagatcacttatgaaataaaacccgtctgactaacagtagacccctcagcagaaatcctacaaggcagaagagactgggggcccatattcaacattcttaaagaatttccaacctagaatttcgttatctggccaaactaagcttcgtaagtgaaggagaatataagatcctttccagacaagcaaatgctgagggaattcatcaccaccaggcctgcctttcaagatctcctgaaggaagcactaaatatggaaaggaaaagccgttaccacccactacaaaaacataccaaagtacatagaccactgacactatgaagcaaccaaataagcaactcttcaaaataaccagctagcatcatgatgacaggatcaaattcacacagagcaatagtaaccttaaatttaaataggctgaatgccacaattaaaagacacagaatggcaagctggataaagagccaagacccatcagtgtgctgtcttcaagagaccctctcatgtgcagacacacacataggctcaaaataaagggatggaggaaaatttaccaaccaaatgaaaactataaaaaaaaaaaaagaaaaacaaaacaggggtggaaatcctagttcctgacaaaagagacttcaaaccaacaaagattaaaaaaagatgaagagcattacataatggtaaagggttcaattcaacaaaagagttaactattctaaatatatatgcacccaatacaggaacacccagattcataaagcaagtacttagggacctacaaagagacattgacttccacacaataataggagactttaatacctcactgtcagtattagataattgagacagaaaattgtaacagagatattcagaacctgaactcagctttggatcgagtggacctgatagcaacagaatacacattgttctgatcgctatgtggcacttaatgtaaaattggtgacataatcagaagtataacactcctcagcaaatgcaaaagaactgaaatcataacaaacagtctcagaccacagtgcaatcaaattagaacacaagatcaagaatttcactcaaaaccacaccacaactacatggaaattgaacagccggctcctgaatgactcttgggtagataatgaaattaaggcagaaatcaagaagttctttgaaactaatgagaacaaagaggcaacgtagcagaatctctgggatgcagctaaagcagtgttaagaaggaaatttatagcactaaatccccacaccaaaagccagaaagatttcaagttacaacagaacatctggagaaccaagaacaaacaaaccccaaagatagcagaagacaagaaataaccaagatcagagctgaactgaagaagacagagacacaaataacccttcaaaaaaaaatcaacaaatccaggagctggttctttgaaaaaattaaaataaatagatagaccactagatagacaaagaagaaaagagcaaagagtcaaataaacactatgataagggggatattaccactgaccctacagaaatacagacgaccatcagagaatgctattaaacacctctatgcatataaactagaaaatctagaagaaatggataaattcccggacacataataccctcctacgaccgaaccaagaagaaattgaattcctgaatagaccaataatgagttctgaaattgaggcaggaataaattgcctaccaaccaaaaacccaggaacagatacattcacaactgaattttaccagaggcacgaagaagagctggtgccatttctacagaaactatcccaaaaaatcacaaaggagggactgctccctaactcattctatgaggcaagcatcatcctgataccaaaatccggcagagatacaacaaaaaaagaaaacttctagtcaatatctcaatatccttggtgaacattgatgaaaaaatcctcaataaaatactggcaaactaaattcagcagcacatcaaaagccttatccaccatgatcaagttggcttcatccctgggatgcaagattggttcaacatatgcaaatcaataaatgtgattcatcacaataacagaactaaggacaaaaaccacacagttctctcaatagatgcagaaaaggccatcaaaaaaattcaacatccctgcatgttaaatgctctcaataaactaggtactgaaggaacatacctcaaaataataagagccgtctatgacaaatccacagccagtatcataatgggcaaaagccagaagcattccccttgaaaaccagcacaagataaggatgccctctctcaccactcctattcaacatagtatgggaagttctgggtaatcaggcaagagaaagaaagagtattcaaataggaagagaggaagtcaaattacctttgcagatgacatgatcctttatctagaaaaccccaacatctcagcccaaagcttcttaagctgataagcaacttcagcaaagcctcaggatacaaaatcagtgtgcaaaaattgctagcattcctatacaccaccaacaggcaagcagagagccaaatcatgaatgaactgccatccacaattgctaccaaagaataaaatacttaggaatacagctaacaagggaaatgaaggacctcttcaaggagaactacaaaccactactcaaagaaatcagaaaggacacaaacaaattgggaaacattccctgctcatagataagaatcaatatcatgaaaatagccatactgcccatgctcatagataacaatcaatatcatgaaaatagccatactgcccaaagtaatttaatagtttcagtgctattcccattaaactaccattgccattcttcacagaattagaaaaaaaactattttaaaatttacatggaaccaaaaaagagttggagttgccaagacaatcctaagcaaaaagaacaaagctggaggcatcatggtacccaacttcaaactatattatagggctacagtaactaaaacaccgtggtaaactggtacaaaaacagacacatagaccaatggaacagaaatgaagtccacacacctacaaccatcatgatcttcaacaaacctgacaaaaacaagcaatgcagaaaggagtccctatttaataaatgatgctgggagatctggctagctatatgcagaaaattgaaactggaccccttccttacagcttatacaaaattaaccaaggtgtattaaagacttaaatgtaaaacccaaaactataaaaaccctaggagaaaatctaggcagtaccattcaggacatagtcacgggcaaagattttatgacagaaatgccaaaagcaattgcaacaagcaaaaattgacaaatgggatctaattaaactaaagagtttctgcacagcaaaagaaactattgacaaagtgaacagacaacctacagaatgagagaaaatgtttgcaatctgtccatctgacaaaggtgtaatatccagagtctacaagaacttaaacaaatttacaagaaaaaaatacccattaaaaagtgggcaaaggacatgaacagacacgtcttaaaagaaaacatccatgcagccaacaaacttatgaaaaaatgctcaccatcactggtcattagagaaatgcaaatcggaaaccacaatgagataccatctcacacccatcagaatggccattattaaaaagtcaaaaaacaacagatgctggccaggttgcggagaaagaggaatgcttttacactgttggtgggagtataaattaattcaaccattgtgaaagacattaaggatgacaattaaggacctagatgcaggaataccatttgacccagcaatctcattactgggtacatacccaaaggaatataaatcattctattataaacatatatgcatgtgtatgttcattgctgcactattcactatagcaaagacatggaatcaacctaaatgcccatcagtaatagactggataaagaaaatgtggtacatatataccacagaatagtatacagccataaaaaggaacaagatcatctcctttgcagggacatggatagagctggaatccattatcctcatcaaactaatgcaggaacagaaaatcaaacactacatgttctgacttataagtgacagctgaatgatgagaatacatggacacatggtgggagggaacagcacacactgaaaccttctggaggagggggtagggggagtgagagcatcaggaagaatagctaatggacgctgggtttaatagctgggtgatggaatgatctgtgcagcaaaccaccatggcatgtgtttacctatataacatatctgcacatcctgcaaatgtaccccagaatttaaaataaaatttgaaggaaaaaaaaaaagtctagcagcctcaagtgctttggtgatctgtaaagtactattatacttaaaaatattttgtatcttactacccatggttttattattttataattaaccgtgagtcgcaatataatatctcctggcctgtatacttgtgaaagttgtttttaaggaatctgggtaagtactaccactaacaataatgtagtagtagtgtttctttctttctttttttttttttttttttgagagacggagtcgctttgtcacccaggctggagcacagcagcgtgatctcggctcactgcaacctccacctcctgggttcaagcgattctcctgcctcagcttcccaagtagctgggactacaggcatgctcaaccacgcccatctaattttgtatttttagtagagatggggttccactagatgttggccacgctggtcaaaaactcctgacctcaagtgagccactcatctcggcctcccaaagtgctgggattacaaacatgagccacagcacccagccagtagtagtatatattttagagcctttgctgtttcaaattattataaaaattattgatatgtcttctaacatttttctgacagactttgattacggttgattactagtgaggcagagcaaatgttcttatttttcaactgtgtgtgtgtgtgtgtgtgtgtgtgtgtgtaaagatgttcctgttaacaaagatccttccccccactttacttattttttgataaacagaaaatgacttttatttcataggtcttttggcctgtttattggccatagaattattatacctactaaatgtttgatggacatcggtaaatcctctcataccacttatcacagtatctagcatgtagtagagattcagtacgtaggttgaatttgtaagtggaaatgcattgatccatttagagcttagatgaagcaataattcatccattatatgaatctgtatacccttgttatcaagagggtcctttggttgataaatacgtgttagtgtggttcatgagaagaagtttttatgtataaattatatgtgctgtggtgcccagttaacaccatagacatttatttagtacgagctgtgcctaaagcactgaggtagagagacacaaagattagtgatatgacccctgagagtttctgaaagccctggaaaggggacaaaagggcattcaagtgttacataactagatggttatatggcagggttcttgactgaggatacaaaggaaactttccctccaaagatgggagggaggttagggataggaaattacttaacgggtacaatgtatactatttgggtgattattacactaaaagcccaggcttcattactacacaatgtattcatgcagcaaaattgcacttacactgcctaaatttatataaataaaaaaaatgaatgcatagacctatttctccccatttttcctggaagtttacatatcactttcttttgccaactccccattgttcaaatgtggaaaacaatgaggtgcctttgaccctgtcttctcactgtcctctgttccttttcaaccctagatggaaaggaagaccctactattagaaacacatctcagtaataggcagagagtgggatttttattctgggacatattgttttgtggctgccatgttgaaaagtagcagttaaatatgatgccttaggaggtttgttcctgtatttgacaacctattagggaattagaaaggggatgggatgtttcaaaataaattcctgtatttagaagtttttaaaagcagctgcagggatttcattttcagatgaggaatcattttcatttaagcccatcagctaaaatgagtgcttagtgaatagaaagcctgtaacataaggcctcgagggcattacccccactccactgaactctgagattaagattctgtattccccttcaaccactttcttcatatacccaagagaaggaatcatttaaaatgcatcggtcacctttttaaaagcgtattgactttagaaataatttggcatttgctgtttgtagatgggaatacaaattgaaatcaagtgctatgttctacattgaggattgctatgttccattgctgtgtttctgacccattggtttttacctagggtttttaactggttttccagcttcctcaccaggcagggatctaggcttctcctctatgccttcgactggtaaaatcagagagagagcctccatcagggccccttgccaatcttccaggtatctacagttgcttagagatctgagactctctctttcctcacagggaaaggctattccaaccccagggactgctggccagtcacttcccactcctctctccttaaaagcaaggtcctcaaataacaactactcatgctgcactcatttccttacctttgaaaggacatgaggatcagatgaaaaaagcttctgaaaggtggctctcccggctgtctgaggaagtggaagtatgaagatggatctaagaatttactcgaactccttttaacttcactgtggatggtggtagtgttacttatacgcagtgctggcacttggcttctgtgtcaatcatttttctgttggtttgaggattctctccatgcacagagtctaatagatatccaaaggcagtgcattacaaaccagagtcactcctaaaagaagctttactgtaaaaagaccattttcttaaaatgagttgtagcaatataatgttgctcaaaaagaaaactttttcactccatgagaaagattcactatcagttaccaaacctgatgttttctttgctaaagtgaaaaatataaatacaaacttgggcccatagtttagtgtaattctaaagctcatccttattgtaaatctaatgattgagagaactttaacattcattatctctaactttctgatgttccagaaaactgcagtcctatgaggttagctaatcacttcaacctgacttggttagtgcaaagtcaagtacgtagaacccggttatcaatctcagctcattgttttgtcttccgcactacactgcctttcttaaaaagttatcttcctccacctagcaccccagtaacctgtggctctctttgtgaaatatcctttttccatcacttaaaagaattaaatggaacaacttcttatagtaagtaatccaaaagcccaagtgaaagctgtgggtcatcagatcccatagtgtgagcaaggaagaagacagaatctgcccttgctggccctttatcagctcccaggatttgttgaagactttcatcaagaaagcaagtgactagattaagtatccatgcctttcatcagctgctgtaggtcttggcagtgttactgcagtgctttcacccttctcatttgtcccatccatttgaaatacagtgtacttaaatttccaacaaaatcataacgtagactccgtcagttaattaaagtatactaacaagcatacaaattgctaagtcattctgggaggctatcagtgctggatgtacttatacattcagcactggaaacatgcccttccagtagtgcacagccagaaataccaagcaggcttgcaaaggacaagattaaccttggcctcatggtattttgtctttctgcagggaaaggaagatcatggagacaacaattgcaatacacggtggagaactcaacaccccttgattaaaaaaaaaaaatagttgaataaaaaagaagtttcctgaaggagtaagatagaatttaccacagaaagaaagtggtagtatctccctatttcaatttaagtgttgttcccaggcaggtacaagtacttctaaaaaggcatagattaaagaaaaatggtatttggagtcatggttactaaatgaagctacagctcaccatgatccttgggatgaagactatgacccccagcaaagttacaaaggattctgctctggaatttatcaactgctttgtttgttctcttaacaggtaaaaaatgcagctgccaatgtactcagggaaacatggctaatttacaaaaatacaaagctagtgaaaaagatagatcatgcaaaagtaagaaaacatcaacgaaaattcctgcaagctattcatcagtaagtatcatttttcatttttatcctgttgttgtgtccttggctttcaatttttgcacttgtttattcttgtttcataaggaaggaaaaaagaaaacattgtcatgtttattcccagaagatgttatctggcaatctaatcattccacaataagatcctgagaataacctcagttcctttaatgattaaaaatcacttattagtactagaatatttattaaaatatcttctcagtttctttttagaataacttctgctgaaattgtatttcttaatttgacctatttattcagatagtttgctctaggattttttcagctttattttctaaacatagcttcaaacatatttatatgaaagtagtgcatataactgatttagtacttgaattttaagttagtttttaatcagaattttggctgtgttcattttaaattttccagtttgtgtagaccttttactctcttatcattattttaactttatccagaccactattatggtttaagtccttcgttctgttccattgttatataattagcatacgcttttaaagtaacaatctatatctagtaagatgcactgataatttgaaagcacaggatctttctcctccgggctggcataatccttactgtaagtattattcatgtgggtatcgattgtgatgccatgcagacttgctcttaattctatatggagaagagcagatatggtcacatctgtggctcagaaaagtagctttccttatgaaacctacgagggtagtaatggaaaggtgggtaaatacaagatgctttggctatccaatgagatttgtctctcagagccaactagtataacaggcaagaaaactcagaggctgcaatttttattttgcatgttcaggtaattcatatgtaatatggtaccactaacattctataggaaattactaagcattcatcttctaccctagaatacaaaacctgtccattgaactgccctgcttaaatagatatcactgaaaatgtagaatatgtaattctggacagattcattcttccatagaaattaaaactcaagtatcctgagatttatagtagaggcaggctctgcacgtatggtagagtatctggccttcattgctactcatggtctttccccagctttactaacacactttcctaagatagtgatgctatttcctctgtagctcagtgacttgacacatcactatgctttttctccctttgtaaggaaaacacaaggttagagttttcaaataatactcttaaaataaggaaaaacacagaaaggaacattatattccatctggctcacaagagggaacttgctccctagacttacagttacccttataacccagaaccaccatccaggagcccttgcctagaaatcttgattccttgaagtttagattgaagagaatgagaaccctccctttctcccaacccagagatgctgagctttcgcctctgtgttccttaacctattttcctgtggaacaggcatcttcctcaaggcactcacctcacacaactctcctattagagtggtcttcccctgctaaaaccatactacacagtaaccccaacacattcatacaggaggtccagaggccataccatgcatggcaaaatcattttttctacctttaatattttggtattaacctatatttagtatgttaaaaagaaaccttaccttggtgcatgtgagaaggtatgtatgtccagggtggaagggtatgagatgacacggcagtgagcaagtgtggtcggtctgtgttgagcagccacacatcccattgcctccaggatcttatctgggtcctttcctgtcagtcagacctatcaaatgggtaattacatgtgatttacctttaatcaattttcatataataacaaatccaagaaaatgctgtgatagtttttatagtacggttctgtagccatgtgcagtggggatttgtattacatcttgtaatataagactcttctggactattatgttcagaatacattcacattcaaaagcctgggggagaatttaggggtttttaccgtaaaatgctttcaactttgccgttaggttattacgtttttacattaaaacattagaaaaaaagtatttggggaagtttaaaaactgtccctaagcaagttgcaaatgcaccctacaaggcatgtcggccctttcttaagggtgggtactgtggagtcgcttgcacggggtctcttagcatattgtgtttggatagagtgacagaggaagctacttgtgatttttctgcttctgtcagatatttcttattctgtttcttctgtagcaatgtgtacttctaaagtagataagcttcaggcaactcagaaatgctctgaattgctttataaattcatctaggggttaccgggtttccattacagtgggggacatttatacttctaaaagtgtaactgagtacgtttattcatgcaagctttgtttggctagatcattctaatcatgcatacttacctttcattttagcttagtgttggaagttagggagtgaagtcataggggaagcacacagggctcgattcctaagggcaaggcttccattgcccactgtgcagatccagtgagaccctcggccttatctgtcggcactgggtacaatcagaccttactagctgaagaaaaatgttaaaattcattcgatagatcactcctggcctctcctactctctgatttatcctgagcactttttcagcagctctctgcttctaccagtccatgctatctcaactctgtttctcttttccaaacttcatagcctctctactctgttggatgctgaactgtccaggcctgtgccctcttttcagtaattgtctttttagattgtcacttagtgtcgtgaagtgttctctttctctaacttttaacgctttttctggtagcaactttccctttaaagtttatcattcttttatctcaactatggaccaacatgaatttgtttcagaaccaagaaatccaatctacttgatttgtatatcatgagagttggattacctgcctttcagaaaccccaggcttctgagttgtcctaatttggaaaagatgtacccccccaaaaaaattacaatgcctttgtttcaaatattgttcttttaaccatatcacattcatattaggcaaaaatatttcttgttgtttacttgaacatcaaatatcaagaggccatgatgactttatgcatgctcttccttctgaactcttattcaggaggaagctgagtgcttacagatgggaaagtatagtagcaatgaagaaggataattggatagtgtttctctttggccaatatttcaaaatcctgcagaaccataacaggatcttccagctaatgaatcgagccccttgtgcacaactgaacaccacattgtgttattttgttccagaatattttacagtttcttttcttttgttttgtctttttatttcaacaaaatgaaaatagagctcggaagtaagttgtgtgagccgctcctttcaacatttgcagaattttctactggctgcatgcacccagcagatcctttatttgtgaattttagtagtctgattgctgctatggaaatgtgatccaaaatcatgatattttcctgtgataagtgaagttcacaaggaagaaatcaacatatgtttctttttcttttttggggggaaaagtgtaatacacatctgcatgttaccttttattctggcagctgcagcttaagcaggctttttctatcagctctcctacattacaggcagtataagaaacaaacaacaagacaagatgattcaagttccgatagctaaaggaattccaatcaaataaggctactgtatgtcagctttccagattagtagaaaataaaatgggcaaaattctactgtcagacatagtatagtaatccaagagaagtaaattaggccccgttgtttataagatgaagtacccacttaagctaagaaactgccactggcccttctagcctgacttacagaattcaggactttctctgtactcattacttgctggaggcatctggtccagagcccaaacttcagtcatttctgtgccactaatactataacttacttaaatttgaacatgaaactttatacaaattcctttatacaaatgttaatccatttttatacaaatggattaaaaaatattacgaagaaaggtaaaggtaatcgtcaattgatagttgaaacaccgatattgaattctagccataggctgttgcctgcagaaagctctgagctgagattctgctttttcttttttttttttttttaaaaaaagaaaaaaaaaaaaaaagcaggtgttaggagataaagacagagtaggaccagactatgatgtttttcttgcagtaatgaagaattagaagagaactaaaaggattaactgttttccatcttaagtatcacttaaaggcatctagaatacctctgttggtatgaatccagcagtgcagaaacatttctctaatctaacacacttcatttcatatgtgaggaaactaaaggtccagttagagtaaggatggaatccactgttgtacactgctctttctttagtacacttctgcgtaatgacccacggatgtctaagtgttctttttagggggtgtagggtgggggcagttgcctgtttttcaaaggcacacatcaaaaattgtaaccctattaattactgagagaaatctttctcaacaatatattggatctaaatacatgcttgtaaattttagactaggacatattccatctctgtaatagcataaaaaggagccaattaacttcgttccagcattctaataaatacatagtcacaatgagaagttataaccttaaactgttgtagattgttaaagatcgtgttgtaggtatgtgtcagctaaacttactggcagaaggcactacatcttcactgtagagcagatttggtgacatattggatatcctagtttcggaacaaaatcactgaacattatgaacgtattacaaaatctccctggcagtaaaatcttgccctgtgagtttttattccttctacataattacctttcatttcaattgaaaaataataaaaaattctctctctagcattaaaactatactttgtaaaatgacttgtcatcaaagcaaaataagattggcatgactttttgtttgttttcattaaatagtttagaagaacctacttctcttttgggaaaaagcttttaattgttagcttaaggaacaataaaccacacttctcttattggaaaatctttcttggtacatagtaaacactgaataaatatttgttgaaaaataatatagtaaataaagttaaagaatagcagagttcttacctacaagtgtttttttaataccgttttttgactcttaattgactcttcatcaggtatatacaatgatatttaacagtagctaaacataatcttacaagtagagattccatctgccagatactataattgtcctctgacttttatctacactgaaaatgggaatttttcctaggaaatggtctggcctccctacaaatttaatggcagttcaagataaaagttaaatgaaatacaatgaagaataagataataattatgtgttttgtgttatattgctgctggttgaataaaagtttttttttttgttaataagaatctcacttatcactgtgttttcatcaggttcaaatacctaacccaatccatttcggactaaacagggctaatacctgtatctaatcatgtaggcataggaaggtgctcattgctccaacatcaatgaaattccagttgctttgcatatttcttcctatgtctatgtgtcatgatactggggctttaaggaatgttttggctttttctcatatggttaaatccttatgagtctttctgaattcaactttacctggtaaatagttgtcctaaggacatctcatctcttgctctcactctctcctttcttttttgcggtgttggggaagcatgcttctcattgtaccagacacataaccagtttggacttaccccaaatgttcaaggcattatccatgcagttatttgctcttgtcaattttgtgcatgctctttggaaggcataagattgccataggaagaagggaacctttctgataccagattctatcttttagattaagaagtgtaaaaatggaacagaggaaactgaatgaccaagcaaacactttggtggacttggcaaaggtaagcctgaggtgcttagccctcctagttgcatctgttgaaatcaaccacttcacagtcactaatcatgaatgtttcaagaggatcccaacccaaatctaattaataaatcaaaccagcaaagcaccctaaaatgatggtccaacttaaaagaatgtttctgtaactctcatttaatgtactctttccctattacgttattcagccccattctgaaaacattcctagttacagtgatttggaagtaccataagaagcttaagtggaataggagacaatacatgcgggatttttatttgcatgtaaatctcatctcaatgagagcagaactgcatcctaggtgtgactgtgatattcaggaatgaataggactcatcaattaaattttgtcctatgtattttaagcaaactcaaaagaatgtaaagttgaaataaaaataaaagataccagaaattacatcctagaatgaaagttatcaccctaaagtgatcacttttttatggttctttctccatttcattatttcaaaatcataccactttttaaaaagtacattaacagtctccaaattattctaccttatttataatatttatctgatcaatgtttagttgtttctccccacataaaacccattcttaaaacataaatatttgtcaataatcaaaacattgcattttcctgggtgaattctaaaggtggtattagaatagcatttatataattgttcagccttttacccaaatgctttgaaagaggcaactctcagttgcatcttacaaactgtttttttttgtttgataaatcagacatgactttgctaaagcctcaagtataatccataaaaattacaagtatttgtcctagtctcattaaataatgcatctaaattacattcattttaatgtatagcagtaacacatactagatgttgaagacagtaagtatttaatgacttaccctaggagagcatatatcatgcatataaactggacagcacacatataaaaagtatgaggacatcctcgattaacgtgtataaatgtggctgttacttggacatatgaaaaaaagatagggcaagctccatcactcctaggttaaatgatttttaatgggtatttttatgaaaaaatgaacagaccacattgaaatatgatgtggagatgtaattttacttcaagagtaccactgtgaggcaagatgctgtttctttattaatgtacttattatgaccacgggactgtacataccataaaggctcagtattttcttaaatgaatggatgctgttcacatattctcaagactatgtagtaaaattaagtgtatgcactctgtctctggtcaaactgaaacaaggtgcctatattctgaataataactcccttatcagttcatttaccatctttaaaagattgttaagcagaagaagagcatatgatagaagggaaatgcagtaggagggacggcttaaataaagggatctcagacttgggaaagtctgcactaaactaagattaaaaccttttcctccctctttgccagccttttccctgtctagctctgagctgatcagtcctctctctttgtctcttggctactcaggaaatatacctagaaatcagagttatggataccctgtgatcaagacaatcaatttcaaggttcactaggaatccagaaacattttcctgttttaaccacttagctttgattaagccatagccaggaggtcagagccatggccaacaaggtagactggtaacttcagtatctcccttaactaatattctctcaatgggttatctgtaaaaattccatttgacccaatggagagaggcctgtaatttggaacaaaggataacaaacaatctttaggaatttattgctttaaattacaaaattatcaaaccagttaatcctaaacttcatttatattctaccctcaacatttctgctacatcccaatgccatctgtattattatttatccctctgtattatttattgttctttgcctctgcccattttttaaaaattacccttgccctaattaacaaacatgttgcaaaatgaatttgatgtactaacctttgtgacaacctttaaaatacatatataaatattcaattgaaatgtttttgtctatcctgataccacctaaaatcaatgggcatgccaccagtagcagtacctgctccacattttctgcaactgaaccaaagatcttatatttcgattataaatcctggcattgaacacatacaatgagttggctttgcaagatgagctgttcagttagctgacacccctgttacactgaatgccaccagcaagagaccagagctaaacctctgagaggtggacagtttgtgttcagggcaagtataattaaccttcttctcaatcctgtttttcagacccagaacatcatgtatgatatgatttctgacttaaacgaaaggagtgaagacttcgagaagaggattgttaccctggaaacaaaactagagactttgattggtagcatccacgccctccctgggctcataagccagaccatcaggcagcagcagagagatttcattgaggctcagatggagagctacgacaagcacgtcacttacaatgctgagcggtcccggtcctcgtccaggaggcggcggtcctcttccacagcaccaccaacttcatcagagagtagctagaagagaataagttaaccacaaaataagactttttgccatcatatggtcaatattttagcttttattgtaaagcccctatggttctaatcagcgttatccgggttctgatgtcagaatcctgggaacctgaacactaagttttaggccaaaatgagtgaaaactctttttttttctttcagatgcacagggaatgcacctattattgctatatagattgttcctcctgtaatttcactaactttttattcatgcacttcaaacaaactttactactacattatatgatatataataaaaaaagttaatttctgcacata

SEQ ID NO: 317 - DNA, 62971 bp, Homo sapiens
cttcaacactgtggaagctttgttctttcgctcttttgcaataaatcttgctactgctcactctttgggtccacactgcctttatgagctgtaacactcaccgcgaaaggtctgcagcttcactcctgaagccagcgagcccacgagcccacagggaggaatgaacaactccagatgcaccgccttaagagctgtaacactcacggcgaaggtctgcagcttcactcctgagccagcgagaccaggaacccaccagaaggaagaaactccgaacacatccgaacatcagaaggaacaaactccagacggcgccaccttaagagctgtaacactcaccgccagggtccggggcttcgttcttgaagtcagtgagaccaagaacccaccaattccggacgcagttgggtcttgcttttattcactctgacagcctctttttactaatgtattcagaccattgatgtttaaagtgattattagtatagttgtattattatttatcatatttttctttattttctgttcattgcccttgttctgttttttgttaatttttttgtcttctgcccttcttctgatttctgcagtattaattgagcataatatatgatttcactttttatcctttttagcatatcagttatactactattttttttctgtttgggaggtttctattgaaatatcttcaagctcagagatttttttttccttcgctataaacagtctactactcataagcccatcaagacattctttatttttgatagtgttttgatctctagcatttctttttggttttttcttacaatttctatctctctgcttaccttacccatttattcttgcgtgctgcctctttttcctttagatcccttaacatactaatcatagttattttaaatcccagtctgataaccccaacattcctaccatatctgagtcaggttgatgcttgctctgtcttcacacttttttatttggaatgccttgtaattttgtgttgaaagccagatataagatactgggtaaaaggagctgggataaaccggtctgttgtaatcccctggtattatacaagagccctattgatatcagtagtggttagctgtgagaagaaaggagccattctgtagtccggtgattagttctcagtcgtttaataagtacaggtccctgggctgtgactttcatcagtgcttctcaggtttttttcctctcccatttagatgcaacagtaaggctagaaggggctgaagtgggggtgttttccttccctcaaatgccagatcactccggggggagatggggaatggggtgcctgtaattgggtatttcccttttcccaagtgttttaggctctggtgaaacccaaggtggttacagtctggtaaaataatttcctatgagggcaagctattgttaagaacaaaatgttctgggcttataaaatggttacttttccattttctctgctggaagcaggaggggatttttctgtgatctttatcctaagatcctattggagctcctggaaattaaacttagaaaaatgtgatgccactctctacccgtcactccccacccctcacccctcaccccttacccctcaccccaggaccaggccttcctgagtttgttttctctctcaagctagtgagtgcacagtctctagcaattagtcaattaccttttaagtatcattacctgaggctggcttcagaggtggtttttgggtggtttttgttccaagtaagctgtgggttttccttatctacctgtgtccctagttttgagggtggtggtttgtcttgtgaccttaattctctgctagatctaagaaaatttgttggtttttagtttgtcacctttttttattttcttgttgtgaggataggaacgatgagtctcaaactcctttgggccagaaactggtagtaatgaaaaataatgtttctagacttcatagtattctatcaggtggattgtgtctcactctaaacaaaactccttttgaaagcaggagaaaatcctttagtttgatcaaagagccaaatataggcatcacagaatttgctttatttttactctaaaaaaaaaagatgatttagatagtatttagatcattataatgttatttgggtgattataattttatatattaagttatacattttacattcttttcatttaagcattctacatcatgagtaaatgtgaaatgttaagtgataatcattttaaattaaagtcttttaattttatgtttttacatgaatatgaaaacaaactttagtcactgcttctaaagtgaaactatattttgggttatcttcaagaaggcacaattccttaagtagataagttaatgagcatttggacttttacttttggtcattatgcttctttgtaagggtgccttaaatttggctagtttctgttttctctgaagtaggggtttttatctctgaccaccttgaactgatttgcattgtaacttgtttgtcgtaatctttttgcatttgctctgcaaagctgcatttcacacctctgactgtaatgggtcagtcagggtcacctcattatacttgaaatatgaaatgacaccctgtaggtcatcatcaccctgcatgtctaccagaaatgagaaattgtccttaagaatacactttgtcagcttggtgttacaagtaccaaagtggttacagtattttacattgggttttgaagtattttttaagttttaggtgtttaatcagtgtaacagatttaggaatggtttcctatcaactatgagatagtctgtaacacagttttttggattttagtgtataatcagttcaactgattctttttgttccccttatggaatcattaaatgatcgtaaaattagagcaacaaatgcctcagattaaacaatcttgatttacttgtatgtcatttgatcagatgaataaggccttagaaaatcaactaaataaagtcagcattcagagtcctgactttggccttgctatttattatgaaattccacctaggcatacatacttggacggttgtttggttttttcctcacgatactttgtttcttcatcttttggactatgtgtataacattgacatttaatgaaacgtatctgtacatttttcatttggctaaataaaggcatacaagtatgaaagggaaaaaatcgatgaatgaatcatgcagttcagcttcctaccattttttctaaaatctatagaagctttgaaacagtgctatccaatagaactttctgcagtgatggcagtgctctttgacactatccaatgtgatatccactagccaaatgaggttattgagcctctgaaatgtggctggcattattgaggaattgtattttttattttatttaattttacttaaatgtaagtagcactttgagctagaggctaccatattggacagcacagatttaggttttatttgtgggttgtttttttcttatctataaaatgtgtgtgtgtttgtgtgtgtgtgtttgtgtgtgtgtatgcgtgcatgcatgcatgtgttgcaagaaaaactgagctttaagtacaagtctttcattcaaggaaaggtatcaagaagagaaattggcaccaaaacagtagaattggatatatatatagaatctgtccaagaaatcatttaaaacatagtaaatttggtacacagaattaaatggacttcttcccagaacaatggaacagcagtcgaggaattgaaaacagtgcctgctggagaaaaacaggaagagaaagagacagtgggaacagagagaaggggaggaagagaggacgtgaatgaatgcaagtgttatttattgacattttagaaattttaattgaggtgatattactgtactggctttgtaatctagtaggggaaaaagctaatttagtctagcttctttttgtagtgaagactcaatagttaaataaacagtgctctgcagaatctgtttattccttcaaaacagttaacctttcagattaaagatggcaagagctaaaagtagaaaataaaaaagtgttatattgacaggtttggggactattgaaagtgttacatagttcaaatccttctgattaacttgagttttccaactacatgtgatcacataacatactatagtttgaaattaaagaaccaacatttttgtaggactctctggtgtaaaaggatcttcattctgggaaggtagaaaatcatgagtctggggaagaggacattgagaagcagtcacgtgtctatttgcctgggtgatatttgagtaagattttttctggatcgtcagtaaatttgtttttggcttttctaaactttctttcttagttcattttcttaaatatttctttttctcttggtttttgcctatcccagaaaattatcatccagttctaggagcataataacatgtttaaatgttgtgaccagttaaaacacaaagccccactttatctacaccaatctgttaatataattcctttcacctttatctccttctcagtctttctaaagcaactgtacagcttttccttccttggagaaagaaaacagattgccagcaatctgccacatttgagtgttgtggtctgggtgtgacatttctgagcgtagtgattccagtagaacacacttactatatttacagtttgaaatgtaggagtgccagatagtaacataaagggaggttgaaagttttacataatgagatgcttagcatcagctcggtttggatgaactgctctatggacactaattcccatcactccatgtgactagatggaattttggctgggtcattggcatttgggaggattatgataggggaaagtgtggaattccagagatgggacatagtggtattagaaaaaatatatttctgttgcaacttttgatcttttggggacaggatagaaaaggggcttagcagctagaatctctaatttcacgcctcacttaaaataatttatctagaagatctttgggaaggtgccataatgttcccaggggtagtttagccatgccaacaacagcaacaacaacaacaacaaacagtctctatgatgcttcctcctgtccccatttgttggggaaaatggtgatgtcaccatgcttcagacattccccgagcatgttgtcactatgcctaccagccatcttaccttagcacttggtcaaaaataaattctgccctggtgcctctttaagttctattttcccctatttgcctgtctgaaaactcccgttgctcttacgaactggacaactaaagctgcaaaaccctatgttagagaatctctttctacagataaatgtgacagccttggtacagcaatgagtgcgttggaaagcacatttaataactttctgtggtgtcattataaaatatgttaatagagtgtaattacaacatattttaactgtaaatttaacttagacattatagtgcatgcattcaaataaaattcaaaggaaaaatgtacagtacataaaaaaatctgaaatttcatattcagtaaaatgatagacttgatattctcataaccttttgcgtaacatctagaggagctggacaaatggacgcccatagctaaatgggaagggaaatctccacatgcctacatatatgtatgaaaacatatcagcagaaatgcaagtaataagctggctctcacgcttcagctactctgaggaccacttctaatcttggtaattaagagccttaacttttttaggttctttttttaaagagaaaactgcagtaagaatataatttatattagaacatggtatataatctcacaccccactgaatagcagattttgtagcaatgtgcacagttcttactaaggatcagtgttaactactcttttttacgattgtactccattctgttttattacaaaatgctggtcataatggtggttctcagtcttgacacctaggagccataaaaatatatatgccagggtcccaccctcagtgattctgatttcactggtcttgggttgtggcccaggaatcagggttttaaaagctccctgggtgattctaatgcaccgccaaggttaagaaccatagcaccaaattgatttcactatgtactaatagaacttgacagcatatttcaaaaccattgctctaaagggatatacctataataaaagaatagactaaatataaaatctcccaccacagaaagaaagcaaaccaacaaacaaaaaaacacccttgattcccaggctgggtggggtgtgtgcttggtgaggttataggggtagaaagtggtctaccctaaagaatatgtaaccaaaggcctactcacatatgcttttgaaattatactatgacaagttcagaaatcagcatttaaatccctggtgggtaacaccttgaattgcatggtggaagcaaacactaatctctatgaagggacataccttgactcaggttcagctgggttttttttctgacataagacataagcctccctccacccaaccacccaaggctgcaagctgcaaccaccatgaattctctgtttctggaagtgtaacagatccaaagccaagtaaagaaaaaagaaacctacatgtagacacatgaacgtaaaaggagtcagaaaaagaaaagaaaaaacttgccacaatgattgctgatcctagaacatcctaacataaaaaactagagctggaatatactgcctatttctaaactgctgaaagaagttaactcctaacctagacttctatgccttcctaaatttaatttaaaaacaaaggcaaaataaaggcattaggtaattaaaaagtgagagtatgtaccaccaggtcctcactaaaataacttctaaaggatttccctcaaaaagagggatgagatcccagaaaggatttttgacatcttaaatgtgagaaggaatagggaggaaagaaaaaatagccctctggataaatgtaaacaaacagggtctacaaataacaaaacaacaccaaaaatgagtacttgggagggtaaagaaggttgaactgaggagttgggtgacatggtacaggtgtgattagatttaaagccttctaagggtcatgtacctgcactactcaggggaagtggggtgggggtggggggggctttgaattctaagtctacaatcaagtatgtcttgttaaaagttataagtataacctgtaaagtaataaaaatagaatgtataacatctaagcaaatagaatagaaaaatgtgtagtatgaagggagcatataacaaacagggaattattaatagaaatttgaacacaatgtgatagctaaaacccacagatgttagtgatcacaataaatgatattcttttttttattctaactatataaagcttacaagagttatagctaaaacaagtatgtcagtgggttgaaaataaaagattggaaaagatacaacaggcaactacttaccaaaatgagtttagtgtcactatgttaatatctgataaagatagtgttaaaagcaaaaactagtaggaataaaaaaagatcactacataatgtaaactgcaattcactgcaaagttgtaataattctaaacttgtttgtatatatttaattatatagcctcaaaatatataaaataaaacagtgagcaaactagagaaattaatacatttactattatagtgcaaggttaatacaactcagtatttaatgagtcatgcagatgaaaaagattatagatgatttgaataacacagttaacaagcttaatctagcatacatatattaaaccctgtagccaataactagtaaagatacattcccttccagcacgcatagactgtttcagtaattgaccatatgtgatgccataaaatacatctcagtagatttcatagaattagcatcaatgtgtaattcatgttctcagagaacaatgcagaaaaattagaaatcaaaactccagaagtaactaaactaaaaacatactgttagtcttccctcctccctagcaataaacactatattcctaggaaaaatgtcatgataatatgagggtggcatcctttcaaactgtatataaatgtataatttttttttcaaaacagggacatgtttgtgtgatcatgtaatttggtttctgtttgtttttaactcagcaggctattacagatatgctgccatggcagtacacacaggtatcccactagactagatcactaatatatgtctctaaaacaagagcttagtaaacgaggcacttgactttgggtcacctcactttgctcctaaagatctattatcccacagcctgtccctccagaattcacactgagaaagaaacaagactgccagtgagtagccaaaaatgcatgttttaaaacttaactgctgtattcatagaaaaaataattggtggactcagggatagctttctgcctttcattgcatactattttagtatagctcagaatcccatttctcaaacacaaattaaaaagagaaaaaagccactggagtgaggataacagaagttagtgacaacctggttggttcctggttaggaacaggataaacaaaacagtacaaaagtgacattattagaaaccacaatctagagagatttcacgtggggaagagacatccctctcagtgcatcaccattacagcagaacgaattatatatatacatatatatatataattttcatatatttactgtatatatagagagagagagtcaatatttgtaaatataagaaaagagtaacttctgttcattgaagtttggaggacagggacatttatgtagtgattttaaggaaaaacaatgcatttaaaaatggagttgatgcagaaagttacctggttataggggctgaaatcatcaggaatttacctatgtggggtgaactttggcaagtcccttcaccaggctgaacctcagtttcctcagtgatatgacaagctgctcccatgcttctgtcctgggatacagttgtctctttcctgccctcatgcaatacatctctatgaatacctcctttttgaagtatgcctcgccagatgctattggggcttatgaatggcaaacgacggaagactcagaccataaacctgcccctcgggtttacagtctaggaggaaagatgagagatgtgcaccagtaacagcagtgcagggactaaaggatatgtaagagagggatggaaaatactgtggtgtataaaattaagtctcatcggaacaggaccttcagaatatgaaacacttgtgaactcggagagatgtgggcagggggaaaagaggacacacagtagttctgtttaagaacatagtgcatgagcatggtcagaagggtaaattggaacgtcatttagagggacctcatgccagcacaagagatttttaaaggtgtttttttcacaaaggagtgactatttaaatgcttaaggccgggtgcagtggctcaagtctgtaatcccagcactgtgggaggctgagggggtcagatcacgaggtcaggagtttgagaccagcctgaccaacatggtgaaaccctgtctttgctaaaaatacaaaaattaactgggcgtggtggcgcgtgcctgtaatcccagctactgaggaggctgaggcagaagaattgcttgaacgcaggagggggaggttgcagtgagccgagatcatgccactgactccagcctggcgacagagagagactccgtctcaaaaaaaaagaaacaaagaaaaaagaaaaaaaaaaaagaggcttaagaacatgggggtcattaatacagtactaacagttgatttaaaatttttctgcttcagtggaagacttgtaggttattttcagcatttggtcacataatgttcattgttctcatgtagaaagaactttagaatcattaggctaaatgcttcgttgggattatgtaaggaatgccttgcttccacagtctaaatcagattgaagagttaaaagggaacaagaacacaaggatctcaaattatccattgcataaaatatttaatttcctatgaataagtggattttactaaaattatttttctgccctcaggggctctcaggaaagcagtttaatgaagggtactgattttagaagctcttaaaatttttatagtagaagtaatctgtgaaggcacgtgaaatagatgcacgggtggcaagtattgaaatctatattgtagtgggtgaacctcagatttactaagaagcagcctgaacgtgtgtttggaagtaaagagatctgggttatcactcttctctgctcctaatttgtcatgtggctggtgataagaagaagtgtcaggaaaggtgggttgggacccaattattaatggcttggggtatatgctaaagcaattggacttttcattctaagcagtggggaatcaccttgttttagaaagataactcacagaacaatgagaaggatgatatagagagataggctggagacaaggaaagaggtagactggtaagatgtctgttacaatggactaagcctctgtcttctcatcactagaataaggcagtggaaatgggagttctcccacttattcattcaccaagactctcctttttgagtaccatgtaacaggcatggttctaaccagcacagggcatattgctttgagcaagacagagaccactccttagcacaagtagtggtaattccaggtgccatggaccatacagcaagggatacataaccccttctcaggaggaggaggggttagagtattaagaaatcactgacttcggaatgtgaaggaccaaaatacaggccaaagtggggattaagatacaagaaaaaaaagacagcatatgagaatcctggaggggtaagagcaatatatgccccatgaattgaaactacttcagctggagcttagggtgcaagttcaggacagcaaaaattaagattggagtggcaagcagaggccaggccaaaaagaatgctcaatttgagaatgtttgaaagtggatgccccagaacgtcagggttccttgatttgagggatgagacataggtaaaggtgacttcaacttgtgtgatttgatttcaggcaccttggtatttggaaataccatcttaacagacgaaaggaatatggagggaggacagctgtgtgctgtgtaatggcactgatgagagagcaccatttgggtgtctgggtactatgctgacctgaagcttcacaaaaacaccttcttgtctcaccaaatgagtctggggattggacaaagctgaagaaagcctgctgctcttcctagaacctcccctcactcaaataccccctgaaaaaatttttctccttgcaccccacattgcatcaagtacagtgatttgcacagtgtgggtcttcattgtattatttttctaaaccagcaggttgtttatttagaacacaaagtttagatgggttcatgatttgtatatgatgggaggtcacaattctgaatacagtagtaacataacatatgtgcttgcatgtatatgtgtgtgtctttacatgtatatgtatacatgcaatgtggggtgcaaagagaaaaagtatttcagggactatttgggggatttctaggaagggcagctggccttctttagctgtgcccaagtgatttcaggataagcaccttttatgataaagtgtatgtaaattggatcaaataaatctttaatatgataaaagcaaaaatgccctacaacatgccttacctccgtttactaagaaaaaaggggttatcatgagatcccttttcaattgtagatgtcaacattttaataaagtgttcagctacctttgcatccatgagacactttataaaaatattacttatcagtaaaatacacaagttaagaaacaaacactttaattaaattgcacagagcaaaagaaagctttagttggctgcattattcttcacactgtgttttaaaactatttctatgtaagctaagtagctacacaaatagtcacaccattggaagcatctgtttaaaaatgtttgacatgcatcaaaatacacaaagtaataaaaagatcatctctatatgtattccattacttttttcctgtagtttgctagtattgctatcaatatgcatatcactaaacaatatataaaattatcttgtaaatgtataaattaagccttgcttctgttatttcttcagtagcatgccaggtgagcagaacctcagtactgggtaatgagagacactctcttttattctagttgtttgatttggaaagcaatgcatcccaaaagcatctaccctgcagtaacctttttgtggatcccaccttgggcaccagctgtttcccacagtatgggcaggatcacgggaagtgaccagcataggcttaataggaagaacaagggtgctttgcaagcctgtgaagcctaggataattcttcacttcttgtggatgtcagaatttctggatagacgttactggcctcctcccctggccccagtacttggtacagtcttcctatgaactaggggagtactacctgtctgagtaaactaatatacaaaaatgagtctaaactcatttctttaaagtattcgacttattttccttgtccaagaagcatcacaacaaaataaccaaatgacagaagcgcatagaatactgtgtcaaatatgtatatataaagtcttggaaattggggaaggtattatatcttctgtgtcctattttactttggcaaagaggaagttcttagtgaatcttaatggctaaattgaaatagccctgttatgaaagcatttatatatgtgttctgtggatctcacaacttggctctctggtccttgctgtccaacatggcagccaataacatcatacggctatttaatttatattttattttttgagacagagtctcgccttgttgcccaggctggagtgcagcggtgtgatctcagctccctgccacctccgtctcccaggttcaagctattctcctgcctcagcctcccaagcagctggaattacaggcatgcacctctgtgcccggctaatttttgtaatttttttggtagagacagggtttcaccatgtcggccaggctggtctcgaactcctgacctcaagtgatccagctgcctcagcctcccaaatttctgagattacaggcatgagtcactacacctggcctttaaatttaattttaattgcctgcaatctacttggaaggctgaagcaggataattgcttgaatcagggaggtcgaagttgcagtgagccgagatcacaccactgcgctccagactgggtgacagagcaagactctgtctcagtcgatcaatcaatcaaaattttaatttattaaaatgacataaacttaaaaatctagttcctcatttgacactattcatcttcaggtgctcagtagacacatgtggctagtggccactgtgttgcacagcacagatattgaatattttcattatttttgcagaaagttattttgaacagtgctgtagtgcagctcctatttccttttctaatatgcttccaggtcagatatttcctataagcttcctcaaagcctatgtagaacacatgcaaatacttatttatatcctctagagcacccctgtggctaccaagctgggcacatagtaattcttagcctgattggtagaatggaggagaaagctggttttgatccttttgactttcacctgcctagtggccatttaagttcactgcactgagaactgaatggttttagatccagctattgtatttggctaagagtttgactgtcatcagcctaattttgttattttaatagaaggaaatgtctctgggtttgataggttcttgtttgggaagtatagtttaacagaggtagaatttaagaagatgtcctgtgtttgttttgaagagagatgactgacaaacattttgcacaactgagctcaagctcatgggtctgtttgatttttgtaattctgatcctcgatggcctttggttaactgcaaaacagtcaaagtgcagaggctattctctctccaagcttccctttgcagtattccatcctattgattcctgcattacctatggggaaaaaaaaagtttgttagaccaatttagtgagccagaattgtgattctgttcaggaaaatgtctgctgtatttgtcattgctagtcattttacaagtgtattttgatgagctgagtatgtaccacactttacgaagggtgcgctttttcctttttgcttctacaggtgaaaaccttcaaccaggaagcatttttatcattttaaattccaaaaatactaatatttaagaataatgaaatattgaattgcctttttcttttcacctttttttctggattagttggaaactttataggaactagtgaaagctacatgatctatttgtggatagtgctggaaaacaaggctggctttttaagtaattagtaggctggctggcattgaaagttttggggttttcgtgatttatgtagtgatttttctccaaccattatatgtttacaaaattttacttgcagttattttcactcttttattcactttctcactttcagctcccctatctcatcctttcttgttacccaactcttcttttcttcccttcatttcttattttctgcctgtataaaaatatttttccggctttaacacaacatattgtgtcagttccagatctctacaagggtgttctgaagcctttatggagtaggggactggtgggtcttagcggtgatggtttgagtttgagacagcttcgttcactacactgtgctcctcctgcatgaacctagacctgtgttttaattcagttcctgacattttggcattgaagtctatattttagctgcccatgctgaatcaagcaaggtgcaattaggaggcattctaagactaatttttagaattgaagtgggaaaatttaactggtaaaccttgaaaatgaccttcccagaaaatctgtgctcattctcctcagcctgtctggaatcatcttcatctgagaactctctcagctcgctgggtttggtggctcagttttctgactctgcttcttatctctccccgaggaataatgcaatgacattcaggaatgttctgcttccctagaaacatagcttgaaactgtgaagtgctggaggctaagacttcttgtcattgtttgttctacgtaggaattttcatttgctgtattttgaaaattaaaaatttagaatcaatttgtgataactgcgtactgtagatggggcaccttaagctggttgatttggatcagtggcgcatatttttttctcagttgactgagagccctaaacagaagccctgtcaaaaaattctcaggaatacgtgactgatactagacatagagatgtacgtcctccctcggcctgccaccctggagattgaagtgctagtgttggtaggagaggcagctgagggggcccaaaaatgaaatggcacagaacgatcgtgagctttcttttttcatttggacttcttgtcactgaacttcccactttcttcctggtttcattttgtggcctgctgtaccctcaccctatgttgctcctgcctttccaagggacctctgactaaccttttcctctccctcctctccttctccagccctcttttcagtctttgtcatactagttactgtgctcattggcagtggcagcaaaacgtagtgtagggtagaagggagcaaaaccaaagctgcgcatactctgagcagccctcaggtatgtcaccttgcttctgtgcaagaaggcccacttccaaaagtaatgacttttctttgtatctacttttacgtaaatagagtacttgctgaatatagagcacacagtctgtacactgatgaggacttgggtagcgttttgttatctccgtgctcacagccacctggtgaggtagacagtctgttctcttagagaaaagcgaggctcagacattaggatgcactgctgtgggtcatgcagaacaagaggtggggcagcacctctgaacccagctcagttcctccttgcctcttgtctcagagcaagtgaacaagaccctgacttttatatcttcaaatgcaggttcatttccaacattgcctagttaaaaatatccacagggattttttttttccttacagatttaagagataagatctggtctttgatcttgagaatctcagaggggtgaaatgtacagatgctgcctcctcagatctgctaccttagattggatttagaatagagtaagcatccaaacatacacacacacacacacacacacacacacacgcgcgcgctcgcgtgcgcgcactcttcccttagaagagcccttaacccagaatgggggctttccctgcagggtattcccacaacatcacctcacagccctcctctagcactgatctggctgaactctgcagagcagctgtggggataaactggtgtggcactgccacctagtgactgcccgccacaccgttctttgcctctgaggtgccgtgcatccgtcagctggccgctacccatcatggaaaatcatagtgggggcttctaaaaatagagtctgccaggccagtgtcaacatgctttctctgctatcagcagagcctggcacacatcagacatggattagattaagtgtttttgaaaaagtggttttttgggtaagggaatctttgggcctggtcgagcatggctccatctgtctgctggggttccagtttcctcttggaggagctcacagtgtgcacaggatgcctggcacgcagcaggagctgaatgaatagaggttgccccgcaatgtttaaatatccactggtctggaagttagaaaaggaacaggaggaaagagaaacttggtcagaaatgctagtcctggttaaaacattgttctggattttgatattttttgatttcccagaaagtatcaggggcttgagaatataattctcttcaggcgtttttgccaaattccaagattttccagtttcactactttccagatgtgttgatatgaagccagctccagattgtctgatggccattactagagtcccagctgccctgaaactctaggccagtggttcagaacaggagtaataccgcccccaggggaattatggaaattagtggagaattttttttcttgttgctgccttgggccagggatgctgtgtatctgttacgcatttaacaaaacactgttctacatcccacttgacttcagattgacctactggatattacatataacaaaaacctgtttataattttcttagcttagacctaaattcattttaaataaggacataaaatagttttgctcagtagtaatcaacatttaattttcaaataatgtaattttctaataatatataaattgggggaaattattagtgataccgtctgtgttcttataggtttttaacatagtagtgaaagttatataggtgtaagatttgagacttttaacttattgacagataagtcattgctgaagtcacttattccaatatgacatgtaaatgcatagtgaataatagagttagaaaacaaaacctctttgtcctctcagggaaacacgataaatgtaattcttcaagtttgaaaatttgtggatgttctatcattcccttttccattgggacatcgaactttattttaaagtaagcttatgctcttagaacatagccgctgatggtctggagacaaaaaagtaagttgtctatatcccaagtgtgaatgaaactgtcattagccaaggttaatgcatgaaaagaaaccggacattttacagaaccatgccccgccaaacatacgcacacacacacagggagagagaaaaggggttagctttgacatttttctcaatgaaaagaagagaggaagacattccaaatgtgcaaaattaaaggagcaaaagaaaatcaaggtgaaaatactcactttggcattttagagtcaataaagaattatataatttataaaaattcaaggctggaggcggtggctcaagcctgtaatcccagcactttgggaggccaaggcgggcggattatgaggtcaggagatcaagaccatcctgcctaacatggtgaaaccccatctctactaaaaatacaaaaaaattagccaggcatggtagcgggtgcctgtagtctcagctacttgggaggctgaggcagcagaatggcgtgaacccgggtggcggagcttgcagtgagccaagatcacgccactacactccagcctgggtgacagagcaagacactgtctcaaaaaaaaaaaaaaaagaatcaaatggaatcctgcctaaattaaagctgggctttagatgtagcagcattatactgcctgttgccactgctgcttctctttgtttacttactaatattaaaggaagtctgtattgaaatcctcaagatcctaaagccatgtttatgttttcataactcagttatagggaaaaaataggagtgcaaggaggggactatgagaacgtcaaatagattggggcagtttacattctcatacgttctataaattagttccagagagagtagtttcatacataaaactacagcatttatactttagagcaccctcacttagggaggtttttattaaagtgtttggacttactggattttacattttatttgaatttagaactgtaattttaggtgtcagtgatggaacattattagacactcatgtcatcattttcaatctgttgcatatatttttctttgataggtctttacatctggtgttcacatttattacagcttgcatattaccttactccttgcaaccagttttctgccttaccacattttaagcttctcatgaatgcttactatttttactcatctacatattctcagtgcctccaaaagtttctttacatgtagatgttcaccatgttattgaatgagaaactcctgaaataaagctaattgatggttctcagactagatagcacattaaaatcatctggggagcttttaaaaaatccctgtgccatggcttcacccccggagacctcagcttcattgtttacggatggggctttgcacaggattccttttaacacttcccaggtggctccaatatgcagctacaggtgaatatgccgctacagtgaatagctacgtgtgaatatcagcaacaagtaagagacacgttagctctttcttctgagccattggcagtaagctcttttccttttgaacttagatatgtaccttctttgaatttctttttatgcttatatgttctaattaattgaagcagttattttatttgcctttacttcaaatgaaaactacatgcacatagttgcaatttggaaggagaccatttatcagactccttgcatctctctgagcctgcagctggtggacacggcaatatcagctttgttactgaaattaaacggatttggacaccaccacttgccctacagccacatgggctttctaatgttctgctgatttaccactgaatttgaaaaaagtcgtaggtgtaccctcacactgagggagtcactctgtgtcccaggtgagcttaccacatagaaaaccccatacacctgctttgtgggcaagccaaggaaagagagggcctgatctatgcctgctcagttcctactgccagatttttcatccctcccctgtacaaaacaagagatgcattgcctacctcttttcctcccaacacacatacacactacttaaaacaaataatgttagaggcaagcatttgaatatttagctcggtctatttttctcctcttagaaactttttaagatcttttctttattcctggtatttaaaaatttacagtcatctgccatgacttaggtcatttcttatttcgtatacatattctcagtagaatcttccctttagagatagatgtgtgccttccagttttccagtcaaagaaatagaagaacactatttcttttcttccactgtccatattatccttctggaaagatagttgttggaacctctattttaattgtctgagaatgtatcttttttgttctcctcttctctttttgcttttttctactttctgggaaatttctgtcaacttacattctaactgcattacggttactttttcatcataagttggtgttgtatagttgtattccacttttcctcttcctattaatgcaatttttttttaactttcagttcctgtgatacatgtgctgaatgtgtaggtttgttacattgatatacatgtgtcatggtggtttgctgcacctgtcaacccgtcatctaggttttaagccccacacgcattaggtatttgtcctaatgctgtccctgtcctgtctcaccacaccccagtaggccccggtatgtgatgttccctgccctgtgtccacgcattctcattgttgaactcccacttacgagtgagaacatgcggtgtttggttttctgttcccgtgttagtttgctgagaatgatggtttccagcttcatccatgtccctgcaaaggacatgaactcattctttttatggctgcatagtaaagtttttatttagcctttttgtagtataatttacatagttcaggagtcctgtcccctcatcactctacatcatctcaggtttgttctgtttcctcccttcccttcctttctttcttcctccctcctttttgtgtcttttcgatagaaatcagattcaagtgtgtgctgatcatttgccattctctcgtattaagagtggcaattggaagccagttggaagctcggtaagggtaagggtttactgtttgatgacaatcactgtggggtgatagttgagtttttcattagggaattcttgatattattaatacatgaatgtctttcctgagaagttgtcctgtttctccagggaaaaatattctttctctgtattatcaaattctaatattagggtcaggtatgggaagtgaaggaaagagactagaaatgctactgttcagcttagaaacttgaacttaaggccccaaacatttcttctgcccttggctgggccctaagtctctgagtatccagtgtatccccagagaatgaacctatctcctgtgagttgtctgttgataccaggcagggcaggtacgtgcgtatccatcattctgtatacttacagttaatcagttcccctggttttagctttggactttatccacacattttgtggtacttggtttctccaagttgtgacacttccacgggttctatgacaatttgtgccttcgaattgggggtacacagaccatttatatttaatgtggttacagatacgcttatgtaaatctctcctgttgctatttgtttactatttgctccatctctttttttcctttatttctggctctcttgggattttttttaatattcaattttctatcctttattgagttatcagctattctttttcaatgtgttacttcagtggttcctttggggtttatggcacacaggcttacctcattttattgtgcttcactttattgtgtttcacagatactgcattttttacaaactgaaggactgtgtcagtgctgcatcgagctaggcgatcagcatcattttttccatagcacatgctcagttggtgtctttgtgtcacattttggtaattcttgtagcttctcaaactttttcattattgtacctcttatggtgatttatgatcagggatctttgatattacaattctatttatcttggggttccatgaatcaagcccataagagaaggcaaacttaaatgataaatgttgtgtgtgttgactgcttcaccaactagctgttcccccatctctctcacttttatctggctttcctattccctgaaacgcagtgatacttaaatgaggccaactaatgacctacaatggcttccaagtgttcacgtgacaagaaggattgcgtatctctcactttcaatcaaaaactagacatgattaagcttaatgaggaaggcatttcaaaagctgggataagctgaaagctaggcttcttataccaaacatttatccaagttgtgaatgcaaaggaaaagttgaaggaaattaaaagtgctactccagtgaacacatgaataataggaaacaaaacagccttaatgcggttatggagaaagtttgagtagtctggatagaagataaaacaagctgcaacatttcctcaagccaaagcctaatccatacaaggtcctaactctcttcagttctttgaaggctgagagaggtgaggaagctgcagaagaaaagcttgaagccagcagaggttggttcattagatttaaggaaagaaaccatctttataacataaaagcaaggtgaagcaggaagtgctgatgtggcgacagcaaggtgtccacatgtgatctagctaagatcgttgaaggtggctacaataaacaatagattttcaatgtagatgaaacaggcttctattggaaaaatatgtcatctaggaattccatagctagagtggagaagttaatgcctggcttcaaagtttcaaaggacacatgaactgtcttgttaggtactaatgctgctggtgactctgagttgaaggcaatcctgatttaccatgctgaaaaacctagggccgttaagaattatactaaatctactttgcctgtgccctgtaaatggaacaacaaagcctggatgacagcacatctgtttatagcatcatttactgaatattttaagccacttttgagttctgttgctcaaaacaaacaaacaaaaaaagacttctctgaaattattactgatcactgacaatgcacttggtcacccaagatctccgatggagatggacaagattagtgttgttttcatgcctgctaacaaaacatctattctgcagcacacagatcaaggagtaattatgactctcaagtcatattatttcaaaaatacattttgtaaggctatagctgatggagctaggcaaagtaaattgaaaaccttctggaaaggattaatttattctacatgccattaagaacatctgtgattcagggaaggaggtcaaaatagcaacattaacaggagtttggaagaagttgattctaaacctcatggataacttgaaaggattcaaatttcaacagaagaagtagctgcaggtataatggaaatagcaagataactagaaatattaatagaagtagagcctgaataagtgattgaattgctgcaatctcatgatcaaatttgaatgtatggggcgtttgctttgcttcctatggatcagcaaataaactgtttcttgagatggaatctactcctggagaagatgctgtgaacattgttgaaatgacaacaaagactttagaaaatacataaacttagttgataaagctgtgtcacggtttgggaggattgattccaattttgaaagaagttctatgggtaaaatgctatcatatagcatcatatgctatagataaatctttcctgaaagaaagagtccattgatgtggcaaacttcattgctgtgttattttaagaaattgccacagccatctcaaccttcagcaagcaccaccctgatcagtcagcagccatcaacactgaggcaagaccctccaccagaaaaaagattatgactcattgaagacttaaatccatagaatttttgagcaatacagcactcttcaattaaggtatatacattttttaagacatcatgctatagcacacttaatagaactacagtatagtatacacataacaacatttttagaaactgggaaacaaatttgtgtgacttgctttgttgaaatatttgcatgattgcagtgatctgcatctgaacctgcaatatcccccaggtatgactgcacttacacacttaggcatactatacctatgttatcacagtctttcttcacctgatagtatatactatcttttactgcagtctatcttcaagcggtactgtatcacttcacatagatgagttttcagcttaataatcaagcagaaccctatgaagttctctgcatgtgtctctgtacaggtctctcctttttgatttttgcccttttgaattcttaacctccctggatttccagctctgtccttcaacagagggagacctccaggcagtgccaggtttccttccctgagctgcacctgagagattctctttagtcattaaagtgggggccattgtattgctcagttgttttccatctctcaagaatcactgtcctttgttgctagataaccaatgtcttgataaccattgtatcaaatattttatctgcttttttagttgtttcaggagagagtataaatctagttctctgttgctccatcttggctgaaagcaaattacacagtaattgacataagaatgtgttgtttcttcttctctgatgtctcctttcatttccctttgttcttgttggtttacaccttttaaaaaaaatgcattgctgtcactttaatggtatttcaggagagaggtggattccagaaagagaactgatggtggattgatcacatgcatttacatctccataatacttctcactaactatggctgacatttgagaccagagctgacatttgagatgagattttttttccatttttagtattactggtaaatttaatagaaaaggattaatgaacacaatttgttagctgttaacctccacgactgaattatttttacagatataaaaataccttctaagttgcacacagatcttggaacataacacgacaaatccaatttatgttcactgatgagcaagaattatttttatccactttttatatgtctatgtgtataatcctaaaaatctagcatgtggcccaaggcaagtcaacttgaggacatgtttccctttgtcacattaattacttcaaatattacttccctgctatgtttttgtaagcatctgtgactatacaacaatgaataaggcatagtcgttatcttcaaattctttataatttcgattctaagggtatgttagatgagtgaattccacattacctgtcttatgacccaaagtaacgtttatcaaatggtgctagagatatctacaagatgttcctgggatacagagagggaaccaggcttggagtatcatgctgaccaaaagctacagggaatctggagaaggggacccacaaacagatcctcagagtacaaacgagggttagagagaaggggggacgtgtttcccagcagaaggaaatacatctgcagagaaagagagctgtgaaggataacagcatacctcccagccattagtgtgcgggtgctgagggaggcaggagcgcaggccagaggccatcactctcttggggaagaaggcactgattccttgggaaagataacttctgtgaactttgacacacgttatagaaagctgtcatatttgtaatctaagaaagagtgtgagacccttagtcagcaatgaattaagaaatgaattaggaatagaaactaagaaaaggaacagtttgcttcttttaaaacattaaagttgatcttacagtctttgtctctgaagcatgcagttcatgccaaaactccaaagtcctcattttaaaagcttgagattattgggcattccttgcactaattttaatcttattgaatgtgtttttattaaatcagcattcatgttgatcaaaacttgaaatttgtacaaatcatttcttcatgcctttctcagaatagttctccttgtagagaaggttggaattgtctaagtatgtgaagcgaacttctataaaaaatgttttgaaaatttttaaacattgtattaatcattcacagtgatgtgaatctgtcatagattaaaaacctggggatgttcaaaatgataatatcatcctgtgaaaagtctaattttgtttctgagttgctgaaaaacaaaataggggattattctaatagtatctaatttggttcctgattacctcatcttgaatattcacaatcatgtatgtctgagtgcaacataaacattagtatgagatgtcatttttctattctgagctatttttagggcaggtttattattttgtaagcaaaaaggataatttatcattgaatcccaagccctaaaatgccaactcctagaaagatgcatgtttctatttaaagctcttcaatacaggatgacaatctctgatgcaatgtaatgcgaacagcatatagtaaatattaattgagtgatttaatgatgtatttcctgagagtatttggcaaataaggatggaagaaatttgtctatctaagatttgagcatttgttaaaggtaagcgtctaatgagttagcttgcctaaatgttccagtgtatgcttttcattgcagttttcagtcatttactgcccccaactctgaaaaacatttttaataaaaagtgctgcaggagcaggagattagaaagaccttcacacccatgccaaagttgaaatttccctgcaggcaacggccatgaaggtaccccctagaaatctttgtttatcgtatgaaatctcttacttctcttcgtagttacctgctctgtgaaaaccacatgcctaggaaggttgtttttttgtttgtttgtttgttgttttttgacaaggagtctcactctgtcatccaggctggagtgcagtggcagtgcagtcttggctcactgcaacctctgcctcccaggttcaagtgattcccctccctcagcctcccaagtaggtgggactatcggcttacactaccatacctggctaacttttgcatttttagtagagatggggtttcactgtgttggcccaagctggtcccgaactcctgacctcaggagatccacctactttggtctcccaaagtggtaggattccaggtgtgagccaccacacctggctggcctagctagttattaataatagtgttctggtcactcactgtggcagtgaaaaaacaacttgaagatttcactgggacccaggcacattttctaagtgtctagaaactaagtatctaaggacactttgctgatatagagacagtcaagaatataactgtttcagccaaagattgtccatgcattacaacatacgtcaaattagaaaatgcaagttaagttctctgagtacatagtgaacactcagtaagtatggtatgtacatacatatgcatcatggaaccagagccattagctcttaagtgtatcacatcagtgtatgaattgtgctaagaagcagctttgtctcacaattaaaaactgaataggaaatgaactcttttgcctcccctctctttacagaccattcttacgatagggtaatgtatttcctgttttaggaaattgcttggtgaggaatacttactagagagccccaatattattaatagattataatccagagtttatttctaggggttttattttgaaaggaaaaccacgtcctcccattgaagctctgttacatacgcatagcaggctcccagagcagtccacagaatcctgcttagctcatattgtggctgagcatagcactgatcacatagcatcttcctaggtatatattaggtaacaaagattctcaggggaaatgcactcagctgccttcctggaatgctaggaatacatatgactttccttttgacaatgacagcctctacaccaagaccttctggggagaggggactttacagctaggtcatggaggttgtttaggggtgaggaacggtggtgatttctgcacctctgccacagaaacttgcaggatgctcctaatcaggctggctgcctgttcacatgcccttccctttgattccaggagatcagtgattgccctttctctggggttccactcactccagcccggagcctgtttccttagtccacagtagcaggaaacagaatttcttagcttctctattctttggaagaaggcaaagggacaaatgtgataagaatgggtctcttgtatgtccaaagatagagtgtaagatctgctgatattgtggagaaaagcttataccctgtaagataaatctgcattttttatttttgaagcaggaagcttggcatgggatgagggacaggaaaaaaaaaaaaagcatagcgaatgccatggtccagtgtaggttgcatatagggctaatcctggggctctggctaggagcagcctccttgccaccacagccctggcagcacagacacagatggggaattgagttgaaaggcaggactgagtgagcgaagcaggagatgatgagtaccgcgcaattatcagtatattttgcagagcaagaaatgaggaaaggaaagccctctgagtggtatctgagagatgggaaggagtgatggtcctttccaatggtgggtgaaaagtaaggaagtcttctagtgaccagagtctggggcctgactgtcatagaaaccagagcagggcctctctgccccatgaccacacagaatgtgcatctagagcaaattcttctagggtgacaactctgatggccttgctgttgtatgcatacatgctgttgtataaaaccagtgtccacatcacgggcacagagggttactgtttcgtactgttaattcaaccgaagtgtgataggatacctgtttctgatataaaagctttcttccttaccagtaaaatttgacacctcaaagaatgattaggatactttgtatccctctccctcttttcgactgtaagttctttgtgtataactggtaagacaacttctattaagctctggttatgggcagggactctgtgatcagaggtacagtttctgtgttcaaggatgaaggacatccaggtagattgacctattataatatggtcccatgatctagggatgtgcccgatactcagggagcacaggggaagcactgaggggaagagaagacagaaaaggctcccacttgaacttactttgaaggatgaagaggtgttagcccatcgtcaggaaatcgaggtagcaaaggccagtccaagcaaagggaacatcataattcattttggttacaaaggtgtggagtgagattgggcagctgcatattgtctcttaagtctggcacatcagctaggcaaggagtgacgagacacgggcaggggccggaggagtctacaaagataaatgtgcctgtatcatcttacaccagtgaggaaatctgttttatattttacagtctctttcagatgatatataaagttgaggcactttctgatgtcgtggattgcttagatggaacctcaattttgtttatattcacaagctttgaaaacttctaaatatagcagtttatagaagatacagtaaattcgttgaattgaaccaaaccacacttaactatcatattggagattaattataaaggactggttttgtttgctgtttttcaggtaccatgatcaacaggatgttactagcaacttccttggagcgatgtggttgatatcaataacttttctctccattggttatggtgacatggtacctaacacatactgtggaaaaggagtctgcttacttactggaattatggtaagtgtctttatacttcacatctcttttatttacgctcaagaaggcacttaaaccactcagtccacgtgcataagtaattgtgagctacttcttttcccatcagcaggaaatcagtataaataaatcaattttgtgttgagagagaatgtcaacagttttcctcttaattcttctcatcatgaaattctgttgaagaggtagagctgtttgattgccccttgtggggcatgcactaatttgataaactaatttgatcttggagctttggcttcagaatcaggaagtcctttaagactgtgtcctcccatctcctactagctgtgcaaatttgagtaaattgtaaaatatagcccataataactatcttgaaatgtgttgaagggtagaagatatattaattataatatttatttttctttcttttaacaaatgtttgttgagtgctaggcactggcctaggtactaggaatacatcaaaagaagatagaaacttactgccctgccttcatggagcttacaagggaagacttgcattttaaaaataataaataatggttcattacatttgtgaactagtaaagcttctgacctgttttgggcctgggggagagggatgggatctactcagagaaatcatcactagaaaattgatttttacgctgaagtgagaagggtccatacccaggaagggaagtagggagagcattccaggaagaggaaatggtgtatttgaaggcaatgaggcaagaaggagctcagtacagtggagccaggtcattgggccaggagtacacagagcaaaaggggagagcggcctggcatgaggcagggacaggaggccacgtcttgtggagcacttgggaaaggtctgctactgacatgccatcgttcttctggcatgcctcataggctcagacatcttttttgcccctccacacatgactagccaggaccacttttttgctccatttgttttttaggtataggaaatgggaggctagcaagctgtgattataatgtggtatgaacttctaaatatttaagccagaggtagtttcaaattgttgatgcacagttttcaatgacctaggcttgtctgcattctttatctactttttaaagtttgcttacagcaaagagtgtcatcttgatccttgtgtggtttctgtctacatgaggatgtgaacgagtactgcaggttccaaattgtcagaatttctgaaatcaggtaccctgttcaacacctctaactgtattcacccacaggctggtaggagagagcagagggttgtcatttgagggcctctgagtggtggccagtggagggtgcacacctttgcagaagctgcctgggaagactgctccaagagtcacagctaagtggaaggagagcgtgcccttggcatagacaggcaacatccttctcccccctcggtagtgttcaactgggataaggcagctaactttgaaaataagaatccagggtcaattttaatgtcccagtagtaacaagatggccatttcaagtcccaattgtagaaaatatagtttgggggcataatttaacattatttgcctttaaaagaaaaataatagttttaattatagtgaactttaaaaaaaaaaacggtatgctgcattatctgtttgtttactattggatcacttccccttttttcctcaaataatagcattttattatgtggtataatgctttgggaaatgtaatttgcatagattatttttaggaggcccataacaagtccacaagggatataaatgatgctatttataaaaactagtaattgcagagtctttcccctagtgcttcttagaaacaacttccttagtgttactttttgtcaagatggtaccctcttttattctccaatcaggtgtgactcaagggtcatgtgcacaggcttatttgccatggaatctgagccaaatttgaggttaaccttgcctgggttttacaaaatgtttatcgttccttgatattttcttgttcctcgtgtctcaaaaactgttccttcaaagtctcatcagatagtacaaatcttttatttaccttcttgaactgcctcttgctcaggtttcactactgatcttactttgcttaaaaaagagaggttatggcctggcactgtgtcccacgcctgtaatcccaacactttgggaggccgaggcaggtggatcacctgaggttgggagttcgagaccaacctgaccaacatggagaaaccccctctctactaaaaatacagaattagccaggtgtggtggcacatgcctataatcccagctattcaggaggctgaggcaggagaatctcttgaacgtgggaggcggaggttgcagtgagccgagattgcgccatggcactctagcctgggcaacaagagtgaaactccatcatctcaaaaaaaaaaaaagagagaggttatagtaccattaaatatatgtggacacaaaaatgttatatgtaatggaatttatggtgacttcgttccagcccttaagcttatggtaaaagagtccctctattcttaggctgaggagctccattccctctccttcataaggatcagacttatttcctaattaattgacttgatcaaaattggtttacttgcatacagagaaattcactaatatttgagtaacatatttgagatgctctgtagagttggattatctcttcttctagactaagcagattcccatggagtcaggctacggggcagtcttcctgggattcacttctggcagttgattacatcttacatcagctccttagggatcaagagcatatggatgaaagtgacctagacactcctatggagaatgtagaaatttcttcattaccaagaccaatatgggaattaaagcttaagagaccaagatctcttattattatttttataaaataagtcatgagattgcctaatagaagaaataaaagaaaaccactcactacccttcaagagaaaaccattatggttgtaattacttattttctctttttattcttctacccttctgctatttgaggaagtactgaagacctgagggtttactattgtaaaggtcatgataaacaatgggatgatttctgagtagctttgtacttttggttgaagatggtaggcaagtaatatggttagatcacagtgtctatcagcttttggacagcaccagctagtttctcaatgtctccaattttccaataaagtaattgttttacttagcatttacaaagttattttatcttcctagaaatatatatatatatatataaaacacatcctgaaagctatgaattctcccacaactatgaatatatatgattgtttcaagagtgaaaaatagccttgtgggtaagggtatctttcatcttatactggaattaaggttgctcatttgttctttttgcttctctatttctgtaaaattacagtgactcttggtggccttttgactagagtatggatgactggattttttggtttaattatctttaaatatcgagtaatatctgttcattcctagggatgcaggttgttattcaataaatggttctctaatagtgatttataaaccactagactttgacaacatctagcatgactccctcaacaaaactgaggacacttcagatatcagtgatttaggtttcttccatcccactagtagttctatgtaaacaaaagcaatgcgtaaagctttcgcagttcatagcaatttgaaaatcactacgctaattaaattttaaaattttcttcaaggagcaaaaaaacaagtcagttcaggacagaagcctttacacagccttgccttttccttaagatttgataataatcctttccacgttaaatttgccctgtgccgaggaaatcttaatttaacatcacatggtgactccattagttgtcagttaaacaaacagtttgcatcctgaagagcaaaaacactaccctgttaagtcgctaagagggtgttccaaaacagcacgaattagctagagctcataaaaaagaagtgattggtatgaaagaatgcgaaacctaaggtctgattatactcctcttcctgtaacactctctgtttccatttgaggatttgttttcccccgccagtgtacatagaaatcctgcaaaactgatctgaagccattccttagtgttgaatgtttgagaatgtgcaaaacactcaaggatttttaaaaatgtcttacacaatttgacattgggtgtttaattttgaagaggttttaacttttgtattgcttgctttttggttctttctggtgcgttcactgaatctcatcagataaagccccagtgaagagagtatatctttaagttcttacatacaatagtttctattttgtgcagagcagctggaggagatgggccttttcagtcataaggctaaattccccaccaatgtcctttcttgaggaccttcacttcccaccaagaaatttcataagtggatcgcaaaaaaatgtcttaaatatgacagctgccgtcttccgggtacaggaaagtataggtggaagttgttgtgaccttttagcacacagctcatggactccacaatttcacccaatttttctaaactatcagcacttttaattggcagagctgcccttcctatctctgaagtacctgcactcacactggcactgttgctaatcaggagatttaaaccgagggatgattcattgttgatgaccagttttatgaggtacttccttctttctgaccctaaaagtagaagaatgacctgaacaagcaaatcactataaaggaggctcgggttgcccaggcccaggcttaataactgggctcaaacaccacacactctcccctcttttcttacaatgaggacatttgaaattgacctccacccttagtagcaaatatcaacttgtatttgaagacacttagagggcatttttgatagaatttgtcatcaaaacttccttgaaacttatttattttcatgacctgaggaaaccttgtaaaactccaatgggatataatattaaagcagagtgctttataaaatgttacttgccagaattgattgtttcacatgtttttatgaaagaataattatttatgtcagtcaagtatagtaaaaatgtttttatggttctggcacattgagtcagtcagccccagggacagaaaaacaggcaatgtgttcaagtatttgttttaccttccttttggagggcaagctgatttgtgaaagatcttaaagctgttttatttttacataaaagcgtgattttttttcaagttaactattttggataaattttaattataggctaatagtctatttagtctaataaactggctgtcaaactgaattttgaactttgaggagcaggagctattataaatcccacaggaggatactttaagcctagaatattttgaacattagtgttttttatcagagccattctctgtagcagtaaaaattctggaatttgtttaaaaagtataaatttcattattatgttgaatcttttgaagatgtctttttcacagttgaaataatcaaaacctttccacagtgtgttatgtgaaggaatttctctttttcataggcttgtatccttgttattaaagcttgatcccaaaatggtttttcaaaatgattcttggaagtatttgcaggatcagcataagtagatgatttagggcaaaaatgtgtcacattttaatttttcaaatattatgtgatacatgcttttgagggaaatgggatacctgaacttcttttacatccaagggctcaacatggcttacagtttctgcgctataatggagaagaatacagtggagaaaaacactacattttaattttaacttggcagcatctaagactatccacgtgttgggatttccctagaggtacataggtaatagtaactaattgtcatttgtctgttcagtttaatctggcttggcttagggtagtaaacgttaacaacacttgtcattacttaccttttctaaagcaaagtccttctccctctgccccccttaacttatccctttttctctctttcaccatcttctctgttagaaggaaagatgataaacaagccaagcgaaacctgaacctttgcttttaatatattgacttcctaaatacactgtattttcttcattttgtttttaaatgcccaagcatcttgaagtgacaggttagtgattttgcttaagttttttctaagaagataaatgaaatgagagaaaagtaaccaggatacattttctgactttggtgaaaggaatatgactcatcttgttaaatgcatacagggatcttaatttcagagagtaacatatgttagtcccaactgtttctacatcgattgtggtggtgacaagctttggagaaaatgttgtaaaatcgtacttatttccattcttattcactttatgaaacggaatcgtcctggaaatagacactgggtggacaataatattatgccattacttaaattactataaccatgaatatgttggcaggaatttaccttgaacctagaaagctttcggaagtgagccagcttcatcttgcataactctaaaaattaaaaaataaaggttactttcatcagattctcttacgatttattaatctagggaagtataagtttatggttttcttcactaaaataaacagttaaggggtttgtatttgaacaaaaaggtttctaagtggctctggaggtataacttaaaggagtagtgttaggataatggagtgaggtatatagataatagttttgataattactaaatgattggattaatttcttttccactttgcaacagaggtactcatttttaatgcatgtcttagatgacacccggtgagaaatgggccagtagcagaaaagaatggagcctgagaataaacacaaataaaaatccactttccaaggctcttgattccagtgattttccactcctgttaggattttgatttctttccagaaagatctcagcagaggccacctgccaggggagaacaatattcaactttttatgccaactaccctctcatagctgtctctgcagtagttaggaacccctcaggtttttatgacctctgcttattaaagaatcattgctgccctgaaccaccaagttcctgtagaacccagtgattgaggagtagtacctaggagcatatctacaaaaggctagcctgtgtttgtcgagcatacgctataccatacagcaggtagctttatggtggttatcataggtggtcactgatttggtttcatcagcctgctagaactctttctttagacttcatggtagatgtttgaaagtcagtaaaatgggtagagatgcttccaaaggccattcttttctttcattagtacccagatctaaaatacctcgctttcattgtctgcatatggcacaaaatatcaaaataacatcacaccctctgcctttactttccttgtttatcgtgtcttcataagtcagtcaaatgactcttataagaattttgaccctcttgttttaataggtttatggagtttgtcatagtcactgcatatcctcctttatctaaagcagtgactataccttgggatcacctggagagcttttaaaaaatttcagacacctgggttttatccctggagatgaagatttgctgtgaggcacacagctctcagcactaggatttttacaaactctccaagtgattctatagtcaaggttaaaaactaccaatttaaaagttataccagttacacaatagggacaatgttgattattttgataatcatattgcttgatttttagacattcatactttatcatataaaataggtgaatttgaatttcctgtcttgctttgaaatacagtgcttcataatgcattatggctatggaataatcacaaataagaatatacagtcatcccttagtatccatgggggttcagttccagaaccccacttcctgccatgaataccaaaattcacggatgctcaagtcctttataaaatagtgtattacttgcatgtaacctaggtacatcctcctgtgtactttaatctctagattacttataatacttttaatacaatataaatgctctgcaaatagttgctaaacagtattgttattgtttaaagaataattacaaaagaaaacggtctataatgttcagtacaggtgcagccatccatttttttactgaaatattttcaatccagttgaattcatgtatacggaacccatggatatagagattcaagtgtatgtgatcctaaatatagatatagatattatgagatgaagtaaagagtaggaaaaatatcaatgctaatcaaagtttataactgaataatcatttactctgctttagttgtctcatctctaaaatcagaaggctaaatcagaatgtctaaatacttggcaacctctttctctgatcatgtgatcagtagcactttctttctgaggatactgatttcttcatagaactagatggaacaggctatttaagccctctggaaatatattaaagcagtattggctcatcattgtggcaatgtttccatgatcataatgatcaggtcgtgtatttattttctccttttctcctcaatcgtgtccctcctgccagatttgttgcagcaactcattgagtaagcccaaagatggattctttggtctataactgaatagctaaatcacatctactttctgtgcctctgtctagcggactctgcctgtgccctgccatttacattgttatctgtttgttgagactagctgggcaatgtctatggttctgtggtcctctcagggttgagattctatctggaggtgtgacttccctttcacagacccctgaggtagttcctcacatgcccccttccctgctgggaggttggctgtgcccaggactgatgaattggctgcagcaccttgaccttgcctggaccctccaatcggtgccccagcaagtagttgctcgtctttcagcacagaagactctcacaacttggaatgagcacaccttgatcacggagcgggaggactgtaattcttagagtaccacacagagtctctttttcaagagatcagaacaatggtctgtaattcaaaaaggaacactgttggttttttcaaaatgaagatgacccgtgcctttcctagtgtcatgttagtaaacctgtaaaatggtataatggttaccccttaccttcagtacttcatctatctctgttgcccaggttaagatcactgtgatcttcctgttacgcttcctcttgtgtgtgtggaacactgaagcagtgtatatgctgagataatttattgtttttattcctggtgcattgcagttgatcaccttgaaggcctgctgatctcatcttaagattagaggtttattctgtatggaaaaatccttatttctaccccatatacatttatgctaatctactcatttgttatttgttcctattataattataggtatataactgacttgctctgttttttaaaaagtctccaaaaattcaccaagttgcttttaggccatttatttcttagaatggaaatgttttttccaaatatgcttttgttcttaaaatatgtaaactaaatttttaatcccagtttaaggcacattgcttacatgtgttgatcacacattttctgtaatacttattgaagacaatgtttttaatcctgagaaacttttgcatttgatgcaaaacattttctaatgtgtctgagacagaaagtagttagtaatgctttgggtttctcttctctccttgttttcagggtgctggttgcacagccctggtggtagctgtagtggcaaggaagctagaacttaccaaagcagaaaaacacgtgcacaatttcatgatggatactcagctgactaaaagagtaagttactatccatatatcttcaaagagaatattattgtgattttttcagtgttaggaaatatggtttttattttgacatccgaagctgaaatgacatggtttgaaagtataggcattcttggaatcacttccattttatcacattttgagaatagactatttctaccttgaggtcagttaggaagtaattgggcagtcttggtatttggataaagacgagtcacataaatgttaggtatgcctacttgtttagatttcagtatagtatatgaggccaattcttggattgagtaggaaggaaaatactattaatgtaaaatagtaatttgatggaaacgtgattgaaaatgttttactgaacttctaagatcaagtcactgttctcaagacagggttgcaaagacaaaagaaaccaccactaacttttagaagcccaagatagggccagaaacaggctctttccttgacttacaggccataaaagagatgttaaaaatagtataccatccagttgggcaatcgctgtccaaatattagcagaagaaaacagtaatcacaatgtttaagagcactttctgtgccaggcactgttccaagtgtgccatgtgtataaactcacttcatcctcataacagcgttatgagggaagtgctattattctggccattttataaatgtggaaactaagacacaaaggggttaggtaacttgctcaaagtcaccagatccaggtagaaaactgcaagaagagaaaggtttttattagactaaatttttagcctttcttgatagtcacttgagacaaataccaaagtcaaaaaattattttatagtagagtcatcttgctgtgtaactactgctcaatgtggaatgcaatcaggctgtcagtgaaataacaaaatacattgtcaacttggtaactttacccataaatgaatcaatagatatttcaagcatagttccaacttccagtagtgttttcactcactcttgattttggttgtatatttaaaagtaatcttgtttaatttggttgatacttcctaacaggccagtcattttaatgcaaatatatatttatatagattatacttaggaaatgaaaacatgaattgctattgcctgctcatgctaagtcttacctatcagacagtcctgtgatacttcattgcagttagtaggtccacgtttatagtagatggtcagagcctcccaggttcagatgctacattttcagcctacatttaccactttggaatgtcttctactctccatgacttactctcattttcttcaaactcctaaatttgttctcaaaacttgtgaacatccctgtatgagagtgtgcagggaaaaaggtcaatgaggagctgaataaaggcttgggtttcttttactttttaaagatctactagagataaaaatatgtgcatatgagattagactacatctaatccataaattggagcagatgttttgtgtatttcatcatgtgcatgtttggtcctttcagggctctatgctgggacaatttgtgtttaagagtcacaagttttataatattcaaaagaacacttgcattaagacccttgtaatccatattattttaccatgaagattatacatttcctcaggaattaagttaatgccacacttaagatattagggagaaaaataccttaaaataccatgtcgcccatatgtttgcctgtaaatcttaacagaaaaaaaaaaagtgacagaatcacaaataagaaagccaagttagcatgtttgggcagacttctccatgtttcataagcagattttaatttcatcttaagaaggaagcatatagtttctctaaatattactttggaatattgatattccatatcttaattattaaaacattttaagagttagaaaagacaaagagttagaaaagacaaagactttgagtacaaaatttacagtatcacactgccatctaccacctttgataaaaatttttttatgaagttcaccgaggtcaaccagtttcatttgggagacattccaagttggttttatagtgtagttgctgtattccagggcctctcaaccttggcactcgtgacttttttggctgaataattctttttcatgtgggactgtcctgtgtgttctggatgtttctcaccatacttgacttctacacactagatgccagtagcactacccccaacttgtgacaaccagaaatccctcaagagacaaaatcacctgcaggagagaaccaccttttaatgtgctgttccacaaggatttgacatcttagaaaggacagtctctcttaaaagatactgagtctactgaatatattgtaatttccttttttggaataacatataaaaaatatactgtatactaaatatggttgtcatgctatgttaactgttaaggatcaagagctaaagaatcacattcgagtattccaaagattttaagcttttccagtactgaccactcagaaaatcagacgaaatctcagatgcttcctgcttggcagaaaaatgcacgtgtgcttgtgctcatgggtcccctaaagtccggtcagaggcccctttagagaactatggatccaggatctagatctatggattttggtgaccctccttcagtttttatgaatgaaaagcatcttcccaaactgacaaagttttctgatgatgctacagcttttttgttgtaagttcttgtatactttaaacttcctttggataatgttgcctgaattgtcaacttattgcctgttgaaagctttttcattaagtactgttctggtttcaaattttacattttatataatacttaccatgctttaataattctgttatttcattactacttttttttttaaattatactttaagttttagggtacatgtgcacattgtgcaggttagttacatatgtatacatgtgccatgctggtgcgctgcacccactaactcgtcatctagcattaggtatatctcccaatgctatccctccccccaccccaccacagtccccagagtgtgatattccccttcctgtgtccatgtccaacaatgatagactggattaagaaaatgtggcacatatacaccatggaatactatgcagccataaaaaatgatgagttcattactactttttaaaagtagaactactttgcagtatttcttgagactggagtctcttgagaccggagtctcttataggtctgagaaatatactctagtaggcttgctgacagatccatttttttttttttttggagatggagttttgctcttgttgcccaggctgcagtacagtggcgcaacctccacctcctggattcaagtgattctcctgcctcagccccccaaatagctgggattacaggcatgcaccaccatgcccagctaattttttgtatttttagtggagatgggggtttctccatgttggtcaggctggtctggaactcccgacctcaggtgatccgcctgccttagcctcccaaagtgctgggattacaggcgtgagccaccgcacctggccgacagatccatttagtgacatccaagatgtcactaaataaagatattaatgttaaaatgacactagaagaaaacagattgctggtttataatacccattcctgtattatatatactcaacaaggtataggcaaataatagccattttatagtcctctcattattttatacaaagtcatcaacttaatgagtatcatttacttggaatttgattccatttgcttatttatggaaattccaaatggactcatataaatgagtataaactttaaacttttaaaataattctaaaatgctgaatgatttgtgaataattaaaagtaaatagagatctaaaaaccatacctagtaactaagatacaaactcaaggttactacatattgttagagaaaaatacaactattccctgaaacattatctagaaagaaatcattttttctgatggttaacaggagtaatagtcacagatgttctgaaatctgaatatgactctaaagaaaaaagcaatatgaatgttaaaagatagtctgttctcccaggaacagatgtaacattccaagtcttccagtttgtatctttagtgaactgaacaatttctgtgaaaaattattcactatgtacagattttcaggggaacaattttatataaaagttgtttctctgtatgactacattaaccaagtaaaatactgtatttgaaagtagaatactatttattgtacatcagcactgagaagattgttttgtctaatcctaaatatttacatgacattctgcaattcaaaaatggccgacaggtacatgtgtccagaacaaactaatgattttgaagtgaaaacataataccattaccttgtctcctagtttagtaagacaggaccagctatttaatagatttacagtttatcaccttacaggggcaatatatttaccatgcaatatcttttggaaatatattattattactgctcattccattctgagcaaacaggaaatcttgtagtttgatccccagaatacctttttggaaaagaaacttgaaaacaagcaattccaaaacccagacataatttttaaagttgctagataccccacaaaggataattatacatattaatgtccactgtgggtgttgttaatctgttaagaattctcaatcagatccataataagaacactattatgcagttatataattttgtttcctgtatgtctcttaacaagggaacagaaattctaaaggatttatttcacattgtccttggctcacagcccagggggttaacacattaaaatgaatcacttggctatgccctgttccacagctacaacattcacccaggcctcatacacctgacctaaaggaaaactggagagagaggttggagcatgaacaaatctatccctgctgctgcaagggtggttgagagcatatggcaccctggtgcattccccttgaattggcgaggagtggaagtgttatgctaaaaaagcctctgagaaagcagcaggagaaaaaaacaacaacaaagaaatggaagttgaaaatgaagatccaaaatagccttttaaactatgttgtcattacctatatgctataggtttgaacaaagcaaagttttaatgaaaagaatgaatgaaaaagagtgaacaaaacctccgagaatatgggattatgtaaagagatcaaacatacaactgattggggtacctgaaagagatggggagtatggtactaagttggaaaacatacttccggatatcatccaggagaatttcctcagcctagcaagacaggccaacattcaaattcaggaaatgcagagatctccagtaaggtactccacaagaaggtcaacccccaagacacaaaatcatcagattctccaaggtcaaaatgcaagaaaaaaaagttaagggaagccagagagaaaggccagatcacttatgaaataaaacccgtctgactaacagtagacccctcagcagaaatcctacaaggcagaagagactgggggcccatattcaacattcttaaagaatttccaacctagaatttcgttatctggccaaactaagcttcgtaagtgaaggagaatataagatcctttccagacaagcaaatgctgagggaattcatcaccaccaggcctgcctttcaagatctcctgaaggaagcactaaatatggaaaggaaaagccgttaccacccactacaaaaacataccaaagtacatagaccactgacactatgaagcaaccaaataagcaactcttcaaaataaccagctagcatcatgatgacaggatcaaattcacacagagcaatagtaaccttaaatttaaataggctgaatgccacaattaaaagacacagaatggcaagctggataaagagccaagacccatcagtgtgctgtcttcaagagaccctctcatgtgcagacacacacataggctcaaaataaagggatggaggaaaatttaccaaccaaatgaaaactataaaaaaaaaaaaagaaaaacaaaacaggggtggaaatcctagttcctgacaaaagagacttcaaaccaacaaagattaaaaaaagatgaagagcattacataatggtaaagggttcaattcaacaaaagagttaactattctaaatatatatgcacccaatacaggaacacccagattcataaagcaagtacttagggacctacaaagagacattgacttccacacaataataggagactttaatacctcactgtcagtattagataattgagacagaaaattgtaacagagatattcagaacctgaactcagctttggatcgagtggacctgatagcaacagaatacacattgttctgatcgctatgtggcacttaatgtaaaattggtgacataatcagaagtataacactcctcagcaaatgcaaaagaactgaaatcataacaaacagtctcagaccacagtgcaatcaaattagaacacaagatcaagaatttcactcaaaaccacaccacaactacatggaaattgaacagccggctcctgaatgactcttgggtagataatgaaattaaggcagaaatcaagaagttctttgaaactaatgagaacaaagaggcaacgtagcagaatctctgggatgcagctaaagcagtgttaagaaggaaatttatagcactaaatccccacaccaaaagccagaaagatttcaagttacaacagaacatctggagaaccaagaacaaacaaaccccaaagatagcagaagacaagaaataaccaagatcagagctgaactgaagaagacagagacacaaataacccttcaaaaaaaaatcaacaaatccaggagctggttctttgaaaaaattaaaataaatagatagaccactagatagacaaagaagaaaagagcaaagagtcaaataaacactatgataagggggatattaccactgaccctacagaaatacagacgaccatcagagaatgctattaaacacctctatgcatataaactagaaaatctagaagaaatggataaattcccggacacataataccctcctacgaccgaaccaagaagaaattgaattcctgaatagaccaataatgagttctgaaattgaggcaggaataaattgcctaccaaccaaaaacccaggaacagatacattcacaactgaattttaccagaggcacgaagaagagctggtgccatttctacagaaactatcccaaaaaatcacaaaggagggactgctccctaactcattctatgaggcaagcatcatcctgataccaaaatccggcagagatacaacaaaaaaagaaaacttctagtcaatatctcaatatccttggtgaacattgatgaaaaaatcctcaataaaatactggcaaactaaattcagcagcacatcaaaagccttatccaccatgatcaagttggcttcatccctgggatgcaagattggttcaacatatgcaaatcaataaatgtgattcatcacaataacagaactaaggacaaaaaccacacagttctctcaatagatgcagaaaaggccatcaaaaaaattcaacatccctgcatgttaaatgctctcaataaactaggtactgaaggaacatacctcaaaataataagagccgtctatgacaaatccacagccagtatcataatgggcaaaagccagaagcattccccttgaaaaccagcacaagataaggatgccctctctcaccactcctattcaacatagtatgggaagttctgggtaatcaggcaagagaaagaaagagtattcaaataggaagagaggaagtcaaattacctttgcagatgacatgatcctttatctagaaaaccccaacatctcagcccaaagcttcttaagctgataagcaacttcagcaaagcctcaggatacaaaatcagtgtgcaaaaattgctagcattcctatacaccaccaacaggcaagcagagagccaaatcatgaatgaactgccatccacaattgctaccaaagaataaaatacttaggaatacagctaacaagggaaatgaaggacctcttcaaggagaactacaaaccactactcaaagaaatcagaaaggacacaaacaaattgggaaacattccctgctcatagataagaatcaatatcatgaaaatagccatactgcccatgctcatagataacaatcaatatcatgaaaatagccatactgcccaaagtaatttaatagtttcagtgctattcccattaaactaccattgccattcttcacagaattagaaaaaaaactattttaaaatttacatggaaccaaaaaagagttggagttgccaagacaatcctaagcaaaaagaacaaagctggaggcatcatggtacccaacttcaaactatattatagggctacagtaactaaaacaccgtggtaaactggtacaaaaacagacacatagaccaatggaacagaaatgaagtccacacacctacaaccatcatgatcttcaacaaacctgacaaaaacaagcaatgcagaaaggagtccctatttaataaatgatgctgggagatctggctagctatatgcagaaaattgaaactggaccccttccttacagcttatacaaaattaaccaaggtgtattaaagacttaaatgtaaaacccaaaactataaaaaccctaggagaaaatctaggcagtaccattcaggacatagtcacgggcaaagattttatgacagaaatgccaaaagcaattgcaacaagcaaaaattgacaaatgggatctaattaaactaaagagtttctgcacagcaaaagaaactattgacaaagtgaacagacaacctacagaatgagagaaaatgtttgcaatctgtccatctgacaaaggtgtaatatccagagtctacaagaacttaaacaaatttacaagaaaaaaatacccattaaaaagtgggcaaaggacatgaacagacacgtcttaaaagaaaacatccatgcagccaacaaacttatgaaaaaatgctcaccatcactggtcattagagaaatgcaaatcggaaaccacaatgagataccatctcacacccatcagaatggccattattaaaaagtcaaaaaacaacagatgctggccaggttgcggagaaagaggaatgcttttacactgttggtgggagtataaattaattcaaccattgtgaaagacattaaggatgacaattaaggacctagatgcaggaataccatttgacccagcaatctcattactgggtacatacccaaaggaatataaatcattctattataaacatatatgcatgtgtatgttcattgctgcactattcactatagcaaagacatggaatcaacctaaatgcccatcagtaatagactggataaagaaaatgtggtacatatataccacagaatagtatacagccataaaaaggaacaagatcatctcctttgcagggacatggatagagctggaatccattatcctcatcaaactaatgcaggaacagaaaatcaaacactacatgttctgacttataagtgacagctgaatgatgagaatacatggacacatggtgggagggaacagcacacactgaaaccttctggaggagggggtagggggagtgagagcatcaggaagaatagctaatggacgctgggtttaatagctgggtgatggaatgatctgtgcagcaaaccaccatggcatgtgtttacctatataacatatctgcacatcctgcaaatgtaccccagaatttaaaataaaatttgaaggaaaaaaaaaaagtctagcagcctcaagtgctttggtgatctgtaaagtactattatacttaaaaatattttgtatcttactacccatggttttattattttataattaaccgtgagtcgcaatataatatctcctggcctgtatacttgtgaaagttgtttttaaggaatctgggtaagtactaccactaacaataatgtagtagtagtgtttctttctttctttttttttttttttttttgagagacggagtcgctttgtcacccaggctggagcacagcagcgtgatctcggctcactgcaacctccacctcctgggttcaagcgattctcctgcctcagcttcccaagtagctgggactacaggcatgctcaaccacgcccatctaattttgtatttttagtagagatggggttccactagatgttggccacgctggtcaaaaactcctgacctcaagtgagccactcatctcggcctcccaaagtgctgggattacaaacatgagccacagcacccagccagtagtagtatatattttagagcctttgctgtttcaaattattataaaaattattgatatgtcttctaacatttttctgacagactttgattacggttgattactagtgaggcagagcaaatgttcttatttttcaactgtgtgtgtgtgtgtgtgtgtgtgtgtgtgtaaagatgttcctgttaacaaagatccttccccccactttacttattttttgataaacagaaaatgacttttatttcataggtcttttggcctgtttattggccatagaattattatacctactaaatgtttgatggacatcggtaaatcctctcataccacttatcacagtatctagcatgtagtagagattcagtacgtaggttgaatttgtaagtggaaatgcattgatccatttagagcttagatgaagcaataattcatccattatatgaatctgtatacccttgttatcaagagggtcctttggttgataaatacgtgttagtgtggttcatgagaagaagtttttatgtataaattatatgtgctgtggtgcccagttaacaccatagacatttatttagtacgagctgtgcctaaagcactgaggtagagagacacaaagattagtgatatgacccctgagagtttctgaaagccctggaaaggggacaaaagggcattcaagtgttacataactagatggttatatggcagggttcttgactgaggatacaaaggaaactttccctccaaagatgggagggaggttagggataggaaattacttaacgggtacaatgtatactatttgggtgattattacactaaaagcccaggcttcattactacacaatgtattcatgcagcaaaattgcacttacactgcctaaatttatataaataaaaaaaatgaatgcatagacctatttctccccatttttcctggaagtttacatatcactttcttttgccaactccccattgttcaaatgtggaaaacaatgaggtgcctttgaccctgtcttctcactgtcctctgttccttttcaaccctagatggaaaggaagaccctactattagaaacacatctcagtaataggcagagagtgggatttttattctgggacatattgttttgtggctgccatgttgaaaagtagcagttaaatatgatgccttaggaggtttgttcctgtatttgacaacctattagggaattagaaaggggatgggatgtttcaaaataaattcctgtatttagaagtttttaaaagcagctgcagggatttcattttcagatgaggaatcattttcatttaagcccatcagctaaaatgagtgcttagtgaatagaaagcctgtaacataaggcctcgagggcattacccccactccactgaactctgagattaagattctgtattccccttcaaccactttcttcatatacccaagagaaggaatcatttaaaatgcatcggtcacctttttaaaagcgtattgactttagaaataatttggcatttgctgtttgtagatgggaatacaaattgaaatcaagtgctatgttctacattgaggattgctatgttccattgctgtgtttctgacccattggtttttacctagggtttttaactggttttccagcttcctcaccaggcagggatctaggcttctcctctatgccttcgactggtaaaatcagagagagagcctccatcagggccccttgccaatcttccaggtatctacagttgcttagagatctgagactctctctttcctcacagggaaaggctattccaaccccagggactgctggccagtcacttcccactcctctctccttaaaagcaaggtcctcaaataacaactactcatgctgcactcatttccttacctttgaaaggacatgaggatcagatgaaaaaagcttctgaaaggtggctctcccggctgtctgaggaagtggaagtatgaagatggatctaagaatttactcgaactccttttaacttcactgtggatggtggtagtgttacttatacgcagtgctggcacttggcttctgtgtcaatcatttttctgttggtttgaggattctctccatgcacagagtctaatagatatccaaaggcagtgcattacaaaccagagtcactcctaaaagaagctttactgtaaaaagaccattttcttaaaatgagttgtagcaatataatgttgctcaaaaagaaaactttttcactccatgagaaagattcactatcagttaccaaacctgatgttttctttgctaaagtgaaaaatataaatacaaacttgggcccatagtttagtgtaattctaaagctcatccttattgtaaatctaatgattgagagaactttaacattcattatctctaactttctgatgttccagaaaactgcagtcctatgaggttagctaatcacttcaacctgacttggttagtgcaaagtcaagtacgtagaacccggttatcaatctcagctcattgttttgtcttccgcactacactgcctttcttaaaaagttatcttcctccacctagcaccccagtaacctgtggctctctttgtgaaatatcctttttccatcacttaaaagaattaaatggaacaacttcttatagtaagtaatccaaaagcccaagtgaaagctgtgggtcatcagatcccatagtgtgagcaaggaagaagacagaatctgcccttgctggccctttatcagctcccaggatttgttgaagactttcatcaagaaagcaagtgactagattaagtatccatgcctttcatcagctgctgtaggtcttggcagtgttactgcagtgctttcacccttctcatttgtcccatccatttgaaatacagtgtacttaaatttccaacaaaatcataacgtagactccgtcagttaattaaagtatactaacaagcatacaaattgctaagtcattctgggaggctatcagtgctggatgtacttatacattcagcactggaaacatgcccttccagtagtgcacagccagaaataccaagcaggcttgcaaaggacaagattaaccttggcctcatggtattttgtctttctgcagggaaaggaagatcatggagacaacaattgcaatacacggtggagaactcaacaccccttgattaaaaaaaaaaaatagttgaataaaaaagaagtttcctgaaggagtaagatagaatttaccacagaaagaaagtggtagtatctccctatttcaatttaagtgttgttcccaggcaggtacaagtacttctaaaaaggcatagattaaagaaaaatggtatttggagtcatggttactaaatgaagctacagctcaccatgatccttgggatgaagactatgacccccagcaaagttacaaaggattctgctctggaatttatcaactgctttgtttgttctcttaacaggtaaaaaatgcagctgccaatgtactcagggaaacatggctaatttacaaaaatacaaagctagtgaaaaagatagatcatgcaaaagtaagaaaacatcaacgaaaattcctgcaagctattcatcagtaagtatcatttttcatttttatcctgttgttgtgtccttggctttcaatttttgcacttgtttattcttgtttcataaggaaggaaaaaagaaaacattgtcatgtttattcccagaagatgttatctggcaatctaatcattccacaataagatcctgagaataacctcagttcctttaatgattaaaaatcacttattagtactagaatatttattaaaatatcttctcagtttctttttagaataacttctgctgaaattgtatttcttaatttgacctatttattcagatagtttgctctaggattttttcagctttattttctaaacatagcttcaaacatatttatatgaaagtagtgcatataactgatttagtacttgaattttaagttagtttttaatcagaattttggctgtgttcattttaaattttccagtttgtgtagaccttttactctcttatcattattttaactttatccagaccactattatggtttaagtccttcgttctgttccattgttatataattagcatacgcttttaaagtaacaatctatatctagtaagatgcactgataatttgaaagcacaggatctttctcctccgggctggcataatccttactgtaagtattattcatgtgggtatcgattgtgatgccatgcagacttgctcttaattctatatggagaagagcagatatggtcacatctgtggctcagaaaagtagctttccttatgaaacctacgagggtagtaatggaaaggtgggtaaatacaagatgctttggctatccaatgagatttgtctctcagagccaactagtataacaggcaagaaaactcagaggctgcaatttttattttgcatgttcaggtaattcatatgtaatatggtaccactaacattctataggaaattactaagcattcatcttctaccctagaatacaaaacctgtccattgaactgccctgcttaaatagatatcactgaaaatgtagaatatgtaattctggacagattcattcttccatagaaattaaaactcaagtatcctgagatttatagtagaggcaggctctgcacgtatggtagagtatctggccttcattgctactcatggtctttccccagctttactaacacactttcctaagatagtgatgctatttcctctgtagctcagtgacttgacacatcactatgctttttctccctttgtaaggaaaacacaaggttagagttttcaaataatactcttaaaataaggaaaaacacagaaaggaacattatattccatctggctcacaagagggaacttgctccctagacttacagttacccttataacccagaaccaccatccaggagcccttgcctagaaatcttgattccttgaagtttagattgaagagaatgagaaccctccctttctcccaacccagagatgctgagctttcgcctctgtgttccttaacctattttcctgtggaacaggcatcttcctcaaggcactcacctcacacaactctcctattagagtggtcttcccctgctaaaaccatactacacagtaaccccaacacattcatacaggaggtccagaggccataccatgcatggcaaaatcattttttctacctttaatattttggtattaacctatatttagtatgttaaaaagaaaccttaccttggtgcatgtgagaaggtatgtatgtccagggtggaagggtatgagatgacacggcagtgagcaagtgtggtcggtctgtgttgagcagccacacatcccattgcctccaggatcttatctgggtcctttcctgtcagtcagacctatcaaatgggtaattacatgtgatttacctttaatcaattttcatataataacaaatccaagaaaatgctgtgatagtttttatagtacggttctgtagccatgtgcagtggggatttgtattacatcttgtaatataagactcttctggactattatgttcagaatacattcacattcaaaagcctgggggagaatttaggggtttttaccgtaaaatgctttcaactttgccgttaggttattacgtttttacattaaaacattagaaaaaaagtatttggggaagtttaaaaactgtccctaagcaagttgcaaatgcaccctacaaggcatgtcggccctttcttaagggtgggtactgtggagtcgcttgcacggggtctcttagcatattgtgtttggatagagtgacagaggaagctacttgtgatttttctgcttctgtcagatatttcttattctgtttcttctgtagcaatgtgtacttctaaagtagataagcttcaggcaactcagaaatgctctgaattgctttataaattcatctaggggttaccgggtttccattacagtgggggacatttatacttctaaaagtgtaactgagtacgtttattcatgcaagctttgtttggctagatcattctaatcatgcatacttacctttcattttagcttagtgttggaagttagggagtgaagtcataggggaagcacacagggctcgattcctaagggcaaggcttccattgcccactgtgcagatccagtgagaccctcggccttatctgtcggcactgggtacaatcagaccttactagctgaagaaaaatgttaaaattcattcgatagatcactcctggcctctcctactctctgatttatcctgagcactttttcagcagctctctgcttctaccagtccatgctatctcaactctgtttctcttttccaaacttcatagcctctctactctgttggatgctgaactgtccaggcctgtgccctcttttcagtaattgtctttttagattgtcacttagtgtcgtgaagtgttctctttctctaacttttaacgctttttctggtagcaactttccctttaaagtttatcattcttttatctcaactatggaccaacatgaatttgtttcagaaccaagaaatccaatctacttgatttgtatatcatgagagttggattacctgcctttcagaaaccccaggcttctgagttgtcctaatttggaaaagatgtacccccccaaaaaaattacaatgcctttgtttcaaatattgttcttttaaccatatcacattcatattaggcaaaaatatttcttgttgtttacttgaacatcaaatatcaagaggccatgatgactttatgcatgctcttccttctgaactcttattcaggaggaagctgagtgcttacagatgggaaagtatagtagcaatgaagaaggataattggatagtgtttctctttggccaatatttcaaaatcctgcagaaccataacaggatcttccagctaatgaatcgagccccttgtgcacaactgaacaccacattgtgttattttgttccagaatattttacagtttcttttcttttgttttgtctttttatttcaacaaaatgaaaatagagctcggaagtaagttgtgtgagccgctcctttcaacatttgcagaattttctactggctgcatgcacccagcagatcctttatttgtgaattttagtagtctgattgctgctatggaaatgtgatccaaaatcatgatattttcctgtgataagtgaagttcacaaggaagaaatcaacatatgtttctttttcttttttggggggaaaagtgtaatacacatctgcatgttaccttttattctggcagctgcagcttaagcaggctttttctatcagctctcctacattacaggcagtataagaaacaaacaacaagacaagatgattcaagttccgatagctaaaggaattccaatcaaataaggctactgtatgtcagctttccagattagtagaaaataaaatgggcaaaattctactgtcagacatagtatagtaatccaagagaagtaaattaggccccgttgtttataagatgaagtacccacttaagctaagaaactgccactggcccttctagcctgacttacagaattcaggactttctctgtactcattacttgctggaggcatctggtccagagcccaaacttcagtcatttctgtgccactaatactataacttacttaaatttgaacatgaaactttatacaaattcctttatacaaatgttaatccatttttatacaaatggattaaaaaatattacgaagaaaggtaaaggtaatcgtcaattgatagttgaaacaccgatattgaattctagccataggctgttgcctgcagaaagctctgagctgagattctgctttttcttttttttttttttttaaaaaaagaaaaaaaaaaaaaaagcaggtgttaggagataaagacagagtaggaccagactatgatgtttttcttgcagtaatgaagaattagaagagaactaaaaggattaactgttttccatcttaagtatcacttaaaggcatctagaatacctctgttggtatgaatccagcagtgcagaaacatttctctaatctaacacacttcatttcatatgtgaggaaactaaaggtccagttagagtaaggatggaatccactgttgtacactgctctttctttagtacacttctgcgtaatgacccacggatgtctaagtgttctttttagggggtgtagggtgggggcagttgcctgtttttcaaaggcacacatcaaaaattgtaaccctattaattactgagagaaatctttctcaacaatatattggatctaaatacatgcttgtaaattttagactaggacatattccatctctgtaatagcataaaaaggagccaattaacttcgttccagcattctaataaatacatagtcacaatgagaagttataaccttaaactgttgtagattgttaaagatcgtgttgtaggtatgtgtcagctaaacttactggcagaaggcactacatcttcactgtagagcagatttggtgacatattggatatcctagtttcggaacaaaatcactgaacattatgaacgtattacaaaatctccctggcagtaaaatcttgccctgtgagtttttattccttctacataattacctttcatttcaattgaaaaataataaaaaattctctctctagcattaaaactatactttgtaaaatgacttgtcatcaaagcaaaataagattggcatgactttttgtttgttttcattaaatagtttagaagaacctacttctcttttgggaaaaagcttttaattgttagcttaaggaacaataaaccacacttctcttattggaaaatctttcttggtacatagtaaacactgaataaatatttgttgaaaaataatatagtaaataaagttaaagaatagcagagttcttacctacaagtgtttttttaataccgttttttgactcttaattgactcttcatcaggtatatacaatgatatttaacagtagctaaacataatcttacaagtagagattccatctgccagatactataattgtcctctgacttttatctacactgaaaatgggaatttttcctaggaaatggtctggcctccctacaaatttaatggcagttcaagataaaagttaaatgaaatacaatgaagaataagataataattatgtgttttgtgttatattgctgctggttgaataaaagtttttttttttgttaataagaatctcacttatcactgtgttttcatcaggttcaaatacctaacccaatccatttcggactaaacagggctaatacctgtatctaatcatgtaggcataggaaggtgctcattgctccaacatcaatgaaattccagttgctttgcatatttcttcctatgtctatgtgtcatgatactggggctttaaggaatgttttggctttttctcatatggttaaatccttatgagtctttctgaattcaactttacctggtaaatagttgtcctaaggacatctcatctcttgctctcactctctcctttcttttttgcggtgttggggaagcatgcttctcattgtaccagacacataaccagtttggacttaccccaaatgttcaaggcattatccatgcagttatttgctcttgtcaattttgtgcatgctctttggaaggcataagattgccataggaagaagggaacctttctgataccagattctatcttttagattaagaagtgtaaaaatggaacagaggaaactgaatgaccaagcaaacactttggtggacttggcaaaggtaagcctgaggtgcttagccctcctagttgcatctgttgaaatcaaccacttcacagtcactaatcatgaatgtttcaagaggatcccaacccaaatctaattaataaatcaaaccagcaaagcaccctaaaatgatggtccaacttaaaagaatgtttctgtaactctcatttaatgtactctttccctattacgttattcagccccattctgaaaacattcctagttacagtgatttggaagtaccataagaagcttaagtggaataggagacaatacatgcgggatttttatttgcatgtaaatctcatctcaatgagagcagaactgcatcctaggtgtgactgtgatattcaggaatgaataggactcatcaattaaattttgtcctatgtattttaagcaaactcaaaagaatgtaaagttgaaataaaaataaaagataccagaaattacatcctagaatgaaagttatcaccctaaagtgatcacttttttatggttctttctccatttcattatttcaaaatcataccactttttaaaaagtacattaacagtctccaaattattctaccttatttataatatttatctgatcaatgtttagttgtttctccccacataaaacccattcttaaaacataaatatttgtcaataatcaaaacattgcattttcctgggtgaattctaaaggtggtattagaatagcatttatataattgttcagccttttacccaaatgctttgaaagaggcaactctcagttgcatcttacaaactgtttttttttgtttgataaatcagacatgactttgctaaagcctcaagtataatccataaaaattacaagtatttgtcctagtctcattaaataatgcatctaaattacattcattttaatgtatagcagtaacacatactagatgttgaagacagtaagtatttaatgacttaccctaggagagcatatatcatgcatataaactggacagcacacatataaaaagtatgaggacatcctcgattaacgtgtataaatgtggctgttacttggacatatgaaaaaaagatagggcaagctccatcactcctaggttaaatgatttttaatgggtatttttatgaaaaaatgaacagaccacattgaaatatgatgtggagatgtaattttacttcaagagtaccactgtgaggcaagatgctgtttctttattaatgtacttattatgaccacgggactgtacataccataaaggctcagtattttcttaaatgaatggatgctgttcacatattctcaagactatgtagtaaaattaagtgtatgcactctgtctctggtcaaactgaaacaaggtgcctatattctgaataataactcccttatcagttcatttaccatctttaaaagattgttaagcagaagaagagcatatgatagaagggaaatgcagtaggagggacggcttaaataaagggatctcagacttgggaaagtctgcactaaactaagattaaaaccttttcctccctctttgccagccttttccctgtctagctctgagctgatcagtcctctctctttgtctcttggctactcaggaaatatacctagaaatcagagttatggataccctgtgatcaagacaatcaatttcaaggttcactaggaatccagaaacattttcctgttttaaccacttagctttgattaagccatagccaggaggtcagagccatggccaacaaggtagactggtaacttcagtatctcccttaactaatattctctcaatgggttatctgtaaaaattccatttgacccaatggagagaggcctgtaatttggaacaaaggataacaaacaatctttaggaatttattgctttaaattacaaaattatcaaaccagttaatcctaaacttcatttatattctaccctcaacatttctgctacatcccaatgccatctgtattattatttatccctctgtattatttattgttctttgcctctgcccattttttaaaaattacccttgccctaattaacaaacatgttgcaaaatgaatttgatgtactaacctttgtgacaacctttaaaatacatatataaatattcaattgaaatgtttttgtctatcctgataccacctaaaatcaatgggcatgccaccagtagcagtacctgctccacattttctgcaactgaaccaaagatcttatatttcgattataaatcctggcattgaacacatacaatgagttggctttgcaagatgagctgttcagttagctgacacccctgttacactgaatgccaccagcaagagaccagagctaaacctctgagaggtggacagtttgtgttcagggcaagtataattaaccttcttctcaatcctgtttttcagacccagaacatcatgtatgatatgatttctgacttaaacgaaaggagtgaagacttcgagaagaggattgttaccctggaaacaaaactagagactttgattggtagcatccacgccctccctgggctcataagccagaccatcaggcagcagcagagagatttcattgaggctcagatggagagctacgacaagcacgtcacttacaatgctgagcggtcccggtcctcgtccaggaggcggcggtcctcttccacagcaccaccaacttcatcagagagtagctagaagagaataagttaaccacaaaataagactttttgccatcatatggtcaatattttagcttttattgtaaagcccctatggttctaatcagcgttatccgggttctgatgtcagaatcctgggaacctgaacactaagttttaggccaaaatgagtgaaaactctttttttttctttcagatgcacagggaatgcacctattattgctatatagattgttcctcctgtaatttcactaactttttattcatgcacttcaaacaaactttactactacattatatgatatataataaaaaaagttaatttctgcacata

SEQ ID NO: 318 - DNA, 230023 bp, Homo sapiens
atgattaatcgctgaccaccccgcctcccgcagctcgggagagggtgctctgggaatgtggaccggggctctcaagtgccggcagctggaaaggaagaggagtgctgcgaggcggagtgcgccctcggcgaagaggggcagaggcggagcgccaggtgctgcggtctcactcccagccagccaggagtttagaacgttcttcctccgccctctccccgcctcgccccagccacatacactcccaaacctcaacacccaggcgcctcctgggcctctcctaggttgggctgctccagcaagtttccatgaaagcacctgaaatactaagttaccttcgcgaggagaactcgagtgagataaaatcgtgcgcccacgcaggtgagtttgcagccaagaattttggacgctgctgggaggagaaagggaagttgagaaagtctttggacctggtagcctggtgctctttctcatggcttcacccagcctcccgggcagtgactgctcccaaatcattgatcacagtcatgtccccgagtttgaggtggccacctggatcaaaatcacccttattctggtgtacctgatcatcttcgtgatgggccttctggggaacagcgccaccattcgggtcacccaggtgctgcagaagaaaggatacttgcagaaggaggtgacagaccacatggtgagtttggcttgctcggacatcttggtgttcctcatcggcatgcccatggagttctacagcatcatctggaatcccctgaccacgtccagctacaccctgtcctgcaagctgcacactttcctcttcgaggcctgcagctacgctacgctgctgcacgtgctgacactcagctttgagcgctacatcgccatctgtcaccccttcaggtacaaggctgtgtcgggaccttgccaggtgaagctgctgattggcttcgtctgggtcacctccgccctggtggcactgcccttgctgtttgccatgggtactgagtaccccctggtgaacgtgcccagccaccggggtctcacttgcaaccgctccagcacccgccaccacgagcagcccgagacctccaatatgtccatctgtaccaacctctccagccgctggaccgtgttccagtccagcatcttcggcgccttcgtggtctacctcgtggtcctgctctccgtagccttcatgtgctggaacatgatgcaggtgctcatgaaaagccagaagggctcgctggccgggggcacgcggcctccgcagctgaggaagtccgagagcgaagagagcaggaccgccaggaggcagaccatcatcttcctgagtgagtcctaagtcgggggcaacacgtgagcagcttcccaaccttcccccacgacccgtgccactgcctgtggccctctccagggcaagtcttgccctagaattgcacacttaagtttactaaggtggaagagtcttgtagcagtatgagggcattgctctgggtctctgaatgtttcttctctgtgtttcggggattcatggtagattatggtgaaaagagcacgagaccagaacccagaaggtttgggtatattccagaacatcactgctgtgacctttgggaagtcacaaaaatctttggtaaaatggggacaataatactagagaatatgacggacaaattaggtaatgcaggacaggtgaaagtcctttgcaaaagaccaagttctgcagagatacagggaaccgtcttatctagctcttttacccggggaagactttcttgtgcaattagattttgttcccatttttctcctcctttggagaaagcaggctgtgagcgacacacactctcgggctgctattttattccttggagcctcttcgacccaatcttaagacatgggagctctcagcactccccagggcttgggtttctgccactgtgggtctgttccttaccagaccagagcaacctggcaggacggcctgtttatctgatccagaaaatctggcttcaccgattcctaggatttgaataatcacctcacagacccaattcttatgcttgttttccaaacttttgttgtgatacaagtatttaaagttgaggcctcgtctatttaaaaagagcccacaggtctgttgaccccagagccttcagaagagggacctagtggctgggagacaaggctttaatggagacacatgaaatgtgtgtgaacaaagggttttaaaatatatttttttagcagaaacaataaaaaggatgtattgtgcgtgtgtgaatcaaaaaggaatagatataacaaacatttcccttcttccctctcccctgtggcatcaggaaaaggaataaatcatggtgctgtttgttttggtgtgggcaactgggcagcaggttccagggacaggaggtagacatgagagagagttggaaggcacttggagaatgatggaaagacctgggtcttgcctcagaccagcccctggcttccagtgtgtcattaattgttaaaagcttagggtctaattttactctttattcgatttgaaataattgccctaatgaatttcaaagtactcagaggcagccatggattgcccccagggagctgggctttgagagctgtggcaggtgaccagctgacttgactttactctgtgtctgcacaaaatgagaatatttggatgctactctgcattaggggctgtgccaggtgactgatatttccatcttctagaggaggaatttgagacttagagaagacctagttcagaatcacctcagtgcagctcaaagagtcccactgtgcttttcagggcagagaaatgcatgtctgtttgtgactttcacaggcgtgtggtgaaaggaaaatgaaacaaggcaggactttgacaagcataggtaagcctggtggtgttgctgcctcttagggccagcctttctggaagttgtagtaggtaacgttatcttgggacttgggaagcgtacccaactcagtctatcacccactggttgctactactcaaatattacagagaggaatggacattgtatttgcttaaagcttgagtgtttgttgaaatactagttctcccttcctccataaatattcccttaggcatatcttaaactgtaaggtgtaatttatactttagtgtgagttaattaaatttcctttttttttgatcggaggagactggcatgagtggataagaattagggggtagataagcattagcaagtggtcttcaagtatctcccagtctaacttaggaattaaggctgcctttgaccaaagggaaaatcattgatttatcgttactctatttgaccaatctctgtgtttcctgtatttctctgagtagatgtctgttctccccacagcaggtgctccaagttaaagccagtctccatttgcagcataaaatcagaatgccacagacttttatttagagatggataggaccttggagatcatcagatcccattagtaattgtctggaatgagtttgttcttgctgctgctctcgttcttttcttctggctctttccttctttcctataccaactgtatgttaatcgcccactgtgttctcagcataaagattgttgaatggcaatcaggtgctcaatgtgcgataatgtcctgggggaatttaccgtttgtatttagcccattttctctgcggtaggttttcaaagcagttctcgcaaatgtcctcctctcccaatgaatttcaaagagcttttaaaaataggaacctcactaattaactcaagttaggaaataaattaatggagtgaagaggaagaaatcatggcctgcattcatcagattaattcaatgcaatttactttgtaagtttcataaaacttgtgctttggggcatttttaacccagaacaaatgaacatataaattgtttacaaatcgctgaatttaatatagtaatttagttgtctttttagtatttcatttcacagatgggtcaaattaaaataaatatttgcttatttcaaacattttaaatttaatgtgaaatgtaaatggcgacatatcacaagtagttcttggagctcttaaggcaataaagaaaacaattaagattgttcgccgctcgttgttaaaaatgctaacttctgcatgacagaaacaaaattcataaatctacgcaagatgaggaagcccatgtaaaaaatattaattttccttcatctttcactattgtgcctcagtctagtcgatgtgctgggctggtgaataaggaaaacacattgggaactctgggagagaaagagaggctgggatacctactagctctcaagcaatttacaggagaacacaatagtgatgcaaaagtgcacattcctggaaataggagtgtcttgtcttgcctcttgtcagcccagtgacaaatcagtactagacttggtttctgtttcaaggtttcagccagtgtggcatggtaatatttgtccgatgtcagaacagaggttgctggtctggatttctgcctcttctggaggaaaggaactgataatttgattatctgtcctgtcccttcaatgatgaggatgtgtaaaatgagacttcctttcaagcaagtctttccccagacctcccatcttctctttctgaagtctcctttggagttgttctcaatgcagatagcatccaggtctgtggacacttgtgtgtgtctattgcacacatggcttgctatcaagtgtcacccactcaaagtggaatgacaaagtaattttaaaaaaagcatagttttaatttgtataataactttcaagtgattgggactcagctgcaactacctcctagagaactagagggcagtgattggctttcaactatagttatgaaaaaagattttacagacagtcatgaggttattaaataaaagaaacatcatagaagattcataactctagaataattacactcttttgcattctgatttgctctcctgagtcagaaggaaagggaagaagttacatctagtggcagggattacacatcaacttggtttgctcatattgaatatagacattattcatcacgtgtatttggatggaacaaaggttagcagttgctgctgaaatgaactactctaaaaataaggttgatatacatttagatatttgtggcatggttcagggagaagcaaagagaaggagctcagaatcacatcctctgggtttttagaccacagaattaggtcaaaccaagcagggccagggaagaagaagagagagaagagagggtagagggtagaggggaatgagatattgacagtgggtcctctttacctgaggacaatcgttacctgaaaagaactcataaagttggttcctttaaagtggggttgaaaacatttgaaaagaggtctcattgggacttgaaagtgaaaattatgaaaagaaatttatttgtatgttacaaatataagttatagttacaactatatattaattcttataatgattattcagaatgaatccaatgtggcttgagggcacaatttttctaacaaaaccatctgataacctttgtgttttattttctcagtaagattataaaaagggcctctcttcattctttgttatttaaatcaccctcatggaagcacctatccttgcattatccttatcagttttccattctttcataattatctggtctaattcgagcaaatctttgcttgtcagtggcgtggcatttgaatcatctgtttcttcagcttccttttcattgacttcatgaaattctgtaccctgtgtgcaggccataaccaaaaatataattaatttaaaaaccaatccctatactctactgtatatttcgtattacacagaagtggatgccttgaaatgctttgacagtgcccataagaatttttagtagttgttttcttcactaggttaaatgcttatcttacaatcatgttttcatcattagttttcttagcaaaggctttttatttgatatgaaaggatatgtcaacacagtctttgagggaaataccatcaacattaaattagtgacttttttagtgtaagatattattttgactccaatgtttcaatatttcagaaaaaagttttgcctcaaatattttatgtttattaccctatttgtgatagctttcataaattgcaagtgtcctgtgatcagcctggcagacaaatataataatgctgcattatttttataatcaggctgtctcaaagatttcatttctctgttggagagatgcatagtttccgaggaaggggagattgaaatcccagtccccatttattagcaagcctgttcatctgtcagcctcctgggggctgctgaagtgtaataagagaggcctcagttgcacaaagcatttggcttattagtgctaaaaccattcagaataaaagccatttacgagttgagacagcgccgtggaagaatattgaattgggagtcaaggagcccctctggctgtacaaggcaaggtccgctggtctaccatttggaggacactgtcgactcctatcccttttccctctgcacatgtcccctgccaggctgcagccctgggaccactcaactgactctccacctctactcttggctatttactgaggactggagacatgattggtcatcctttctgctgcacattcttgtagatgaatagctgtcttctcattgtgtcctgacctggccttctctgcacatgtgttctcctggtgtctcttgctcttcttataaggatgctggtcttatcagattagggccccacccttacaactttattttacccgaattacctcccaaaggcccaatctccaaatacaatcacaccggggcttaggccttcaacatgtgaatttgcaggggacacagttcagtttataacaccccttaactgccttattccactggctccccttcaagttcttcaagtgaccatgactggctctcttcccccatgctgcctgtgtatgggttgtttcctctgcctggcatgcttttctatcttactctattctctacctgctccccacttccatccccttccccaggttaatatctttctcctctctcagatctccccagggaaactggcccatcctccctgacttcattaaacctcccacaaaacaagactcactgttgtcattttacatttaattgtgcaattactcgactgatgtctgtcttccttctaattccttgtggataggtgcatgccctaatttccctcaacactgtacctcattccagcatagtgtctagacatagtaggtaatgaatatttgttgactgaacaaatgaatgaatgagcctcagcttggaattgagaagcaatgttctgttttcccttgggcatgcattcgtatagaggtttatcattcctcaaaagtgttctggttcatctgaaccaaagatgctatctttgaaagggttatgattcctctgaggcctctgaagtcaaaccaacatgcaaaacatttaagatttgcttgcccctgagcaaatgaacactatgtgctaatcagaccctgaatgttagctttaaccatgtatatctgccagaagtaaccgtgagatgaaagtgactagggtggtgaatggtccttgttaaaatctattgaacaagatgttaaatgcaatgatacaactctacacattatttcttagcaggctctttcaccactttttaacaaggggtcctcaaggtaatgaggatacagtgggggtgacattttgaaaatattaaaccatgtgtttatgtctccaccttaaattgcatccacttgcagccatctctctcaagagtgagccacacttatcaccccagggtaggaataagcagctactgcctgggacaaaggtgttgtggatccatcctgggtccagaggatggaattactgacctctttagctgggcaattatcttaaaagccagactttgtgaaggatgaaaaaggattgcctaacttcatatctctccctttaatgtatcatgagcccagcctagtggactggatcagccagttccagatgaaaccatagctaaggggtttggaatttatccttggaagccattgcagggttttaagaagttaaacagcacagttggatttctagtgctgcccctagagtgacagcatttgttgcattccaatttgggtcaaagtacaggcctggctgtgtttatagaataaaaaaacagacaacccttcattggaacacagttctggcagagcagctgacactggtgagttctcctttccattaggcagacctctggcccttggtttctccaagtcttgctgctgccactgtcctccatggccagacagtgactgcttccattcagcaactcccactttcccagcacggaggcccaaaccgcccccatgttgctcaggccctgattaggaggtggccctagggagctaaactaggtcacagtagctctcacctgtcatctctattgctcaatggtctattcgttcttcaacgacaatctccagctacgaccaactcatatatctcccatgacaaaacttcctaccacttacactagcattctgcatatgatatatctcagtgcctcccacttcttccatgaagccttcctggactacgacagcctatactgatgttcctatgcatggtgagccatcttagacatttctcagaagggggcacagatgatgtctctcgactatattggaactccctaagatcagggacccttcactgttgtacatcttcaaccttccttactgggttgggggcagagtagccatgcattgcttgagagattgatggattgaagttctctgacagtggctgctgctcctgaaatggaggaaaagcaccctcactgtgatcctcaggcagctctcttggctctaccttcctttccttctttccctgtgctaggcagaattctgaaatggcctccaaaatgcctggtccataaggtatacgtatcttctcccagttattcaatcaaacactaatctagtgctgcaaggaaggaaagtaattaagttcccaaatctgttgaccttaaaatagggagattttctgtgtggatttaaccaagtcacatgagcctttaaatctgggtctagaggtcagaggcaggagaactaagagtcaaagcatgagaggcatttgaccagggagaaattctctgttgctggctttggagatggagggagctggcagagaatataggtaggttctaggagctgagcaccagcaagaaaatgggccctgaataagcttagaggtaaaattcccccccagaacttctagaaaagaattcagcctggcctacatgttgagaacccaggcataccttgcctggatctctgatctacagatttgtgtgctaataaataggtgttattttaagccactaaatttttgataattcactatgtaccaatagaaaacgaatggattcactgaactctgctgaaaggagctcccaggtaaacacatggcctaccttagttataacttccaagacaggttcaatctccagaagcttctctttgaaaagtctcaccttccaagaattgcctttggcccagccattcacagatccaccaaccacttgttggtcacctgctcagtgctcagtgatctggaagtttaacaagatccagggcaccatggaatgttcactggacttttaaactctcgtttggagaattacaaaatttgtgggtttgagtcccactggctggattttcagaatgctgatgccttgatagtcagaaaggaaaacagtattgaattgatcttataattatcatccttttggtagctctatttcgtcatagcctggcaatgactaggcgctgcataaaggtttggtggataagctgatgcctaggcagctctgctgctttccagagtcctcctcaccagaagggagatgcctgtacccctcatcatttggcttcagatggaaaaagtgtgtcagggaggaagccaaccctggtgctgaagcaagtctgaataacagaaatgtcttgggctaacagactttatcattttctgattttagagcctttcccgatttagaaacttgacaaaaagtcttgtttgtacttactgagtgtaagagccattctggcaagcagagggtttaacactcaggccactgctttgcacaccgcaaaggtggctaggtagttggagagcagtggtgttactggtacctaacagacagatcgggaggcaaggctgcagcatcaaagttgccattgtacttgttcagtgtctaactgtccatgaaactaacggcatgcagaaatgggggcaggcccagctgggagtgatgacgctcattaaacttgcagagagaagccactctctttctttagtgaagaggaaaaagatcaactctgctttagaaataaaacactttacacagggtgcttgagccagagatgaagtcatttgaatatatatatatatgtacctatatatataatatacatatataggtacatatatatataatatacatatataggtacatatatatatatatatatatatatatatatatatgaaatttttttttttttgagacggagtcttgctccgtcgcccaggctggagtgcagtggcacaatctcagctcactgcaagctctgcctcccaggttcatgccatactcctgcctcagcccccgagtggctgagactacaggcgcctgccaccacacctggctaatatatttttttttatttttagtagagatggtgtttcactgtgttagccaggatgtctcgatctcctgacctcgtgatccacccacctcccaaagtgctgggattacaggcgtgagccactgcgcctggcctgactttacatattctattctatttggttttatatattatatatgttatatattgtatgagtatgtaatataacataatatcttatacatataattctttggagacatatactcagcagaaataaaatttctggcatatttttgagtctactttctatgtgctgccattctgaaggattaaatatcacattgaaatgacagctacatctttttgttttttcagttacatttggaagagaaggatgggaaggagtctcagtaagttgcctaggctggagtatagtgactattcacagacatgatcatagtgtcctgaggcctcgaactcctgggctcaagcaatccttctgccttagcctcttggtagctaggactacaggtgtgcactaccatacttggcttttaagctgtacttcatatatatatataatatatatataatataaaattatatttaaatatatatattatatatagttatatatattatatatagttatatttatatttaaatatatatatatttaaaagacagctgatgggttttcactgtttttcaagttcaagtttacccttgataggggtgacaaatgagtcaccttggtgattgaagcttgctgtagatatcctctagagaagatgaaaaaaacttctgtaggaactagctgttctccttgttagacctggggttttcctcattattgaatctcttacaagctgacttcctccaagaagcctgcctggactggctttacccttctctcattattccagcagatcttcacatttcatttgtttgttcattcatcaagtatttatgaaacttaagttgtgcttaacatcgtttgtaccatagagatcaaaatgctggttcctcctttcaaggagcttaatacttgtctcattgggacatcaaagtataagggcagagccttgtagaagcctaaatgtaccacttgatgcagggtctgggttgtggctgtttatgaagtaagctagttctagtaaatgttctgccagaacttttaatagactggctaactgggcttcactccagagatgttgttagtctcgatattcacagtatggtccagggacccgcagcatcagcatcacctgggaaattgtaaaaggcagagtattgggccacacccctaccagttgaattgtaatctgcattgtaagcagatccctggaatacctatgtcctaacatcagggtatgagaagcactgatctacaacacttggggattctttaatgtcaatactagaaaagggtgaattgggaaggactaaactcactagttgtgataagaactgtcaatcacttgttgtgtagttgtaacaggtgggaatttgctccatgacacttagacataaaaaagttgcattatttctaaaaagaaacttaaatctggctccaagctctcatttggaaggtggtgaaaatgttaatcttagtaacattgggggtcggggtttcccctttctcatgttgtgtcaaaattcaaggggcttatgagatgcccagaaaatgaggcattgggtctgttgttcaaagttcttcctattgccaattctgctctatgattttgctgccagggctgaccagagcactagggccagccagccaaagggctggcctttatattttatcttcaatcctcatagtatcattagcatgaaggtatcgttatcctcactttgcagaactgcctgaggtcatcaaacattgagattggagctgggatctggcatgttttgcagtccacgttctttacatgagcagagggtgagtctctcaaaagaaaacgctctgtagtctctcaaaagagaatactcttcagtgggggaacttgttttggatggtcagtgtcagggaggcaagaaattatgatgccaagtctggtggatgtttatcttgcttttaggctacccagcagcttttggctgctttttatctctgggaaatttccatctttttgagtcctgcttcctcaagatagtggtcagaagcttgctttcccagcatccctcacagccagagtgcagcatgtggcctgggctgcgccagtcacgtgcactggcatgagagtctcatttggaagagaaggatgggaaagagcagtagccacatggactctctttggggttaaagccagtgtgtgacaaatggggttaaaagagtgtaaaggagcctttagagagagcaaagacagaaaagctaaagacagcatcctaagccagatgtttgcagcacctctacattggtgcattctgatgggataaccttatgtgattctctggccctcctaggggttatatgaaataactaatagcctcatttctggatgaaactggaatgggctctgctgtttgtcctaagaactctgcatgtccagaaagtaggtaatagaatgattggactggagtagggaaatctagaaggtagcagtgatgaatttagactgaaaagtagactgagttaaatatggaggaagttgatagctaggctaatggattcagactatgtattggaggccatgggagccatggaaagcttttgagaagaggagtggcaggaaggagtgcaaaaacactgatgtggccatgtggccaaggtgtgtgttgctggcagagagaggcagtgtgaggggcacaggtgtggaagtgatcatgggttctgatgacggtttgtggttaggtttagtcatgaaggggtggtagttatcaaccctgctaaacattacaatcacctgtggaactattaaaaatgccctactccagtctatttatatcaaaacctttgtgggtggagccctggacattggcattatttaagccttcaggtgactccaatgtgtagccagggttgagaatgggagaagaaggagctggaaaggcaggctgggggtggctggggagaccttgactttagtaactgtgccaaggttctttgactagaggccaccaaaccggattcttcttatttagcaagtaagaaggaatttattggaagtatgggaggtagctcactgagtcaaagggaaggctaaataaagaaccagatttatcagggacctagggagtagaaattcatggaccaccagcttgggctctaccatcaagaaggtatcagcttcaggcatcatcccatctttgttgccactccatccagggatgagaaccttgttggactggctagggctgctcatccagcccctgtgaggctgagatgagggcaggtgatggacagtgccgtcaagactgcatgcagtgagaggcgtggtccccaaaggagacccatgttctacccaggagagcgggttacagagccagggagcagaaacaacagacaccccctgtggggaccttcgtaagcttagtgatgtgctctgacattgttgagttccttctttgttccatgcagactttccccagattctattctctcttatatccctggacttccccttccccctggctgagtcctgggtgatatttcccagggatctggtcatcttagtgcatgagcagtttagaggggtggggaggaggggtcagcagcagagcctcctgcttctgaaatgctgctgccagaagctggttggtgccaaatccccagggcatgtctcctgccttgtaagctgactcactcactcacctaggtcactcactgaccaagtatcaggttgtggctgctcattaccatgaaatcaggttgtatttgaaacttggcctggaaaacaaagatctctggctgtgcttcagcatcagatgcaacacctatttctagaattgggcattttctagttatgtcttaatatgatattggccttaagccaggactccttatttcagatgtaagatcctacctttgatgtcaagcatattgaccatggaaaataggaaacatatgagttgcattcattgccttctggaaatctaaaaagttatttaagaaagaaaaactagtaaaatttattaaagttttgttcataaaatgttttagtttcacattggaatgctgattgatctttgattttgatgtcagtcacattctgtctctagggcagttactgttttctctccctgcaaattgagaggccaggaggctgctctccaaggcagcttctcagagtcttcacttctcttggtgatgtttttttgaacgagagtcaccatacgccaggtgagccttccccgtggaacttggcagtgagctgtgtgcattgagaatatgtggagggagtgtggtgtgtgtggacttcacattcagtgggtagggcctaagtatgtgactactgtatcttaagtggtggggatgatggcaaatggggagtatattagtttcctgtggctgctgtaacaagttactacacatttgacggcttaaaacagtagacatttattttctcacagttctggaggccagaagtccaaaataagtttctctgggccaaaatcaaggtgtcagcaggaccttagagcttaggctttaggagagaattcactctttcaaccttccagttgctggtgactgctggtgttccttggcttgtggttgtgttaccccagtctccaaggccaacatcttcagatttctccctgctctgtcttcaagtcatcttcttgtttgtcttgctccatttgggctgttatatcgaaataccataaactgggtggtttgtaagcaacagacattattttctcagggttctagaggctgggaagtccaagatcaaggtattagcagatttggtgtctggtgatggcctgctttcaggttgcaaactgctgacttctcgctgtgtcctcacatggtggaaggggcaaggcagctctctgggacctcatttataaggacacaaaccccatgagggatgtactatcatgatgcaatcacttcccaaaggccacacctaataccatcacattggtgactaggtttccaacatacagatttgaaggacacaaaaattcagaccatagcatcctctgtgtgtgtcaaatctccctctgcctccctcttctgagaatgcatctgatgaaatctagggcctactctgataatgcaggatcatctctctacctcaaaatccttcgcttaatcacatctgccaagattctttttcttataaagtgacatttactgtatccagagattaggacctggtattctcggaggacatttttcagcctactgcagggagcaaagggataccagaaagtacaaaaatttaatgtggtacatgagcatagccttcccacctacagagagacactgctgtgcataggtatatgtcccaatctcctttccatcacctactagtgtgtgtgacttgacaaattactcaggacctcagttttatcatctctgcattagacataaactggtctaaggttgatttgagcatgcagtgagaagtatatggaggccacctgtgcagtgcctagcatatggtaggtcgtcattgaaaactacatttgacccttgaacaacatggatttgaactacttgggtcttcttatacatgattttttcccaataaacgtattataatactttttggagatttgtgacaatttgaacaaacaaatggtaaagcttagaagtagaaaaaagttaagaaaaagatatgtcatgaatgcataaaatatatgtagattcttgcctattttattatttactatcataaaatatacacaaatcttttataaaaccttaaaatttatcaaaacttacatacacacaaatacagattgtacatggtgccatttgcagttgagaaatataaacaaatgtaaacatgcagtattaaatcataactgcataaaaattagctacagtaattttttgtagctacctcctgttgctatcgaggtaagcttaagtgttcctagtgtccacttgcaactctgtgtgacgctaatcatctcagcatgagcagtttgtctctccagtaaaatattgcagtaaaaaagtgatctcgtgggcttctcacataaatttcatcatgtttagtgcaaataccataaaccttgactaacatcatgggactcatacaaagtgccactagtggtgctggaagtgctgccaagaagtaaagtcatgatatcacaagaaaaagctgaattttgacatgtactatacattgaagtctgcaactgcagttgccctccatttcaagataaatgactccagtgtaaggaccattaaaaaaaaaaattcatgaagccgtcacttgcaagaagtattttgcaaaaagtgtgaggttgtcatgcctgctattactacagctatgccagcaggcatgacaacctcatactttttgcagaatagttttttatattgtattggaaatgcagcttttatgttggtgcaggattgctattagaaatagcaattgctatagactctaatatgattcaagaaaaagcgaagtcattatatgacaacttaaagcacaatgaaggtgaagggcctaaagctggagactttaatgtcagcaaaggatggtttaataattttagacatttggcttaagaaatgacaagataacaggagaagcagcttctgatgatcaagaggcagcagatgagttcctgtacaccattaagaaaatcattgaggagaaaggatatctgcctggagaggtatttaatgcagatgagagtgctctattctgaaaaaaaatgccatgaaggacgtttattagtaagaaagagaagtgagcatcaagatttaaggcaggaagggataggctaactctactgttttgttcaaatgctgttgggtttataatcaggaactcctttatttataaagctgctaactcctgagtcttgaagggaaaagataaacaccagttgctaagtcttttggttgtacagcaagaaggcctggacaataagaacactttttctggattggttatgttgatgctttgtccttgaagtcaggaggtaccttaccagtaaggaactgccttttaaaattcttttaatattggacagtgcccttggccactcagagccccatgaggtcaacactgaaggtgttgaagtggtctacttgcccccaaacagaacatctctaattcagcctctagattggggccataaagacctttaagtctcattacacgtggtactctatggaaaggattgtcagcattatggaagaaaaccccaagtctggaaggatgacactattgaagatgccatcattgttacagaaaaagtcatgaaagccaccaagcccaaaacaataaattcctggtggagaaaactgtccagatatgcatgacttcacaggatttacaatagagccgattcagaaaattataaaagagattgtggatatggcaaaacatcaggtgggggtgaagggtttcaagatatgggtcttagagacatacaagagctaagacaccacaccagaggaaataacagaagatgacttgacggagatgagtgcttccaaatcaacgccagatgacgaggaagatgacataaaagaagcagtgccagaaacaaatggacaatattagacaatctggccaaagcttctaattattcgagactctttttggcttcttttactacatggatcattctatgatacagacacagacactgaaagtaaagcaaacggtgaaagaagggctggtaccatatggaaacatctttagagaaatacaaaggcaaaaaagacagaaattatggtgtatttctgtaaagttgacccgagtgtgcctgcctctcctgctccccgcacacctccttcaccccttctgcctctgccacccctgagacagtaaaaccaacccctccttcctcgttctcctcagcctattcaacatgaagatgatgaggatgaagacctttatgatgatccactttcacttagtaaacagaaatatactttctcttctctatgattgtctaataactttctctttctctagcttactttatggtatgtatacaatacatacacaaaatatgtgttaatcgactgtttgttattggtaaggcttccagtcaacagtaggtaattagtagttaagtctttggggagtccaaggttacatacagatttttgactgtgcagggaagggtgtgttagaccctgaatgcctgcactgttcaagggtcaactgtagttgcctatagtgaccttgtgatattacagaaagaattttggttgaggactcaagagaacttggttctagtcattgccaggccacagacttgtaacattttgagcaaatctccacatattttctcgtgtaaagcttgaagtggtaaacttgaggagtttgtctcaaaagtccccatagacataagacatgaaggggatatgggttccagacttaagcactccaaggaatagaaagagtgtgaagattatatagtaaagatgcatggacatttgcttttcattccattgtatgtcaatgtctgatacaatagaaaaatgttttaagttcgttttcagaaagcaaaagtgtcagcccaggaagggcaattcctgatggctataaggagcctctgaaagactctcaggtggccccagctgtgtgctcattccagaaagagagctttaggccctgaggccccccgagtccctaagcttttgaaattgtttgcctttgacctttgtcctgtgagaagttactggaagagcaagagcagcagctccaggccctggcagcccattctaggcgggagcttttgacaaattaccacgttgatgccttcttcacgcacctgtaaggccaaggcattattggccaaggcaatcgatatatcaaaatgaatttttggaagagtgtcatcaagctcagctttatttccaaaacaaactctgccccagggagggaaaaatgactttcactgtgaagtaaacagttgattgtttagacattacttatgtcatgctagtccatctgagatgtaggcaccatggtaaccaattgtccccagaattcatatttttgaggcccattaaaactcgaggctgctggagtcatgttctccgcattttggccattttaataataataatgagaacgttaaaatgacatttggaatttatatcacacttgtctgtgaggtgctctcagcactttacaatgtatcatccatcctcatcacagagatgggaaatatcagaggtgggtagtatttgtgattatattcagcttagtaaagagccccccggcttgaaggaatttcagtgatgtggcatggtgcttgccgacttgtggggacagaagaggctggtgctggcttggtgcttctgctcggtccatctctctctgcctcagtttccatcaatcaaatcagataacagcagtgtgtctcctcatcccgcagcgtggttatgtggatcattgtattaatcatattaactaacgttttaaaaaatttacttgctatgtgccaggtgttctaagatctttttgtatgctcattcattgaattctcccaaggccctatgaggcaggtgcagttaattatcctattttagagataagcaaattgaaacacggagagtttaaggaacttgcctcaggtaacacagcaattaagaacctgaggtgtatctgacccaggcaggttggctacagagcttgcagtattaaccactgtgttagagttgcttaaactttgatatagcaagacaatacacacacatgcacaagtgcacacacccgcacaggcagagcaaacaaaagtttcactgaacgatattcacccatccttacctttgaatgtgaagtgcattttgatcttttctcttctattcatttcattaacgaaaatgccaatctgaagccagtaaactgagtttatgatcatgagtaagtctgacatacattttgaaagccttagcactacaccatactccttcatagatgctcctggggaagcatttgagaagagacatgcagggagtgtgtgtgattggctggggagggtcgtggagaccagaatgtgtgaagtgtaggccctggctctgctcccacggtgctacctcctgaggcagctgctccgtgtcatgtctgggcctgtgggttggcgggcagaggctgccccactctcctcttctactttgtgtcataatagtctttgggggtcttctctgccagcctccatgggcttcagctctgagttaaccccaggtatttactgaatagacattatgtactgggcctcgtaggtatccagctctgactgggaggctacagagaggcattagacatgttccttgactgcaaggaaattgcaagacaccagggaaggaaggctgacatgtcaagggagaattaggggcaggtcccccagtgctgtatgtagggagcatagattttggagctagatggctcctcctagtaatgtgacctcgggcaacatacttgacctctgagagcctaactctggggctgcacctgcagcctgagtgatattatcctggctagtgaaactgtttggtgaaccatgaagtgttactaagaggttagtatttagaggtcatgttgtcataacagtattgccaaaagtctggcaacagccataaacattggggtttcagggaagggacggagtgttgcagcaatcctggaagccttcctggaggaggcagcatttaatctgaagcaggtattttcagttcctgactggaaggatcatgggtcacttagagatggaaacagatacgcaaggtccaaccattcatgtagaaaccatgcttatatataattaggtcatagctctgactccaataggaggatcctgagtgctttcataagttgttggggttttgttgttgttgttgtttgtttttagagacaagatcttgctatgttgcccaggctggccttgaactcctgggctcaagtgatcctcctgtcttagcttcccaagtagctgagactgcaggctcaagtcactcagtacactgctttcctaagtttgacatgccctgctggcttgaggtcactggcagacaaccacttgattcccttaggtcaggggttagcaaattacgtatgggcaatccctgtttctatatagctcatgatacctgtaatgtcagcaagctttttttttttttttttttttttttacatttttttgagtgttgtagaaaaaaaaatatgcgacagtactatgtggtcccataaaacctaaaatatttactatctggccctttaaagaaaaaaatttaccaactgatgccttaagtctcaaagtatacaatccttgtttcaagttgaaggtcttccttagttctgcatcatcctttagtcattctccaggcccttctgtcataccctgagggtacacagggcccaagccctggagagaaggggaaagtaggcctccattagtcatttcctggcttccatggctgtcggaattcccctgctctgccatggcagcatattaatatgtcgcagcgagcatgtgtatgtttaattctgatgacatgtggcgcataagtgattagtggcaaatgccaaaatgctaggctggagccctgatgctattcataataacattcataagagtattcccccaggatgcagctttctgtttctccaacataaatagcttgggaggccaaatcacaaacacgatttctcttcatgctccacctggccattcgtaacaagcattagatgtgaaatttgatttaaagcagcagttaaactcggaaaatcacaatggtgtcaagcccattgtttattttaaagatcaagagaaaaccaaaggtgagcaactaattctttattttattttatttttttgtggtaacagtgtcttgatgacaggctaatgtgcagctcaaaataaaggtacctgggtagaaataacccctcaaacatcattgaggcaatatgccaagaggcgcttggtaaatggctgtgaaggaggacagattatcctgttgaaaggctgctgagatgcggctccacttgacaatggtgggacttttgtcacaggaaaattagatgcctttggataggtctgagattgttcttatcttttccatatagcaaaaagctaccactcagaaagaaaacagagagttgaaggagtaccctgattgaatgccttccagaaaaaggattgttttgagagaaacactttaatttgcttcagatgattctgtggaggcttattgctgaagtggttccatttcagcacaggtttagctggctctgaagagagaagtgatttttaaaaatcttagggaatacaaagcatttatccattaacctgagtcaccaaccagttttcacaacaaggcagcctaggagctagtggtggccaggatatgttttgtttgtttggctcagtgtttgctgcttgttttttaaagaatttgaacaccgctggactgcttgtgctgtctccagtttctcacagcatgcccacttcctatggggctgctccaggctgcctcccatatttgtctacaaagggattggagtccaaggtgcattgttacagcttgtgggttccatcgaaacatgacacctagttattcccatcctactttgtatcttgtgaccacagaaccctcctaacaaaggtttgtggatggtaggtgactccctgaagctcagccctagtcctagagaaatattacagagtccccctgtgctgatggtaggtcacggaccctagccatctccaaaggacagagtccttttcttgctagtgcccctactgatagaaatgttgaacaaagggccagtggccgttttctagcagtggttaattgcagtgagttctattgtggcagaaaggtttgaaaaccatctctcgcctgccctcacaataacctgaattgtggttcttggttagactagggcaaaggggtggtgacatgagaacacgaaccctggagctggactgctgggttccaatcccagttccctttttgctccttcctaggggtgtgaactgagatgcaggggcagctttttaggggaaggatgtataagttgggtgacagattgatgcaggaaagaggaagaacaattggaaatggctttgacattagtttgaattccaaaagtgggcaagtaaataccaacgcggtgcttggattaatgagagggtggaaatggaaagggatccactagttaacaaagtttaacaaccactgacatcagggtcagtgtggaaggaaggaactcatggcgtgctcagccaaagtactttagagaatgtcctagtttgaaactttttcagtcactgagatttaaaataataataataataatggcaaaattgtcatgaaaaaaagtcaaaagaggctaaagtggctcagttgcaacaagacccaggaaggatatgagaggcacatgtgcccttgcagggcgtgactttccacaaccggtgtgtgtggtgggggtgctcagagcagtcctgccccacattccctccagcctacttgcctttgtctgcctgaaggacacgctcttctctgctgtttgtctatgtgggtaaaggtctcagccaagagaaatttttaagtaaattaaaaactcaagcaggctgatccatagccatgctcataagaagcctgcctcaagtgactgtttattttctttattccttgatttttttcacaaataagtatagttacatgcctgttatatgccagcctctgttctgggcccaaagtgagggtaacatcttcaacccctgtgtgctcccagaacaggaaatgagatgcatatacaaacaagtgggatgcagagccctgggagggatcatggtcagggcagacagttccctgtttacagatacgctgcatttcaaaagttagctttcaaactcttggttaagaatctggattcattttccagtacagactttcttttcatgcatatatgcttttttttttgttgttgttgttgttgcagatagcaaatgtttattgaatgcctaccatggaaagaactgaaaataccaggaagataaaactttgaatccccttcaagtcagggagtcatctatacttaacaaaccagcaaaatgaaatgctgggcttggtgctgtgtgtgggaagtggcaatggaagggccccaggcagggccctaatgaatggagtgattaatacacttgacttctttttctttttcttccccttctctatcacaccgaagcttccatttcttccatttagctgttatgctaggtgctaggaggaaagcaatagtttaaactaatttaagtttagatgtgactagaactgatgggagattgtcaataacctctgaggggaaactttctgtgtcttaatgatctaagactcaggcttggggttttatatgactgaaagtcacaaaataccttaatccgctcttcacgcagaggggagatcttgccgtgtgcttgcactcacacccatgaatttcacctgcttctggagatgattttgctccagttcctatggtgtgtgttcccagggtgtttctccttgaaaatgcagttttttttcttcattctttgctttgggacttcaggttctaaagtcagtgtcaaggcaaaaaagcctgtagagtcacaattgtccttgaaaatcacttagcaagggattacattggagacccaattttaccctgtctcagtgagtaccacccaaccactttttccttccctcttagaaaaagggacgtgattgttcagttggaaagcaggagaggtagttgggtccaagaaatagaaaaacacaaatcgtgaaacaaacatttcactcagagtggtgactgatcactcccttagaagcatgaggtcgttgcaacaaacccatgtagacaactgtagatgcccaggtctcatctcaaatttgctgcctgccttagagacatgggattctgcagttgagtccttatggctgggcgtgggggtggaggggggctcctttcctgtaaagagcacacagatgctctaaatgtccgctccctgaccgccattaacaccgctcaggccccagggaaatgctttccttcatctctggtcctgcgtccttgaaacagaaggtgggcctgtctgattgccaggaaggcttttggctcatgcccctgtgaaaggcagagtcagacacagctttggacttcagagaagatttaagcagcaaaactgcttaggtaagaagagaaaacaaatgaattaccttgtcggaggcttcctctcacatatcagcgatgcaatagattcatgtataatgaactgtggtttcacagcagtactgagtgcccatttccttgctgcttttttttcttacaatttgtggtttcggagatattcacagattcccaacacttgcacatggtgactgaggaacattttttcaacattaaaaaatttatatcgctcttcactctgcatatttaggcaatattgattctttgcattggcaactggagaggcatggactgctataattaggaatactcttattttttaaatggttaataagatttaatttacattaaaatgaataaaaattagctttaaatatctctgatataaatagttggaatatattcagtatagttaatattttatgttttaattttcatttacattttaaaatttaatgtaatttgaattttttattacaaatgttcaaattttatacattgaatacaatcacattttattttagaataaacattatattaaaactattgatttgaataacattagcaattttgctgaaatgaaagcaaggaaagttagttttgtgaaacaaatatataataacttatgaattatttatgcttttattgcgtaactcatccaatattactaaagtacagatggtacctgacttacgatggagtgacttatgatattttgatgttaggatgacataaaagcgatacacattcgggagaaagcactctgtgagtacccatacaaccattctttttttcactttcagttcagtattcaataaattacatgagatattcaacactttcctagaaaataggctttgtgttagatgattttgcccaaccgtaggctaatataagcgttctgagcacatttaaggtaagctaggctgagctatgatgtgggttaggtgtattaaatgtgttttcaacttatgttattttcaatgtatgatgaatttatcgggatgtaggcccacagtaagttgaggaatatctgaattaacagaacacccagacatgtacaatgattagtcaatttgctgatctttggtattttgtgactttcagtcatataaaaccctaactttaaacatatttttaaaattttgtcagccaggcacagtggctcaagcctgtaatcccagcactttgagaggccaaggagggtgaatctcttgagcccaggtgttcgagaccaacctgggcaacatagggaaaccctgtctctatcacaaaaatacaaaacctatctaggtttggtggtggcatgcacctgtagtcctagctacttgggaggctgaggtgggaggatcgcttgagcctgggaggtggaggttgcagtgagccatgattgccccactgcactccagcctaggcaatagagtgagaccctctctcaaaaaaatggtcattatgaaggtgtatttgtcagggaaggaggatagaacactttattgaacaattcatcagcttggtttgtaactttaaaatatttatgtggccttccatttgtattctcatactgactacaagtcagaattacccgaactattgaactgttacctagtctcactagcatatagttgaattctataaattactagtctatggcattatgggaatttttttttttaaagacagggtctcactcttgtcaccttaggctgtgcagtggtacaatcatagctcatagtcgcctcaactcttgggctcaagccgtcttcccacctcagtctcccaagtagctgggaatgcaggcacacgcccatacccagttgacttttattttttgtagagatggggttctcactatgttgtgtaggctgattttgaactcctgacctcaagcagtcttcctgcctcagcctcccacagtgttaagattacaggcgtgagctaccacaccggctatgagattttattctaacactgtgatttaattaggcttctgaactcatgcatctgctggagtctggcagtgtttggccgcttcatttaaaaacttgatgctaatggccaggtaattgtttcaaagatcaccattgatgaagtgtccagatctatcagccacaaatgctgtgaaggagagaatggctatcttccatttcctttgggtttgctgtacttttagttcagagtagcagtggcccttcaaggtttgaaaaagctgaaaacatcagagaggatgcagtggacaaatattgagtcagtccttattaaagaaaagaaatttttgagtgggcgacatatcccaaaaggtaccagtttcctaagagccagataagataagaacacagataagatctgtgtacagatcttaggtttatcaaatggcttcagctcccctaccgcccatccattccctttatttaaattgggtgtcaatgtgatagtttttaaaaaattatagaataatcatttaaaaatcattcatgactcatcatcctaacacacctgtttttattgttacatgttaacttactcgtacatgtaaactactgcattgttccaatcagcatccatatgttattctgattttttgttttaaatgttacattgtatatttttctatgttcccatagtccttataattcccattttagagtctatataatatgatgacatgattttacatgcctttttttgtaacatggaaatttgagaacaaaagaagaaactgattcatatccctagatcctttgagtttttattagtcttatcactctttaaaacccctactgacttatttccatgatgcaagcaagataatttgttaatcaaaagtttaattaacacacatactagagttacatatttattttaggccaaattttaaaatgtaatagacttaaccttgatatatggcacccccatgtaattgatgtatataggacatttatgcctgttttctaggtcttttctttcattgctttataaggctttaaaaatgtatacagggatttattgttgtgtcttcgcttctatgacaaattgtttgccatacctgtgatttatttttcactaatttgttcccagagaacaaccttgaaatgtagctctccaatacaatgctgaccctatgaggaaatgatgatctgccttctagaaacacattagggtaaacagtagacactgctggtatttgcaccaagtaccagtcaagggcaggcccctgtatgaataagaggcgaaggtcagtggtcaccagcgggctcaggaggagacaggggcttgtctggcatagcccactatcatgggcatttcgtcagtcacagagatcagcacaggagacctcgcaggagaaatggcaagccagaagcgggggtgtgttttgaggaagggggtgaagtgcagagatgtgactcctcagagaagcatgtgggcaagtcttgaaataacagagaaagaactagttagtagattaaagcagattttcaaattacatttaaaaaattctcttaattggcatagagatctctagaccagggcaatctacatttttattgagactctatactgagtgcccagcatggcaatagcgtactgcactcacccttttattcacccattaatagtgagcacccactatgtgccaggcatgtgctgggcctcagagacacaaagccatgaagaaatggtctccaccttccattttcttctggtgtaatgagaaagacagacacgcacataaaccagatgttgcaattcagagcaaaaagtcttaaaacagtgttagggccaagtgccttggaagcattcatttattcagtaagcgtttattgagtttctgttgtgcaccaggcattgtgctaggtgctggacatgtaggagagaacaaagagggtaaaactcctagcattgtggaattgacagcttggtgacgctagaattcctcttagagaaagaattttgtgcctctgcctgtgtcttggaaagcttcctggagatgctggcaaggctaagtttacagggcagtaggaatgaggaagtggaaatgaaggtgggataggggcagcaaaggagtatgggagagatagaggtggagcaggggcagtaatggagatgagatgggagcagaaatggaatggagtggagtagagagcagggatggggctgcaatgagggtagggtggagatagggtagattgtggggacagggatgaaggtgaggtggacaggcagatctttttctagtatgcagagacaagtgtgcaatggcacagaaaagtgaagcaacatggttagggcctgaatatatgccccatatgtaaagatccagatgacccagccaggtcccaaggggcatgtaatagtgttgggcagacaaggtgaatgcatgaaacgggcaaagcaatgccccacctggtcaagagagctgctgaattttgcacctttggttgtaaattgctcattagcagaatctgagtagcgggcctgttgcagtaaccgccagcctggtctctgtacctcggtcttcatccctgtcctatcccttctgtcattcattaaatatttactaacacctcctaagtcctgggcccagtagattctgttcatatatagttaatttaaagacaaagtctgtctccagagcctaggagctattagataagtttgtacaatcccaaggagttaagagctttctcaggaatagaaaccaaatctaagtggaatgtaaagaggagctggctaatattatcaggggcgctttgttgctgacatttcgttacaattttctgaatgcttcatgtattttccttcattcttaactgacatttttgctgaagcttgcttctcaccctcttgcttagagatatcttcagctgctaggctcaccgtggtccaggtccacaaatctctcaaatttgtattataactattataacaattaactgaacatgtgtattgggtgcctgctcagactgaaaactgcttaaggacaggagacttcttttggagccttaactaagaacattacaggtgttccaaaaatatttgttttttagcaaaattggagcaattagaaaagaatccattaagtttagcaactgaagcaattagagaataattcatttttaaaaactttagaatatcagagttaaagtgtatggcttggctttttgataaagctattgacctttggattccttttgtcaaattctgactctccaaatatcaccagcacacaaccagttgaggagagaaaactgaatttattgtttgctgcagtaaggaagaaaaccaccttgacagctttggtggtgtcttggaacagggcaaagcatggttggaatttgttgagaagtggaagtttgatttaaggcagacctagatctttcaatggggaggacttgattagaatgggtaaggatcatgatagaaaagtttagaattggtggaaatagcaaggtaaggatttttgaggcagaagacttaaagaattttagggaataaactgctcttgatgaattctttttatgagagttctttgggtcctttgagaagttcctataatgaacagtcaaattatctgcctggacaagactctcctggcatactaagatggtgctagtgatgacaatgaaatagtaaagtcatgtatgtagacagtaagctgtgtggggtgtggatagttttggttctcacttgctagccaagcaggaagtaattgatggctagaaaacaaaacacaaaaggctttctctaacgttttgtttgggagtttgaattttcacttaggcacatgcagaggcaaagaggtctcctgtccatggaaatgtgtttcatggataagaagaggtcagtcgtcaggttactgggtgctgacccctgggatttgtcaaacacacgtcagcggctggcttccttaacggctttcttaacagctgatgccgagtgctgcctgcaatgatgcagtgagtttccatgttcccttgtttctgtgtcacatctttctcttgacatttatccttctatgagatgtttactaatgcagagacccaccagatgaaaatgtccaataacatcatgatactttatttcatattttattgggtcagaaaactgcaatgtctcttccatttcatgctgactgccaccaactcacttctaagtatactgtaagaatcatgcctttctttaatcatgcggcaaaatctcacccaaggaatctgaaattggtttttctccccttctgtccagacactgcagccccagacatctttttggtacctttctgagtaaaatgggaggacaatggtgtgatgcagatttcagcaataaataattttgtctcttacagccagctctccgcaaccccctgcaggctgtttgcaaactgcagtttttcaaataccaccttgcatggtattaaaccctcttgagctgagcattggagaatagtcaaaataagctattgagttctgggtgatagcaggtgggcagaaactgaagccagagctgccattgccacacggcaaggtttctgcaaatcgccttcctccccaacagagaatttgactctggtgctttcttttctttttcctttccttcgtgtttttttgtttgtttgtttgttttgttttgttttgagacagagtctcgctctgtcacgcaggctggagtacaatggcgcgatcttggctcactgcaacctccgcctcaaggttcaagggattctccagcctcagcctcctgaatagctgggagtacaggcatgcgccaccatgcctggctaatttttgtatttttagtagagacagggtttcaccgtgttgtggtcaggctagtcttgaactcctgacctcgtgatccgcctgcctcagcctcccaaagtgctgggattacagacatgagccaccgtgcctggcctagtgcttactttattaatggaagctgtttgaattttcatttggttgtcttgggtttgagggcttctcatcagcccttttttattgtttcacttttcaaaaacattccactttgcttctcatcatctttgttcctcagttgaactgagagcaagtgtgattttaatgaagcactgatccttttttttaagagcttttcagcaggcctagatgattggcatttattatcattttgtgtctgccttctgctcagaatataaaggaatcttggaattattttctctcttctcttataggcccaaaggggtctcacttctctcccccttccttgctttttaaaattttacatctcctacaccttctagcatcccctggtacaatctcctacaggcccttcaaaatcttttgggcacaagtggctgggctgagtcagacagcttggaaatgcaaaaaggcaggccaggcagaaagattgatggtggaatgtcagcttgctgccagtgtctgtaccatgtggaaccatcagggtttcccttgccctttgtctgttccaatatactttgcttatcacccaggctctggcaggtcaaggaagacctgacgtggcagcttctagggctgagatttgcatgaaagtgctggaatcaaaactacctgactgatgtctgcatggagctcataggtccctaggttgtaactgtacctgctagggccaccactgctgatcagcatagaattgatgcaaagcagatggccaccaacattgagctttctgctcagctcctctcctggctgtgcttcatagaatgcaaaggtaagtgggctttccactggcacctactttgtaatggacatttgattataggcacttggctgagaggcctgtacattttttaacatatttaccttctgacttttcatttcttatctgcatatggttgttacctacacctgggattcgtaaaagttcatcaggaaagcacatgtaaggtaccagaaacagtgccaggcacagggcagcctctctatagctgtttattcctttctttcctgcttccttcacctataccctctgacacctcagccaggctgctggttgctagtaggtgccaagggaatggtgctgaagtgagtgccctcagagaagagacaagaaagctttctgagtggggtttgaacttcttccctctactctgccagccaactgagctaacagaagttcagcaacagctcaccatttcctttgaatcggtgtctccaattctcagtcttcaaatagctccagcagacagcagggttttgtttttcctttatttagaaccaattatggtctggaaccaatttggtgaaaggtgcctgagttttccttagcaacctaattctgtttgccttatgtgcttgacttttgctgattttcagcccaaattccagctatgtccagtgctcaaaggtggatgccagaggaaaagggctggtgggatcaacctgccccaggtgcttgaacagaaatgctctgggaagaggtagaggggatgctattttttagcatggggctgtgggaagctctggaggctagctgagagccattgctatctttgaggctgtgtgtgtgtgtgtgtgtgtgtgtgtgcacgcgcgtgaaatgctttgccctttgatagtcacaagggtcacccattctttcattctgtcctctgataccttctcaccgccactctcccattactctctatttccactctgctttattgttcatcatagtactcacctctacttggcattatgttgtacagttatttgtttataacgtgtctttccaattaaatgtaagctctttgaaggcagagtcttgcccatgttgctcattgctctattctcagtgccttgagccatacccagtgcatattaggcactcaataaatattcattgaatgaatggatgagtggataggtaaatgtctttggtgtttgggacaccaagcagcaaggtgagaggttattatatgacatgggcttgacaacaggctacatagggaggaaacctggcagattaatgttcttttagtcttttctttctttccttcccttgcctctcatcctctactctatttcacttgttttactatattcttaggatttacctttgggctgttaaataaatttatttaccagtttctaatgatatcttttgacttcttagctatagaagataatacagtagcttcttccttccccttctgttagttatattagatctacattttcagggtttataatatttacctgtttttaatcataaatcccaacttgctttagtcttagtcctacatttaaatagattcagtcttcttcactaggcctttgctgttgttttccattcaactcttgggtggctgaaaacttcttcccctaatagtttcttcaagacataacaaaatgtcttgaattgttgtaagttcaaatatggttcatttcttttataatgaatgatagtttttgctgggtataaaatttttgagtcacactgttttttggaggactagtaccaaaggtatcactccactatcttctaatggtaaatgatacaatggtaaagtctgaggccaatctcatttttccccatcataaggaaggagtgactgcctgcccaaatattctttctttatctttggagtctcataaatgtactagattatggttgtcacttttttccaggatactctgtgactttcaagatgtagtcaagtacaatgtattcaagtcttcttttatttctggaaaatgtattgagttacacctttaaatattcttttatgtcttttgctaatcttccttacctatcattttctttctaatccctttaaatttcttatttccatttcattctgttcttacttttttcaatcactgttctttcctttctgtttctttctgtatttttttaaattatactttaagttctagggtacatgtgcacagcatgcaggtttgatacataggtatacatgtgccatgttggtttgctgcaccaatcaactcatcatttacattaggtgtttctcctaatgctatccctcccccagtcccccaccccccaataggccccagtgtttgatgttccctgtcctgtgtccaagtgatctctttgttcaattcccacctatgagtgagaacatgcggtgtttgtttttctgtccttgtgatagttagcggagaatgacggtttccagcttcattcatgtccctgaaaaggacatgaactcattctttttttatggctgcatagtattccacgctgtatatatgccacattttcttaatccagttctattcattgatggatatttgtgttggttctaagtctttgctattgtaaatagtgctgcaataaacatacatgtgcatgtgtctttatggtagcatgctttataatcctttgggcttatacccagtaatgggattgctgggtcaaatggtaattctagttctacatccttgaggaatcaccacactgtcttctacaatggttgaagtaatttacactcccaccaacagtgtaaaagtgttcctatttctctacatcctctccagcatctgttgtttcctgactttttaatgattgacattctaactgatgtgagatggtatctcattgtggttttgatttgcatttctctgatgaccagtgatgatgagcattttttcatgtgtctgttggtggcatagatgtcttcttttgagaagtgtctgttcatatcctttgcctaattttgttggggttgtttgttttttacttgtaaatttgtttgagttttttgtagtgtttggatattagccttttgtcagatgagtagattgcaaaaattttttcccattctgtaggttgcctgttcactctgacagtagtttcttttgctgtgcagaagctctttagtttaattagatcccatttatctattttggcttttgttgccattgcttttggtgttttagtcatgaggtccttgcccatgcctatgtcctgaatgatattccctaggttttcttctagtgcttttaggttttaggtctaacatttaagtctttaatccatcttgaattaatttttgtataaggtgtaatgaagggatccagtttcagctttctgcatatggctagtcagttttcccagcaccatttattaaatagggatgccctttccccatttcttgtttttgtcaggttggtcaaagatcagatggttgtagatatttggtgttatttctgaggcctctcttctgtttcattggtctatatgtctgttttggtatcagcaccatgctgttttggttactgtagcctcgtagtatagtttaaagtcaggtagtgtgatgcctccagctttgttcctttggcttaggattgtcctggcaatgtgggctcttttttggttccatatgaactttaaagtagttttttccaattctgtgaagaaagtaataggtagcttgatgcagatggcattgaatctataaattactttgggcagtatggccattttcatgatattgattcttcctatccatgatcatggaatgttcttccatttgtttgtgtcctcttttattttgttgagctgtgctttgtagttctccttgaagaggtccttcacatcccttgtaaattgaattcctaggtattttattctctttgtagcaattgtgaatgggagttcactcattatttggctctctgtttgtctgttaatggtgtataggaatgcttgtgatttttgcacattgattttgtatcctgagactttgcttaagttgcttatcagattaaggagattttgggctgagatgatggggttttctaaatatacaatcaggtaatctgcaaacaggaacaatttgacttcctcatttcctaattgaataccctttatttctttctcttgcctgattgccctggccagaacgtccaacactatgttgaataggagtggtgagagagggcatccttgtcttgtgccagttttcaaagggaatacttccagtttttacccattcagtatgatattggttgtgggtttgtcataaatagctcttattattttgagatacgttccatcaatacctagtttattgagagtttttagcatgatgggttgttgaattttgtcaaaggccttttctgcatctattgagataatcatgtggtttttgtcattggttctgtttatgtatggattatgtttattgatttgcatgtgtcgaaccagccttgcatcccagggatgaagccgacttgatcatggtagataagatttttgatgtgctgctggatttggtttgccagtattatattgaggatttttgcgttgatgttcatcagggatattggtctaaaattctctttttttgttgtgtctctgccagcctttggtatcaggatgatgttggcctcataaaatgaattagggaggattctctctttttctattgattggaatagtttcagaaggaatggtaccagttcctccttgtacctctggtagaattcggctgtgaacctgtctggtcctggacttttttgtgttggtaggctattaattattgcctcaatttcagaacctgtaattggtcttttcagagattcgacttcttcctggtttagtcttgggagggtgtatgtgtccaggaatttatccatttcttctagattttctagtttatttgcatagaggtgtttatagtattctctgatggtagtttgtatttctgtgggattggtggtgatagcccctttatgattttttattgtgtctatttgattcttctctcttttcttctttattagtcttgctagtggtctatcaattttgttgatcttttcaaaacaccagctcctggagtcattgaattttgaagggttttttgtttctctatctctttcagttctgctctgatcttagttatttcttgccttctgctaacttttgaatgtgtttgctcttgcttctctagttcttttaattgtgatgttagggtgtcaattttcgatctttcctgctttctcttgtgggcatttagtgctataaatttccctctacacactgctttaaatgtgtcccagagattctggtatgttgtgtctttgttctcattggtttcgaagagcatctttatttctgcgttcattttgttatgtacccagtagtcattcaggagcaggttgttcagtttccatgtagttgtgcggttttgagtgagtttcttaatcctgggttctaatttgattgcactggggtctgagacagtttgttgtgatttctcttgttttacatttgctgaggagtgctttacttacaattatgttgtcagttttaggataagtgtgatgtggtgctgagaagaatgtatattctgtttatttggggtggagaattctgtagatgtctatgaggtctgcttgttgcagatctgagttcaagtcctggatatccttgttaaccttctgtctcattgatctgtctaatattgacagtggggtgttaaagtctccaattattgtatgggagtctaagtctctttgtaggtctctaaggccttgctttatggatctgggtgctcctgtattgggtggatatatatttaggatagttatctcttcttgttgaattgatccctttaccattatgtaatggccttctttgtctcttttgatctttgttggtttaaagtctgttttatcagagattaggattgcaacccctgctttttttttttttttccatttgcttggtagatcttcctccatccctttattttgagactatgtgcatctttgcacatgagatgggtctcctgaatacagcacactgatgggtcttgactctttatccaatttaccagtgtgtgtcttttaattggggcatttggcccatttacatttaagggtaatactgttatgtgtgaatctgatcatgtcattatgatgtttgctgtttattttgcccgttcattgatgcagtttcttcatagcatcgatggtcttttcaatttggcatgtttttgcagtggctggtaccagttgtttctttccatgtttagtgcttccttcaggagctcttgtaagtcaggccttgtggtgacaacatctctcagcatttgcttgtctgtaaaggattttatttctccttcacttatgaagcttagtttggctggatatgaaattctgggttgaaaattcttttctttaagcatgttgaatattggctcctactctcttctggcttgtagggtttctgccgagagatccgctgttagtctgatgggcttccctttgtggataacttgacgtttctctctggctgcccttaacactttttctttcatttcaaccttagtgaatctgacaattatgtgtcttggggtggctctcctcgaggagtatctttgttgtattctttatatttcctgaattggaatgctggcctgccttgctaggttggagaagttctcctggataatatcctgaagagtgttttccaacttggttccattcttcccatcactttaagggacacaaatcaaatgtagatttgatcttttcacatagtcccatatttcttggaggttttgttcatttcttcttactcttttttctctaaccttgtcttctcactttatttcattaatttgatcttcaatcactgaaacccttacttccacttgatggaatcagctattgaagcttatgcgtgcatcatgaagttctcgtgctatgattttcagctccatcagttcatttaaggtcttctctacactgtttattcgagttaaccatcgtctaatctttttttaaggtttttagcttccttgcgatgggttcgaatgtcctcctttagcttggagaagtttgttattaccgaccttctgaagcctacttctgttaactcatcaaagtcattctctgtccagctttgttccattgctgtccatatgtggtgtcagtcagcccctactgggaggtgtctcccagttaggctacacggggttcagggacccacttgaggaggcagtctgtctgttctcagagctcaaacgtcgtgctgggagaaccactgctctcttcagagctgtcagacagggacgtttaagtctgcagaagttgtctgctgccttttcttcagctatgttttgcccacagaggtggagtctagaggcagtaggccttgttgagctgtggtgggctccgcccagtttgagcttcccagccactttgtttagttactcaagccccagcagtggtggacacccctcccctagccaggctgccacctcacagttcgatcttggactgctgcgctagcagtgagcaaggctccgtgggtgtgggacctgctgagccaggcatgggaaagaatctccttgtctgccagttgctaagaccttgggaaaagcacagtatttgggtggaagtgtcctgtttttccaggtagtctgtcacggcttcccttggctaggaaagggaaatctcctgaccccttgcacatcctgggtgagacgatgccctgccctgcttcagctcaccctctgtgggctgcacccactgtccaaccagtcccaatgagatgaaccaggtacctcagttggaagtgcagaaatcacctgtcttctgcatcagtcatgctgggagctgcagactggagctgttcctatttggccatcttctgtattcttaccagtcttgttttacttgtgttgcttcaattttgcctttatttctataatgtttttattttttaaaaaaaattcacttatttccagatttttcttagctcatatttcaaattcttctatcttatcacattttccatgagctcatatatatctactttacctctctctctctctctctcggtgtgtttgtgtgtgtgtgtgtgtgtgtgtgtgtgtgtgtgtgtaagtgcttcattaagtttttcaaaaatcatgacaaagtatttagtcacattttttgtatctgctccatggcaatagttctctgctgaatgtttttttgtttgccattacttttcatatttctttgcttatttttcctataatattgctttatagagcctgtagtttttccttcttgatgacaaagttttgaattctttgaattttccccccaggccatttgtaggaaatttgtgtagggaagagaagagaaccacattgcattcaaggaaaaatttttcttcactgcagtgttttgtatgaatccttttagccttcacctctgtccagtcaataaagatgagcaattatagagctgttcacaatgccaaatctctctcctccccaactcatgtgggaagactttttttctgcatatatgacatatctgtgtgtctccttattcaacccattttcacctgtttctcagaatacagctggttccaaagagacattgttgactgcattttagagcccatttccattgttgaaagtaagggattctgattctacacctctgggttgctcctcactttacagtgtacctttttcactccttcctaaaacagcaaccaaagaatatcctctctctgtttctgggctctgctatttttggtgtcctctctatttacttcatgttttacagttccatgtctcctaggttcatcacaggtagaatttgtgtttgtgtctcttgtttagagttattgttaaaaagggaagattgaatgttagtcatgtgctaccatatccaggtgggaaaacctcagccctttttgagaaatctctttcttcattaatagaaagcctgttttccaactctcctgattctccaggaagcagctgttttcttttctcgttctctccctctccaggtttccaagtgaggccagattccttgttcctcaaaaggctttaccctgaccacccatgcctgaatcctcattgtgctcagattccacactgggtgtagcttctactgctttgattgcaccacctttttgtatgtgtatattcctttttgtctaaataatagggcatttagggacatggtctggggcagaaacactctgtatcctctctgctactagcatgtcactccatgttgtaggtgctgcatacatgatcatgaattattcccttctagggaattcttattgaattagatagctgtgtacttggcatgcattatatttgacacatactcagtcacgaagacttgataatgcatagactgcttctgataaagaactgtgggtaagtgccctcttgaacttatatgacactgagcaatgtcattagaaataacttcagcttttagttgtctccaggattacgtagatcagtgatccttccaaaacgatacctgctagttacagcctttgggatcaaatcacaatgttcctggtagcctgcatcctgcatactttagtcatgttccagagtatcagacctaaaagtaaaaggagctaatgaggccagtgactctcacagggtttcccactgcttcctaagtagaagcattttaaaatttgggattttagggtaaatggtttgaaaaacaaacaaatgaaaaacctgcataggattctagtataacttcctagcaatatgtctcctcatctctacccttgctcccagactcctaaagatccctggtttagtccgatgcctgtgttttagctgtagaaagctggcacagaggggcacagtaactcatttaaggtcatacatcctatgcatttttcctgaatggctgtaccatttttgcccttcatgtagtccacagatggacaatttcttgatagatgaatctgatgtgtctgaaagttggcttatgctaaagttaggcttgatgtctgggctgggggagaggggagaagatgctgttgtagaaaaaaaggagtcattggagtagaatggaaaatgtacatttgacaccaatcaataagccaatgcttaaactgagatttccaaacatgataaaggggtggaaaagataaaatagtaattcaaaccatagcagcctccttgaccccagtcagtaggagactcagtggaacaaatggttgcttttccaaattaaaaaagaaaaaaaggtggcagaggttaatttccagtttctgggaaggtgtgcttaaaacatgatggatttgaagactctgccaacaatttctctgtctctgtcttttttttttccttacctttaactttcctgtttctgaaattctagtcatttttatttcattcagtatcaataaggtgcctacatggtaaccccagatgggaaagagatgcataaccccagagcacagccagctctgggcaggggcttgctcggggttgggctttgggtgtatgggtcagcaaagccgagagcaggctgccagggacatcctggaactcgttggcacagcccaggattttacatacttggcaagggagtggactgagaaggatagaggggtgtaacctgtgctgggtttggagatagggaactgggatgtatgagtaacttggaggatgtggactgacccttccaaggaaattccaaagccatctggctcccttggtaatgcttgccctagaataatcgtataagacccttgtgggtagtattctcattctgcagataaggaaaatgggatgctaataaatgaaatgacatccttgtgttacaaaagtcactctaaacaagtctcagtctacagccctcgactctgggctcttacctcacaactctctctactctatcacagagctggctttttctctgtgttaccaccggcagttttttcctagacttgctagctgcctagtatcgtgctcaaggtactgccatgtatacagtagttacaacattaattccagctgaagaggagcttattttaaaatattattgaatgtattttcaattttgaaagtaatataccaaaattcagaacatttagaaaaccataagatcaagaaacatttaaaataatctcaggctgctaacacaacagctgtaatcattttggtctgtgggtttttggtcattttcctcatacatttagcatttggaaaaatctgttgaaaaccatattgcacatacaatttcatttcttgctgttttcatatagctttttgtcgtaaatcccccatcacaactttaatggcaggagaatatttgtgaggagcttaatcatgaagcatttactaatcatagtattaaagcatttgattatattagttcaataagtatctgtcaagcaccttgtgcccaggctctcctggcagccattgccccagtgacagtcaccttgctgtgccgagggatttggaatactcagaaccacatgagtcagagccccacacacattagtgagaaccccccatatgttaatggaagccccagactttcattctggctcttcttccatcagtgggccatattcaggctggctgaggccaagatgcaacgcagtaagattaccatgggcccgtctaacattttctttataaattcatctccatgactgttttaatcacctcttattagccctgctcatgagggagggactcctggcctaggtttctggagatagccaaatatataatacccaacactggacagatgagatgtacagcagtttattaagtcacatttgctcacagcccagggaggacaccatgttgcatgcagggcctcacaaaggttgcactcaggaacagagtagaccaccagaggccacggacagcaggccttgtagtatcaagaggttgtggtgctccctgtttcttgtgaaaggatatgattggcttgtttgaataattttgcaggctggcacagaactgaaacctacttctcaggggtaaactgtaactgtgcctggtccctttgataagaagggttgttgggctaggggaccttatctaagggggcagagtagggaggggaagtggctgttaggccattcaaggccctcctgattttaccagatgtcaaggcagcacctaataatgaggcttaatgttacatcttacaccacaatgacaagaactgcttttcctgcctccattttctacagctctttcctcctacattttttttaaacactctggcctttgctgacttttctttgtgcagctgtctaatagtatagagtttaaagtcagccaaccaggcagtccaggctcagccacacactagcctgatggcattagacaaatcacttcacctctctctgccttggtttcctcatttgtgaaatggagatgatggtactaaaagtccttacctcacacagtttttgtgagaactaaataatacagataaagcatttagaatagcatctatatatgctatgtaggtacaaatattcctatttttacttataagtttataataataatgtgattctgctcttttcagcctttctactccctttctccaaggtaaacttaccacaagcatgtttccagaaaatgtactctgttcattcattcatgtatttcttcatttgttcatccattcagtcaacaaatatttaagatcctctgtcgtgcaccaggcactgttctaggtggcagaatccatcagacaatgaaactgacaagcaccttaggagctggggcttagtgtgaaagtgggtagacagaagataggcaagtatataaactgaaaggtagttatgactggcaaagagtgctctgaaggaagaaaataaaatgaaaaggaagccatcagagagacagcttggtttccttatacaaggcactgagagaaagcagggctagggttctctggtattacaggggtggtgtgaggtctttggagggcaacaacctctgttctcttgcttggtgaaagatacaagattcattaagattgtcttcctaagagtcgggtctttttttttttttttggtcttctttaaggctcttccctccccacttccctggccatctctttcctcctgtcaagaaaggtcctatcttgttagcccagtttatgcatcgattttggtctagagtcagggaaattaatagggaaagacaggagaagagaggcaagaaaaaggagaaggacctgctgtgtgaagttaaactcagtttataaaataagaagctttacaggagtgcagagagaggttcaaggaaaacaagccccagtgttatttattagttatgtattgctatataacaaaccactccaaaatttggtagcttgaaacaacagtgatttattatttctcacaatcctgtgaattgacagttaatgtctctgctggttttgcttgggctcactcgttcaaccacgggatgggcaggactggaatatccgagatgggctcattcacttgtttgcaagttggtgcaggctgcaggcttggacattttgatgtcttcatcctctaggaggccagaccaacttcctgtaagcagcctcagggcagcattccaagatgatgaaggcagaaattgcaagacgtcttcagtcctaggttctgaaactcacacagtgtcacttctgccacattctattggtcacaggaagtcacaaagccagcccagattccagctggtgagatagatgttaaattaaaaatcacgtagttcttatttttgaagctgtgaaagggagctgaagaagaagtatcacatgagcttatccatgacgaacgacatgcccaacactgagccatcatctggattgatttacttccccttgcttgggatcatgcatatacagacatggctgttggtgttcagttgtgtggtaaaagtttaacatagcagccttgaagctggtgtccttagagaagctcgtgtgcaggattggcctatgacgggcatctgggaacttgaatctcaggaggatcccagtattccctaaggatagtgcagtatgcctagactatttgtacaaacaacctagtttattctgatcactcatttctagctaggaatctggaccattggtgcattttagacaaatggtatccatgagagaagcccacattaaaaaccttcagcactaagtctctcactagcttctcagggcagaaacatctcactcatgctgctgcagtttgttgctcagggaaaagtgggctgtatgtgagctctcaggggaaggagagagaataagcaagcttgtgcatggatttccccagacccagcctgtgtccttccctcctatgacccggcagtatatccttccaacattgctgcaataaattgtagtcaagagtacaactacatactgagtcccactagtccttctagcaaacctccaaatgtagaggtgctcttggagactctagcatattagtcttgttctcttacacgttttgtcttctatgaagatgggagccaattcccagggggcatggggcaataccagaaaattaccttgagggattttatgctaagaaggaaatgatgtcctgtgtcccttaaaccaagaggtcctagcaggcctggtggctgtaagccaatgtttcaaaatgatgatttgacttgcttattcacaaaatttgtttggatttgagacataattcatttaattagtagcaaacaggtggtaatttggaatatgtgaaagtgattggttctctctgaaacctcaaggaacagcatctttcactcaatgagaaggttaaaacaaaagcaaaaaaaaaagaaagaagtccctttgtcctgatcagatctgggcagtcgcctggacaaatctgtaaggatagattaccaggattgtctctacagaggagttccccttttccttgcttctaaaccaggtgtcgtccatcaaccagtcctctggagcccaggaactctggggcctgtaactacagtggagggaaagttagccatggaatgcaacttcccctagtctccctgtaccccctctccaaactatcatgctgctggtattggcaatgaaactgtctgtgagtgcattggcactgttgtacagtaagtaatcacagccattactgtttcctggggagtccctggatggcaaagagcatggtagccaataaggaggcaaagagcatggtagcctaggaggaggcatacacatctcccttggcaggtttacagtggagttgtcaaacatgctaaggttgtcacagcgtttgaaggagaactacttactgctttggaatgggaagagggttgcataaaacaaaaagtataggatttagaatttaacagaggtgggtttctttttttgcctaccacttaatagcttatatgacctcaggaaggttaattaacctctctgatccttaacatcacaaactcagagtggttgtgcaagtaaaatgaggtggtgtatataatgtatctgaactgttgcttagcataaaataactgcttcttaaacttgggtgatgaaaatatgatatatttttatttttgcttatatgtatagtattgatgaaattttctgtaatgaacaaatatttgttttataatgagaaaaaagaggattttttttaaaagcttaaagcctattttctttccttgccagccttgcaggctgtgtcttggctgagcctttctgagtcattcatgcttagcatactcttgagcttggctgtctctgagcagtcattgtacagtaacatccacaggggtttggaagggttcatgtcttaactgaatgactgaagaactgtttgtcactgacataggtaaagtacctcaaatattttctcaatatttcagtaattataatttgaattaatttttcatccagaatcattttctcttagcagagtcgctatcacaacatttaaaaagaaagagagaaagataaaacctatactttctggatgattgtcctttttttcaaatttgagtttccttgcgatttatcttttgtttcctttccagctaggaatgaaatgcatttttcaggaaaggtcagggtaggctccagcaaactttgtagctctggggaacattcccagggccagggttgactgagttctgtggtgtctgttgagaaaatctctggcaagtcaggcttctgggctgctcctctcctgcagggtaagtacaaagagggcagcataacccccaggctaacaggcctggacccttttgaggaaactaaacacataggcagagtgagctgagtgagaactcctactgtgtgcaaattagttgctgggtgtcctctggtcttttctttaagtctataacattttagatggagaatgacaggtagaaaatttcagggctgttttttttattgcaaatgtgtagaggaccaagagtggcatctgtgcccagagagcacttggcctctcaacaacttgagctagtacattctgacttgcattatgattactcttcagtatgcaggagctctccctcccacactagagtgtgaactgatttctcctgcgtgacaaggtcaccccataacttcatgttttatatttttttaacatttttaaagtacctgccaaaaaatggtgcttatatgtgtttgctaattgacagtaataccctagtaggagttgtaggcagtgaagaaatattaagcaacagccaatattataagaaattttcttggaccccttttggagtcaaagagaaccattacaatgtcttagtcttatgggagggccaagaggagtgtgtcagtctacaggcaggtgttgagcatagattcatggacctagcagagcactggctcctgtggggcaatcaaaagctgcagacaagcactgtggttgcagcagaaggccattatcctaaatggactaatgcaagaacagaaaaccaaatactgcatgttctcgcttataagtgagaactaaactttgggtactcatggacgtaaagatggcaacagcagaaactgaggactactagagagggagggtcagagcagggaaagggttgaaaaagtaactattgggtactatgctcagtatctgaatgatgagatcattcataccccaaacctcagtatcacacagtatagccaggaaacaaacttgtgcatgtaccctctgaatctaaaataaaagttgaaaaaagaaaagtatttttgaatgaatacatcaatgaatgaaaatgaaaaaatgctgcagacacaatctctccatagtcaagttggtgagctacagttactgctcatgaaactttaatgaataataaagatgatgtatacttttaccctaagctgtatggtactaaagtcagtgaaggcagggaacatagtggcccagaacagttaggaaggttttctggaggaagccagaatgaaactgggatacaagggtcagttggtatctatatttatttactcttcatacccctttagagggagtctgcttccacttttcagaagcctcagagaattttccaggaggaattagatcatgtacccagtagccctgagctaataaaatctggttgttaaattccacccttttctcattctccctcaagggtcttgtaatataatttgcatttctcaaatctcagctcctggtaccattttcttagaagtcctgcctcccagcacctcccaacactctgcctgatacttggcatgatgggaaattctttttttttctgctaatatttgtgcaggtcccatgaaaataaacaatctccaaaattgaacttgacccaaccaacatatttcaagtacctgtggtttcactatgtgtatataaatgcagatgcaacagtgaacagtttcctgtcctcaaaaagagtttaccttctagaccaggaaaagaaacaactatactgcagatagaatgtgagagaagctacaacaaagaaggatgagattaactgcaataggggaagcttttgtggaggggataggactggggctagtccataatgagcacctgaaatttacctatatggaagtggcagggtgggagagagggacatgctagtcagagggtacattgtggacaggcacacagaggtgaccagtgcagaaatggtccaggtttggctgaggctagggatgtgaatgagtgtcatggcagtgaagactggaatgatgaattgagtttggaacgtgagactgagaggttgggccctatactttgggtcaacccaacctttgcccaaagggttttaaacagaaaacagaggtgaattttaggctgctgctctggccatagcttacgtgtgcagtggaagcaggaggtggttacagatggaaggtggggcagggcaggtctctgtctggcagtcactggtgcaggtcgttatgaaggctgaaagtagggtagtggcgatgggcctggaaaaaggggacagatgagagagaggaggcagggtgacctttgcttgtctttcctcctccccaggtgagatacattgtcacgtaggcagtcatttcaggattgcaggaagctaatgatttttccccacaatgttgctggcttccaaccagagaatgttgcccttgagatttgacaatgactgttgcctccttggcagcgattctgaatcaagggcaggagtcagccttgctgggaagttgttcagttgattcaaagggcttgggacatgtctctgagactgtaggtggcaattcctgcaagttgcttcattccgttgtgtctttcccttgggtggagcctcctcttgccctctgagtggggccagaggcccagttccatccccctgtaggcatcagaaaagggctgcttcctgtgttcagtttagagctctttaaagcccctgctgacagatcctattcaagctaaaatgagtggctgggggcaactcatacataatttccttctatgtagtgacttcctgcaccatggggtctgcatgatttctgttcatttaatgaaaggttatattggcaaattgttatccttgggagtgtgggtgtgcagggagtgcttttggaatacattacagggtaattccctttgccctttattgcctctgcaggccatgtgtaattgaatcgcaaataacacactttagaaacaggcagagagactgaggcctgagcgtcctttggctttaatgagacagtgagcgtgtgtgtgtaaacgaccctctggttatgcgggccaggtggaagaggtagtcgtataactaatgggagtgatttttctccacctgccccagacagtgcaatcagcagccttcactcccgcagggagggtctcaatccagtggctggctctgcctttgaaacatccagagggcccattactgttaataggagcctctcccgagcacctgctagagactacctcacttacatgctggctggtggggttgaggtggccccatgcaactttcccgttctcatctccctccccagaggaggctgctgtgcccgaagttctgtgcatgaggaaaacaccaacagggggaaactgttacggcaaagttgcccactctcagaggagttggcaaaagtctgtgaagttcagagaatgcaaggtctttaagtgtggggaggtgaaagggtgggatgcagcaggggattaaaggcaagcagtgattacatgagacggtgtgatgtcttaggacactcagcactgacccccaactgggcaagagctgtgatcacaggtggatatggccacctctagtctaagaagtgtttgtccctgaatttgagggactgggtgttaatacctttgtgccccataacatccttccagttagtggtggcaccagcatttctgcagagcagaggtgtgagactgccatttgtgagggatgggagtgctatggagggaggagatgaaggtagacaggtgttcattttcagtagggtagttagggtgggcctcgatgaggtgacattgcaacaagtcttgaggaggtgaggcagttagtgatgaagacgtctggggaaagactgttccaggctgagggaccatggtggtgttggcacttcctaaagcagctgtaggcctgggtgatccaggactacaaaatgaacggggcaagtagggtgccgagaggtggggttggagatggattataaagtgctctgttggccgctgtaaggatgctggcttctattctgagtaaagggtgagccattgtggttgttgagctgtggagtgatatgaaacagaaatgaaaatagacgatccagtaaaatgaggaaaatgtatagatccagttgtacaaaggaagcatttgttggggggcagggagaggggctgtctatcccagcctgggcaggggagacagggagggcacggaaaggcttcctgggtgggcgggggagggtgtcagctgcatttgtccagggtcttaaatgatgggccagcctgtgacctcccaacccccacctgacactgtttctgtaaccaaggcagcaagggactagtttctctcctgtggattcttgggcaatttgtgtggtcctgtttgcaacctctgtgtgtgggaatcaatctatgcctcatcctttgggcataacctttgcttggaatccactttctatccactgacccttggcaaatcagtacccatgtggatatcttgcctagcaggatttccttacatgctaatgtgttactgagcactgcaatcccagggcagtgggagtgtggggcaaagaaagtgaggccagggaagtaggcaaagtagaagcaagggggtctgttgcaagctagccacagcctcacaagaaaatatagccagttttctggtcacatgagatgtgaccaggaaatgagatgagaatagtccatccagttagaggaagagagaacaatttatttgttggcacctgcctgtctcctcatactcattgataaagctctagtccatgaggatatagacctgttctactggcatgagtgcctaaagtggccacatggtagatagagcttcaagctcagtggaagctttactgtatccactagtcggtgcaacctctctaggaacctggtagagtcaaagtatgtggggttaggatgcacagcctccacaaatatttcataggggtggtggttagaatgacctctcctacttccatcacttggttcctgggtcagtttattgtagctgttgggaacacagtgtcacatgtcagccactggtttatcacctacaccacatcttgaaaggtagggcccagcccagcaaggagtttttttttttttttttcttccccataactcgttgccttaacttcactttcaataggctgctatgccattctgtcagtcagattgactctggggatggcaaagattagttagccccaggtcattgtcgtacttcctttgcaataaaatgggtcgcttggtgtgagacaatgttttcggttaactttcagtagatcaggcattttataagcctttgctcaggatttccaacaaaagctctgcaagccaggcagaatacccaagtccgcaatgtgtatcaacttcagcagggatagaccaatgttctttcccatgtggaaggggctcaatataatccacctgccaccaggttggtcttctcaaggaatggtgccatattgaggactcaacatcagtctgtgctgttgacaaattgggcattcagcaatgataacagatagatcagcactggtgagcaggagcccatgatgtttggtccatgcacagcctccattcctgggcaagtagtagggagtggaagagagatgccagctgacattcattaacatcatcttgtctaacttggctcctgagaactttatctggagtagattctctgccatggaaattcatgtgagatacaaagattttcaagcattgtgagcccttctgtaggtccctccaggcctccttgctgctggccttccaggtgtattccatccagctcctgacctatcagcaaatccacttgccactcccagaagttgatatctgcaccacaggccatgtttccctgaatacaaagtggatgactgagtgtctgccagaagctttgcttcctgggaggccactcttgagtgaggctatagttcagccacagtccatcttcaatgccaacatttcctgcaactcacctgtgaaccaggcccaggtccattctcctccatccgttggtcatagggaatggaaacccacatatatggaatgaaaaaaatggtgttggtactacagaggtaagtgacatggtagtgacctgaccatgaacttactttttcacgcaacttatactctgcatctgcttgagtctagtaccaaatataccactttaatcatataatggattgtgactacacgcacttggccttatgacttggtggatatagtattacttagcttgtaatggaggtcatacagtctagtgtttcaaggtcaaatgttagtttcagctagaactcagtaacacaagggagctattttttcaagtagaggacgtggccttgattaagaactctctaggtctgccctgagagtctcatatttgagcttgcccagcatccttatccaccgtgaacccccctgcaccaccagatttgctgcaacatacaggtcaagtagctgggcagcttgtgccactgcctgaacctgctacagagttctctgttcccctggtatcttcctgaatcaccgggtaaataaatttgagcagttttccaaagtgtggtaaacactgccttaaaattcaatgaatttcaatgagtgctgttcttcttttgtagtagcaggtgttctaggagcaaggatttctcctttagagcagtgtcccagcatgctccaagtcactggaagctctaaaaatgtcactgatttggcaggtcctaagtatttgtggcatttatctcccaccttccaccatgtatgtgttctcttagtaaattatctaagccacttcctgctcccccatgcaattattataacatcaagataatggacccatgtgatgttctgcagaatgtcaaggcaatcaagttccttgaggactagattatgacaagaaaattaacatagccctaaagctattatgttgaaggtgtactgtagtccttgccatggaaagactacagtactttgatgccatcactaatggatattgaaaaaaaaagcatttatcaactcagtagcaatatattcagtaccagagtccatgctaatctgcttcaggaagtatgttattttatctaacttatcagttagcattgcgactaccacttggctaattgtacggtagcttatggccatctgctatgctccatctggtttctgcagaggccacagatgaattgagagacatgatgtagaccactatctctgcctctttcagatttttggttgtggcactaatctcttcagttgttacaggaatgcagtattgcatccaatttatccaggcagaaaagaggggtagtttcagggggctgcatttagcctttattaccataacggctcttcctccacagtcagggaagaaacgtgagggtcttgctagttactaagtatctctataccaactacacacttagtgactgggaaataatccagtgtgggtcagtggacaggcacatgtgactcaggctaaagcactacgacatgacatcagtgtgtcctcacttcagtcagaggagcatggtgagtttttgaggtcctttggtattagtgtcagctcagaccctctatttaacagttaatgaaatttctgggttttctcttttctcaaaggcgaagttacccagcaaatgttttctttggggtgataattagaggcatattttctgcatatctctgcactggtgttacacaattcttcctcaaggaaacctaatcttttcttcagtctgctgtctactacctctcatggcctctagaccaataaccagtgccaggacttagcacagcttgagtaggggtgcacaagccctgttctaggaagtaatagatggtacctggaagggactgtaggacgtggctaatatatgctttggatatggagctttgggtctgtgagctgacttacgtctggaaactgggtgaggggactgtgattttctgctgtggaaactgatgacaaccttcagctcaccagcttgtgcatgcatgcgtggagtgtttgtgtgtgtgtgtttatttttgattgtacaaatcaagcaacaccctagtcaactgcccatctatcttgccccttgaaacaccatcaccatagatttctattgatcgaggcagcccagttgctactccagccttgctgcacattatgctaacgatgttaagggctgcttcctggcctttgccattttgggaacccattattgcctttagattaaggatctcggttccatggcagcatattcatggcaattcctgcctgcagtggacagccgccataaagaatctcaatgattcttgtgcccccttgatcagtacatttcttattgccttgttgaaggaagtgccctttgagtcctctcagagaatttatcatgtgatggggtctcaggttttacagagtaaatccactctaacagttccatccctctgtgccttctgaccccttcttcagaactatgctgaggaagtttcaatatcttcacccaatttactgtaggccatcattctgctcatggttcaaggagccctcccagtatggtatcaggactggttccaggtatccttatcagctaattgaatcccaagtctcaggttaatgttctcatgtcaatcaccatccccatctgtccctttcctttgctgagtagtctcttcaccctcaagagtcactcctgcatgcttgttcatgaacactgctagtatgtgttagcaaagttctacagttcatctagtatatagtctactacttcatagaatagggcctgtatatcactgtgcatgcatgctggcactggctattggtctggaggtcatgaggggtagttgggggcagatcttgggaagaataaataccattctgccatgcacctatttccaataatatcagtacgtgatctttcgacaagttgattgagggaggtgggggaactgttttcctctggcaatggggagaagcttctttggctggcccagagggttcaagattctccagcttaactacacgaatacccccacaccaggtttcgtagtcccacccttactcgttagggctctgattgtgacatacgagacaggtcgaggctgcacatttgacctactttgaaaatttaccacatggaaaagtcatgatctgggtctgattttcagtgcagttggccctgaagctgcaggagacaagagtctctttttctatggatacagaatctttgcacttttagaatatgcctgaagccagcaattagctggcttggtttcattttctttttgcaagacctcaaatgctttcacaaatagccatttcacactcccatcctcatagttgtcattatcttctgccaatcaaatgatgcagccatttgaccttccagtgtcttgcactttacctgcacctcatctcaatcaactgcaggtgaaagcttgactaattgtgatgtcaccacatgccacttagcagcagcagagggattctttttttttttctctttttagacaaatgagtatcaagaactgtgaagagtctgagattacactctagtttcaagccaacaccttacctttccacattcatggatactgaaggaagacaaagtcctttaactcgggcctagtagtgtcatgtcatttataaaagaccaaaggtgaattgtatcccaacagtcagtattccaactccaaaatcttataccgaggatgtcctggttccaaagtttctggttcgaagtccctagaaaacaaaacctgaggcaaaatgtatttcttcatgtatattgaaagatatattcccaggctgggcacggtggctcacgcctgtaatcccagcactttgggaggccgaggtgggtggattacttgaggtcaggagttcaagaccagcctgggcaacatggtgaaaccctgtctccactaaaaatacaaaaattagctgggcgtggtggtgggtgcctgtaatcccagctactcaggaggctgaggcaggagaatcacttgaacccgggaggtggaggttgcagtgagccgagatcatgccactgcactccagcctgggtaacagagcaagactccatctcaaaaaaaaaaaaaaaaaaaaaaaaaaagatagatatgtaaagatatgttcccagggcactgataacatggcgggaaaaggaagtgaggtagggatggaggaaaagcatatgatgctttatcaagctggccacagtatcacagacaaagacaaatgtaaaggagtccatttctcggctctgtaggacaggctgttattccttagaacagtcattcgtgggaaggaagggaaaggttggctctgccaattccttcccacagaggcactcctctgtgtagacactccatcctacccttcccagttgttgctgatggcctctccaggcagcctctggggaagtgagattcaaggccccacagtatttgcctctggctgtggtgggctatggtccccctctgcctgctcttctgcctctgacactaaccatccatgattctcgagatgctatcccatctgtttttacatggacccagtgggaataataattgctgcagtgattattttaaaagaatgttgtaagagagtaaacattttgaaaaattgtatgtgctgtagaaaaactagttgctatttatcagatttctcaaacttgagtcagaagaggaagaggaggcgcctgaacaggactttgaaggacgagtagaagatacatagatgaggacacaaggaagggcttctcaggtggagcattcagaggcgtggaggacaggggtgggagacagcatacaacagggccagcctgagcaacatagtgatatcccatctctacaaaagaggaaatatcagctgggcatggtagcgcatgcctgtggtcccagctactcgggaggctgaggtgagaggctcacgtgagtccatgaggtcgaggctgcagtgagctgtgaatgtgccaatgcactccagcctgggccacagagcaagaccttgtctaaaaaaaaagagccaaggctctgtctcaatcaaagagccaaatccagcccgccaactcattttgtaataagttattgaaacatggccacatccattcacttatgtgtcattgtgggctgtttttctgtagtttcaacagagaccatatggcctttaaaacctaaattatttactctgtggcatgttacagacccctgatgcaaaaggaaatattaagtatattacaaagttggtaattaatgaatataaattgcctttctcttttcatcttcctcctttgtctcacaaagaattgatcacataatggctacatagtaaacactgattagtgaacttagtctttggaaatatatttaataccattgcttactaaacagagttaatcctagaaatttactaatttaaaatcaataccataacctacaaagaatttgaggcattttattctatcccctttacatgaatcatattaataattgagacactgtcccacacataatcaccaactatttgaaatctggctgttctagaaaatctggaattaattgggacttggcattacaatgactctttaaaaaccacaaactgctgaacactgactgcgtttccacaggcagcaaagaaaaagtctgaaacattttctagattccttgaggggaggagttatgtcttatgtgacttggcatagaagggattaataaagaattgctgaataaataaagtgtccagaatagtgccgggcacaggataggttcttggtaaatgtttgttgaattatctggcaaaataatccattgattcaaatgaatgagaattttcaggccacagaacacagatcattgttagacccaagctaatgatctccataggttgcacacaagtaatttaaaatctacatctaatttatttgtcagaatgttgtataaccattggttggccccagatactggatgagcttcccaatcaatactacgtaacaagaaaagctacctgtcaaagacagaaagctcagtcaggagggacctcatggctgtgctgctttaaggctaattaactggtgtctgacatcttccagtaaatctaaattaaatgtattcttgtgaattctaatttcaagtgagtttaattgaacttgggagggaagctaccacttagtgagtaaaatgaaaatgaagtaattgaatatttttccagaattgtatttgaaatgtgctccatcaaatgttgtttcagaacccaagtgaccagctgcacatggttaatatttggaaagggaagaggagtatttaaatgtcagcttgtagccactagaagggtaaatacaatagccggctgttcagttactagatgtgagctctacttggcattcaaagctttttttttttcaagttggaagttcaataatgtgttcaagggaattaagatgagtttggacgactaaagcacaaaaaccaaaaccttctttccccacttctcccccttcccagcacacaaaaaggacagcagtgctgctgatttaaaattgcaggcattttgatgggcttaatcaactgattacacattaaagtgttgaaccctttatttaatgactatttattaaaggcccgtggtattccaggcactgcggaggatagacgattgaacaggacttagtctatggccttaaggaactttttgttccgtagtgagatgagacctgcgaattaagtggtatagaagaggaaaatgtgacgcatatggtaagagcaagcaccaagtgctgaaagaaggtagacttctggctgtgaaaacaaagcactcctctcaggggaggtggtatttgagctgtaaatatttgcagaaggaaaagaaagcatgggacctacttggaggatgatgaagcatttaattgggctggtatggaggatttgtggaatgagacagtacgaaataaaatagctggtgtggttataaagatccttaagtgggtctgtactttattcagtacacggcctctcagcagggaaggggtttgatcagaaacaggaaagaagaatctagatgtaatgctcactatcagaaaaattcaaatccaaaccacaatgtgataccacctcatacctgttaggatggctactatcaaaaaaccagaaaatagcaagtgttggagagcatatggagaaattggaacccttgggcactgttggcaggaatgtaaaatggtacagccactgtggaaaacagtatggagattcttctcaaaattaaaaataaaattactgtattatctagcaatcccacttctggatatatatccaaaaaagttgaaatccaggtctcaaagaaatatttgtagacccacattcatagcagcaccgtttgccatagccaagagaacccttgggcactgttggcaggaatgtaaaatggtacagccactgtggaaaacaccgtttgccatagccaagagatggaagcaacccaaatgtccatcaacagatggtatatacgtgtagtggaatattattcagtcttaaaatggaaggaaataccatcagatactataatgtggatgaaccttaaaggcattatgctaagtgaaataagtcaatcacgaaaagataaatactatatgatttgacttatatgaggtatctaaagttgaaaaattcatagaaacagaaagtaggatggtggttgccagggactaggaggaggaggaaatggcaaattgttgttcagtgggtaaagagtttcagatttgcaagaagaaaaatttctggagctctgtttcacaacagtgtgaatgtacataacactactgaattgtaaacttaaaaatggttaagatggtaaattttttattatgtgggctttcaaaaccataataataataaaaagaatatagatacagcggcatggtatgaattgtattggggttgaaagagagagaaagtgggaaatcagtttagaggctgttgccctaggcttgatgagatgtaactagggcagggacaggaggaaggaagaggagttctcaagatagaattagtaggatttggcacctgcaggaaactcgattgaaggagagtgtcagagatggcttggaggttcccaaccaatgctaacgagaaaatgatggaggctttcccagaaatagtgacttatgtggggagataaggagtttggttttggattaattctgactgcaggttgtggccaattgtgctggagctggtctaattatactgtgtgctaagagctgttggaagctcttttttgtttgttttgcgttttctctcatgtttctatgtgtttgaccttcaacttcttagttggccttgctcaatggtttatccctaacttttcaaattaagggcgagttgcacattttcaaatgtgggtctctcaagagttcgttcactgaatccttcaatctggggttgaatatctacaggattggttgtaaaaattagggagctatgaggctttctttactgaaaaacaccgtttaaaaattttttatcctttttcattagaaatttaatttccaacctggtcaagtgaacacaatgcccttacctttttagtgtggcatcttattcgtctaagctggaagcagcctcagaggtgtgagcttatttctttactttaggcatttcacagggaccagaggtttacaaatgtattcgtgtcggtgctctataaggtcatcacctcaagattcccagagtggtggcagtagtagatttgtaattccaaatctatgtttccacagttgagagaattctgctgaaaatggaaaaggagggtaacgaaatagactggtttcaccttggcatggattggtctacaaagataatcacccatttgagtattgagaagtgtctttttagtgtttgctataccaggaggtaaaagaaacatttggggacattttcaaaggccaggatctgggattggaatgggatgcaattttaaggtcattattctgtcacttatgtcagaaagaatttttgttactgatatttgtgagcaaatgattgcaagtgctgacatgaagttgagctttgtttaacacattgcatacatatttcagccctgaaagactcagatacttagaaaattttccttaggctttggagaacaggttacattttgagacaagatttttatagaacaatatgtgactctgtaagaaattataaatacttttctgaaaatcagatgatcttggaggcagttccttaatgccactgctcaaccttggagaagaagatgaaattcacagcaatgctccagcctcagcatgccctcccaggcctcctgattttgtcaggaaatacttccttgaagattaaagctataattcagaatctaagtcaaagaagagtaccttatttaaacccatgattttaactcacagcaataaggccacagcagacgggagctgaacatctctgtagactggaccatctggaccatcacttgcaagtccttctctcaacattgttgacgtcccctaaataatggctctgcattgactggtgccactgtcccaagagtggttccatgctcagctcctttgcctgcctgtctgcctctctttgtagacaagcaattaactgattagatccagaccttagtatttgacttgtttctttttctctgtgtcatgggaattcacttcctgttttaggacattttcccttttcagcctgatggacctgaggattttttattcattcatttttgacccagtgttcacagatttttacactcatgtttctctgttaggtgcccctaaatgcctcctttagtgagatgccttttcctcccccaaatccagaattgttcatcctttttttgtagaagtcatggagttttctcgagtgagagatagtaaaaggcctggagctcgagctgggctggcacaggtacatggtggctactgggggcatcacttctaccacattacgtggatcaaagcaagtggacgagcagttcagattcaagagaaggggaaacaagctctaggttgggatgtggatgtcctggaggggaggaattgtggcagccaactttggagactcctacactaggcattaatttacattccctcacaaaatctttggaaacacaaatattttgataccaaactgttgacatcttttgggtgccagtgaacctatattttcttactctagattccttattagtagtagtttgcaaatcagataaagccaaaatagtttataacaatgtctgtttctccaccaatgctttaccttgtattaataaattgaaccttacccatgtgttctataaaaagaaattcttacagtgtaagtacttagtgactatttaaactgacctacagaattatcttccactcaatgttaagtaccacaataatatccctgcactgtgcacggcaatatagtgtagcaatggagtgcacggacctgagagccagattgcctgagttctgatatgaactctgccacgtactaactgtataaccttcagcaagtttcttaagccctttgtgagtcagttttcttatctataaaatgagagacctaataataccaccatatagggttgtaatgaaggttaaatgtgctcagaacagtactagacatatagtagcatacaggatggttcaactactattgttgttgttgttgtcattgttatgacagagcgatcagcactgaatgtttagggcaagtaatgtgagtgggacagttggaacagccaaggtacaaggtcacctctcacccatggaatgccatgacttctggcccacacttatgcccaatccatcttgcttcatccagctctagtgggtgcatggcacgaatgttgggcaggctgggcagccctgtgtgttgccttcacttccatgtaatgatggagtgcttttgtatgccttccatgttgtgaaagacaaagactctctctatcattcaggccgtgattggccgttctggtctcagagttatatggctaatgtcagtcttttggtgttataccagagcctggtaacaggctggtcttgtctctcaaaagaatatctaaccttagcccttgctggagttgttttagtccaggacacagttgcttttcagtttgttcacctatgggacatcacaaaatctccaaaatgcattcacattcatgctgagaaatccagaactgcattctcagccagggcctagggttcaagcctcaagaatgtttgtggcatctggagacctgcttcctggagcaggtcctactaaaaaaaaatgacaatattcctgggtactttagatagaggatactgcaaaatactcaaattggatgtggctagaaatatgctatcccaggaatccagatagtatgtcagcttttcttctgttagttggtggatcaaagtgtaggagtttttcttgaccttgatgggaatgtctccactccacccatacatttaaacccaaggaactgagttcaaaacacaggtcctggatcatgcctgtgttaatgacccatcttcagttccttaggcaactctctaaagctaagtctactttttagtgtagtatcaccttcactcatgatcactgatgtgttgcgctagttacaggcatgtggctggcaccaagggccagtgttctaatgagcatgcctatggccattgcaagatgttaacatatccctggagctgcctggtaaagagaattctgtgtcctttgtgtccagctgttcagcagactagaaatcctgataatgactttcttgcttaaaataagtttaaaatgctgactaaatcatttaaatatgttttcaaaggcattaatgggttagcaaaaaataaagaacctaataggccacaatgggcatcagagagatgttgtgaccccatgcaggcatttgccagattaggtgaacttggccattagttcatacagccctgggagacagatggacaagcctcagatgggaaatccaattggtccatccaaaatgggaactataatcggagactcccactatcccaatccatgttaagttaaaaccccaaataattgcaccttcagggtaagaataaagtaggaataagcctcaggggatgacaaggaaaattgcttgtctcaatccttgattctgagtggaagacaaaaattctcctataagaatttaaaatctttttataagaattcacacaccctcacacagtttatatgctctgacatattttgtagcctgagctcacactgtttagatggtctggaaaacctcagatagaaaatcgagtattaagttcaggttggttgtgccagaggcacctggcaagaggaaacaaatcctctctggaggaactcacttgtatccaagacctcagagaagtctcacagataatgtcagaagtgggggaaaatgagctcatattttgggggcaaaattgtgaaaccacttatggaaactgtactaagagtggagagcctgaaaagacagtgatttcagatacaggcataccttggagacatcgcaggttcaattccagacccctgcaagaaagcaaatgttgaaattaaacaagtcgcataaaatttttggtttcccagtgcatataaaatttttgtttacacaatctgtagtctaagcattgtgtctaaaaacacaatatgcataccttaattttaaaaagcttcattgctaaaaattgctaatgatcatctgagccatctgtgagtctttttgctagtgaactgtcatgccccaatgttgttgactgctgaccagtcaggatagtggttgctgacagttagggtagttgtgacaatttcttaaaataagacaacaatgaagtttgccacttcgactgactcttcttcaacaaaagatttctctatagcaagcaatactgttttatagcattttatccagattaagacttctttcaaaattgaagtcaatcctctaaaatccctgctgctgctttatcaactaagtctaagtaatattctaaagccttcattgtcatttcaacaatgcttataacttcctcagcaggagtagatttcatctcagtaaaccactttctttgcttatccataagaagtaacttctcgtccattcaagtttgaatgagattgtggcaattcaatcacatcttcaggctccacttctaattctagttcccttactatttccaccatatatgctattatttcttcactgaaattttgaaccctcaaagtcatccgtgaacgttgggattaacttccttcaagcttctgttaatgttgatattttgacctcctcccatgaatcataaatatttttaacggtatctagaatggggaattctttccagaaggtgttcaatttactttccccagacttatcagaaggatcgctgacagctatagacttatgagaagtatttcttaaataattagactcaaaagttgaaattactctttgatccatgggctgaagaatgaatgttgtgttaataggtatgaacattaatctccttgtacatctccatcggagctttcaggtgaccaggtgtcttgtcaataagtggtaatattttgaaaggaatcttgttttctgagcagtagtatcaacagtgggcttaaaatatttagtaaaccatgctataaacagatgtgctgccttccaagctttgttgttccattcatagaacacagacaaagtagatttggcataattctgaaggaccctaggattctgagaatggaaaatgtgtattggttttaacttaaaattaccagctgcagctgcattagcccgtaacaagacagtcagcaagtcctttgaagctttaaatcctggcattgacttctcctctttagctatgaaagtcctagatggcatcttcttccagtagaaggctgtttcacctacactgaaaatttgttgtttagtgtagccaccttcatctactgtcttagctagatcttctggataacttgctgcaacttctacatcagcacttgctgcttcactttgcacatttatgttatccagatggcttcctttcttaaacctcatgaaccagcttctgctggctttaaacttttcttctgtagtttccttacttccctcagccttcatagaattaaagagagttagagtcttgctctggattaggctttgggttaagggaatgtagtggctggtttgatcttctatcaaaaccactcagactttctatatgtcagcaataaggctgttttactttcttattgatatgttcactggaaaggcagttttaattttcttcaagaacgtttcctttgcattcacagcttggctaactttttagtgcaaaggcctaactttcagcctaactcggctttcgacaagcctttcttactaagcttaatcatttttagcttttgatttaaagtgggagatgtgtgacttttcctttcatttgatcaattagaggtcattgtagcattattgattggcctaattttagtatcattgtgtctcagggaatacggaggcctgaggatagggagagagatgggggaatggccggtcagtggaggagtcagaacacacacaacattcattaagttcaccatcttatatgggtatggtttgtggtgctccaaaacaattacaatagtaacagcatatatcactgatcacagatcaccataacagatatagtaatgataaatgcaataaattttggttattcttactgtatttcactggattatagtacagtgagaataaccaaaaatgtgacacacagctgaagtgagcacatgcttttggaaaaaatggtgctgatagatttgcttgatgcagtgttgccacatgtcttcaatttatttttttaaaaatacaatgtctgcaaagtgcattgaagcgaagcataataaaccaaagcattcctgtgtcagtattaatagacacagattataactaggtttaatatgcttaaagtaattaacaaaggaacttaggaaataacaaaggaatatgatgctttaaatgattaagcagagttgacaaagaaccaagttaaaattttagaaatgaaaattataatagtcaaaatttaatgattatatttaacagatttaacagccaattagacctagctttaaagaagattagtgacctgaaataaatctaaggaaagtatacataatgcaatccagagaggtaaagagatggaaaaatgagaggataagagtcgtagagggtagaatgagaaagtttacagatatctaatgagaatttcagaaggagaaagggagaatattggaaaagaggcaatatttaaagagataatgtacttatctaaaactaatgaaattaaacagtttcaggaaacatatttaatctcaagaaggtcacatcaaaaagtccacaactcaacatatcataatgaaattgtaatgccaaagacaaatgtaaaatagtaaaagaaaaacagtgtatatagctttcaaagaaaacagcccatttttaggtcctatttgccttccattttgaccagtggggaaactaaatggtaagtagacaaatttgcttacttctttctcctggacttactttctttctgacaattatttaagacctttgttaataggtacttgccttttggaaaaatcaagttgtaaactttttctccaaattaaaaatgaagttcttcaacatctcaacttgaccagatataaaacaattttaaaacctttaaaagcgtattgagaaaaaccgagcttttcaaaaacaacatgcctgtcattatcaaaaagaggcatatttaggtaaaaataacaaaaaaaaacccttgctgcatagatattgcaaatagttctagttatctggtcagtgggtaaaaagcaaggacttaaggtcttcagctccaatatcttgctcatttcttattgctggaatttcatatccttttcttcctgttggatgactaaatggagtggtggtggagatggtaagcccacatttactcagccacattctgctcagcctcaggagtggatgaattctcagcttttgtctctaccatcttgtcgtttggggtgttctgagcatcagggctggtacttgaagttgtggctgccccgaggctgaagtgtctgctgaccctgggttcattgccttggttttccttacccatgtcattgctgtcctctctcggtcatctttggcaaggagagctcctgtggaaccgtggtctctagccccatccacatcccgcctcactggtttaccttgtgcccctgcgccctggctgtcagcacctccacttcttctccctgcaagggagggtgggaatactgtgattgcccgcaggttatctgagtgtagtgaggtgtgcaccctgtgggaccactgtcccatcctgttctttttctctctctcactattgaggacccctatgacgcggagtctatcatggttgcagcctgctccacgtttacctctttgacctggaattccaccagggcctgtgacacttgctgccagggtcctcctctccttagatgacatcgaactccacagtcattccatatcctaccctgcgaaggtacttcctggggttattcttctttacagcagtctggtacacaaatgcatcttcctcggtatcattcctcttggtgaaaccatatctgtttcttacgctgaaatattttattgtctccaaaaccttccttgcaatgaccttttccccattggcaggcgccggcgctgtccgtggtgctgggcttggtgccggcagcaccgagggcagggacgagggcggtgggggccgctggcggctcctgggccggggacttgctgctcctagctctggtgactgtgactggggctggcggcaggccgtggggctgctcagggttccctgcgggccgctccctcctggactttcttgactgtgtgactatattcttaattttcccggaggactttttgatgagcctttagagtactctgtgaacttcattttgactcatcagtgtggctgcaggtaccgggtaaggaaaaccttgggtatgcatggctggggtggggaccagagtagggggcaagacacatttgtatgatcagttaaataagagtgttgatactgggtggatcaaacctttattctaattctttttacatattttccttttatatatgcactgcagtgccctaaaaaatgccatattaggagtgctgtatttttaatttttagtacaaaaattacttttctgtattaaaaatgtatttgtattaaatttatgatcaatttagtcagttactgacagctgaaaagctacttcagagaggagaggaggctcagcctagattccctttggacacaggcccaggagcttgcaggcagaggatcagctctgggaggccccagagagagtttatggtgagcagaatcctcaccaggtagtccccaggcacctggcatgtggcaccgtgcttgctcctgtgctcacctgctttctgtcctgcagtcagcaagccactctcttctgccaaagcctggctcactggggacacaaaggtcttccctactagttgaaagagccagagaaattcatctcccttaaggaaggagaggagagagagaaatagaagtttggaggggcaggatgcagcctattaatgcacatatacttttctttgcttcactctagagtttggagatagcgagagatgaaaagaaagaaatggaaagggatattatgagggaaaaacccactaagaatgagatattcttaataatctaaagaaatccagttttctttttttcaggtcaaatcctgcttgtcctcggaattctttaaccatcagctgtagatttagaccgaggaggtttattcgatatttaacgtatacttaatggtcatctgctgtattccagacacttctacacaacggagggtttgatagtgaaaaagagacaaaactctttgaccttgtggagttaacatctagtcggagagacaggaagaaccagtacctagagcatgccgatcgctggtgaatgctacaaagaacaagcattaagtgacctgggaatgtgaggcaggagggggaggatgatggctattctaagaatgatcagggaggcctcagaggccagatgatgtgggcacaggcctgaacagggtgagggaggtagggtttcaagggactgagtgggtttgcttctagtagcccctcctcagccaaagaggagcctccagggacccctaatccaggctagacaggaggtactgctgtgcagcagcaagagcctctctaactccccaaatatccaccctggttggagggagatgatgataaacgtgtgagggctaaaggggctgcgaaggctctgtggagggcaaaggccacaaataccaggcccgcgagctgaattcataactgggcaccagctcaagtgtgaaccaccctggaaggaactgctctaatttgcgaaccttgaaccaagctgagccctaaattaatctcttttttttctcactgaactgagcactgaaccaaggattttttcaaaacagcaacagctagtaagccagtttgaaccagaaccaagcctattcattttctaaaagtattgaactggaacaatataggaatattaaagtatctttcgaactaaaccaggattgaactgatcattcacaagtgcccagcttgagaagagaagaaattctttttggagagacaattctgtgtatattaaatgtctgccttgagagtcattccctaccaaaaaattacactgccttgtgacctctttttaaaattttaatcttgggcctaattctaatatttaacttttcatttgtacatttcatttgcctacttattcaaatgttcttgatgataggaaccacattttgtattgcctggaaatgttagcacaattcctgggatacaatagaagtgtgggtatatataggggaataggggtgtaggagtgattggtggcatgcaatgaccaaaggcttgaaatttattctgcaggccagaggaaactgtggaagggattcaagcagaaagtggcaagatcagatttgagttttagatggcactgtggggaaggggttaggaatggagattggttcgaagtgtgtattatagtaatccgggtgtgaatcagtaaaaagcagtggtattgtgtgagccccagaggcagaaactgcctagattccagtcctagcttcacatgtccttgctgtgtgacctcaggcaagccacacaacttctttgtgcctcactcccctcccctgtggaaggtagatgctaatgatgcttactccatcctgtgcttttgaggtttatgtgatacattgtgtgtgaaatgtagagcactcagaatagtacctagcacatagtaagtgctcaaaaaaattcattattaattttcattgataaagtaattatatatatatacacagcacatatatatacaccacatatatatacaccacatatatatgtatacaccacatatatatacacaccacatatatatatacataccatatatatacacaccacatatatatacataccatatatatacaccacataaatatatacacaccatatatacaccatatatatacataccatatatataccatatatatacataccatatatataccatatatatacataccatatatacaccatatatatacataccatatatatacaccatatatatacataccatatatataccatatatatacataccatatatataccatatatatacataccatatatatacaccatatatatacataccatatatatacaccatatatatacataccatatatataccatatatacaccatatatatacaccatatatacacaccatatataccatatatatacaccatatatatacaccatatatacacaccatatataccatatatatacaccatatatatacaccatatatatacaccatatatacgatatataccatatatatacacaccatatatataccatatatacacaccatctatatatacaatatatatacacaccatctatatataatatatatacacaccatatatatataatatatatacacaccatatatatataatatatatacacaccatatatataccatatatatatacacaccatgtatataccatatatatacattccatatatataccatatatataccatatataccatatatatacataccatatatataccatatacacaccatatatacaccatatatataccatatatgtacaccatatatatacaccatatatataccatatatatacaccatataccatatatatacaccatatatacacaccatatatacaccatatatatacaccatatatacaccatatatacaccatagatataccatatatacactatatatactatatatataccatatatataccatatataccatatatacaccatatatataccacatatataccatatatatacaccatatatataccatatatacacattccatatatataccatatatatacattccatatatataccatatatacaccatatatacaccatatatatacaccatatatacaccatatatgtacaccatatatacaccatatatatacaccatatatacaccatatatataccatatatgtataccatatataccatatatatacaccatatatataccatatatatacacataccatatataccatatatatacacataccacatatatacactatatatatacacaccgtatatatacacaccatatatatacactatatatacacacgccatatatacacacaccatatatatacacaccatatatatatacaccatatatatatatacaccatatatatatatacaccatatatatatatatatatatatacacacaccatatatatatatatggtagcagcaacaggattggatatgggggaggagagagaaggagaagttcatgatgagtctgccatttctgatatgtgcagttaggtagatggtgaccacatgaatgtaggccatttgggagaggaatcaggttggaaaggaaaattttaaacatgttgagtggaaggtgcctgcaactcatccacttagggttctccagcagatggtggactgcataggtctggtttttaacagagcaccacaggctatagctagatacagacatgagagtcatttgcagagacctagggtgtgttgaaatcaccaggagagaatgtcaagtgagcggagcagagggaccatcagagaaggtgggaattccaagtagggaatgatcaatagtaataaatacaccaaaaacttccgatcaactaaagactgaaagtatttccagtggtgatatggcttcattgactccatagctagtggggtttctccagagggaggagagcagaaggcaggttatgggggatgaggagcagctaggacgtgagggagtagggaaagcatgtataggcaggtctttaaggaaccttgattgttaagagatgggagacaagatacaggtttctcattgagttgccttccctaaatcagggtttggtttcactggctaaaccagggggaccttataaaaatggtccaaggcgtaatatggctgatgcctccacatcctcctgagaaagaccttctccagaacaccctacctctcctagcctctcctttcaactaatgacatgaacgtgtttattgcccatctcttcgccagtaaaatccagggtccatgaaggcaggcatctttgctgccttgttccttctgttttctcatcattcagtaatgcctggtattatttggcatcaattcctgtcactcgctgtgtcactttatcacacaaggcttctattatgggacccacaggagaattttcgctcaggccttataccaggcatgattaggccttccctgagcagccgaattgttttcatcacacggacactatgccctgttttatgtttccctctgattatgcttttctctatgctgtggtcacagaaatggagtcaaatttccatcctatttctagcagatcatataacatccaggcatgggtttttgtgtgaattcattcaacacaccactaactttgagctttttttatcctcatcttattttccatttatctgatttcctcctttctttatatttgatgtttgtttttcttatccagagtgcagtttcccaggtttcttcaaatattttttggaaaaaactgaggttatatgtcaataatgggaaaaataggatggtaaataggacttgtgtggaactgggttttgagacaaaagaaatgaaaaagggatgaggctgactttacacgtaaagggagcaccctgaggggataggggaagtggggatgtgatccccagccctagcgggtttctaggagatttcagctttgttggagacacatcaaagacactaggaagagagtaacataacaaggccatagaagagcatgtgctgtcatgaatggttcagggggttgtataggggtaccaaagaggaagagagcatcatagcatatatgctggcatgttctagaaggctccatggaggattttgggcaacttcagcctcaaagagggaataagatctaaatagagcaagtgaaccttacatttgtcaagaaagatttgagtgtggcagtggcttttggggcaggtggccagaaatctaggtccacctttgctgggaaggaggcactagctggagtttggacggtagtgggatgttgaggtcgctttgtagatttcagtttggaagccccaaactgtgggggtgtctttgccaaggtcataacaggttggactcctctcttgcttggctgctcgacttgcccttactggccgggcttttcagacaagtgcattcattcctgcccattcagatctgctttcttcactgacctcggcagcagagaggccaggtttgattgaaatttcacttaaggtgcacagagcatcccttccttgccgaactcatcagccagcaataaatggaacttcttgacagtttcaaatttcctgccagggagcagctggtgagtgttcctctggagaagcagtcttggagaaattttatcagtatctggctagagaaagtattttctacctctcctctcctttcctctctttcatccctctcttctcaccccctctcttctcttccccttctcacccctccccttttatcattgctctcttcttcttagtcttacctgtaaagactttgcacttctttagtccttagccactgaaaattaatttagggacaagagaaggccttctctacacagccttctgagttactcattactgtctttaagattcaaagagcaaaccctcttttttcaaggcttctcttaatgagccatttcagcatcggacttccaattttcacccctgccagaaaacagccgctgggaaggtttgggaaaccagtctcccttccagagacttgtagctattgggctgcaggagcaatataattattccccattagtgctctatgaaagtgcagatggtgtacaaagtcctgatgctgttttgcttgcctttttttcacccttcctgaaacattttggtttatgtcccttcatttcagaaaacaaaggtaaggcctggctcagtgtatttgggtgaatatcagagtacagtatcataaatttcctatatggaacctataatttcttgttatttacctaggcatttgaagacacctgttagcctccagcaggaaactgtgttaatcacaactccctttgctgctacaggaagtgcctggtcccctcccaaaataataatcagtcaccttaaaacaaaggcaacagcctgaaaaataacgtggtgataactttattagtgatccccaacaaggcaaataaaacagaagtgtagatgtcatctggagaagagatttcagaccttggctaagctccaccatcccttttaccaaacctttttgttttctctccagttctcctcggctctgagtctgttggagattagaagtatttctgacatgctgtgcaaatatatgcaaattcattgtgagttgtcatcaactccactttcccccatgtggctgggctgcctgtgcagtgctgggctgctggcctcctggaatcgcagcaatatggcctatgcaccctgtgccaggagccattagcagccttgatgcatcggattagggagctctgatggctccatggtgtcagtgagtggtacccgggcttctaggctgtggaacagcacaaagcaatgtcaaaggcagagggaaagatgctgatttccactgatttttaaaatatccacttggtttcccaattttactttcatatatatgcagccacagtagaaattggctatcatgacagcagtgattatctgatgatgtccttatacatgcatatcttttagtgccggtcttttaagttgattgctgctgagattttccagaggagcacatcctgatgtgtgtgtgggcaggcgtgtggctctctgtgtataaacacgtgcagagtgtgagccacacaagggtcaacactacatttgcatattaattccaaataaccaacatgtgactcctaacatgggcatcctcaagcaacgggaaaattgtcttgattttcttgagattgttttgggtcctcccatcctttcctttaaggtttttcctatcttcactcaccctcattggcctgtttgtagggcccaatgagagaggaagagtgggttctgggtgggtgggagaatccgaaaggaaaaggtatgggtaactggaagagaattttaagaacttacgtgactaccaccaccttcaaatacaactcttcaattgagagcagaggattctttgctagattccattctgttacctctcttgcccatatatcaccatgcaaacagtaaaaaggtgaatgttggactcacataggacttttatgtaattgttataactaattaagagtcataattatttcccactttggaacaaagccctttctaacaccctacttattatgccatcacctggagtgcatatgaataaattcctgctgctactcaccctgaagctgcccaaggaagaagcagctcaaacaaatcttagcccatgcatttggagaggctgccctaatgactcactgatagttattgagaaacagattatctctgtggatgtctgaaagagaagggaatggtttcaagggctcagcagtctccagagaatatattaccaaagattcctctatgactgtgccctattaaaatgtatggaaaaacaacctggattctgggtccctgtaaaaggctccaatctgcatttatcattgaatctgcatcatcttaggcttacacttcagttatgacgacaatatggggcttgacaattctgtcatatttttgatatttaactgatgtatatttttttaatttttaaattttattatttcagtaggtttttggggaacagataatgcttgattacatgaataggttttttagtggtgctttctgagattttggtgcactcatcacccaaccagtgtacactgtacccactgtgtagtcttttataccttgctgccccccaccctttaccctgagtccccaaagcttatcattcttatgcctttgcatcctcatagcttagcttccacttatgagtgagaacatatgatgtttggttttccattcctgagccgcttcactggatggagtctccagttccattcaggttgctgcatatgccattaattcattcctttttatggacgagtagtattcatgtatttatataccacattttctttatccactcattgatgggcatttgggctggttccatttttttgcaattgtgaattgtgctgctataaacatgcgtgtgctagtatctttttcatataatgacttcttttcctctggggagatacatagtggtgggattgctggatcaaacggttgacctacttttagttctttgaggaatcttcacactgttttccatagtggttgtgctagtttacattcccacgagcaatgtgaaagtattcccttttcactgcatccccaccaatacctattattttttgattatggccattcttgcaggagcaaggtgtatcacattgtgttttgatttgcatttccctgataattagtgatgctgagcatttttccacatacttaatggccatttgtgtatcttcttttgagaattgtgtgttcatgtctttagcccactttttgatgggattgttcttttttttcttactgatttgagttctctatagattctggatattagtcctttgtcggatgtatggattgtgaagatttcccactctgtgggttgtctgttaactctgctgcttatttcttttgctgagcagaactttttagtttaattaaattccatctatttatctttgtttttgttgtatttgcttttgggttcttggtcatgaaggctttgcctaagccaatgtctagaagtgtttttcctaagttatcttttagaatctttatggtttcagggtcttagatttaagtctttgatccatcttgagtggatttttatatgaagtgagagatgaggatccagtttcattcttctacgtgtggcttgccaattatcccagcaccatttgttgaatagggtgtcttttccccactttatgtttctgtttgctttgccaaaaatcagtcggctgtaagcatttggcttgatttctgggttctgttcccttggtctaggtgcctatttttataccagttccatgctgttttggtgactatggccttatagtgtgaagttggggggtgtgatacctctagatttgtggttttttttgttgttgttgtttgttttttgcttagtcttgctttgactatgcgggctcttttttgattccatatgaattttaggattgtttttcctagttaagaatgatggtggtattttgataagaattgcattgaatttgtagactgcttttggcagaatggtcattttcacaatattgattctacccatccatgagcatgggatatgtttccgtttgtttgtgttgtctatgatttctttcagcagtgttttgtagtttttccttgtagaagactttgatgttcttgattagatatattcctaagtattgtattgtatttatttatttatttatttgcagctactgtgaaaggagttgagttcttgatttgattctcatcttggtcactgttggtgtacagcagagctactgatttgtgtacattaattttgtatcctgaaactttgctgaactcatttacaagttttaggagctttttggatgagtctttagggttttctatgtatacgatcatatcatcagcaaacagcaacagtttgacttcctcttttctgatttggatgccctttagttctttctcttgtctgattgctctggctaggacttccagtactatgctgagtagaagtggtgaaagtgggcatccttgccttgttcctgttcttagggggaatgttttcaactcttccctgttcagtataatgttggctgtgggtttgtcatagatggcttttattaccttaaggtatgtcccttctatgccgattttgctgcaggttttaatcataaagggatgctggattttgtcaaatgctttttctgtatggagatgatcacatgatatttgtttttaattctgtttatgtggtgtatcacacttattgacttatatatgttgaaacattcctgcatccctggtatgaaacctacctgatcatggtggattatctttttaatatgctgttgggtttggtttgctagtattttgttgaggatttttgcatctgtgttcatcagggatattggtctgtatttttctctttttgttatgtcctttcctgatttggtattagggtgatactggctttgtagaatgacttagggaggattccctttttcctctatcttttgaaatagtgtcaacaggattggtaccaattcttctttgaatgtctgatagaattcagctgtgattctatctagtcctggactttttttgttggcaattttttaataaccctttcagtctcactgcttgtcattgctctgttcagagattctatatcttcctagttaaatctaggagggttgtatacttctagaaatttatccatctcctctaggtcttctagtttatgtgcataaatgtgttcatagtagccttgaataatcttctgtatttctgtggtatcagttgtaatatctcttgttttatttctaattgagcttatttggatcttctctcttcctttcttggctattcttgctaatggtctattaattttacttatctttttaaagaaccaagtttttgtttcatttatcttttgtgtttttttttttttttttttggtttcagtttcatttagttctactctgatctttgttatttcttttcttctgctgggtttgggtttggattgttcttgtttctccagttctgtgaggtgtgacttagattgtctatttgtgctctttcagactttttgatgtaggcatttaatgctatgaactttcctctagcatggtttttgctgtattccagaggttttgtcattattattgttcagttcaaagaatttttaactttccatcttgatttcattgttgacccaatgagcattcaggagcaggttatttaatttccatgtatttgcatgcttttgagagttccttttagagctgattttcaattttatttcactgtggtctgagagagtacttgatataattttgattttttaaaatttagtgagacttgttttgtgggctatcgtatggtctatcttgtagaatgttccatgtgctaatgaatagaatatatattctgcagttgttgggtggaatgttctgtaaacatctgttaagtccatttgttgtaggttatagacttaagtccattgtttaagtccattgtttctttgttgactttctgtcttgatgacctgtctagtaaagtcccttactgttattgtgttgctatctatctcatttcttaggtccagtagtaattgttttataaatttgggatcaccagtgttaggtgcatatgtatttagaattgtgatattttcctgttggattagtccttttaccactatataatgtccctctttgtctttttaaactcctgttgctttaaagtttgtttggcctaatataaggatcactactcctgctcacttttggtgtccatttgcatggagtatctttttccacacctttaccttaagttgatgtgagtacttatgtgttagatgaatctcctgaagacagcagaaacttgcttggtgaattcttattcattctgccatcttgtatcttttaagtggagcatttaggccatttacattcaatgttaatattgagatgtgaggtactattctattcatcgtgctatttgttgcctgaataccttattttttcattgtgttattgttatataggtcctgtgagaattatgctttaagaaggttctattttgatgtattttgaggatatgcttcaagatttagagctccttttagcagttcttgtagtgttggcttggtagtggcaaattctctcagcgtttgtttgtttggaaaagactggatctttccttcatttaggaagcttagttttgatggatacaaaacttagctgataattgttttgttttggaggctaaaaataggaccccaatcgcttctagcttgtggggctgagaaatctgctgttaatctgatagattttcctttataggttacctgatgcttttgcctcacagctcttaagattctttttcttgtcttgactttagataacctgatgactatgtatgtaggcgatgatctctttgcaatgaatttcccaagtgttctttgggcgtcttatatttggatatctggatctctagcaaggctggggaagtttttctcaattattccctcaaatatgttttccgaacttttagatttctcttcttctttgggaacaccaattattcttaggtttggacatttaacatagtcccaaacttcttggaggctttgttcattttaaaaaattctttctttgtctttgatgcattgggttaattcaaaagccttgtcttcgagctctgaagttctttcttctgcgtgttcagttctgctgctgagattttctagtgcattttttatttctctaagtgtgtccttgatttccagaagttgtgattgttttttatttatgatctctgtttcactgaagaatttttctttcacatcctgtatcatgtttttgatttatttaagttgtacttcatccttctctggtgcctccttgattagattaatacttgactttctgaattattcttctggcaaatcagagattttgtcttggtttggatccattgctggtgagctggtttgatcttttgggggtgttaaagaaggttgttttgtcatattaccagaattgtttttctggttccttcttttttgggtagcctatatcagaaggaagatcttggattcaagggctgctgttcagattcttttgtcccaaggagtgctattttgatgtggtgttctcccccttcctctaggaatggggcttcctgagagctgaactctagtgattacttttgctcttctgggtctagccacctagtagagctactgggctcctggctggtactggggaatgtcagcaaagagtcctgtgatatgacccgtcttcagatcttccagtcgtggataccagcacctgctttgatggaggtagcaggggaatgaagtggactctgtgtgagtccttggttgttttatttagtgcactggttttgtgttggttggcctccagccaggaggtggcacttttaagagttcatcaactgcagttctatagggaggatgcaaactcgccctaggaacaggtttctcaggtggtgggcagggccatagaactcccaagagattatgacctttgtctttggctaccagagttggtagagaaagaccaccagctgggggaacggataggcatttctgagcttagcccctcccagggcagggctttctgtggctgctgtgggggatgggggtgtggttcccattccagtggagttatactcccaggcagattatggctgcctctgctgagtcatacaggtcaccaaggaactgggggaaagctagctgtcataggcctcaccctgctccaagcagcctgtagtcctaatggcctcattccctccatgctcccccaacagcactgagtctatttccaggcagctgatgaccagggctgagaacttgcaccagaccatgagcttccctattgagaaagcaagttgactcagtttttggcatctcagggagcctgcaggggtaatccagtttcttcaaagcatctgtggattctctcagctttcctggtatgttcctgcagtcgtttttggagcaaatgttcacattgtgagtctccacatgctactctgtctgtccaagcaggagctgcaagctagtctttcttcctatcatatctatgattctttagcaattgaaagtctaaagccatcattcatctcctcttgccatgatatctaaatataaatatgtatttcacatgtctcctaactggcaagagatgcccctcagtggaattttagtttccatcacctgtgaaagaaggagcaagccactgccaaaaggtggtcactcagcctcttgggccccagttctagaagctctggatagtgactgcctgtcgttggggtgctcaaaatctctttgtgcttgaagttctcagagagaacatatatcctagctagttctgagctgctcttcctgtggacacccttcaatcacctcttcagggaagagcctgtctctcccaactgtcccacagagagactttcctcagactgacttatgattctctcacacttctcgattttagctcctactagtggcattttgtgtggcatattttgtgtttgcacataaaatagaattcaagcaaagacttgaaagaattaataaccatctggtgactctctgtcacacccataaaatcctagtataatttaaaaatatatatagtttttgaattcatttgttgaaatatttaaataatgttttcttggtataaaagaacaacaatggggtgcctaaaaatgctccaaagtgaattgtgtacacgacctattctatatttggagttagatttcttcagcacatctttccacatttgttggaaatctgttcacagttggtggaaatctgtccagctgctttcatgtgatatgctaataaataggcatgtgccttagtctgtcttctgttgcctataacaaaatacctaaaactggataattaagaaagaaaaggaattcatttcttacagttatggaggctgagaaattcaaggtagaggggctgcatctggtgagcaccttcttgttagtagggactctgctgagttctgcagtaggacagggcatcacaatggtgagaggccgagtctgctagcttagttctctcttcatcttctttttttcttaattaaaaaaattattaatacataatatgtgtacatacttatggggtacatgtgatattttgttgcatgcatagaatgtgtagtgatcaagtcaggatatttagggtgcccaccacctggggaagttatcacttctatgtattgcaaacatttcaaattctctcttctagctatttaaaaatatacaacacattgttaactgtattcaccctactctactttccaccgttagaacttagtccacctatctaactctatgtttgtactcattaaccaacctcttttatcccctttacccaccccacacacccttcccagctcctggtatctatcattctactctctacattcataggattcaccttgatagctcctgcaaatgagtgggattatgtaatatttgtctttctgtgcctgacttatttcacttagtataatgaactccagttctatccatgttgctgaaaattacattatctcattctttttatggccatatagtaatccattgtgtatatatgtcacatttttaaaaatccattcatccattggtggacacttaggctaattccgtatcttggctatcgcgaattgcgctgcaataaacatgggggtcaagtatatttttgatacaccaacttctgttcctttggataaataccaaggagtgggattgatggatcatatggtagttctaattttagttttttgagaaatctccatactgtattctacaatggttgtactaatttacattcctagcaacagtgtatcagctcccttttctctgtatccttgccaactctgttattttttgtctttttaataatagccattttaactagagtaagatgatatcttattgtggtcttgattttcatttccctgatgattagtaatgctgagcatttttttttcatatacttatcagccatttctatgttttctttggagaaatgtctatgcatgtcctttgccccctttttaatggggttgtttgttcctttgctgttgagttgtttgagttctttttatattctgaatattagtcccttgttagatgaacagttggcaaatattattttttccattcaacaggttgtctcttcactctgttgtttcctttgctgtgcaggacctttttaatctaatatgctcctatttgtctatttttatttttgttgcctgtgatcttgaggtcttagccattgtattagtccattctcatgctgctatgaagaaatacccaagactgggtaattgataaagaaaagaggtttaattgactcaccattctgcatagctggggaggcctcaggaaatgtacaatcatggcagaaggcacctcttcacagggcagcaggagagagaatgagtgttcagcgaagggggaaggcccttataaaaccatcagatcttgtgagaattcactcactatcacaagaacagcatggaggtaaccactcccattatctaattacctcccaccagatccctcccatgacatgcgaggattaggggaactacaattcaagatgagacttgggtagggacacagccaaaccatatcagccctaaattatttgcccagaccaatgtcctaaagtgtttctcctatttttttttttctagcaggagaaaaatccctaaatactgcttattctataacccaaagataaccacttgatagtttcaggtcttgcatttaagcctttaatctatcttgagttgatttttttctcttctgataaagccaccagtcccacttccatgataactcattaattcatgaatccacaaatggattaatccatttatgagggcagagccgttatgatccaatcacctcttaaggccccacctctcaatactatcacattgggaattcaatttcaacatgaattttggaggggacaacattcaaaccatagcagcatataattaggaaataattttatttatatatagacatgagatataatgaataaggaataataccaggtagtgctcagtgaaatataaaaaggtggggcaaactatagtattctatatttggtaaagccttaaaagagatagaagaagtcttaaaaataagtaggtaagcccctgtcctgctacgtggtggggcataggtttcattagtgatgggtaacatttatgagtgcttactgacatcagtactgctctgagcatttcacttgtgttttcttccttgttttaagtatacttactaaagattgaaaaggataagaatttgccccattaggtagcacagctaaaaagtcccaagactagggtttgaacctcaggagtctacattgcaattctgatcactacctggggttaggtcaaatttcacaggttaaaggcatggtcccccacaaaactgacctcatcccagatatcagctgcaagctcaagaaggtcacagaccgcccatacctctgacaaactgaatttgagtgttcccatgacctcctcagctttggcaattcactagaacaactcagagaacttaggaaagcactatacttattattacagtttttactgtgagtgatgcaaatcaggaccagacaaaagaagagaagcacagggcagaggagagtcccaaacatggttatctttggaacgtgtcgccctcccagcacaattaacaaagaatctccagtgagcttcagtgttcacagtctttattgtgatttcattatgtaggcatggttggttgaatcgttggccatgtgactgaattcaatctctagccccaaaatccttctctgataacatatggttcaaagccccaaccctatagtcacatggctggtctttccagcagggcaggccccaatctataaactctctagggacttacctgagtcacctcattagcataaactcagatgcggtctgagggtccacttggaataatgaagacactcctactacttgggaaattccaagggtttaaaggctccctcccaggagccagggacaaaggccacacaaattctctattatacaacacagtcatcctggtggtaagggaacttgagtctcatcaaaggacttcagaagactctcaacccccttctctcctgaggcccaacattaaacactaagctccacagtaaggctcctgaaggaacatagacttctgtttctgaggtcgtgcctgagctctagctgggtgggttagtagaagggctgccctccgagaattggagactaaatgctcagggtcctcagaagtttcctaacaagagggtgcagatttgctctgcaaagactggaagccacatatttggacagcaaacacctccatgcattgaaatgactaacaagccagaggagcctttcctagaggtggaggacagcatcttgttaagtgtactaaaaaccatatctgtaaatcagctgccgtttaaagcagttagcagtcacttaccaccatgggcaataagcatatgctgggctacacctgccatcagccccagggagcctcagagaggttcctggttcaccatttcacagacagagacattggtgaaggagtatgggtcacagatggcctgggactgagaaatgtctgctccaaccttatgttcccagttgtccaccagtccatacctgttggactaggagactcagaacttctagggtacagaactctgggtgcttggagtactcattaaatttgcaagctctttggtctcccagaagaaggaagcagatacaagggatggggccccatggaaatccagagaggccaggctgtgctgaagggagacgggcatcagaaactgctggggtgggtccaagagctgggaaaccagagaaaagtgtttctggaagctttactaatcattccttctccccagcatgacttattccctctcacctgcaggccttagcctgacagatcagtatgcaatcagtctctcactctacctatagggagtggatagtaaccagctcaatgtatgttgcctgggttttagggaaacaaacacatttctgattgttcaaaataatatatgagcattagagagaaaatagagagatgcacagagcaggacaaaatctctaaatactgcttattctataacccaaggataaccacttgataaatttgatatttctccatctgagtccaatgctaacctaatctcaaatatcatatacacactcacacacacagacactcactcgcacatgtccctcactctccggttgctccttgtctgaacttaggagctatgaatacattcagacatagagacatacttataagtagtatttgaataactacattttcattcctcaaaaaatttttaaaacaaaacttggatagttgtgaccttgtgtaaattccttaactgctctgactttcaggttactcatctgtgagtaggtataatgacccctgcctcacagaactggctattagaaggtctcaaagagacaaaagccctgaggcactggcattgtgcatgtggtgcagcagggacccaggcaccattagttctccctctctcactggatcctctctggctccaataggtcatcccagccccaccttgactcacctgtctgcaagcatctgctcatggtcctgaagcacctagatggataattcatgggcaaagctcagagaggagaggactgtgtatggctggtaggagaggggctcttggaagccatttgccatgggtgcagatggcataaaggaggggaggagagaggcatttcccaagcagtaactttaatattttcaaatccatatatctctaactatgactgagaggctcaatggagccattggcatggatcaaatgaatgagctagtggttgagatggttggtcataacatttgtaagcatagtcctgacaggctacttgaattttgactccctgcaagttaagcactgggatggtttttgtgaagcgggttcactgggcactggttacctacttgtctgtgtccagtgagacaaaacactcacatacaagacatgaagtgagcttattgtttgcaggcaggcagcaagagaccacagaagcctaggatgtaatttgagccagtctccccaggctcgggaaagctgtctggggctgctagtctcatctactcatgccccacctgtaccacagctgagggaccccagaaagcagcctgccctcagttttatactttggggctcttggaatcactgggataaagtgttgaaggacatactgtttttcagggttgagggcaggctgaaacagagcctggactattccagccagttcctccctatttaaggttgttgcaatcttagcacagtttccaagtgttcttgagaatcacaactgagaaagagggagaactgggttggtctaaggccacccagagaatagtcctgaaattttgactgctgtatggagttcagctctttttgttcatggttctattttgtttactttactgccataatagatctgataaaatggataaggaacattgatgttataatatacaaaatgaatgaggagtgtaattgtgatgacagttcttcaaacatgcctcaagatgatctttacctgattgtatgttgcatttatttgcttactatctgtacgtagtatataaggatagctcctgaactcccaaaggcagtgttaaaaagagaaaatagaatgatgattataaccaatctgaattttcgtttattcagattaaagggtttctttatccaaaatgtattatttgcagacataccaaaaaggaaaacaaaaaagcctaaagcataaaccttttctatctcatttaaaaggaaaaacacacaaaatataaaagttaatgagtttccttttaaagtgaacattgcaagaattcccagcatcccatcgtgaagcaaggtttgcctgtttctgatgcaccatcatttagttaaacttcaatctgcattttcatatagattcagtctccaaaccaaacctgatattttataacactttggaatttattgccaacaaatcaagtttttctaacataattaatctaaagtaaattaaactgtgtgcttcacttggcaaatggaaataagtaaaaatctgactacatattatgaatattattaaatacaattaaaaataaaatttataatacattcttcaatactacactaatttgaatgaaatatgttaagcttgaaatcagttctgtatgatattctaaacaaaaatgacaaaatggtttttaaaattccaaaggcagttggtaagatcgtatgttagtgtgagtagggttcacaaatcaaaaaatgtagtgctgagggagaactctgactctttggacaagcttgtggtgtggctaatcagagaagtgtcatatttgctgcggaaggtgattttttctaaagtagccaggtgagggtgcaggaccatttgctgtcttggtaaataacagcaaacactgacttaatatgtactacgtgccaggcattattgattaagcatttattggtgttagctatttaactctaccaaccactctgtgaggcaggcattgttgctaatgtcatccccattttacagatgaggaaactgagagccaaagtccaagcaaagtgatgactcaagtccaggcagactctatacattgaaccactgtgctacgtgcgtatcgaaaagtgcacgaactcatggttgacttctcataatacttgggtttgtcattgttcctcaccctcacccccagtccccaatccccagacaaacaccttgtcattgtcaggtgaaagaagctgatcctgtgttcacctgggggctccctttttcctcttccaagggtgttaggctgtaccttggctctctgtcagtctagggctaagagtataacttggggtaattatgcatttcttcattcttgcctctatgctggtgtacatgtaaacttggtaggagctgctgaactgtaagtaaacctaaggcgtatggattattagggaggtattgaagcatttgctggaagaataggcccagttaaccagagttggctcagcacacctccccaggtcagtcatggggaaagtttaagggattctgaaagagatactcacggagagatgagggcactgaaaaggataagggggggtacagcccccttctccctggcaccctaatggcctccaaacactcatagtcctctccacaagggtgtgttctgggtgtgcttggtggttatggtttgtccttgtggaaccacctcaggcagatcagaggttggggattccagtttcagaatcaggttggaatcctccctctactctttatcagctatgtgacctcaggagagttacctcatctccctgagcctctgtgatctcatctgtactagggacttaacaatagttttcacctaatggagttgttgtgaagattgaataagaataaagtacacactagtgcctggctcagagtaattacacagagcgcagtcatacatttatgcatactgcatttagaagcttgctgtcactcccaatacatagatacttttacagtacacacatgtattcatgcatatttcaagtatttcttattttttatccctctggatggctgggaaacttagactttccaattaatattttcattctttattgctgcataacaactaccccaaaacattgtggcttaaagcacccattattttgttatctttcatgattctgcgggttgactgggcttagctgggcagtccttctgtgcccatatgaagtcagcttgggctgcaatcacctggggatttagctgggctcctgggtcggttctgttcaagatggctcaatcacacggctgcactacatgtggtctccgtgtgacacatggttgggttccagtaagatgtgtcccaggagtgaccattccaaaagtcccaggcagaagttgcaagacttcttatggcctagccccagaagtaggacagcaacatttccacagcattgctcaagaaaaccactaaagccagtgcagaatcaacagtctgcaccccgtctctactaaaatacaaaaaattagccgggcgaggtggcgggcgcctgtagtcccagctactcaggaggctgaagcgggaggatggcgtgaacctgggaggcggagtttgcagtgagctgagatcgcgccactgcactccagcctgggtgacagagcaagactctgtctcaaaaaaaaagagtctgtgtattccaccgctagatatctggagtagcaggtgtgtccagggaaggaattaatggcggcagcttgggaagtctgtctactatgtacactacactgacaaatgcaaaagcgcacatatactgttttgttattttcgctttctctcttctccctggatggttgggaaactaagtcttgtcaattaacatctttgtctgttccagcttaagagtatcttttcagttcgaatattaaaactgaatttctttttttagatggggtcactctggccccccgagtgggagtgcagtggtgcattcacagctcatggcagccttgacatcctgagggttaaggtgatccttccacctcagcctcctgagtagctgggactataggcgtgcgccaccatgcccagctaatattttgtattttttgtaggggtgggtttttgccatattgcctaggctagtgaatattcaatttaaactaagttaaattatctaatagagctggtttgagtagcttcttttggataacttgcagtccaccttccttcttttcttttcaagatggcctctggggatgccctgatgtcctgtggcagcaggagggtgggtgatacggggatgggggttggcctgctctcccacttttccagtaaagaaaggctgggccagatctgtgactgttaaggcagcactggtccatctggccttaggggatgcagtgggacccaattctggaatccctagcccaggccacttggttttgatcttgacatctccaccgatacagacctttgtcctgtctctccatgtacccctactgtggcatgtcagagctcctgggtctgtgttctacctgtccttccccactgcctgccactgtacaccctcaccattgctcccacaccaagttggaccccttggccggagttatccaaggatatctggagcaagggatggtctggagggtcacaggctcccccgtgttaagctgaatttatctacatctttcccacctcacccctccttgaggtgtggctcccagatcattggtacctgcctgatttcttctctctagctctgttcccctctgccacttacagtccccagcccattggaacagtagtcaggctttgcaggctccttgcaggatgtgcctctgccctgcaacagctctgcttagagcctagcaggcacaggtggaaggtgcatcctctctacaccgtggaagagataatgattacatcctctggacttggccctagatatattaaataaatgccagagaaatttagaaaactttcttggcaatgtctagcagtcaagattcatgtctcttaaaaaaactttttaaaaagcctattttggtaacaaattgaacaatccttttttctctctgagttcttgttttaacaatcttaatactctagccctattaccaataacctctcccatggtcaccctaccagccagagtatctgccactggctgacatggaagacaattatttcgaggaaatgcacagtgaaaaaaacacagtaatatatttccaacaaaacaaaacaaacctcaagttccctaactagtagctacaattgtgatgaccattgtccccacccagatcattcatttattggtggcaggggccagttctggttactttgacgttaacctgccatgtgacttcagcaagtcaccagcagtaggtggcgttctgccaaggtttccaccacatctctaaggccccttccagcctaagtctccttctagtgacaacctgtggacagtgggtgagaaaatgcaagctgctgaccagctgacactgagcagatctcttagttattgactgaccatttatccaaccaaggtttccaaggactgggacattgtctttttcaccactgtatcccctgcagctaaaacagggcctggagaatggtatacattcaataaataaatatttattagatattgagtgactgctgactccttcccactggtcctccccagacacctgtcccacgtgtgatgtttatcaggtatcagaatgcaatatccccaaatatggtaccttggcatactgaatattttaaggtgaaggaaattgagaagatcacagaagcaataaggtcactctgatcttcttcctgcttcttctctcctgaagtgggtcatagagactagaattcccctcaccctttcttccttaaagcaactaataaaacctaagaatgtcactctctgaccttgtccctcctttctccctgaagactctcatacaacaggtatcctgctatatacctagagggaaggaatgtcacacagaagccaagaagaatcagactaaacagggcttgctaagttcctccctgtttattattattaagtcataaccttttgtcctctgattgtatttctgcatgactgtccgtaaaaatacatggttttccctaggtctttgggtcttcatttctgaagcctcccatgtcatgtaaaatttatatgaagtaaatttgtattattttctcctgttaatctgtctcctgttatcggagtcccagccatcagccttgcagtgactgacggaaagatcttactttttctcctctgtcctttgtttctgctttctgggtcctggcaagcccgtgaaggctgatgtctgtgcccacctcttgctcgccaggcttttgagggagggaaattctcagcgtccttggccattctttactggctttcatagtgagatgtgtacctcgtcagagctgagggggtgcctctgaggaaggtggcatgttctctggctaattcagagcttctcatcagacaacgggtctctaggaatgaggagcagaccctgctcagacattgggagcagcaagattcctagaatgagatggaatggtccacaatatggaatatgcactctaggctgatggttcacctcaggaggtggccttgggtgttcaatacaggacagggaagtgccaaaaatgatagagggtgtcttgggggatgggatgcagatagctgacatttcctattcttaatatctctcagcataaagcaaagaacatacaatgtcagtgggggctcacctgaggcctgttagttcagaagttctctgcatttttcagccggccacactctgataaccttcaggaaaggtattctcacatttgtacctacagttacctcctaggtaaagccaagctgggtcatgggttatttgctccctgcttacagctggaacgctcttccttcttccactggcctgtgatgggccaacatgacagaaccttaacactcattgggatacctagtgcagcacctagcacaggtgggcatttggggaatgtttgtggaatgaatgaatgaaacaaagggcaagagggaggatgaatgagagggaggaagagaagtaaaggaaagagaaaggaatggagaagaaagattatttcatattggtgataccagtgctcatttagaagtctctaaatttttgtaatagcaaaagattaaaaataacaccgatgtccatctatagggtcctggctaattaactaactgtataataagataaaatgcgcatttttttttaaaagcggacactcttcaggttttggtatgaagaagttttcaaggtactaaatgtaaaaagcaaagtcactccgtttgtgtgtttaggggtgtgtgtgtttgtgtgtgtattaggctacttctgtgtcaaaaaagagaggaaaaataagaatattttatatatttacatgggtcatataaacaaactatgaaagagtatacaggaccctaataaaaatagttgccattttgggggaggttagttgggggaaggaaaggaggaagaaacaggaggaaaacttttcactagctctttaaaatggttgtgcctggaaatatattactcttgccaaggttgtagtttaagtccctcaagtcaggggagcattctagttgaatttcctctatctagtgccctgtgaagcatgtgactagagctctcccttgatcatggcaaaattgatttgataatagaatctgatctttttcattttagccaaatctagctcatctgaaccattgccctccagttataagggaggaaagagagaatgactcagctcaaaggaactgcttagatatggttacagcatgctacttctcatggtaaattatgttattgatcgccaaatttgtgaacagtttttacctatacaaagtattcagttttataagtaaatgtttttaaccattgaaagaattggtaaaattcaggaatggttacctcttgccaggattcttggaaagatggaaaatcggaaacaagcatctgtttcactgctttttctacatttatgtctttatctttgaacaagtacctactgaacacctattatgggtgaagcttagataaagaaagtcagaaacatatgtgggtatattgaaaccattgacattcccataggggctttttttccttttttgctatgtttggggggaatggttaattatcattgcactataaatgtattggcataacaagtggcttatattcttcactttaataacaatctgtaatttcctgagtcataataataaggctttaacatattagctcagtgaagacttggtcaatgtctttactgagaaaaatatgttatgacctagcacatgataccatccattataatgttcttggtcaataatcataattttattataattattgaaagctagggtttcccctctgtgcagagtgttgtaaagacagatgcatgagattgtgaaggatcaaggtgttatccataatagtacattcagctggatttatgtccctctccaattagaggacaatcaagctcaaattaatttagctcacagctactaatgagcaacagcaaaatcagctcactataaaaaaattgttattgaattttattttctccaacttgatgaatgtctatgcactgcgagtaatgtgtgtttgaggtctggtggtgagggaccttgagggttgtctcatccgccccgttcatgggctctgtgacagctccgttccctggtgcaacaacatttaatgagttgttagaggtccacagagatgggcttcctctgttaactgagccttgacagtgcttttgagtgaattttctggtctaaactgctgatataaatataatgcaaaccacatacataatataaagttttctagtagccacattttaaaaagtgaaaaagaaataggtgacattaactttaatatattttatttaactcaatgcaatgtatccaaactattatttcaatgtgtaaacaatataaaaatattaatgcaatagttttcattctttctgttttgtagtaagtcttcaaaatccagcgtgtattttacatttatggtacatctccagtactctagcctcctttcaaatgaacaatagccacaaggggctggtggcttccacatggcacaggatgggtctagattgaatttcttcattcataacaaagctgcatttccctctttggagtttgtaggttgaggcaaggtgagcacaggctttggttgctcaatgatgataaagaacatacacaacctataagcaggagaagatactacattttcatctttactgtgagtcttgcaagtcattggcaaatttacagtctctgtgaattggcttatggtccctgtcaccatccacctcccacactaataaaggcagaatagatcctcataaatatcctttttccccattatcagagcttcaccaattgtggcctcataaaaaaagaaggttgtttattattattattatttgttgacataaaaaatgcatatttttctgaagcctgacttcccactagtactgttgctttgacatcaaatagggcatgaagcatattgtcaaatacatgtttggggaattagaagccattgagtgtttcatctctttggcaatgttcctgaggaaagtgcatatttaaatctaggagaatattttaattgtttaatattgtaaatgtttaataggaattctgaggcgtaatgcaaggactcactgaacttgattactgcaaagtaggagatgtgtaatgagagtctggagctcggggttctcatcacttggagacccttatacactaatgaaatgggatgcccaggataggggcatgggggagtacatgaggaagaacagccgctgatattaccactccaatggatgcagctacaaactaggcttcttgccagcacacaaggccctctgatgacactctgataagcttcagcctggcacaatctcatcattgctatttccaccctctttcctctcaaagtaaataggtagctatcagattcctgactggtctttctgtttccagccctgtcctcctcaagttcatcctctacccagctgtcagagagctctgtctaaaatgcaaatgggaccccatcactcactgctaaaagcacttcggtagctccccattgcccttggattagagaccatgcatttcttaacagtagcctacaagctgtcctgtgatctggcttctctggatttccttctcttcccttcctctcttctttcctttttctgacttataatttatattcttacaactccgacccacattcctgtaatcattcctttcctcccctcttttggcttcttccccaccaaattttaatttactttctttataagtcataagtcagcctttacctcctccaggaagcttcccccactccactccaagcaaggcaaatgcctttgatactgctgtggtacttgcatcaaatatatgcacatcaatcataatgcctatttgtgtaaccatctgccatctgcataacaccttgcctttcatttttgaatccttcatgccaagctcagtgcctgatgcttagtaggtactcagtagatgtctgctggtggactggccagacccatgatgcagtggtttctggggtttggggaactgcctttcctctctgttggaagatgaggcatcacctctcattcagctcctgagatcagcctgggcactcattcccctacaagagggaactgatgatgagactaagtcttcagcccaatgcctgcagtagggtcctcagaggcctcactgcctgccaggcatggtgatgaaagtgtattgctttggttcagttagatgaggtcttgggaccccaccagcaatgcagtgttttgaagggagtgggtagagggaggatgcctgaacagtcaggagtttaatgtccatcttgatggtgatgagagtcattgaagcatttttagcagagagtgggagaatcaggtttacctggaccaaggctcttccagcccagcctcaactgcacgtttctgtattcctgcagtttataagggaagaaatgcagaggaaggggtcagagagagggatctgtgtcagttagaattgcaatctgttgtaagtagaagaaaattcaaagaacactgagttaaaaacaagattgggggttatttctttcccatctaacaagaagcctggaaatgggctgttcagggccagcacagtgtttacccctttgcctcattgtcttagcacacgggcttcgtcctcatggtcacaggatgacttcgcctttccaatgggaacaagggagaaggatgaagggtccaaggcaaaaggacaagctactgaatctatttcctggacagccacccagtggcctctgcttgtgcctcggtcacgtgggcactgctagctgtaaaggagcctgagagacgttgccccaacaaacttgaagttctgtgaatagcgaaagaacaaatagatactgggcgggcaactggcattaacaccctgactttccaacatcttcctgagagtttgaatttatttttttcctggcattaacactctttgaatttaccttgtttactagtttgttggcttgtggtgtctgaccctagaacatatgctctgtgagaggaggagcctcttttctctgattctgtcctgcctgtttcacctctgactcacaccacagggatgggggatcccgcagctccaggccttcagatccagaatgaaaatcctcggctccatcccccagagggatatttggaagcatctctcaaagaggtaaggtatctctggtatttggcatacaaccaatttcaccagactggctgcctctcctccatctccgggatcttgttctttttcttttcccccccttattaaacaaattagccaagatgacactggatactgattagcaatttgtatagcaataaaagaaaactggcagaattccattgttttgctctccaattcttcatttccatttttaatgtactgtgtcttcattcatttgattgggtttccttttctgtgtatgtccttaatggaacaaagtgttcttcttcccccaacccctccaataattgtgaacattaaagagctgcttaaattgttcagtcatttcattttataatttgagttgggagtatttatggcttttcctccccttccctttgtgctaaatcaatagttgctgtgtaaatgcgacttaaactgtagcatggaggcaagctcttctacttctagatccttccctgtggccccgccggctgggggatttggagtccctatctgtcaaaggccatccttagccttccggtcagccccacgttgtgatataaatgatcagcacacacatccccttcttgaggggagatgccctctctgggctcctatgttaacctacttgtgctttcaaactcataatttttcctctaaaatgatcgctcatttatttgtctactggagattctggagggaagggactttatcctatccatctctgcctccctacagcccccttgagagaatgctagacatcaatagatgcaggatttcacttaatcatcaattaatgactgattgggaagaactgaacaataacaaaagccaaaagccaaatgtattctctgtgataggcattgttctttgttgctttaaagacgttaacacatttaatctttacaattaccgtttatgaagcagggattattatcctgatttcatggaggagggaagtaagccaggaagagagattgagtagctgctttagggttacaagcccaatatgggggacagcaagattgggcccataatttggccctgggtagtgtgagcatggagcctacctgcttagcccttgcagagcacagccttcttgtctgagtagaagctgccatgtatttatatgacatctgggccaggaagcagagcctccttccctctctctgactcaggagcctccatgtggggaaaccattccaaccctgttgactccagcaaccttctgagaatagatataaatgcaaatagcaggaactgcattgatgtggaccttccttaatgcctgaaaactgcctggaagctgccacaacagtgtatgcctccccttggcatgtgcatgtggctactggaagccctgggggacgaggcccaccccatacagggcagagccctctgaagagcctgctgcaggtggctctgccaccaccaacttacgtaacaaatcactccgagccatctttactctgtaaaatgcaaatgtctgtaggtgctggaggcagcctgccaagaattcctgtggccaggaatttcacaaaccagacattacttttttaaaagagaaaagactgaagttaggtattcacctgttaaacattaagaactaagaacattaaaaaaggagaaaagtaaaataaaaaagaccatcttttgtcaccatcgtttcataaaagcattttaactccctaaaatataagtgggactatctcagaaaacaatgaacaatccattaaattgaattctgatggttaacagatgaaaaactcacactgtccttgttttgttcatccgttcagcttagacctgtgaaaattctattgcccatcattgaggtccagtttttgggaaaaagtaatgtagaaaaaaaaaaggagtccaatcctagccctgccatccactgcttgtgtgactttgggcaatttagttagcatctttgatctttggtttcttcctctgtgaattgggagctgcctttcagtgctttttaaagattaaacaaggatatgagggtgatgtggctgcaacatctgtcaccccactgattgccagggttgatttggctgatctggctggctagacgggtgtccctttcctccctctgctccatgtgcatccctcctgaagctgcatgctccgctgaagaggatgaccttccccaacagaggagaaatggtctttggtcaagggtatatgagtagccgtgctcccctgctagaacctccacaaacaagctctcaagattaaatgaggcgtgtgtggagtgctcagaacctgggggaagagtttggactatgctcagaattttcagagcagcaattctcaaaatgtgatcccagacaggcagtatcagcatcacccaggaacttttgagaaatgcaaattattgggcctcaccccagacctgctgaatcagaaactgggagtggagcccaggaatctgtattttaaccagcactcttgttgattctgatgcatgctcaagtttgagaaccaccattatagggaaagctgtcacctcagtcacagtggccactgctgtggccatgtgtgggatctgtgagatctgatagagcagccagaacacctgtgaagagggaacgaagagggtcttgagtttccctggtaattattcagttcaatctgcactttgttcacaatccatccttcatgggaggaggctttacctggacatgttaagcatgggtcacccacctacctgtcagcattagattcctcatccataagctcaggacacctgtgccctccttcccacctagcagtggtggtgacattgctctgcagagagtgagggctcccttcctcccatctagctgtctctgatgtcaagattgccaggagtggggacaagcaacaacctgcactttgccattgatcagcttttctctgtgtctctcattttctctattgagtgacacttggaggtgggcctagtgtctgcccaagtctgctgctacatgatgctgtcagcatctttgtcccaaaatacggctataattgggtctctcccaaacaaaacagtccctttacaagatacccagagaataaatccaaagtctatcctgaaacaccacagcctccaaaatctagtacccactgtctgaattttttaaaaaataaattttaaagatgtaggaagcacagagaatagtattattacatgtactcagaagtcacactatcacatgttactgtgttgtcacatttattttattattttctagtgaagttattacaagtacagtcttctttcccctccttgaattcacgcttcagtcattttcctctgcgaatcgctttatacagcccatactcaagcctgacaggaccatgggaatttccagtggaaactggtgccatattgcctccctacatttgtctgtgtgggacccctgactagaatgtccccctacccatcagctgcccctggaatttgagagttcactcaaatcctactagctcttcaagcaccagttgaaatgccacacctcccatgaagcccgtgggttttctttcccacttctcttaaactcccccagccctccccactgtcaccttgagctgggataactttcaaatccctgcctttggagcacaggattgattcagagcacgaggctgaaggctcagcttggccattgactgagtgtgggatgcttgacagactcaatgccctcatctgtgaaatggggataataatgtcttctttgcaggcttgagagaaaatgtgtgacggctgtaagggatgatcatgcgagggattttataagtaatcctaggtaagggatcatttatgtttgctaatgctccctgactttcgtcatcatttgcggtgatgcatgcacgtatctcaactgcctgaggacagagtgaatcccggcctgatttaccttttatgctacgcagaattcagtttgatgctttcccacaatcatgactcaataaggttgactgaggagtgggtagggttacgaacactgtgatcgtttctgcctgtcttactacaaggtggaggaatgggacttccctttggccgtcagacatacagcaagtgctcactgtgtgccaggcacaggactagctggcagtggaggcacaaatatgttccagacatgatctccaaggccagttataggcaaaggtcacgtgtgtgacaaggaagacatgtcccttcatgttgtttattcattgcctgagcagcagctagatggggagagctgctggggcccaaaaaagggggtgggggagcattccctgagtgcctgagataaatgctccatgaaagtggacacggaacatctcacaagtgtcttggaagcaacctccttcgtgacatcatgacaaatggcttttctaggaaaacagaccaaatgtgagcaaaaaggtctgtgatcccagaccccaaaagttctgaaaatgggatatttactataacttacttggtggcaaaacctggaccaacctgatatgaggctatttatggtattcatcctcctgagtgtgaaaatccatgcctttgctgcagaaatatgtgtgtgtaatgacaggacacttccccagaccttattggagatgtttttagcatgcggtagatgcactgtatcaccttactaaaatctgggaaattttgaattcctacagatatttgaccccaaaagttttagccataaggattgcagacctgtagaagctgcagcagtgagggactgccttccagtcaatcctgcctcccactaagtttttcttcctgtaggctcccaggcaaatggttttcttctacctggggaaggccagtcccagtatcttcaaagtgcaggcagggctcagctcaacctgcagccaaaccctagtgggatcttttacttaattcagaagtatgtttttcttaatgtgagaaacacagctcagcatgagcttacaggaaaggtgggcttagtgttgcctgcaggcatcttctgggccttattggatggttgcaccatcctgctgggcttaataccccacactgcccatcccccggagcacctgcatactctggactttctctgctgcctttccatgtccgtggtgtgtagggaaaatgtcccattttctcagggccctgatagctcctaagctcctatattaactgtgctccagtattaataaatgtgtaggtactaggttttatatttctagataccatttgcactttagcaaatgtactttatgctttaacccataaggtgactaacagagggtgttcaaataatgtgctagaccctttttttaaaattaattctacctactttgttttttaaatttttattttattttactttaagttgtgggatacatgtgcagaatgtgcaggtttattacctaagtatacatgtgccatggtggtttgctgcatctatcaacccgtcatctaggttttaagccccgcatggattaggtatttgtcctaatgctctccttcccctcgctccccacccaccgtcaggccctggtgagtctctgtgtccatgtgttctcattgttcacctcccacttaggagttagaacgtgctatgtttggttttctattcctgtgttagtttgctgaggatgatggcttccagcttcatccatgtccctgcaaaggacatgttctcattcttttctatggctacatagtattccatggtgtatatgtaccacattttctttatccagtctatcactgatgagtatttgggttggttctttgtctttgctattgtaaatagtgctgcagtaaacatatatgtgcatgtatctttatagtagaatgatttacgttcgtttgggtatatacccagtaatggcatggctgggtcaaatggtgtttgtagttctagatctttgaagaattgccacactgtcttccacaatggttgaactaatttacattcctaccaacagtataaaagcattccaatttctccacagcattgccagcatctattgtttcttgactttttaataatcaccattctgactgctgtgagatggtatctcattgtggttttgatttgcatttctctaatgatcagtgacgttgagctttttttgtatgtttgttggctacataaatgtcttcttttgagaagtgtctgttcatatcctactcccactttttatggggttgttttttttcttgtaaattggtttaagttccctgtagattctggatattaaacctttgtcagatgagtagattgcaaaacttttcttcactctgatgatagttttttttgttttgttttgttttgctgtgcagaagctctttagtttaattagatcccatttgtctgttttgcttttgttaccattgcttttggtgttttagtcatgaagtctttgcccatgcctgtgtcctgaatggcattgcctaggttttcttctagggtttttatggttttgggttttacatttaagtctttaatccatcttgagttaatttttgtataagatttaaggaagggattcagtatcagttttcttcacatggctagtgagttttcccagtaccacttattaaatggggaatcctttctccattgcttgtttttgtcaggtttgttgaagatcagatggttgtggatatgtggtgttatttctgagttctctgctctgttccattggtctatatgtcttttttggtacaagtaccatgctgttctggttgctatagccttgtgatatagtttgaacccaggtagcatgatgcctccagctttgttctttttgcttaggattgtcttggctatacagggtcttttatggttccatatgaaatttaaaatagttttttctaattctgtgaagaatgtcaatggtagtttgatgggaagagcatggaatctctaaattactttgggcaatatggccattttcacactattgattcttcctatctatgaggatggaatgttttccattgtttttccatttccatgcactgattttcttgaacagtggtttgcagttctccttgaagaggtccttcatattccttataggctgtattcctaggtattctgttctctttgtagtaattgtgaatcagaggtcattcatgatttggttctctacttgtctattgttggtatataggaatgcttgtgatttttgcacattgattttatattctgaaactttgctgaagttttttatcagcttaaggagttttgggctgagacaatagggttttctaaacatagaatcatgtcaaatcaatcctgggggtggagccaagatgactgaataggaacagctccagtctacagctcccagcatgagcgatgcagaagacaggtgatttctgcatttccaactgaggtaccaggttcatctcactggggagtgccagacagtgggtgcaggacagtgggtgcagcgcactgtgcgtgagctgaagcaggcctcacccaggaagcacaaggggtcagggaattccctttcctagtcaaagaaaggggtgatagacagcacctggaaaatcgagtcactcccaccctaatactgcgcttttccaacaggcttaacaaacagcacaccagattatatcccacacctggctcggagggtcctatgcacatgtagcctcgctcattgctagcacagcagtctgagatcaaactgcaaggcggcagcgaggctgggggaggggcgcccgccattgccgaggcttgagtaggtaaacaaagtggccaggaagctcgaactgggtggagcccaccacagctcaaggaggcctgcctgcctctgtaggttccacctctgggggcagggcacagacaaacaaaaggcagcagtaacctctgcagacttaaatgtcgctgtctgacagctttgaaaagagtagtggttctcccagcacgcagcttgagatctgagaatgggcggactgcctcctcaagtgggtccctgaccactgagtagcctaagtgggaggcatcccccagtaggggcggactgacacctcacacggccgggtactcctctgagacaaaacttccagaggaacaatcaggcagcagcatttgcggttcaccaatatcggctgttctgcagccaccgctgctgatacccaggcaaatagggtctggagtggacctccagcaacctccaacagacctgcagctgagggtcctgactgttagaaggaaagctagcaaacagaaaggacatccacaccaaaaccccatctgtatgtcaccatcatcaaagaccaaaggtagataaaaccacaaagatggggaaaaaacagagcagaaaaaccggaaactctaaaaatcagagcgcctctcctcctccaaaggaacacagctcctcaccagcaatggaacaaagctggacggagaatgactttgacgagttgagagaagaagccttcagaagatcaacctactctgagctaaaggaggaagttcgaaccaatggcaaagaagttaaaaaccttaaaaaaaaaaattagacgaatggctaactagaataaccaatgcagagaagtccttaaaggacctgatggagctgaaaaccatggcacaagaacgatgtgacaaatgcacaagcctcagtagctgatgagatcaactggaagaaagggtatcagtgatggaagatgaaatgaatgaaatgaagagagaagagaagtttagagaaaaaagaataaaaagaaatgaacaaagcctccaagaaatatgggactacgtgaaaagactaaatctacatcagattggtgtacctgaaagtgatggggagaatggaaccaagttggaaaacactctgcaggttattatccaggagaacttccccaatctagcaaggcaggccaacattcaaattcaggaaatacagagaatgccacaaagatactccttgagaagaccaactccaagacacataattttcagtcaccaaagttgaaatgaaggaaaaaatgttaagggcagccagagagaaaggtcgggttacccacaaagggaagcccatcagactaacatctgatctcttggcagaaactctacaagccagaagagagtgggggctcatattcaacattcttaaagaaaagaatttccaacccagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaacaacttgtaccagccactgcaaaaacatgccaaattgtaaagaccatcaaggctaggaagaaactgcatcaactaacgagcaaaataaccagctaacatcataatgacaggatcagattcacacataacaatattaaccttaaatgtaaatgggttaaatgctccaattaaaagacacagactggcaaattggataaagagtcaagacccatcagtgtgctgtgttcaggaaacccatctcacctgcagagacacatataggctcaaaataaagggatggaggaatatctaccaagcaaatggaaaacaaaaaaaggcaggggttgcaatcctagtctcagataaaacagactttaaaccaacaaagatcaaaagagacaaagaaggccattacataatggtaaagggatcaattcaacaagaagagctaactatcctaaatatatatgcacccgatacaggagcatccagattcatagagcaagtccttagtgacctgcaaagagacttagactcccacacaataataatgggagactttaacatcccactgtcaacattagacagatcaacgagacagaaagttaacaaggatatccaggaattgaactcagctctgcaccaagtggacctaatagacaactacagaactctccaccccaaatcaacagaatctacattctttttagcaccacacctattccaaaattgaccacgtagttggaagtaaagctctcctcagcaaatgtaaaagaacagaaattataacaaactatctctcagaccacagtgcaatcaaactagaactcaggattaagaaactcactcaaaactgctcaactacatggaaactgaacaacctgctcctgaatgactactggggacataacaaaatgaaggcagaaataaagatgttctttgaaaccaatgagaacaaagacacaatataccagaatctctgggacacattcaaagcagtgtgtagagggaaatttatagcactaaatgcccacaagagaaagcaggaaagatataaaattgacaccataacatcacaattaaaagaactagagaagcaagagcaaacacattcaaaaactagcagaaggcaagaagtaactaagatcagagcagaactgaaggagatagagacacaaaaaacccttcaaaaaatcaatgaatccaggagctggttttttgaaagatcaacaaaattgatagaccactagcaagactaagaagaaaagagagaagaatcaaatagacacaataaaaaatgacaaaggggatatcaccaccaatcccacagaaatacaaactaccatcagagaatactataaacagctctatgcaaataaactagaaaatctagaagaaatggataatttctcgacacatacaccctcccaagactaaaccaggaagaagttgaatctctggatagaccaacaacaggctctgaaattgtggcaataattaatagcttaccaacccaaaaaaagtccaggaccagatggattcacagccgaattctaccagaggtacaaggaggaagtggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaacatcctcaataaaatactggcaaaccaaatccagcagcacgtcaaaaagcttatccaccatgatcaagtgggcttcatccctgggatgcaaggctgtttcaacatacgaaaatcaataaacataatccggcatataaacagaaccaaagacaaaaaacacttgattatctcaatagatgcagaaaaggcctttgacaaaattcaacaacccttcatgctaaaaaccctcaataaattaggtattgatgggacacatctcaaaataataagagctatctatgacaaacccacagccaatgtcatattgaatggacaagaactggaagcattccctttgaaaactggcacaagacagggatgccctctctcaccactcctattcaacgtagtgttggaagttctggccagggcaatcaggcaggagaaggaaataaagggcattcaattaggaaaagaggaagtcaaattgtccctgtttgcagatgacatgattgtatatctagaaaaccccatcgtctcagcccaaaatctccttaagctgataaacaactcagcgaagtcccaggacgcaaaatcaatgtgcaaaaatcagaagcattcttatacaccaacaacagacaaacagagagccaaatcatgagtgaactcccattcacaattgcttcaaagagaataaaattcctaggaatccaacttacaagggatgtgaaggatcccttcaaggagagctacaaaccactgctcaatgaaataaaagaggatacaaacaaatggaagaacattccatgctcatgggtaggaagaatcaatatcgtgaaaatggccatactgccccaggtaatttatagattcaatgtcatccccatcaagctaccaatgactttcttcacagaattggaaaaaactactttaaagttcatatggaaccaaaaaagagcccgcattgccaagtcaatcctaagcgaaaagaacaaagctggaggcatcccactacctgacttcaaactatattacaaggctacagtaaccaaaacagcatggtactggtaccacaacagagatatagaccaatggaacagaacagagctgttagaaataatgctgcatatctacaactatctgatctttgacaaacctgagaaaagcaatgggaaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctacgaaataccattcaggacataggcatgggcaaggacttcatgtctaaaacaccaaaagcaatggcaacaaaagtcaaaattgacagatgggatctaattaaactaaagagcttctgcacagcaaaagaaactatcatcagtgtgaacagacaacctacagaatgggagaaaatttttgcaacctactcatctgacaaagggctaatatgcagaatctataatgaactcaaacaaatttacaagaaaaaaacaaccccatcaaaaagtgggcgaaggatatgaacagacacttctcaaaagaagacatttatgcagccaaaaaacacatgaaaaaatgttcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttgatgggactgtaaactagttcagccattgtggaagtcagtgtggcaattcctcagggatctagaactagaaataccatttgacccagccatcccattactgggtatataaccaaatgactataaatcatgctgctatgaagacacatgcacacacatgtttattgtggcactattcacaatagcaaagacttggaaccaacccaaatgtccaacaatgatagactggattaagaaaatgtggcacatatacactatggaatactatgcagccataaaaaatgatgagttcatgtcctttgtagggacatggatgaagctggaaaccatcattctcagcaaactatcgcaaggacaaaaaactaaacaccacattttctcactcataggtgggaattgaacaatgagaacacatggacacaggaaggggaacatcacacactggggactgttgtggggttgggggaggagggagggttagcattaggagatatacctaatgctaaatgacgagttaaggggagcagcacaccaacatggcacatgtgtacatatgttacaaacctggacgttgtgcacatgtaccctaaaacctaaagtataataataattaaaaaaaaaacatgtcatctgcaaacggagatagtttgacttcctctcttcctatttgaatatcctttatttctttctcttgcctgattgccctaatgagaacttccagtactatgttgagtaggagtggtgagagaaggcatccttgtcttgtgctggttttcaaccagcttttgcccatatagtatgatatcagctatgggtatgtcataaatagctcttattattttgagatatgttccatcaatacctagtttgttgagagtttttaacgtgaagagatgttgagttttatcaaagtccttttctgcatctgttgggataatcatgtggtttttgtgtttatttctgtttatgtgatgaattacatttattgatttgtgtatgttgaaccagccttgcatctcagggatgaagctgacttcatggtggacaagctttttgatgtgctgctggatttgttttgacagtattttattgaggattttcacatcgatgttcatcagggatattggcctgaagttttcttttttgttgtatctctgccaggttttggtatcaggatgatgctggcctcataaaatgagttagggaggagtccctccttttcagttgtttggaatagtttcagaaggaatggtaccagctcctctttgtatctctggtagattttggctgtgaatccatctggtcctgggctttttttttttggttggtaggctattaattactgcctcaatttcagaacttgttattggtctattcagggatttgacttattcctggtttagtcttgggaggatttatgtgtccaggaatttatccgtttcttctagattttctagtttatttgtgtagaggtgtttatggtattctctgctggtagtttgtatttctgtggggtcagtggtgctatcccctttattgttttttttattgtggtctatttgattcttctttattttcttttttattagtatagctagcagtccctctattttgttaattttttcaaaaaaaaaaaacagctcctggattatttgattgtttgaaaggttttttgtctctgtctccttcagttctggtctgatcttagttatttcttgtcttctgctagcttttggattattttgctctgcttctgtagttcttttaattgtgatgttagggtgtcaatctgagatctctccagctttctgataagggcatttagtgctataaatttccctcttaatactactttagctgtttcccagagattctgatacattgtctctttgttctcactggtttcaaataacttgatttctgccttaatttctttatttacccagtagtcattcaagagcaggttgttcaatttccatgtagttgtgtggttttgagtgagtttcttaatcctgatttctaatgtagttgcactgtggtctgagagactgtttgttataatttctgttcttttgcatttgctgagcagtgttttacttccaattatatggtcgactttagaagaagtgccatgtgccactgagaagaatgtatattctgttgatttggaatgaagagttttgtagatgtctattatgtccacttgatccagagctgtgttcaagtcctgaatatccttgttaattttctgttttgttgatctgtctaatactgacagtgggtgttaaagtcttccactattatcgtgtgggagtctcagtctctttgtaggtctctaagaacttgttttatgaatctgggtgctcctgtatttggtgcgtatatatttaggatagtttgcacttcttgttgaattgatccctttaccgttatgtaatgcacttcttggtcttttttcatctttgttggtttaaagtctgttttatcaaagactaggattgcaacccctgctttttctttgctttccatttgcttggtaaattttcctccatccatttattttgagcctgtgtgtgtccctgcatgtgagatgggtctcctgaatagtgcacacccgtgggtcttgactctttatccaatttggcagtccgtgtcttttaattggcacatgtagcccatttacattaaaggttaatattgttatgtggtaatttgatcctgtcatcatgttgctatctggttattttgcacactagttgatgcagtttcttcatagtgtcattggtctttatattgtggtatgtttttgcagtggctggtactggtttttaatttccatatttagtgcttccttgaggagctcttgtaaggcagtcctgtggtgactaaatcccttagcatttgcttatctggaaaggattttgtttctccttcacttatgaggcttagtttgactggatatgaaattctgggttgaaaattcctttctttaagaacgttgaatattggcccccactctcttctggcttgtaggatttctgctgagaaatccactgttagtctgatggacttccctttttaggtgacctgacctttctctgtggcttcccttaacattttttttttttttttcatttcgaccttggagaatctgatgattatgtgtcttgtgttctctgtgtttcctgaatttgcatgttggcctgtcttgctagcttggggaagttctcctggataatatcctgaagtgtgttttccaacttggttccattctctccatctttttcaggtacaccaatcaatcgtaggttcagtctttttaacatagtcccatatttctcagaggttttgttctttccttttcattcttttttctctaatcttgtctgcatgctttatttcagcaaaatggtcttcagattctgatatcctttcttctgcttgatcgattcgactattgattcttgtgtatgcttcacgaagttctggtggtgtgtttttcagctccatcaggtcatttatgttcctctctaaactggttattctggttagcaactcctgtaaccttttattaaaattcttagcttctttgcattgggttagaacatgctcctttagctcagcggagtttgttattacccaccttctgaagcctacttttgtaactcgttcatctcattctctgtccagttctgtgcccttgctggagaagtgttgcagtcattcggaggagaagaggcactctggcatttggaattttcagtgtttttgccctgatttttcctcatcatcatggatttatctaccttttatctttgaggctgatgacctttagatgaggtttttgtatttttgttgttgttgttgttgttgatgttgttattgttgctttgttagtttttcttccaacaggcaaggcccctcttctgcagatctgcttcagtttgctgggtatcctctccagaccctgttcacctgggtgtcaccagtggaggctacagaaaagcaaagattgccacctgctccttcctgtggaagcttcgtcccagagagtcactggcttgatgccagccagagctctcctgtatgaggtgtctgtcagccccttttgggaggtctttcccagtcaggaggcatggggtcaggaatccacttgaggaggcatctgttccttagcagagctaatgtgctgtgctgggagaatcccccttgtcaggatcagctgctcttttcagagccagcaggcaggaaagattaagtcctttgaagctgtgacagcacccatccctccccccgggtgctctgtcccagggagatgagaattctgtctgtaagcccctgactggagctgctggatttgctgcagagatgccctgccccgtgaggaagaatctagagaaacattctggccacagctgcttcgctgtgctgtggtgaattctgctcagtccaaacctctcaatctccttagcactatcagggggaaaccacctactagagccacagtaatggaggtcgcctctcccccgaccaaacttgaccatcccagtccgactccagactgttgtgctggcagcgggaatttcaagccagtggttcttagctcactgggctctgtgggagtgggacttgctgagcgagaccacttggctccctggcttcagccccctttccaggggtgtggatggttttcctgtctcacgggagttccaggcactgccggagtatgaaagacttctgcagctcagtgcctgcccaaacagtggtctatttttgtgcttgaaacccagggccctggtggtgtagatgcacaagggaatctactgatctgtggattgcaaaaatccatgagaaaagtatagtacccgggtaggtgggacagtctctcacggcttcccttggctgcgggagggaggtcaccgggctccttgcacttcccagatgaagtgacgcctcaccctgcttctgcttgctctccatagatcacacccactgcctaaccagtcccaatgggatgaaatgggtaccttagttcggaatgcagaaatcacctgccttctgtgttggtcttgctgggagcagcagactagagctgcttagctgtttctatttggtcattgtggcccccactatgctagagtgttagggagaatattttgggatagagaagttgttctggttgcttagtgctactgaataaagtacctcctatcccaagtagtagcttcaaacagcaattttattttgttcataatgttgcaggccaggaatttggggagtgcttgcctgggtggttcctctctgatccatgggaacttagctggagtggccagagcatctacttctgtcatattctgtctgtcagagcagtcacaaggctttcccagataagacaggggaggggaactggccctatcctctgaggggatgcagcaagatctcaccacaggagtctgtgggatgggcaatgctgtgactacctttagaaaatacggttcacataggaggtttccaggcagatcagatgctcatgtggaggaatctgtaaccccagtccaaagaattatgatgcagaaaacatgtggcacaagaggccaaaataatatcttccatctgcaccccacagaggaaaggaagttgctattaagaagaccaagaaaatccgtgtctaccctcactcacatcctacaccccctaactcctaaactggttcttgtaccccattccccaaacttcctgtacccttatctgctaaacttcttgtactcatctacaggtactgaaaatttctctaacatatgtagaaaacttttccttccaatgcaaaatataaaacttaaaattgtcatactaagccctgcacaagcttgacagcaggggctctccggagatttagttgtgagaacaggaaggcagcatgagccccagggttctgctgcagcatcaggggaggggaggagaggaggcactctggggagagcgacggtcaggaaggagcttagccatctccatctcacaggggaacccaggggcactgctagactggaatgtctctactgactccttggtttttcccattcctgacactgtcattaactgactcctactggagacccctgtctgccacatgggcctcagtattgcaggtgtttgtgagctggaccccggagcatcaccctttaagaacttggctaggatggcaggttggggataaagctgccaaggagcatttttatttctgcatgttaaaacagcccttgcctggccacctgggttggagggtttgtaattttgtctcagccactgcccatcagctgcaagggtgctattaaaggcaatcttggtgttactgcagtgaaatgtcagctgagagctgcatttctcagctaacttggagctggggcacccatatcctcttgctcgagtgtggtatgaaattgaaactgggctggggctggattctgtcctccagatgagctgcttttgaaaggaaaagaatctctgtaaaacctgggaatcaatctgactggtgatgctccatacaggtggccaaccctcaggcttccctgtggatcatcagcttggtggcttctctgtggtggccctcttgccccattgacctgcctctcatcttgcccaggttccctttccctctgggaactgaggccaggtaaggagacctgggctttttcttcttattattgttattatttttttgagatggagtcttgctctgtcaaccaggctggagtgcagtggcacaatctcggctcactgcaacctccgcctctcagcttcaagtgattctctcaactcagcctccccagtagccgaaattataggtatgtgtcaccacgctcagctaatttttgtatttttagtagagacaggatttcgccatgttagccaggctgttatcgaactcctgacctcagatgatccacccgcctcagcctcccaaagtgctgagattacaggtgggagccaccacgcctggccagcatggactttttctataacaagcctgagcctgggctgggatcataaactgtctggaaaataaaaatcatatcctgaattgacagggcaaaagaaacacattttggatatttcacagttttctgtcatccataccgctctctccttcctcattgacaactgaaaagtgaaggaaaatggcacaggttggccaggtctgtggactgaaaacccaggaagcaggggaaagagaagtgtgtgtaacccacagaggagggtaggatgatttgtggtggggtgcgggcagaaggcttgcactttctgcctcattgattgccacggccccctgtgcaggatacagaggcagttggacaagccttatgcatcctgggctttggtgacatcagcaaagtagagatcatagtcatgtcttcctcatagggcagtgtcttagctgttcaggctattcaaacagcataacatagaccaggtgccttaaaaacaacagaaatttatttctcacagtcctggaggctgggaagtctgagatcagggtgccagcaggtttggtgtctgctgagggacacaattcatagatggcatcttgctatgtcctcacatggtggtggagggggcaaggtagctcactggggcctcttctataagggcactaatcccattcatgaagctctgctctcaggacctaatcaactccctaaggcaccacttcctaataccattgaattgggggttaagtttcaatatatgaattttgggggcacattccatctatagcaggtggacaggaagattccatgaaacaatacatgcaaagcaccaaaaatagggcctggaatatagaaaacactcagtaaatgtttgctgtcactacctctattactatagaggaataaatgaaggcaaaatgaaatagtgaggtgacaaggtaaaagggaaagcctgccatgtcagatggccattggcaagcttggcttctgatccccactctaccagtaactattctgtgaccttgcacaaactctttaacttctctgagccttggattcccctcctaccaactaagaagattagatcagttagtttctaaggccccttctgctagaaaatatattatgagcctgctatgaaaaatgcaaggtcaaggagaacctcctatcatagacctggaaggggaaggaggaaatatgtgcatggaagggttgtgggcacagaggctacaaagctcagcatttgttaatacagggactggtgagtgctgcacagaggctagcctggtgtcctttccttcacatcctgcgtagccattgttctctataataacatcaaaaaatcactagaaacatcaagctcccagttgcctcacttaacagaagcttgggttatgggtacagatggttcttcaacatccattctcctctccttctctgtggcagtagggtcccctttatctgagctgggcacaagactacccagttagagttggtgcttcccaacctcccttgccactcagtaaggtaggtgtctgagttccagccagttgtgtgcagctcagggtcccattcttacaaagatgctgcttgccttcttcctaatcattctaacttcccagggctggaacccagtatgggggtgggtgttcagtttccattgtgtgcatgagataatgatgcaggactttttgctccttaactcagctaggtttgcattcttgtctcacgaccaggaagaattaggcaagtggacattaaagagtgagtggagtagaatttattaagcaaaaggagagctctcagcaaagagaagtgtcctgaaagcaggtttctggttgcccctttcacagttgaataccagggattaaggcgtgaattcctggcagctccactccatccttccagtgtgctttcaggcccttagactgagacactccatattgatttacttcccttaccgtgtatgtgttaaggaatggaattttccactgtgggcatgtttaggcaagtcccctatgcaagttcccttatctgtgcaaaacatctgatgtaagcacttgtggggcaggtcagaggttctccagggtcgcttcccttactatcttcctaaagcaagctggctaactcctttcaataacatactaaggataggaaacctgggtgatcactggaacagtgccactttaacccttaggtcacctgcctacttggacttttcatgagagatatagaaacctatttgtttaagtgcgtgttatctgggttgggttaggtcctagcagccacattagtattatcataaacacaggaatgatgggggttagaaagtggggaagaggaatttgtaatggatctttgttactgaactgaactggggtctcctcacccagctcagtaaagccagacactgacactaagatttgcagcaggagaaaagagcatttattgcagggcaccaagggaggagaataggcagctaatgtttcacacctgaactccccagtggcatgcaagcaagggcttttcaaggcaggggtacatttcaggaaagcagaaattgcagacaaaattataaaccaattacacagaggttatacattgttttggcccatggcatgactttctccagacccctcaggaagaaatttagaacagagaatggcagccagagttcagtcgtcagtttccccttatctgagcattaagtgatagtggtcagcactttccatcttgtggggatttctaaaaacaactcacaacttgagaacatatgttaagatgtcatcttttagtttctatagggaagcaaaacaccttgtgactctggcttgcctgggagactgttgttactatcttcctgcttatcaggttgcttgtttgcttttcaaggctacctaggtgcttggaatttgccttgaagggactcaaggtttttctttatctccatgcttaggaggccaggcaggccatcttgagacaaactagtacttcaaatgtggtgtggtccaaagtctgggttctagtccctgatcaatcagcccaggccagctggattgggggatgtggtggtcatctcagctctccacatgcttgcccccttgatgcaggatttttctcagccactttgccagctggagacccccagatgtccatgcccctgcccaggcctcactctgccccaggcttgctgcaggaggtactccacccacttggcctgctgggccatgcctggcttgcacaccagcccagctcccacacttaccatgggatctgcactcatcctgcagttgggctgggtgtgcaccagtccgccagcattacagcttgtatctgtgttcagtggtccctgagttcttgtctcatgtccaagaagaatgaggttatactgacaatccaaagggtgagaagggcagaggacagaccacctgaagttgggtggtctgtctccccgtgtggctgggtccagggcttttatgggctcagaatgggaagtgcatgctgattggtttgtgagtatgtgaaagaggctaaaacaaaggcaccactcaaaggtgggcatgacagtgtaaaaaaccaattagggaatggtagatatatgtaaaataggtgaagcgtggggaacaatcagcggaaagtacacccaaggggaaaagaggttcttaatcaggtctgtggatttatccgagacttgtagcttggctttcaggttttaaactgtctttggcttgaaagttgggtttcagtggggacccacccctatctgcctaggcatttgtctgcctcctgccactatcaccctcctctgtgccatggcagggcctggtctccaggagtgatattctgtgactccctaactttggactgctctaggttctacctcagagtcacttgttaaagggacagatcttcactcactttccagagagggtgagaaattagccaggcagtccatgtgaggcagctgctttataaacattgagcagacatcatttgtaattgggaaggtgatgtgatttcagggtccccatccataaactctctcatgttctattgtgcaccatggtgcttgaacacactagtagagttttattcctggatttagtcattctagtcttcagatgttctagttaaaaaataaatcctacattcactcaccaaacacttactaatgctaagagtggctatatctgtccctgttccagatccagatgctgaagacccagagttgaataacagtcagattgtcttaaaaccatcttataatccacgatgtgtgatgggcgtgtgtgtgtgtgtgtgtgtgtgtgtgtgttaaagcacctgatgatgacaattcttctccactttcaatgcaccaaagaatcaactggagatcttgctaaaaggcagaatcagatcagtcagtctgggggcaggcctgggattctgcatttctaacaagctcccaggtgatgcagataaactggtccaagactaagtttgcgtaacaagagacaataagagtctgatcactgctgtcaactagtgtggaggacccacataggagagaggacatgattgagttgtcctggtcagaggctagcagacgaagcgaagtttacccaagaggtttcacattcagtctagacctctgaggatgaataggccatcagcatccataactggcatgaagaatagtttatcaggcttcttaatgtatttttccatcagcattaatgagacttagccaagagacaattttggttaagagttggtgagtggagaaaaatgggattcatttataacaacagttctcaaacttgagtgtgcctcagaatcactcccagggcttgttcaacacagattacgggtccccactctagagttgtaagtcagtaggagtgggctggggcccaagaatttgcatttctaacaagcccccagtgaattttaagaaccactggtttataacaagaggccccacagggcacagcaagaggggagcctggctatagtagggacaagaactggacagatcgggggataggcagaggaactctgagaaagaaatatgtgggcaaggttgctggaaggggttgggttaagactaatcctgagaccgtaagttgtagtccagcctagctgatatggacaagatattaagaactgactaatgaattgtaagttgcctaagagaaggggcctggggcttgtctacccagtattcctatcaccagcagagtgaagatgtggtcattccaaccaaaattactttctcccttccctcccctctttctgattatgccacattctaggagtctgcctataaaatagaaaactcggtccagcccagtcagctctcagtggacgttggcaccctggggattccttgacagttccggggcctctgtggcttgggcagagagagcctccatctgtggtggcatttgagagctgttgttctccaggatgcagtagctccacagcaaaaaaaaaaaaaaaaaaaaaaaaaagaggcatcatatgcaaatatcaaatgaaggggagggaaggaggaaagggctggctgacattttggctctgcccctagatcctctgagaagagaaaccactcgtgcctgaattaatgttaattcaagggggtattttcaaaaagtggtccttggaggagcaagatgctgtgtttcctattttccgttgcctccagcaagccgcaccgacagagggtcaatggggttactgtatgaggaagcccactaattgcattataaggaatgttttgcccattagctcagatggaatggtctcctaacagagtcctttgaggggagtgatatttcaggtgggggatggaggaaaaggaattgataagtaattgaaatttgcaaatggcatttccctgggccctagacaaaaatgggttccatacatccagcagggggcagcaatgcacgtacattaattccggtcttgtgaatcaggagcttggcgagatctcagaaattgcaaagcagtaaggatgcctggggaggtttatagacaatttccaggcccggcaaagctgggactgtcacacccaccatttccccaacagtcacaccttttatttttctcaatatactgagaaaataaatgtttaggtctgatggtttttaattctagaaattttctttaatctttcggctgctttgtgtaatttagaatttctgcagcctgactgaaaattataagtaaactaggattaggaagtcagctttattaataagatagttcagctaatagacattttaaaattgtaatgcaatctatctccctccctgagttgaaattttgctagagctgtaactgataggacacccacacaccaagttgggtaacttatttgctgatccattttaaagtggaggaaaagaggctccaaaaatataaataaagataaaagtctcaaagaagtatcagattttcctgaattaggcacagaaaagacctactagtttgtccattcctaaggctgtttaggaatgtggcccataatatattttctcagtaatttgtcaaatttgcttgtaaatgacttttatgatagatggctttgcctgctttactgggctggaaatttctgcagcccagcacacttctccttcaggaagcttcttgcatcttgcataatgtttctcccagccaccctccccgcttacgccccttcccaaggttaatttagtcctgttgttcttaaatgaactactctaaatcatcctcctccccttccctgtctttctcctcactgtttaaacctttcaaggatgtaatagtctggcaaatatttcaatcatcatgtctccttttcagctgcccaattcaattccatttggtgctgctcgtgctgaagtgcaatttttcacagcattgtttttagtttaaataacatacagtgcactattgctaaaggtcttctggaacattccacttgggggtcttacccttaaataatattttgatgggaaactaactcaacttttcataggaagaaatgctatttgctcccagcactaattggctgtaaatttagctaaaagtccatctacgctggcagttagaccatcttcctgtgcccatgtggtaccctgtattagatgtctaatggacagacttagtgaataagtatgtatctgtaagtgcaccatttagaaaacaatcaagtgaaaggaatttaactctgctaagccagcaaatgtaatttttctcatttcttgccccttcttgccacgtggcagctcctcaatttaccagctctatgcccttgcatgtattactcaacatttctgagtctcagtttcctcaactgcaaaatagggaaagcaatatctgctttctaggttttgttgtagggatcaaataattatgtacagcatttggtaaaacataagtccccaagaaatgcaactttttgccattattattatcactactcttatcattatgcagtctaaattctatgcctgggttatctttcagagttcctgactgcctatacattcacattgttcaacaaatgttacttagggaaaccgtctctgaccccctggaattggccaggttcccctgtgattcactgtcacagatacgtgtgtgtgtatgtgtatatgtattcttatattattaccctcaaattaaatgctcccttcttcataaattcagagcagctaatatcctctcttctctccttaatggtgtgtctaacataccttcatatcctaggcttgactaggaacttctcataggcaggagcagagccttgcctttcaatggagcctggattgtcacatagaaatgagcacatagaggtctgtggtgtgtacttgtgagactatcagactgtaatatctttgaattcagggaaaaggctaattcaccttcagttcccagagcataccacaccccaagcctgtacatggtaggcattcgagggaggtctactgtgtcgattaaggctgtgcattggtcttccaaactttgctcaccatatacaggtttccttcagagtcccagtgtccatattactgtttaacacgactgaaaaggaacaaaacgaaatccccaccttcaccctctcactttgactgtgggtgatttctgtaattaagagcttcaggaggtcgggcacggtggctcacgcctgtaatcccagcactttgggagacagaggcgggtgtatcacgaggtcaggagattgagaccatcctggctaacatggtgaaaccccaactctactaaaaatacaaaaaattagccagacgtggtggtgcgcacctgtagtcccagctactcgggaggctgaggcaggagaatcgcttgaacccaggaggcggaggttgcagtgagccgagattgtgccactgcattctaatccggtgacagagcacgactccgtctcaaaaaaaaaagagcttcagatgactttctaagatacactccctaagaatctcatataacgaatggcctagaacatgacttctttattgttaacctatgttgatgccaagagatcagtgtgtctttttgtgatgctcataaacaacctattaaataatccgttttccatttttaaggaggacttaggtgcatgtgcatgagtctgtgtgagttggtgggagaccaaagggagacagagtattctgaaagcccaccgaattattcagctctattttctggcccagaattcaccagatagcacaaaacaagctaaatcatggcatgataaaacactgcagcccggacaatgaatatgcaaatagcataacagagttaagtactgagagagccatctattgtagatagtttagcttccctttagtgaaagatcaaggacagaaacacaaaaagatcatgctaattttaaaaagagaaaatagatgctagctaacgtgaaaaggatgaatataaggaggcgttggatcagtccccccagggctcagcagttctggaggatggcaagcccgagtctttggatacaaggaacagcgcgatacaacggaggtacttgcctcttggaaaacacacttgcactctgtgttgcatctgtggtttccatggtatgaagctgccactgtgtttgttccaatgcactttgaaaagacagggcacatttatgagcaaaggcatatggctttgtcctttcaagcttatccaaggctttagaatgtcaactgtagtggctggaaagcagccagcaaattaggaggctacagaagaatttcgtgagcttttaaaataatttatttcagtttatcgtttacatagaatgtcagatctgaaggggaccccaggagttatccagtctaacttcatattataagtgataaaatgaggtccagcaaaaagaagtgatgttactcatagcgagagtttgaatgtgctgttcctgattcatacattagtgattattccattatacctagctgtatttctgtccagactatttttataatgctgattaagctgggctgttttggtgaattttaacatttcccatagatttttaccatgtgtaattttggaaagggggctttgttaaagtattagaagacctactatagtagtttcttgtggtttaggtggaggaagagcactgatggcattttctgttgcagtaagtttgttggttgtaatatagtttttggttacaaggagcagaaacctgaccacagctgtttgaaagaatataagttcatttttccactacaagaattctggaagtaggagagtttggctttggttcagcagctcaacgatgttagagttgatgtctgattatctcagcctttgcctcagtcataagacaactgccacagtgccagccatcatgtctgcatttgatgcaggaggaaagagaaagagggggagcaaactgcatcttccgtgttattgggggaaaaaaaaactttcccagatatgtccaagaagtcttctgtttagatctcactagccagaattggccatgatgcaaagaagttgaaaaaaggatgtcccttataggcttagattagtcatgacccttcccccagggcttgacacataatcaggagcttgtaatgctgaggaagaagagggcaataactgagggctccatatcaccctaaaactgtccacattcccatttgtatgtaatatgtttggagtacaagcttgatgcaaggatgggcagtggaaggtttttggtgtctgattctgtcatctctttatacctttagtggaagattatttcccaaccaaaggcttatctgaggataacaaaacaattccattgccagacatttatagagcccaacctgtggaaacaataaatgcctgaaacagtttacctgcactatatttcaacttctgaaatgtagatcgagaggataaattttatgaaaagttcactaaaagtaaatattgacaagtggttaaatctcataaaagacataattttaaaatgctgcttgcacctatagttctgttaagtcaaacggcaaaacacaactctgtgctcggttctctgctaggcagttgggatccatcactgagaaaataagaaaaaacatttggggcacaggacttggggatgtattagtcagggtcctccagagaaatagcaccaataggatgtgtggacagtcacccctttgtaactgtgggttccacatctgtggattcaaccaacagaatggcagataaaaaatatttggaaaaaaatatatctatactgaatatgtacagacttttctggctattattccttgacacagtatggcataacaatatttacatagtatttacattgttttaggtatttgatatattaatagtttggatatatgtccttaccaaatctcatgttgaattgtaatccccagtgttagaggtgggacctggtcggaggtgtttgggtcatgggggcggatccctcatggcttgctgctgtcctcgtgatagtgagttctctcaagatcttgttgtttaagtgtgcagcaccaccccaactctcttgctctcactctgccttgtgagatgcctgttccaccttctccttctgtcatgactggaagcttcctgaggcctccctagaagccaagcagatgccagctctatgcttactgtacagcctacagaacaatgagccaattaaacctgttttctttataaactacccagtctcaggtattcttcatagcaatgcaacaacagcctaacacataataatctagagattatttaaaatatacaggaggatgtgtgtatgttatatgcaaatgctataccattttatatctggaagttcggcatccttgaattttgtaaatattggcaagcctttaagtctcataaaagatgtaattttaaaatgctccctgtgcctagagttctgttaagtcaaaccacagtagcctaccaatgtgtatatatgtgtgtgtgtgtgtgtgtgtgtatgtatatatatacatatatatatatacacacatatatatatacatatatatacacatatatatatacacacatatatatatacacacacatatatatacacacacacacacacatatatatatttttttttttggaaacagagtctcactctgttgcccaggctggagtgcagtggttccctgcaacctccacctcccaggttcaagcaattctcatgcctcagcctcccaagtagattggattacaggtgtgcaccaccatgcctggctaatttttgtatttttagtagagatggggttttgccatgttggctaggctggtctcaaactcctgacctcaactatgcctcccaaagtgctgggattacaggcatgagccaccacgcccagccacatatctatgtatattgatataccttggtatcctcgggaggtcctggaaccaatccccctcccctcacggatactgtatatatacacacatatgtatatatgtgtgtgtgtgtgtgtgtgtgtatgtatatgtgtatatatatatgtatatatgtatatatgtgtgtatatatatagtgtatatatacgtatatatatgtacacacacaaatatatacatatatatatataccattagatgtatgctgaaagattcaaaaagtcttgaatgagcatctactacatgtcaagtgctatgtaaagcagggagagaatggggagtgacacagtccctcctcgagggacacaaccactggatgagatagacaagcatagagaccctcacaggctgaatggtggctgccctgagtgagcacagagctcacggggtgtgcaggggcaggcacggctgtcctcactgagttggctgccctctggggtaggcccagtatgaggtcccaagagctggactgacttagctcaggttcccaggcctagaacctgaacccagaccacctggcttgtcatcctgccttagcagaaggcctctctgaaacccacaagcagattcttgacccagtgagcatgagtcctttactctgcctgaaaaaaacaccaccaggtaacatcaggggctggtggtccctgatggcagtgcaatacattggccacagaggacatgggtattgtggaatcagaagatgcttgttgccacagcaaagaagagcatgatttcctggaaggcaacagaccccatggagatgaggctgctgtagcctctacctccctcattcatgctgcagaagtatagccttcctctaacagttgagggtctgaaacttctctgctttcctcagcccttgggagaaagcctaatgatccaaagcaagctgaatggagtcagtagacatggaaaactgggagccgtggtggccttcagagaagagaaccgatggctggctagagagcctggcttctgtaccttttggattttgtacaatgaacctgcattaactttaggtatgatgttaggcaagctgatagcaaaggcttttctgagtaaagtgagagtccctgaaggccatgtgctagattacaaacatcatgggctcagagtcaacagtcacagctctgccacttattatttgggtcatctcacttatctgcttcaaactgcagtttcacaccaggaaaatgggatgctcatgagtttgtggtaaggaatgaatgaggggatttatgtagatagttgaagccagaagttggtcttgtctgttggccttgagacacaggtaggctgaaggccatcactgatgtgcagccctgggtccccagctgatagctacagtgacctgccccatcagcaacaagcacttcctattcactctgctcaaaaagccaaggaagtatgtcatatatttggagagggggcagattaaaatgctggcagggcttaaagggggagggaaaacttgactttgcagcacggctcatttctcaaaggatctgcacaagcattttctccccctagatatgcgctatctcttaaatcaacaataagtaatgctttacaaactttttagtgcacacatctctcccacataaacagtaagcttaattctggaaaagacatactttcatacgtgtttgtaccgttcaaaccccacacatggctgccacattcacttccactttcaaccatttttttttttttcctgagatggagtcttgctctgtcacccaggctggagtgcagtggcacaatcttagctcactgcaacatccacctcccaggttcaagcgattctcctgcctcagcctcccgagtagctgggactacaggtgcgtgccaccatgcccggctaattttttgtatttttagtagagacggggtttaccatgttagccaggatggtcttgatctcctgaccttgtgatccacctgcctaagcttcccaaagtgctgggattacaggtgtgagcctggcctcaaccacttttaacacagaataggttggtaatctattgctgtgaaacaaattacccaaaacctagtgccttaactctaacagtttcttttggtcaggaatgcagaaggggcttggttggcctgctgtgtttcagggtctttcgtgaggttgcagtcagaagtcagtgtgggccgcagtcatccaaaggctttcctggggctggagggtctgcttccaagatggtgcactcacgcaactggcaagttggtgctggggctactggtgtctctgttttattctgggtagggctacttgagtatcttcatactatggtggctgggtccctcaaagcaagtacccccagaaaccaatggaagctttgatgcctttgatgattcagcttcggaagtcactcattagcatttctgagtcctctattggtcatatagaccaccagtgattcaatgtgggaggagattaaataaaggcgtgaataccagggctagccctggaggccaacttcaaggctgactatgacacagagctgagacacaaaggtacttagttaagcacctgataatttgttgatgacatgattgtgcataatgtgaatataacatatacatggtaagaggtgaaagtgtgtttgttttacttttaggggagatgttactcaagtatcccaaacttgagtgttcattagaactacctggagggcttatggaaacataaattgctgggccccaaccctagagttcctgattcagcagatctagggtgaaatgggagaatttgtgcttctaacaagttctcacaggataatgatgctgctggtccagggtcgtgctttgagaactactgccctaattgatatagagacctagtggtccttcaagaaaatttgcttcaatgcaaatacatccttggcctcttatagctgagtgcccaaactgtcaaattcattaggcatatcatttttaatttgacgttttccaaatggcacagagtttatgtaaatgtacgaatcagagagacagtatatggacagcctaagtagtggtatgctggcaaactggctctcctcccaaaataaaaagctttgatttgtaacttttgccagtttccatagtgtaaatgctcccaccatggccaattaccaatagttaactagctcacaaaaattcctatttcacagttgactctgtagctggtacatgctggccccagtacaccattggctctaagcaagttctttccctgcacatatgaatcagagaaagtagtggcctatgtgggggttggggatcactgggtgattctaattgctagtaccttgtgcaccaaacaaaggcggtcaaatgccaggtctgattttcttcctacctggagtgtttgagtctttgaggtagctaaagtgataggatgtgattatgcatacaatgctatgtggtgcaggcacatctaaaatggacttttcaaatcctccccctccacacagtctccttaatctacccccacttggacaattctactgaccgctccaggccttctgtcctaattaagcacaacctcatagacactcctcctcaaaggcctctctggctttccttccctttgaagacaccaaggctcctttccttagggtaggtgacaggaaatactttactgaaatccattctttgagctgccaagatgcccagtgagggtataatgtctgagtgcctgtagaaattgggtagaacatttatttggcaattcaccttgtagagggctgtttatcacattgaactgttgtttaaaccttaacttatggccaggtatggtggctcatgcctgtaatcctggcactttgggaggccaagggggggggcagatcacttgaggtcaagagttcgagaccagcctggccaacatggtgaaaccccatctctactaaaaatacaaaaattagctgggcatattggtgggcacctgtaatcccagctgcttggaaggctgaggcaggagaatcacttgaacccaggaggggaagttggagtgaaccaagatcgcaccattgcactccagcctgggcaacagaatgagactccatctcaaaaaacccccaaatccttaacttgtaggattttttagtgtgttccctcacagcgtctaccatggggttttggacaaaataagcactaagcatttcatgagttccaactttgaattctttctcttgcagaaaacactggcattttaacagagagcttcaggtgccttaatgccagagagtgggtcatttgggaattctctcatgggattcaattaccataagagaaaagtggaataaaatgttttggtagtgtaagattagctgaaagaaaggatgagagagagagagagagagagagagagacccaaggtcaggcaagtaagtttattaacctgccaggctgctccaccgcagtcagaggaggcagccctgagcttaaaaaatgaggggtttatatgggggagagagaccctagggttgtcggttaactttaccacatatcttctcgtgactggcttacaatatagtatcttgtgaaaacatgaatttacaagaggatgtaacttaggtttatccgcgtttctcgtgacctcccccatgccgcccgggggggctgtaatcagggttcactcggcaagtctggtgaccttgctgtggcacctagataagggttcagggatgcagctgcagagtattcagggtaagggtcagctgcactgagtggtggtggtggtggggtgggggtggtcctggggcagcttgtccctaacagctaggaaagccttttagggcttcttttttgttatataaaggatacgttctcagaaaaatgggactcatgctgatccagtgcaataataacaacaaaagcccagcatttgaggtaggcagaatgtgacccctacagaagcgtcatcctccttagcttctctagctctgacattctgttaagtttcttagtctctctaagcctcagttacttggtctgtaaaatgagactagcaatacctgctctgttgtctcttgtgaggaggaaatgagaatgtgtgaaaagtgctagaatggagcctcatgggggaggctctcccaccccatgtcctgatttggacaaggaatcccacacacctcatccagatacacagaggctcatgactgagtctcttgacaaattattttttgagggtgcatacttttttgctgtgaatttccaaatgtttgcatttctaaggccacatttgtgacacagagatcagatcctttctgacacaatgtaactggcaggtcctaatgagctgggggcaccgggaagcattttaagtggtagcatttctggaaatattgagatgaggtcgggggaaagaagctttttcttcagggcctaacctgattaacaagacgatgcacttgagatacatgaaggtggatttctctgcttccagaagctcctgggttctggaaggttatttttatagtatggcaagtaataagcattagtgaccagccatgaatcccagatttggaaaggacgactcctaagacaggggcagacctggaaggaggagataaacattgaataggtgctcagctcaacaggctgcccacagtttacacaagcttcttggctcaatgtatctgtgctagggaaaaaagctcctcttcagttgctccagaagcacatttattaagcactaactgtgtgttaagccccaaaagaaatagaaaaaaggcaaaggacctgattttcatatctaggcatttacagagtagattatgaaaaaggtcatagatagttgtaattatttaactctccttgctataatagaaaatggcgttcatgctcggaatcaaatagagagggttttcatgcttggaaaattcagtaattaataaacttccaatgttttgaaattcatttctttgtagccacttaggaaaagaactgaccgaggttgggatccaggatcggaactttatgtggcatgtaaaataatttgaaagagtgagatatggctttgtaaatttttgtagaaaacaacaaacctgatgatttcccagatttggggggtaacatcaggcacatggagggtgaggtgtttggggcttgaattacagcattttcttttaaacaggcgtgactttccatgcgtagaaaatggtctcagggcttggattaggacgtagagctggaaatcagggagcccgagtttcattcagtgaacacataaacaccttactgagcactgacttcacgtgtcagtgctgaggataagaaaagcaacagcgtggcgccctgatgaagttgatggaagcacgctcagggcagcaaacagctctcccggccaggtcttgggagtagtcagagaggagctaacattgacacagtcttaaagaggagtcgaattggctagaaagaatgaggccagtgttccaagcagagtgaacagcatttcgcagcgtagtcagaaggccacaaatactgtcgttggaaaaggcaagagcattggttctccaagggtaacatgtgttccaatcacctggggacctgtgacatgcaggttctcattcaagagttctgaatgagacttgagagagtacatttctaacaagttcctgggtgatgccatgctgctgcctttagcccacttggtgtggagaggctgtggacatggagcatggagctaggagtaaaaatgggggctgggtggaggaaggggaggatgagggcttgtcacctgggctgatgattgcaccctggcacacttcagctgtactgcatactggtaatagcatccatggtgctcccagcctccaatgggctctgggagctgtctgcatccctcagccagcttagctctctttcccaatccaaatagcagcaacatcctcaacctccaaccgcccacctgccattataaaattcttccctccacccaagcctaagctttctgccagggtctggctgggtttcctcttccttttggcctcccatgggccctcaatacattcatcaccccttctcgatagctcccaccttttgcctttcccacctctttttcctcaaccataaacctgtttggcaccctcctgtcctacagccactgtgctgggaaactggccctgaacctgggtccccttccactgctctccagtctctccccatcctcacaccctgattgcatcgaagaacaaactcacacttgtagtttctctctccttcgtctcatctgttctatgtaatctatcactaccaccattctgccttccccgctctactgaaatggctcatctggagttaacactggccttccgatttcccagtccaggaatttcaggcccagtccagcttgtcctccagaacactttacagtgttgatcaccagtgcccagtctccctatagctctccagattctctttggccccttctcagcctcttttcctggttcctcttcctccatccagtcctcaccaggtaacatttcccagcttctcctctctccaaacatcctgcgtgggcagattgcccaagcctgggaagtgagccactctttctatgctgttgactcaggaactcagcctccttttgcccatctttctgtctattggtcatatttatgtaggtacctcacattttgtttttttttgttttgttttgttttttgctttttttttttgagatggaatctcactctgttgcccaggctggagtgtgtagtggcgccatctctactcattgcaacctctgcctccaaggctcaagtgattcttctgcctctgcttcccgagtagctgggactacaggaacgtgccaccatgcctggctaaattttgtattttttttttcagtagagaaggggtttcaccatattggccaggctgttctccaactcctgacctcatgatccacccgcctcagactcacaaagtactggaattacaggcatgagccactgcacctggcccagtgcctcacattttcaaaacagattccttcttttctctcctaaacctgcttttcctcctgggtcccactccaggtgaatcatacccctaccatttctcttctacagaaatcaaactagggagttcacttgactcctctcccagcctcacctgccatcagccatggtcctggctcctgccccccattaactgctgccttagtgtaggagatgacttcatttcattactcagattactgcctttgtcgtcacctgacctctctgcaaggagctgtggctttcaactttggccacacattagaatcagttggataatgtgatagggttctccagagaaataaaatcattgaatatgagtgtacacacacacacacacacacacacacacacacacacacagataaggaattggcttacatgatgatggaggctaaatgccaaaatctgcagttggcaagctggatacccaggagagcaaagggtatagttccggtccaagtccaaaggcctgagaaccacgaaagctgacggtataagttccagacaaacctggtaggttcaagacccaggaagactcaatgtttcagtccaagtctaaaggccagaaaaggtcaatgtccccctcaagcattcaggcaggaggagctccctcttactccaacttttcattccatttaggctttcagctgattggaccaggcccacccacattagggacaactgtcagctttactaggcctacctattcaaatgttaatctcaacaagaaataccctcgcagacacactcagaatatttggccaaatatctaggcaccccagtccagtcaagttaacccagaatattaactatcacagagaacttttagcaacctgatgtccaggtcacaccccaatctcattgcattcaaatttctgagggtgaggcccaggcatccatttttttttttaaggctctccatatgattccatcgtgcatccaaggttaagagccactgctttcatctcttctccctcagactgattcttcacactgccaccaaagtggttttcttaaaactcaaattggattatatttgatcccctgttcaaaagctttcaatgactttccatcatatttgggaaaattctttggcatgttatacaagcctttttgcatgttacacaaggcccttcatgattggccctgcctaattcttcagcctcattccgtgtgggtgcatcaggacatcgtactcaggctgttctgattcacctctcaggatttcttacggttctctgcatttgcatggactcatccttcagtccagaatgcaatctgtccccagcctattctccttcgtctttaagatcctattttgtcacttacagaaagccttctgagacactctcaagactaggttaaatattccttctttggataccctagcacccagtgctgtcaccaccaagagggagccactggtagatagtagtagatagtaatagatagcaggggttatctactatttacaaagcagcaaaacccagcacacagtatgcactcatgtagcacacctgcatgaatgaaggtatccacctcttcctacatctctaacttcagaacaagctcatgcagcaacaccgagaaagagttgaaagttcaatgagttgttagggcaaaagacttaagtctaaagtaccatatatgctgttaggacatttctcatccttactcaaatctaaatatagcaagtgaaaatgcaatccctaaaaaagcggcattattcccaaagagcctggcagagcagtgtttgctgccacagggaaggtggtcctgtcctctgctcccagtgttataaaatgtgtcctgctacattaagtgcccatgtccactctgattccagggataaggatacaactaagctaattttcaaaaggggagtgtagttcataggatcgcacttgctaacacagtggagcttcactattggcagaacaacagttttcaaacagatcagctattgagaggaggtgattatactcacagcctcctaattttatcaaaggcctatcagccacagtattctttcaagtatgtgcttcccttgagaatgtaaaattagtatcctggctgggtgggatggcttttccctgaaatcccagcactttgggaggattgcttgaggccagcctgggaaacatagtgagacctcgtgtctacaaaaactagctcggcatggtggcacgcacctatagttccagctacttgggaggctgaggtaggagtaaaaataaaatgagtatcctgtttataaaacttcagagcatgtgagatggctcatgccttacaaaaatgagatccaacaaggtttgagaatcactggattatggtgaatgtgaccaccacctggctatgatcagtcattgccttccagctcagagcttctcaaccctggctgcttgttaaaatcctacctgggggacttgcagaaatcccaatgctcaggccttactccaagccaattaaatgagaacgtctgggagtggggccctggcattgttttgctgttttttggcactggtatttctgaaagcacgcagatgatttaaataggtggcctgggctgaggattgctcctctaacttactggttctcaaacttggctgcacattggaattgcctggaggtgcctgggtccccccaccccaaccatggacatggttgtaattggtgtgggatgtgacctggcctccaagccaggatttgtaaaagctgttcagtggttcaaacgtacagcaaagccttgaaaccactgctgcaagcacatcctcccacagcctctaacagcccatttcaccttgaaaagaaaatccattgtcataagcagatgagcaacccaacctgtcaggaacatatttatcctcctggctgacttgaggcggctgaggatcactgaggtgggagtcaccactgaaaatagtcactgtgctggagagcgctggaggaaatgtaatagtgttagtttacacattaaaccctttgataccaagggccctgccacctgcaccaccagccaagcatccctgattcctggctgcctttgtggcccctgtggccttggatgagtggccacccctcccaggaaacattcagagcacattacagataataaacagatatgactaatgagctcaattattgtaaatttctgggtcatttcttatggcatttccctcccttctcctttcatcttatgttcaaaataatttctttgtatttccctatcaacatgtccaacctgagttggcgcactgccccgagtaggtaaggaggagaggacattctgttttctcaccccttcctctgctgactcccacctccacctcatttcctctctgtggcttgtgccaggtgggccagtacctgcaccatcttgagaaaaagttgctcaaaaagatgcatgtaatatcactctccacggagtcttacaaatctaacactttgagggcataatcttcaaaatttctggtttattgatgagtattcttatatgatttctcaacacattggaatcacctaggaagctttaataactatttttttcttttttctttttttttttttttttttttgttgagacagagtctcgctctattgcccaggctggagtacagtggcatgatctaggctcaccacaacctccacctcccaggctcaagcaattctcctgccacagcctcttgagtagctgggattacaggcacctgccaccatgcctggctaatttttctgtatttttagtagagatcgggtatcaccatgttggccaggatggtctcgaactcctgacctcaggtgatccacctgcctcagcctcccaaagtgctgggattacaggcgtgagtcaccactcctggcctttaataactattgatgccataattgacccacagagattctgatttagtggcgtgacgattagccgggcatggggattttttggatgcttcctatgtgattccagtatttagccaagtcatttgtcaatgagagggactgagaaagaagaagcagaaggacactcatagtgaaacatcgctcaagttgcagtcttcctatggactctcccctatgaactcccaatagcctttgtctcatttagattctttataagcacaagcagtgagatgagtttccttttttttttttttttattatactttaagttttagggtacatgtgcacattgtgcaggttagttacatatgtatacatgtgccatgctggtgcgctgcatccactaactcgtcatctagccttaggtatatctcccaatgccatccctcccccctccccccaccccaccacagtccccagagtgtgatattccccttcatgtgtccatgtgatctcattgttcaattcccacctatgagtgagaatatgcggtgtttgattttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacatgtgcatgtgtcttcatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttacatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttggcttttgttgccattgcttagtttcctaggagatcagaagcggggtgaggccacagaaaaatctcaaaagcaggtgtgtttgttttcagtgtcctttcatctctctaggagttttgtcctagggttgctgtctcattgctcacactaccctcctctcctccatgacccatgaaacgtttttgcaacattgttcgggtggcacagatgcaagagaaaaaactcagtattggtgagagtgtgggctggtgaaggagtgggtgattgacaggatgtcttgtgatgcacaagatactgaaggagcttagggtaagtgctccggcttcacgcactgtggtacacataacgttccctggtcatttcccaatacacattccctggccattctccctcagctttccctccaaggccttttccttcccgtgaacatttttctgttctgtgttccataccttcagcgtcctgctgtgggaccagctctgacagccacaatcaatggccttcccgggagccttctccatttgccttcttccttgctggctgctgtggtttgaatgtttaccccctctgaaattcatgttgaaacttaatccccaaagtaacagtattaagaagtggagcctttggccaggtgtggtggctcatgcctgtaatcccagcactttgggaggccgaggcaggtggatcatgatgtcaggattttgagaccaacatggtgaaaccccatctctagtaaaaatacaaaaattaaccgggcatggcggcacatgcctgtaatctcagctactcaggaggctgaggcaggagaatcgcttgaacccgggaggtggaggttgcggtgagccgagattgcaccactgcactccagcctgggggacagagggagacagtctcaaaaaaaaagtggagcctttaaaaggtgattgagtcatgaaggctctgtccccttggatggattaatccactcatggatgaatgggttaatgggttatcactggagtgggttagtcagcacaagcagggtctgttataaaagctagtttggctcatgctccagccctctctctgtgcgatgccctgcacctcctcagcactctgcagggtccccaccagcaagaagaatttgaccttggatttctcggcctcctgaatggtaagaaagaaatttcttttctttataaattacccggtgttaggtattcagctacagaaacagaaaacaggctaagataccagcagaacctggaactttttcaggtatctgaccctgcagcagatggtgaatcttgattagttcaagcagtggtcttttaccttggctgcatattaataacacctgaaaagttctttaaaaactactgatacttgggcctcaccatcgtttaattggtctttcctgtgcggttctcatgatagtaagtttcacgagatctgatggttttaaaaaggggagtttccctacacaagcgctcttctcttgtctgccgctatgtgagacatgcctttcaccttctgtcatgattgtgagtcctccccagccatgtggaactgtaagtccaagagacttcttccttttgtaaattgcccagtctcagatttgtctttatctgctggtgacactggttctgatttaactggccttgagtagggatgaagagttcccatatgattaaaatgtgcagccaagactgaagatcactggtctaggataatcatggcatttcaactccccttgccagtggttaagatagggcaaacaatgccagtttggcagatgaaacatgagaatgcagggatgggagtggggagatttagaaaaagtgtctcacctttaggaagtgatgatgtttctttccttttcatggtcttggagttgttgggcgggggtgtgatgcttgtcgccattgcagctatcttttgactgtgagtggatataccagaggacatagatttctatgatgaggtttgcatgatgcaatgttaaaaacaacctaggttggccaggcacggtggcttatgcctgtaatctcagcactttgggaggctgaggtgggcagatcacctgaggccaggaattcgaaaccagcctagccaacagggcgaaaccctgtctctattaaaaatacaaaaattagccagccttggtggtgggcacctgtaatcccagctacccaggagcctgaggcaggagaatggctggaacccgggaggcagaggctgcagtgagctgagattgtgtcactgcactccagtctgggtgacagagcaagactctgtctcaaaaaacctaggttttcaacagtgtcatcgagctgctaaacaagtcaaatttggaaccccagccctctagttggggagaggtggcttgatagcatgccctgctaaacatgcacagcaccttctgctgggtgtaaagctctcttagctctaaagctgttcactcatcacaggagagctgccaagagccagtggccttgctgggcaggccttatctgctactgagggctttgggcagtgaacgaagacagaatttgggcagattcaggcttgacttctggtcactgtgtgaattgactcaatgaaatgcatagactaagcgccttggttttatcatctttacaatgggactagcacccaagggttgttgctatggttccatttaaagaactcagcacagtacctggcacgttgtaacttcttagtaagtggcaacttttacactttttggtatatttactctccttatgctgcaatgagcaagaggtgaaataattggaaagaataacaagagagatgtttgatttttggaggactagtactctaacagttttgaaagactgaacaagtttttcctgtggtcccctctgcctgaaatttatcaaaataatttgagcctgattcaccaagtcagcacagatgttgggcccagtgtgactggctgagctctatattctagctctgccagctgatgggtttgatggatgcgtggagcccacaaaacccctgctactggtcgtgcaaaggctgtgtctgagcagcgggaccacacctcccttaaggctgagtaccacttgggacagcagctgtggtggggaggggggctgtggagctctgtggggatggggtcctccggctttgagggctgagttctggagtccagtgtcacctagatccagagtcctgaccatactgggtggggcagtgggggtggggggggtcccatcgttccctagagctggctgtcaacctgactgatacagtttggctctgtgtgcctacccaaatctcatcttgtagctcccataattcccatgtgttgtgggagggacccagtgggagatgattgaatcatggggtcaggtctttcctgtgctattaactttagagtgaataaatttcatgagatctgatggttttaaaaaggagtttacctgcacaagccctcttctcttgtctgctgccatgtgagacagggctttcaccttctgtcatgattgtgaggtctccccagccacgtggaactgtaaatccaagagacctcttatgtaaattgcccagtctcgggtttgtctttaagggcagtgggaaagcggactacgaaaccgaccttgtgcctggaagcagaactgggactggggtatcagatcatggtctccagttggccctgagtggttcactggggctccccgggagcccactcactgcccttggccctccccacccagctgattttcttccccagtgtctacagtccttgtttcctcctttctttcttccacctttatccaggcttcaactgccctgctctctgtcccttctgtcacttcccctgttgggaaatgtccccacaccccccactacccctcgtctctgagaccttctctcagttgggctcaatatctgctccagggaagtctccacgttcacatccccctccagccgcacttcctcacttgcctgttttaatcatccttattttatccttatatgccctctactatatctacttctagtccataattccatatccccctcctgccttttcaggagtcttgctgatcagtcatattgttgatcatccttttgccccaaaacctccagtctcattctcagaacttattctttttcatctatttgttaaaatgtcaggtttctcctatcttaaaaacaagacacatgaaaaggacaccctttgccactaatgtcctctacccaggaaggaagaattgtccagatccgctgcccctccactcctcccagccttcctagccctcggcagtgtggcttcctctgtcattacttctctgaatctgccctccccaggggcacagttgacttccttgtgaccaaatccagaatctccctgaggcagcagcctagaggaatgggtgtggctctgcagcacccccgttggttcaaattctgggccaccctagggagaacattgaccttagctaagtttcttaactctttcaatagccttgaaagggtggggcctattgctttcccagggtccaataataaccatagtgaatatttacggcaggcatcctgggcagggcttctgctcagtgcgctgtagggactgtgagttttgtgtatgggagctcgaacatgtttactgaatgaatgagtacattgtgcccaaatagtattaactaggtactttaaattcccacttccaccttcatccccactctgtccaccaggtccctggtttagtttctgattaagaagcgattaaacaaagactgtcttcttaatgtccaaattaaagctatttctagaatcgacatcttacatggatgatttggatctatcctaagactgagcataagaggtatctttggagtgtctgttcatatgaaggtcacattctgaattggtatgtaaattcaggatggttagattaatatcattctgcagcaaaaatttgatcattctggttatagtcagatcaaacacatttttaaaaactctgtaatccaggtcctcttgtgcaatttgtgagactagaaaatcaggggttaaaaaacccatctcaaggtcctagaatgaagatctttacatgagaaagaaaactactctgtaaaaataagcaggtagatgaaatgggcaattaaaataaaacagttgggcgtcttaattgaagtttcattacccttgtccttggaagtaagtgactgtaaactcaagctgggaactggggagtgggatcttactgagtgatggtaaggggttgcggaggcctactgggtgcaccatctgggggtcaggaagtgtgaacagtgtcaaagcaacaagatcatgggcctggctttcaaagagatttcagtctctttgaggagattaaactaaccccataaaaaacacagcattcgatgcaaggctgaataattaagtgctaaattgtggcacagatgctaagtgctagtggagcccagatgagaagatctatgcatcttggaatagcctgcaaactcttagggagggcaatggcttccagctgagtcttgaggaatgggctcagtttctatgacctcagcctgggcaagctacaaaagcgcgtgaagtgtgatgggcaggtatcaagagaggaaatctgtggtctgggactctcccagtgaaatgactggatacccagctcctccccagccaggagaacttggcccacaaatccctgtggatgctacttaccttgagccctcctggctttcctgggttatgtttctttcctgatctgctttccgtaggggcaggtgaccttctaatatcttccactcaaggccagctcgtgttggccctctgccccttcttccgtctggtgttcttgttatcagaccccaaagtcatatgggctacctattttcagcacctctttctttcagccccctagtaatcatgagtccctctccagagaactctggacaagtcctggaggggctggaagtgcatctgagcagagcatccccacgagcttgatgggctcctcctttgttcccatccccagtcccaactatccagttctagccagacaccacagtctccccacaggttagttgtttctcctgagagcttttattagtcagaactcatagggttagaagagattaaaaaaaaaaaaaaaacctcattctaaactagatcttaaaagagaggaggcatttgttgaatcatgaaaccaaaacttataggggttcacatatggctgaatccaggtgatcccagatatccataggagtccgctatgctccatcaggcaccattctctcgggcactttcccccaagtggtagcaacaagtttacactctgtcagatagccacactgcctaagtcctagggaagaaataatagaatttcttctccatagtcctagggaagaaataatagaattgattgtggtttgtctttcttggaccattttatccaaccctgaatcatttcagccaaggaaatgagatactgttatggccaggactggtcacatgcccatctgtggaggtagagtcaggaagagtgggttccccaagtggaggatgtgggttttattaccagaagaaagaatgctgaccaggcacacatgggtgcccattgtggaagtgaaatggtggcccttgctcccaatggccatgggctgtatgtcccatcattgctgcccctactgccccatgggtaaggctgatgctgaaactcttgtccttacttacccttcagagatgctcagaggcaggtctgaaatttccagatgtttccacaagtttccaacagactatgttgggaaatctggaaaatactgttttcaaagatttggaagacctttagaagcctccattttcccctccttcctctatttttccctctgtggcaatagctgaccaaggaagctttggagatcccccaattcactgcttgtttctcattttgttgaccaacaccttggattcccaaataagaaaagcaatcaggaaggtttcagagtgatgtggaaagaggggcaaggagagggccaggcattttcatgcatagcatttgcacaaggacagagtgccaatctcccagcaaagttggcagacagggcctccagcagttagagtgacaaaaaggtaatcagaaccacttgccactttccattgagacagacatgggagccaaagtgggaacaattcctggatgataaattgtttcttgcttttcctttgaacttcaagatccatccccctgggtccctcccatctgatggattgactgacaagttcaatgggcaaggagaggattccatacccaagaatctgagctgtgttaaggcaagtctctgaagctaattgaatgcgaatgtcagctgccaccgataggggtaataggaagaaaagaattaccttcatcaggggaacttttaggggctgagagaaaaaccaagcagaataagcaaagcctcttgaacttcaatgtgacatttttgcagccccagcaaaagtcagttaaacgctagattttaactcttccttgaagaatgtattgcttttctgcaatcaagaaattaaagctagagcactataaatttttaattgacataactttgtatattcagcttcacatgctgatatttttatcatatcatgaacattgtaaaccaatgccatttttcaaaatcatcataaatgtctgtataattcagggaaaggatataccatgctgtatttaaacatttctcactctttggtcattttggatgtttccaatgtcttgtcattgtaaattgttccacctcacatttctgaggcagtgttgaatgaatgtttattcatttttgccagcattgaatattatttttaaaatctattgccaatttggtaggtaaatagcttctctctaattcacatatctttgactactcataaggataagtattactttgcatgtttattagtcatttgtatttcaacttctaaaaattctctttatgctcttcacacatttttcttcatagttcacaggaactctttatatgttaagtatattacaggccagacatggtggctcatgcctgtaatcccagcactttgggaggctgaggcaggcagatctcttgaccccaggatttcaagagagagcagcctggccaacatgacaaaatcctgtctctactaaaaatacaaaaattagctggacatgatggtgtgtacctgtaatcccagctactcaggtggccaaggcacgagaattgctttaaccaaggaggtggaggttgcagcgagccaagatcttgccactgcactctagtctgggtgacagagtgagactttgtcgctaaatgaataaatgttacaatttattctattagagttactgttaacatcttgttatttgtatttaaaacttttgtaaaagatacaacttagtatttttctaatattattaatgtattttttgaatagtaatacatttgcttggtttaagattaaacaggcactaaggagagcaaagtgtttcctctccagtcttgcccttttgtgactgaggtttcctcctgaaagcacccattattaccaatttttgtgtatatagtcagaactttcttctgcatattctgtatctacaaatttctacatttatttttttcatattccctttttatacaaatataatatttgtaatcttcaactttctttttctaacattttggagttcattttatatcagtacataaaagctttcttactctttttatgatgccatggtattctattgtatggtttattgtagttttatgacatataaaaaagttaaggactttacagtcagatctatctttccatttttaatttaatccattgattttatgcttaaaatatctttcactgtgcagtcacttaaatactcatctgtgttttcttttgtgtttaaactttgtattttaagataaaggtaaattcatctgcaattataagaaataagagatccctcacaccttctacctagtttctctcaatgtcttggaaaactatactaaaatattacagccagaatattgctattgatagttaaattgatcctcctgcctcagcctcctgatgtgtttactttttaaagcaactgtgaaactgttttccagagtggttgtaccatatcgcattcccactagcaatgtatgagggacacagttttctgcagccttgtcagcatctggtgttgtcactattttttgctttagacattctgatacgtgtatactgatactgcactgtggttccaatttgcacttccctaagggctaatgatattgaatgtcctgcatgtgcttacttaccatctacaattcctctttagtgaactgtctcttcacatctgctgttgtctaaatgtttgtcctcctaaaattgatatgatgtaatcctgacccccaaggtgatggcataaggagatggagctttgagtggtggttgggtaatgagggtagaagcctcatgaatggtattagtgccattgtaaaggagaccccagaggactccttctaacatgtgaggaaaccgccagaagacggcactctgtgaaccaggaagtgggccctcactagacaccaaatctcttggcaccttgatcttggacttcctagtctccagaaccttaagaaataaatttctgttgtttataaaccacccaaccgatggcatttttaacagcggtctgaacagacaatgactgtcttttgcccattttctaattgaattatttctttttttactgttgaattttgagagttgtttatatattctaggtgttagtcctttgttggatatgtggtctgaaaatattttctctcagttggttgcttatctttttctcctcttaacagggtctatcacagagcaaaagttttaaattttgacaaagtgcggtttatcagttcttttttggattgtgcttttgatatcaaggctaagcctagccaggtgtgatggctcacacctgtaattacagcacttgaggagtctgaggcaggcagatcacttgagcccaggaattcgagaccagcctggccaacatggcaaaaccccatctctactaaaaatataaaaattagccagccatggtggtgtgcacctgtaatcccagctacttgggaggctgaggcatgagaattgtttgatcccaggaggtggaggctgcagtgagccaagattgcaccactgcacttcagcctgggcaacagagcaagattctgtcaccaaaacaagaaaactaaactaaaactaagcctagccctcagtcctgaacattttttaaattttttttctaaaattttacagaaatttagttttatatgcaagtctgtgatccattttgagttaatttcacataagggtgtgagatttaggccaaggtttttgttgttgttttttggcctccgatgtccagttgcttcaataccatttgttgaaaaggctatcttttctccacttaattgtttggcatgcttatcaaaaatcggttgtgcatatttgtttgaatttgttttccttattttgttttattgatctatatgactatacctctaccaataccacattcttgattattttagctatataagtctcaaaatgaggtagacaaattcctcccatttttttttttcaaaactgtttttggggctgggcaaggtggctcacacctgtaatcccagcactttgggaggctgaggtggggggtatcacttgagctcaggagttcgagaccagcctgggcaacacggtgaaaccccatctctacaaaaaatacaaaaattaaccaggtgtcgtggcacacacctgtaggcccagctactttggagactgaggtgggaggattgcttgagccttggaggtggaggttgcagtgagccaagattgtgccattgcactccagcctgggccctgtctcagaaaaaaaaaaattattcttgatattctagttcctttgcctttcaatataaatattagaataaccttatctatatcaacaacaactcttatgtggattttgaaaggaattgtattaaatctgtatatcaatttgaggagaattgacagctgtactatattgagtcttataatttatgaacatgtaagtctctgtttatttagatatttgatttctttcaacagcgttgtatagtttttagtgtataagacatatatgatttgttggatttatatataaatattttctttgagtgactgactgtaagtggcattgtcttttaatgttggtttccatatgttcattatgatcatgtagaaatgcagtactttttttgtgttgaccttgtatcctgtaaccttattgaactcacttattctagattttttttggtaagattccttgggattttctacataaactatcatgccatctgcaaataggggcagttttacttcttcattttcaatccgtatgccttttatttcccttttttgtctgttgccctggctagacctatcagtactatgttgagtaacagtggtgacaaagacattcttgccttgttccctattttaaagggaaagcattgaggctttcattaagtgtaacgttaactgtagggtttttgtagattatcattatcaagttaaagaaactcccctctatttctatttttctagagtttttttttttttttttataaatgggtgttggattttgtcagttgctttttctgtagcaattgatatgatcacacgatttttcttgagcttgtcgatgtggtagattacattgattttatttatttttctcaaatattgcatcagccttgcatcccttgaaaaacgcttactgctcatgatgcacaattcttctaatatattgttaaatactatttactgatactttgttaaagaactttatatacacaatccacattggtttttagttatattttttgtattgtctttgattttggtgttagcataaaaccaacaacataaaatgaactgggaagtattctcctcttttctggaatagattgtatagaattgctgatagattttttaaaaatatttggtagaattctctagtgaaaccatctggacttgtggattttggtggggggagattttttaaattgcaaatttaatttccttaatagttacagggctattcaaataatctggtttatcttggatgagtagtggtggtttgtgtttctttagaaacactagtattttctttgagtgactgttaagtgtgtttctaaatagacttaaccactattcactccagatgaactagattgtttgattagccctaagctattaaggaaattgaatttgtaatttaaagtacatctattttatctaagttatcaaatatattgtgtagatttgtttatagtctcttttaatatcttcaaggtctgtagtaacactccatgtttcacttgtgatattaataatttgtgtcctcactatttctttgttcatcttgctagaaatgtttcaagttcatcaatcttttcaaagaaacagctatttttaaaatttcaatttcattaatttcctatttctttccttctgcttgctttgggtttattttgccctttcatggtttttttctctcttcttttttaagttcttgagggtggaagcctagattattgatttgagactcttcctcttttctaaacatatgctttcagtactataagtttttccttctcagtactctttagctgtgtcccacaaattttgatctttttttttttcattttcatgcagtacaatcagtgtatttttaacattcctcttaagacttcctctttgattcatggattatttagaagtatgttgcttagtttccaagtgtttgaaaagtttgttattgatttctagtttaatttcattgtggtcagagaaacacactgtataatttagattcttttaaatttgttaagatttgtttttgggcctgtaatagggactgttcttggtatacgttctgtgggaacttgaaaagaaagcgtatttttctgttgctgtgtggagtgttttataaattttgattaaatcctgttggttgatggtgcttttcagttcttttacattcttgctgatgttatgactagttctactaattgctgagaaaggggtgttgaagttccaactataagactatggatgtgtctgtttctactttcagttcacatattttgctaccttctggtcttaggcagaaaattcaaccttattaggagatggtctgctagacctcgttgactaaaaattgagtttttattctatttcttatattttattatatatttttaattttatttcaaagagcaaacaaatgtcttttggagtctgttgacaaattatataattttctcctctgacttatccttaaatgtttcttcaacatgaagtacattgtatttcttaattattcttagatgtttacctcagggttccaagaggaaaatgaggtggctgagctctctgtgaagagacctaagggttatgtgatattgagataatttgttgtaaaatgcctaaagtttcagtcttctgaaacattggcttcattcattttaggtaaaaaatactgacttctgttaaaattcagagcttttgaaaattgtgagctctatgagaggtagtgttggcaaaatgattacaagtatgggctttagaggcaaagttcgggcttcctagttacacttgttacctgtgtaactttaggatggtatgtaaagtctctaatagtttcttcatctttgaaatgggattgaaatctctcaggattgttttaagaatcaaatggataactagtgccttgcattcactatatgtttgcatctcagttggattaagggatggagccaatgagtttgggattggctttatctctagtgtgagggttttcccaggatgggaaccatttcccgttttcctttcgtttgacaaaactgtattctgtaagtcacagggacattagcaggaaagtgccggtggctgagagtagtcagttgactttatcaacacatgtttctgttcttaggtcagaaacatcatctttagaaagtgaaaatatgtttacttgcacacttttatttatatgctaatcacacttactggccatggtacaataagtgtgtaccttacttatggagaggttccaccatatcccaagccaggtattagaaccaaaagcactgtgtggtatccaaatccagctttacaattattccttctgtttagacatgttaaaaattaactacaggctgggcatggtggctcattcctgtaatcccagcactttgggaggccaaggtgggtggatcacaaagtcgagagttcaagagcagcctggtcaacttggtgaaaccctaactctgctaaaattataaaaatttgccgggtgtggtggtgcatgcctgtaatcccagctattcaggaggctgaggcaggagaatcgcttgaacccaggaggcagatgttgcagtgagcagagatcatgccattacactccattctggcaacagagtgggactctgtctcaaaaaaaaaaaacaaaaaaaaaaacaccaaaaaaaaacaacaaaaaaactgcaacactgacttctcttttgtggtagtataaagattaaaaaaaaaaaagcattactgtgtctttagtaaagaaggggcacaaaaggtatcactgattgggaaaaacctgtgaggcaaagcagtttttatgaactcactgaatatcttagttgtccagtgactttctttctgcgggctttattttgttaaatcattttgatttaaccaggaaaccagagcaagaaaggctagttagcaagaaacgattcagtcctctattaggtatttgtttccatttgacacatagtcaggagtcttcacagggctatgggggaacgatagtgactttttttttttttttggaagagaatgatcttggttaaatttagcaaaactcttagtaggtctggggttccagaaaccatgtgatggctctgcaaggccttgcagatgcttttaaatattatttgggaacaaaaatgttccctttggctggtgcccttgttatgttttctcatgtcccttccctacatttctctattgctctccatgtcaaagaccaagaatctagaatccaacatgtggggcaggcactgaacccccatcccctagcatttgactcccaatattcctggggaaatgaggtttgggtcaatgcggagtgaggcccttagtttcacaggcaagatagactgactcttagacaaattggagggagccggtagaaatataaagaaaccaatttgatcttcagggccaccctctgcaggggaagaattatcaccttcaagaagcttttattcagtggctaatgaagtatggtgctcttggggcccatctttcagggcgagtgattcattttataactagttatctaaataagaatgcgtgtggcatgaactccagttttactgaatctttctatgactgtggtgttgtttactgcagatgtttcaaaaaaaaaagaattcaaactagttcaggcagatggcccggtggttgggagacaaagtgctgattggcagtcccagctgctgctgtcggagtcacctggcagacctctgagggggtgattaagtgacaggtgtgctggggatgtggccagccgtctgtcctcaggtccttttagacaccatctgcaggtggccacgtctgggctgtgagtcaaagctacaggtgatccgtgagaaggaggaagtgggtttggcgctgtgcgatcacctccatatgcttgcggggaagacacatgcagggaagaggctgggctatagattacaaacaaaaccatcttcttgcatgagaaacagagactgcagtgttaaagatcctccgtgagctgctgtttcaattcatgattacatgggggaaggacttggataatgtaattcttaagtgatttgcaatgtgcctttcaggcaggttttatttacaattctacatgaagcctgctctcagtggctgggagaaggccagatgagtgtttgctggctccattctccagcttagactagagctggggatgaacaatgcagatcaagtggcaggacttggccagcccactctccagccttacagagccacagagcccaggggattcttagcggagtaaggtcaaggtgcctgtctcagtggagtaaggtcaaggtgcctgagcagcctgaggcctagaagtcacctggctgggatgcccagcagggagagcactgtgacctgcagacagtgcctgcctgcctctgcccagccaagccaggtccccaaaccagcctcaccctccttccaaccccttttttacctcactacctacagcagtacttttcaatctgcaggttgcaacccatttgtgacttgtgaccttcacttagtgattcacaacaagcattggaaaaaaatagaattgaatagagagaattagatttctttctttcttttttttttttttttttttttggagatagggttttgctctgttgcctaggttgcagtgacactatcacagctcattgcagccttaaactctaaggctcatgatcccaagtggctggaactacaagtacctgccaccatacccagctaattatttaaattactttttttgttgtttgtttagaggtaggatcttgctatgttgcccaggctggtctcacactcctgacctcaagtgatcctccttcctcagccttccaaagtgctgggattacaggcttgagccacctcacaagtagtacctactgtttcatgaaatgtattccaagtgtgccgtgtgtttgtttgctgggtgatactgtaaaatatatcccttactgtgggtcaaaacgtttaaagctgctagacatttctgttagcaaacactccttcctaagtgagatccccccaacaaatacacatatccctcaaaaaaaaaaaaaagtgccaaagctgggcacatttaatctaacttaaaatagactcttgtaagaactctggccaacctgccaattgaggttaatgtctttagggtgccctctgaattcagaagtgctgagtgcttcttacggagaatgatgggagaagggggagtctcagggacatttcagttattggtttgtaaaaaagcatcccaaaacttagtggctaattaagaatgggttccttttatgatgcttgtgaactatatgggttgagattgaagaggggcatggcagggatgacctgactgctctgtgacgtctgaggcctcaggaagatttggtggctggaggcgacttggcctctgagggctagaatcactgggaggcgctcacaggtctagcagttaatgttccttgtcagggacacttcagctgaggctgcagccacagcacagcaatgtcctctccatgagcctgggattcttcacactgtgacctccaggtacacagcccaggattccaagagaatcaggtgagaactatgtggtccctttgggaccttgcctcacaggtagcttctgctgctttctaacgacttcagaggagcccttgagagaaaagacatagaccacacctttctagggagggaaagtcaaagaatttcataagttgctgcaggtaggaagttttttgaggggtggggtagggatttgaattttagtggcctttggaggacaggttgcagttgaacgtggtgggacagtacccatgcggcagagaccagtgggcacgtgacctggcctgtggtgcagaagaaaagggatgtggatccaggcctttatggaggctctgggggcagagtgctgcaatgagtcctgagaacaatgtatgcgtgaagtcttagaggagcagcatccccgaaaggcctgcgtgttcctctctcaggcaaacagatggtcagaaagcaatagctaattattagacagatgagtgaacacccatgcttgaagattacctgagtgctagccaccgaatattcagaacaaagaggaagcttctgaagccagaaatggtacagtcactcccataactcccttactagaaaagcctggagaggtacccagagggcagggaggttgaaagggaaggaaggctagcaagatctctgcccctttctgtacccaccctgagtccccaaggttctgtctgaaagggagggctggccaagtctccagttctttcaggggaaaaaaaaaaaacgtagttacatttccaaagggaagatgaaaggaaggaaagagaactcacttctagaggcttctaagaaaaaaacaccgtttcgaaaagcaggcaggatcggatgcaaatgaggctttcagaggcaatttggtagaaaatgggatgtctattagacgattaccagtgttcgctcccccaaactggaataagcctcttgatttgtctgcattcatttggataacctacaaaatcttgtttatggacttttaacagtgagagagagcatttctggagacactgatttccacagatctcagaacctcctcaaaaacctgagcacgggggaaggggaggccatgggctctcctgccccccaccatcagggctgtgtggtgggccagaaggccattcatggaggtctcaaaatacaccaaatgtttttgcactgctttggttgacattctttacgtgggagcccctggtatattaaatagtaagccccacactccctcaacctcacagaggtgtctcatggattaaggatttaggacaacaatccctactgcacccgcccctttaccgttccactgcttttcccgtaacaacttgggggctctctgtgggcccttgaagcagtcacattgctgccgtccccagctagggtcataggagtccctgtcccccaggcctttccctaaacccctattctagcttctggactctcctcaggtccttggagaagagtcacctcctgcccacaaggtgtccctctgccagtcccagtccttgagcccttccacatgcatcagagtttagggattcatttctttcccatccccttccgtcccctccccgcttctcccgtgactgatgtgagttgccctcgcacacattttccaaactctccaaaaagcagctttctctgcgcgcatctgtgtgtgcggacggggcctggacttcgaaccgccggcgcggctccacgggctccctgctccggccgcccccgggatgcgtgttgtaggcactggcgtggggaggtcagctggtgctcgaggtggccagtggagtggacgggcaaggggggcgcagtttgcgaactgctggggttctcggagggccggacagcccggtgttttctaataactccctcctgccgcttcagatttggaaacgcatttcggggcgtgatcacgcagctgcctcttggcattctggtgtccctcgaggtgaaggcccctgggttgggcttatgttgttgttatcgtggggtacccgagggggccaaagagagaaatcaacacccagtgatcgggcttctcgaagcatccccggttttttttttttttttttttttttaatgccccactcagagtgaccagtggcaccgcagaaagttcattaacactcccatttgtggcgtctgattcacggctgctgccgctggtgggaagctgggagctgctgctgcgagagcaaatcagcttgggctaatgcatatgttaataacgctaatgttggagcatttggtgttcctcaaagaaagacggtaaagtatctgcgctgtctcctccaacgcttaataaggcgggtggcggggagaggggagcaacaaaaagccattcacttggagcatttatagttagcatttatagaggagagcagcctgtcggtgattctgaaggcaccatgccaccactcagccctgcgccttgcattgttcagcaactccattgtaaaacggtctggtgacaggcgcgctccagcttctgagtttggaaaggcaaggcgtgctggctgaccaaacggttcccttgctagcctctcttccttaggaggaatttgctgtaccatctgttgtctgcgtgtttgctggtgtccctgaggatgtacccaaatgagacacccttggggccttccctggcaatccttcctgacatcaatttagcaacatcaactcccactttcctggatagagatgggttaggatgtatccacagcagagctgctgaattcaggcctggcaggcatcacattttatttttaaaccacaaggtgatagtctttaagcttataattagagatattctagaggaattcactcagacacttactgcgtggtgcacagtttgctgggtcttcaaaagaatatggtgctgtctgagattgtagatatgtgcccaccatatgggattctcgatgtctttcttcatgtacctggtttcaaatgactctcagcaatatctccaacttcttcaggaaatggagatagtttagttctttaggttttctttcaggttgatgtccatcagaaaatatctctgatgtaataagtgggctgcaatggaaagtaggattttaaaatttgggtatctctcatactgtatcaagagtttatatgttcaatctggttttctgcttgtcagcattaaaagactgaaaatatgtttccacagttaaaatttgtaaaggtcttgcggtaaagactgcattgaaaagctttggttccagagagattaggacggtccgggatgattctgatctgtggtgattgctgtggcatttcaccagcattgtatctgctggaagtgggagctgtcaagtctttcagtgaagttgtgcagtttaaaaaaagtatctccaaacaaacaaaagcatagaaaccaaggttctacagcacattaggagatctgtggctctttcgccatttctccagttattttttagattactctctgtcataataggccaagaaccaggatactgttaaagaacaactgcctcttggagctggggccagtgttagtgttaaggtccttcataagaagtgtatatttgttgttacttggctttggactatagtgaaatactttttaaaatgggagtgtctttgctttcttgattaggtcttttcttttttctttttcttttcttttgagatggagtcttgctctatcggccaggctggaatgcggtagtgcgatctcagctcactgcaacctctgcctcctgggtttttaagcagctctctctgcctcagcctcccgagtagctgggattacaggcacccaccaccacaccctgctaatttttgtatttttagtagagatggggtttcgccatgttggccaggctggtcttgaactactgacctcaggtgatccacccgcctcagcctcccaaagtgctgtgattacaggcatgagccactgcgcccagcctagatttgtctttaatatatgttaaagtaagttatttttccatggccatgtactttctggtgatggaacagagagggcagtctattatgaacatgaggagttgactggaataatgaatgaaaaccagctttaaggttcatgagtttcatggtaagggtgctgaggtgtcttacttgggccttcagtatgggtataactcatggagtataggatcttgacatcctattgcagactagaaggttcagcctggaaagagactgaaggtgagaggaggtggaaaagaagggaaaaggtgtttgcgattgtgatggagaaggtcctggagttaaaaaaggcaggcagtggctagcaatgtatgggttaaagacctgtagcactggtccagctctcctctgtacccctttagtgagagggaggttctcttcgcacttgcaccttctcccttctcagcagaagtaagagctctgtatcccttggtgggagggaaggatggccaagggtcttagttattgcaagataaactatcccaacacttactggtttaaaccactaccaatttattatgctcatcatttctgtgggttaaggcagggcacagtgagaatgtcttgtttctgctttgtgatgtctagaatctcagctaagaaaacatggaggctgggggctgacttgatggctgggagcctagaattatctggaggctgcttcactctgtgtgtggggcctgggctgctgggatttctgggagaggagaccgaagactgcttgtcattttccttccttgaagcatggtggcattgggaagtcagaattgaaagtctgcttacctggaagctcagggcttcaagcttgaatgttccagtgaacaaggaagaagctgcatcttttcagacctggtgccagaggtcacacactgtcaccactatcacatgctattcatagaaccagtcccaagtccactgtgatgagcagaggaggactggactccaccccttcaatgcaagtgtgtcaaacacacattgtagaagaggctgtgggatgagagatgtttttgcagaaacctttggaatcagcctcaaatggggagatagagaaaccaagcagaaagggtctgagggcaaactgggcctgctcttgctctgatctccccttagaacagctctaacttagactctgcaaatgcctaaacaactggttggtcaagttgatcatatttttaaaaacccatcagattaactatttggggttgtgtaagccaaagacaaatgggctgactgagagctttttcactgttccaagattgttatgtaggtccaggcaaagaatcgtgggacccatgtctgcaacaaaagcttggaggcagcctttctggccatgtccccccctccccattgcccctctgccttcttggttactaagcagttacctggcaaccatgcctcctccacatcggctgccgagccaagaggcttagcctgtcctccctcagctctcaagtctcccatggatcactggggacaggatacataatgagattttaattgtcacgttgaatcaaatcattttttccatgtgcataacttctaggcagagatgtaatttcaattaacttcgcttatctgataaaactttcatatcctttaagctaatttcatttgaactaataggcactatgctcctctttgagttccagctcagatgtcttaggcagagccgagatctcctgcatactcgggcacattagagagcgtctgggctgtgtgtgcagaagtggcctctatgcttggacacagctagtttatggagcctttccttttgcttttctcacttgatgaacattcctgaaagcctatttggttttattagttttcagcttaagggatcagtatttcccaaacaaaaggtgtcccattgctctaactgccagagccataaagattaaaattacacttaacttgaaggaatgtctgtatttctccctgctgctacaggacctggggcagctggttctatctcagtgatgagtttgagcatttgttttattaagggaagggggaaggtgagaaaggcattgtaatttaatatgtgggagaaaagggctgatgtgccttaattttatttctcagtaacccccatgaatgtgctagttctgcttaaagttcatttgaacaaaaacatgcctttgcagaaattaagctgctctcattatttcttttcatatagtagaattaaacttcaaacagtttatcatttgttctttgacataatactgagtttggccaaaaccaaataacttgatgctattgagcaacagaaattcaaatgcaaagatgctgcaaggtaatgtttaaacaaaccacacactggtcaatttttggatttcactgctagcattttctggctagcaagtttgtttcttatcaaatcaagaagagaaatctaaggaatgagaatgagagagaaaggtttagtcagaaggagaaaacacagtgaggttgaagatacacacacacatgcttacatgtgcacattcacacagatgatggctaggtcctcagaggatcagccctgagcttctagcccagagtgtcactggtttcctgtgtgaccttagacaagcactcagcccctgtttctacatgagtggaatgaggagtggactaggcgcaagacctatggtgggctgaggcttactagtatttgattcaaagccaagcagatggggttgcattgagaccacaagggtaggcactgagtttgggacttgccaaagaagagaagattaagagactgtaaaaagagtcacttgctttaacagtggcactcaagcctaagcactgttcctcatccttactgtcagcatgatgagtttgggtctgtctttcagggatggactcccaccaaccacctgggaagactgatatattgtggtggttaatattgagtgtcaacttgactggattgaaggatgcaaagtattgttcgtgtgtgtgtgtgtgtgtgtgtgtgtgtgtgtgtcttgttaaaggagattaacatttgaattggtggactgggagagacagacccaccctcaacctgggtgggcaccatctaatcagctgccagcacagctaggataaaaacagaggaacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaacaaaaaaaaacagaggaacattgtaggactagaccagcggagtcttctggcctccatctttctcccatgctggatgcttcctgcccttgaacactggactccaagttcttcagtttttggtctcctggacttacaccagtggtttgccagggactcttgggccacggactgaaagctgcactgtcagcttccctacttttgaggtttggggacttggactggcttccttgctcctcagcttgcagagggcctattgtgggacttcaccttgtgatcgtgtgagtcagtactccttaataaactccctttcatgtatacatctatcctattagctttgtccctctagagaacactgagtaatacagatttaaaaactcaagtgccaatgtgacaatttatggtggaattgtaaaacgagaaacacatctattatgcagatcccagtgtttgtagccaaagatcaacatcacaatggataagctgcaggaaaggacatgttggtagtttccagtttggggaaattatgaaataaaactgatttaaaaaaaaccatgtacaagctttcgtgtgaacatggctttgaattcacttgggttaatggctagaagtgggattgctgtgttgtatggtacatatatggccagtgtgtgtttggtgtatggtcaaattgtcttccgagtagctatgccatttttcattcccatcaacaatgaataagaaccaaattataattatatttccttggtaaacagggtctttttcatttgtgcaataaatagttattgagaattcattaaatgccaagtggtattctagacattaagagcaaaatagacaaaaatccctgtcatcatggagtttattgtcagttggtggaggaaggataagaaaataaacaagtgccacgtatgtagcatcccaaatggcaatcagtactaaagagaaagatcaaacatgggagtgaaactgtagagagtgtgtcggcaagggtgcactgagacagtgacatttgagcaaagacctgaaggaggtgaggaagtaagccctgagggtacctaggggaagagaattccaggtagaaggcacagaaggtccaaaagtcctaggataggtgcatacctggtatgtcaagtaaggctggtgtggttgagcagagtcagggagaatggggtagtaggaaatgaggtcagggaaaaaagtggtggctgagggtgaccaggtcttggagaaccacagtaaagacttcatctttttcttggagctggatgcagagccattgggagggcttgagctgaggagtgacatgatctgatctgactgagcctttgaaaggatcactctggatgctgtgttgggtagcagagactaaagggtcagagagaaagaaaggagggtaattagaaagctaacgcagtaatccaagggagagacctgtggcttagaccaggaggtggcaggaagtgattggatgctaaaactaatgttagactggagccagcagaatttcttggattgattggatgcagaatgtgagagatatagaagtcaccaggtacctggggttgggccagaccctacagatgaaggagttagtcctctataagactatcctcacttgagacagcagctataaattcaagagtcccagggccaccttcacttctaaccagctggctacacatttaggtttgatgaccacgaccaccctcaggtttcgtaattcaccagcaagacccacagaattcactgaaagcgctatacttaagattacagttttattacagcaaaaggatacaaattagaagaattgcatggggtaaaatctgagagtttcaagtgcaaagcttccatccttagggacacattgctctctcaacacaatatatgacaacactccaagggtcgtggcaactggggaagctcacctaagcttcagtggccagtgttcactggcatttcactacataagcctgattgattgaatcatagcccaggtcttcagctcccctcctctccctcctagaggtcaggcagatatcatgtgtgccgaagtcccaaccccctaatcacatggttggtttttctggtgtgacttgccctatcttgagctatctcattagcaacaactatgtagggacccaccatgagtcacttcattggcatacattatcagacatggtctgagaggctcagcatgaaaacaaagacattgctctctcttcagaaattcaagggcttataggttaactcctaggagctgaggagaagagccagccaagttctttactacacataggataacttagaagattttgacctgaacaaatggaaagatggggttgtcatgaactgtgctgaggaaggaaacagcaggcttggggagcctgggagtgtatttggatatgctcagtttgatgtgattttttttttctgtcacctaagcagagatgcaagtagacagttggtgttcagggacaggtcctggttggaggatgaaaacttcaagaaagagatgggattcacattagagagatatttgaggctgcaagtcctgagaccttgtggcactggaggaaagaagcgctctccatctggctctttgggcagctcatctctgtcctccagtttaatcattccttgctggtcacccatcgttgcctagaaactcattcctcccatcccgcctccctgatattttgtccaggtcactttgactggaggtccaagtgttgccaaattctttagtcaaatctttacaggtaatctctgggttgattgtcacagaagtggaaaattacagccaggatgggtgactttacaatgtgaacaatcagacagtgaccttctgccttgcactaccttatcactgggggacccgtcatacccaccccattctgccttcaaactcctcataaccaggggtggggagcaggggtcaagtgaccctgggaaggcatttgagtcttctggggctgttagacaccattcattaaaaggaaacattggacttgacgctttcctgggtcttttttggctaaaatgatctctcagtctaaagagtcttgtatgctggttgtatatgtgtatgtgaatgtgcctgtgcatgtcttgcctcctcaatagatagtaaaatttttatgcagggatgttaaaggatcctagagcagtttagaactgattttgcttggtcccatctagtatttctttcctatccctctgggcgtagaaattgacacatagtaaatgttcactaaatttttaatagtagtgaattgaaacagttattcagaaaatttaaatcccttccctgcctcccacccaaaccaaactaaacacttttatctgtgagttcagagtgttttagatcctgagtaatctgtttaatagcatcagttttcacctttactctggagagatggggagagagacaccgagatacctcttaaagacagaatagaaaggtggcttctggggtcagtgtctggttgggttttattccaaatccaccatttactaactctcttgggagagttacttcgccactctatgctttggtttcttcatctgtaaaatgaatctaataatggtacttatctcatagggttgatctgaggattaaacagtttaatattggtgaagcacttgaaatactgtgtggctataatgaaggctatgtaagtggaggtggtcttgggtatttagaggtgaattgatttgttgttgttgtttcctttttttgagacagagtttcactcttattgctcaggctggagtgcaatggtgcaattttggcttactgcagcctccgccgcacaggcttaagcaattctcctgcctcagcctcctgagtagctggacttaccggcgtacgctaccatgcctggctaatttttatatttttagtagagatgggggtttcaccatgttggccaggctggtcttgaactcctgacctcatgatctgcccacctgcctcggcctcccaaaccactgggattataggtgtgagccaccgtgcctggcctttttttcagaataacattaggactggccaggtgggcggtaatacttgtagcacatacctcatgcagttagtttgcactccaagctaaggttaccatgggcctaattttgtttttttcaagtgggaaatgagttcgctgtcttcgaagttgtaacctacaagtccttgtcctgtgtggcctggtgacctagttggaggtgtgtagaagacctgggggaacagatcagcacccccacatccccaccactggagacgactcagagttcattttctgctgatcatgggttcaattccttttctttaggcatggaaggtgacttattttattatggaataattctgtgttgggggagagtggggaacttgttcagtatccagaagcatttacccttcattctggctcagtcatcataatgtgccattttttgttgtgatcaaagtgtgtttctgttcctgccaagcccctgtgtcatgagaaccagcgcagcagctccaattttactgctgaggaataaaccaccaaagcaggtttctaatgaaagtgctagggagactttaattataaccgtgctcttgagctcccttggcaacaccttctcttttgattcttttcagagtagaaacaaaaatggagctgctggtaagagctcatgtcagggagccttagtgagctgggactctttagtgtagccagctctcccccacccttatggaaaagcagttcctcccagatcacctgagccccactggctctccaagctggcctgcaccccagcacagtgcagggaagaacatcttcagggtgctagtggccgattgcatgcggaaggaaagagaccaagcttaaagaaaatcctgggtttattgcccccactgagatttttttaaaattgactacaaagtgctgttgtctgggctctttggaacaggttgcatgtgtttgttcaattgcattagtttttgctctgaaaattcccttccttttctctcctctcagtggcccatgtctaggggctttgttttccttactccccttttccttttctctctctttgttttgcaatgcctccagcacatagtaagtgctcaataaatggtgttcttcctcttctttcacctggatctattctgagtttacttgctttctctttgtttttgtgcccttatctttctccctgccttcgtcccttcccccagccacctgcatgctcttcatcagtctgattcctttccccagtcccattctccttcctgccttgtgtctctttttttcattcaccttcctttgatttaaatcccaatctgaaattcttctttcctcccctccttctcccaatctttatttttcaactctttgtctctcatgtggcctctacctctatttttccactgtccctttgcccaaatgcttcttagccttggcttggaacattatatcacccgagaagttttaaaaacatcccaatgaccaaactgaaccctagacaaattaaatcaggatctctgggaatggaacttcggtagaaatgtttctaaaaagatcccctgttgatttccatgtatatcccaggttgagaaccattgcctggctttttgattgaacatgtttgttgtgcaaagccaactttatattgctgtggctatctctaggtggcttaactgatgtttccgtttttcatttagtggaaagcattttccttgtgtcagttcccagtgtgggtcctgtgacctttgttcttcctcaaggccataaagagtccaggtcaaaaatgaaggagaggtgaggacaggagtagcatggggaactgggatgggatctaagctaccctaaatgcagagagacagtaaaggcacagccaaggactggagcttccagtttctagacacccaagtggaaagctggcttgggttggggtcaggctatgtggaaagggtaagtgcccctgatccaggcagctctgcttacattggcttccagaacatcagcttcccagcctgggcagcaagaacagtgctagcttctaaacttctgcaaaccctttcttctgagcttctccctggctctggatttcaccacctcattctctgtcaggcatgttgggatgatgcactggggactctggagcaggctgttccttgacagtctcttcactgaacacagagtaaggaatttacttcatgtaggggacacctcagaagcaaatcaaacacctgctcagtggactctaaaatttctagcacttgtcaagtagagaaggaagcagcagatccagaagcactcttggaagccctgcctcacattctgcagtttttaccaggcttaacctggaatgagccctgctaaacactgtaaagccataggcatttggcatgtagtctcaccattgtataatatatgtgttcatggaccatttataaatcagctgaagaatatctgataggggaacccaagtcaaacaggcaatatgaaaatgatgatgaaaatttaccaggttctaggggtagggaagtccaaacactattgacccactaggcagaaattcaaagtccaggagagagaatctgcttgccccatagtgggtcacacagggtctcctgatcccatacccaaagtctagtacccatgcatagtgatcatctctggctccttgactttgtcattctgtgctgagaagtgctgaaccagcacagccacattgagctcagctaatccatcagtagctgtttgttcctgagactgaccagctgcaagtcggggccacagaaaatgcagggctggcttctcaaagcaagggcagcctgatttgctgcaccctggcctccagctcaaaggcaggaggataagttggtggcagctccttctgaggctgagaattggctctccttgcaggaattggatcttatatttagttagtatctaggcactggctgctacatacagattggtttaaagcctcttacttaagaactttatttccgggtatttgttaaaccagtttcaactgagagtaacctagggaagcctatggctctcaatttgagttggataagaatcaccaagggatttttttttttttaagataatgatgcccatgtccaaagcttctgatttggctggtctaaggtgaactttttttttttttttttttttaagcaatggggttttttgttgttgttgttgtttaaggctcccaattctaatgctactcagggataagaacaccagtagagtgaaaagcccatggagaggccaggacaactgaattccttgttctagagtttaggtttgccacttcctagatgtggcactggggaaaggctatgctgctcctttaaaatgtgaagggcaggctagatggaaaagttccacaagcatcccagtccaccagggagcctagaaattctacagaagctctgaattccacactaggcagactaaaatccacaccagcatcctagaggcactgggcagtcaatctcggagatccctctgagctagaaagtctagggccctgtgaccttatgtgagcagcaccatgacatgtaacaaggtccctgtcctcaaagcatcgagaatgtaattggcacaggtcaggcacatggagagcatccaggcacgagaaagaaagggatgagctgctggaaaatgatgtagcagggaaataaaacagcagcaacaacaacaaaaaccatcaaggttagttgacaaggaggcaggaagggggtggaggtgcggtggtggtgatctccaaactgttttcatgcctgtgtgaaatggtttatgtgttctctactttaaccaggagctctcaagggtctaagttataaagggggtggaggaagcggctcctgctgggcagataatccaggcacgagaggattatatttttaacaactttccagcgggaggttatggattttcttctctttgggactcttaaatatctttttaaaaagcaaagaaacatctatttgtctttcatatttcaaagatgcttctgctttcctataatcagaagagcatggtgatacctttgtttcgatgtgttttccagaagaggggtggggctggctttttgccctatcctgttctctctccgtctgcctttgcaacagtttttgaggcaactgaccgtggctagaggtggggtctgtagctgggagagaatttttctctgcacgaggtgaatgttccatttctggactgcttagattctagtcttcgcatcacttagtgtctacatctggggaaaacaaacaccatggcagctattttaggtggtccctgagtcccttccaactctgatacttcatcaccaaaatatgaatgagttaattattgatagggaacagaactcagggactgtgctctgcagtgaaattaagcatgggagcaaggtgtggtagtgagggcgctggtgaattgccgccatctctgatttctagtgggttgaggagtgcaagaccatcatggcgtgtcagcagaccattcaagctggtaaactgaggttgggatccagctcctccaactctccttgataagctagacctgccgtggatgtgatctccccaggaaaatgacatttggagtccctcttaataacaccacagatctgctcatggatgagatatgagtgaaagaatccttcttagatactgggtgtctacccgcaaatgctgtccatccacattgactctccacatcatagctcagtctcccaaagggggcccatccatgcttgtctatactttggaggttaccattatcttggctacgcagaagccctatgaaaaagtaatcacaatctgtataaatacatgaatattaaacaaaatgtccctgaacaaccagtgagtctatgaaaaattcaggaggaaatcaaaacatttctcgtaatgaatgaaaatagaaacacaatatacaaaacctatgggatactgcaaaaacagtggtaagagggaagtttatggtaataagtgcttacatttaaaaagtagacagatttcaaataaacaacctaacaatgcacctcaatgtactagaaaagcaaaaacaaaacaaacctaaattagtagaaggaaaggaaaataaagatgagagcagaactaaacaaaatagaggaaaaaatacaaacaatgaatgaaacattttttaaaaagataaaattgacaaaacattagctagactaaaagaaggactcaaaccagaaatgaaaaaggagacattacaactaatatcacagaaatacaagggatcattaaagactattatgaacaactacatgccaacaaatttgaaaatctagagaaaatagataaattcctggacacatataacctaccaagattgaaataagaagaaatagaaaacctgaacagaccaacaatgagtaacaagattgactcagtaataaaaagtctcccaacaaagaaaagaccaggactggatcacattatttctgaattctaccaaacttattttgttgttgtttaaaaaaaaaaatcaatagctttaggggcacaagtggtttttgtttacattggtgaattgtacagtagtgaagtctgggcttttagtgtacctgtcatctgaatactatacattgaacccaataagtaatttttcttctctcaccctcctccaaccttccctcctctgcatctccagtgtccagaatatgcccctgcatatccatagtttagctcttgcttgtaagtaagaacatgtgcccaccaaacttttaaatcagaactaacaccaattcttctccaactatttccccaaaattgaagaggcaggaattcttcctaattgattttatgaggccaggatttaccctgataccaaaccagacaagtacacacacctctaggtgaatattcttgatgaacatagaagcaaaaatcctcaacaaaatactagcaaaccaaatctaacagcacatcaaaaagataatacaccctgatcaaatgggattcattccagggacgtaaggatggtttaacacacacaaatcaataaatgtgatacacaacatcaagagaatgaaggataaaaaccacatggtcatttcaatagatgcagaaaaagtatttaacacaatttaacattccatcatgataaaaactctaaaaaacattaggtatagaagaaacatacctcaacataataaaagccatatatgacagtcccaccgcatatatcatactgaactggaacaagacaaggatgcccacttgtaccactctttttcaacattgtattgaaagtcctcaccagagtaattagataaaagaaaaagcatatacactgaaaaaaaggcaatcaaattgtccctctttgcagacaacatggtcttacatataggaaagcctaaagacttcaccaaaaaacttagaaatgataaacaaattcaataaagttgcaggataaaaacatgcaaaaatcagtagtgtctttatacaccaataacgacctagctgaaaaagaaatcaagaaagcaatctcatatataatagctatgaaaaatagttagaaatgcatttaaccaaaaaggctaaagatatctgcaatgaaaactacaaaacactgatgaaagaacttgaagacaaaaaaattggaaagataacccatgctcatggattaaaagaatattgttaaaatgacaatactacccaaagcaagctacagatctctatcaaaataccaatgacattcttcacagaaatagaaaaaaaaaaaccttaaattagtatggaaccacaaaagaccccaaatagccaaagcaatactgagcaaaaataacagagcagggagcatcatactacctgacttcaaaatataccacaaagctatagtaaccaacacagcataatggtataaaaacagacatatagaccaacataacaagagaatccagaaataaatccatatatttacagccaactgattttcagcaaaggtgccaagaatacacactggggaaaggacactctcttcaataaatggtgctgggaaaactagatatccaaatgcagaaaaatgaaactaggctcttatctcctaccatatacaaaaattaattcaaaattggataaagatttaaataaatgcaagacctgaaactataaaactactagaagaacacataggggaaatgcttcaggatgttggtctaggcaaagattttttgggtaagacttcaaaagcacagacaacaaaaaataggcaaatggaactatatcaaactaaaaagcttctgcacagcaaaggaaacaatgaagtgggtgaagagaaaacctgtagaatgggagaaaatatttgcaaactatacatccagcaagagactaatatccagaatctacaaagaattcaaataactcaaaagcaaaaaactgaataatctgatgtaaaatgggcaaatgatttgaatagacatttctctaaaaaaaaagacacaagtggccaataagtatatgaaaaaaattcaacatcactaatcatcagggaaatacaaaccaaaaccacagagatcagagacctttttagcctagaatggcttaaaaagagaaaaaaaaaaaaaacaaatgctagtgagattgtaaaggaaagagaactctgacatactgttggtgatcatgtaaattagtacagctatatgaaaaacagtatggaggtttctcaaataactaaaaatagaactaccgtatgacccagaaatcccaatactgggtatttatccaaaggaaaggaattcaggttatcaaagagagatctgcacttctgtggttattgcagcactagtcacaatagccaagatatagaatcaaccaaaatttttataaaaagatgaatggataaggaaaatgtgatgtatatatgcaatggaatactatttagctacaaaaaaataaaattctctcattcactttaacatgaatggaactggaagaagttaagtgaaatatcgggcacagaaaaccaagtaccacatgttctcactcatgtgggagataaaaaaaattgacatcatagaagtagagaatggaattgtggtgatcaagagtctgataaggggaggagaggatctggagaagttggctaatggatacaaaattacagctagagaggaggtatgagttctagtgttctatagcagtgtaggatgactatagttaatgatatatcgtatgttttcaacaagctggaagagtggatttggaaagttccctacacaaagaaatgagaaatgtttgaggtgataagcatgctaatttccctgatttgatcattacatactatatacatgtactgaactatcactctgtatctcataaatatgtacaattattacatgtcaactaaaaagaggagaaaaggtgatcacaaagggtgtacatttgtgggcgtgcgtgtgcgaaatgggttactaaaatccactgaagtcaggagctattcaccaaaagctgaaaatgtcaacattctttttaagaaaccattttcatgcctccagcctttgaaggactcaaggccactgacttatgctaaggacagaaaagacactgtgttatttaggcctgatttttaaacaatgcattatagtgatggcagagtgcagggtgtggggagtgggagggacaggaaaatgtatgtgcacatttgtggatgtgaacatgtgtgtgttcatgtgtgtttgtgctgactgtggaggtttgcataaatatacttcacaacccaaccaaggactcctacctccaagatccttttccttaaccgagacatgcttgccctactgtgagtcccaggttgttccaagcatgtgtgagataacctatcccacatgagaaggtcaggtctggctctcagttctgtacaccacttcacaaggtcactagtcttgtcattttcttaactttctccttctgtcttccctcagcaggcaactcatatctgggcacatgatagatgtctatccccttgccagaatgatttaaaaaaaaagaaaggcaagttctttgtttaaactaccgaagctctgagaactgcctatcagaagccatggctgtggagggtattcattatcaccaaagaaatctttgagttctgagctataagggcataaaagacactggccttggcatcacacaagccaacagacctggggagagaatacaacctctacacagaaggatccaattaaacacagcatacagtcccatgctgggtactgcagacaaaaagacggttatgacttgtctcttgagaggtctgctatctgatggcagagacagacttttaaacaactaaccataaagcagaaggataagtgctgcttttatagaaggttatatataaagtcttatgaacatataaaaaggaggccaagtcattctatctgctctgcttaaggcatatatctcagagaaagggacatttgaattagactttgcagacaaataggagtttgctaggtgagaagcagcaggagagagttttaggcagagagaactgaaagaagtagaaacatgaaaaatgcatggtgcttggaaagtaaggagcagcttaatgtggctgaagctgaggatacgtggatggctggatatagaaggtaagaaatgaaactacataacaataacaatgaacacttactgagtacttaccacatgtcagatatcatacaaagtgctttacatattcatttactctttataagatacatgtgatataggtactgtttgccttattttactgttggagaaattgaggtacagtcaatgagtgctcaggaaagaaacattcccaaggtcacataagataaatggtagagctgggacatgacctcagacagcccgacaccagaccctgtgcctatcaccgttaggctgttggatgtgcatattgtagttctgcaagttgatcatgacaaaggttaggttgatgtggcttcagggagaaggtggcatcagaaagaggtaaatgaagtggatgtgggtaggctggagtaagaggagatgagtagacatcccaggcatggaggaaagccatgatcaaagccgtatgtgtgggaacgaggatgtggagtgagccattcatgcggcccattagtctgctcagtggcctggtgcttcttggcaaagcccaaatgaacatctcattgatggccccagaagcatccctgctctccagaaaggtccagggaactcacgtctgctcactttctctctgttccttcctgcttctcgctggcctgggaagctgcagtcattcatacaagggaagatgggtgcccgcaggaatctcatgggcttatctttccctctgttatgcgtggtttttataatgtatctcctaccgagcattcctgggtgaggacggatgctatttggcagtgggatttaatgaatccagcagtgccttgctccccattaagaatccctgaggggtgttcagtcggctgagcagcagaagattgcagctgcacacatttaaataagagagacatcagggcagggtagcagaggccaaagggagaccattccttgagtgaaattgaattttgttagagttaaattgagatgctgagctgtcgttttacaaacgtattcatgggcttggctgtcactttcatttagtgggcttgccatctgaagctggggcttgctggtggagccatggcctccccgcctgagaatgcaaagcctcaccctgagaagcaggagcccaggtgggtggggggagaatctgcagagcagcaagcgggaggagggtctagtctgcaacctgctgcttcctccaccagcttcctcttcctggacctggccaaggacctgcaaaatcatgattctaatatgatgcagaataagaagtgttctagtcccacagatcaaaggtaaagttctggttaagtacaatcaacagccctatcaacgtaggtaatttattgagcctctctgtgcctcagtttcctcacttgtaagaagggctttgaaatagaatctttttagacttatggagagagtgaattttgaaataaaacataccaagtgcttagctcaatgttcagctagcagcaagtatttataaaagtgaaacagagttcttttatccctcttgcagggtgtgcaacaggggtgtggctcacttctttggtgccacactgcccaaaccccaagggggagcatgaagatgggcaagtgcagaggttgtgggtagcccttctgggctccaacccatagcagcatctagggataagtatttacaagcccaagtgggtgtgtattacagtgtgctccttcagctttgctgtctgcagttggcttgtgttagttcagttagatcctttgcagtatcctaagggcagagggctttctgtatcccaagttcttgcccagcgtgccgaaaaaattagatcacacgagggcttagagggtgagtgcaaggttttattgagtggttgaaggtggctcttagcaagatggatggggagctggtagggggacagagcgggaaggtggtcttcccctgtggtcgggccgctcaatggccaaactaacctccaagtccccctggcagaactccccctggagtccgcgttgcccctaaccaagggagaagtaggctccaaaagcagaggaccctgccactcttttccaaaggcagtggtttgccaccttcagggaagatagttgggtgttatctcactctgatcttgatatatattttcccccactaactctttaatctgagaaacgtattgaaaggctgggggcgggtaatatggatcagaaagcttccatggtgtagaatgaaaaggaagcagggagtattcacatgaaaaggtaatttgggtgtcatttgggatctcaagtatcagcctgctctggcatatttcagtgagtgacaggaattgcaaaatttacaagatatttggtttttttaaaagtaattctagcttgtccttttcctgtcctttgctaagtttctacatttgttcattcctttactcattcatcctatgttgaataagcccctgtgtaaaatttattgggttgatcataaagtcagtctcttattcttcccttaaggagtatgaaatccagagttagagggaggagagtaggtggggtagctctaggctttgcaagacaatgtctgggattctatttttaatagccttgggggccagcctgagtgggatttgccctttgaaattgatgcttgtctataatttagagaaccttgagggaggttctctcctgcagcctaaagttatctttgacgtctgacaccagcaagaggcaaattttatctgggggaatacacctctcatccaaaggagataacagctgtgagaaaaactcccccagtgctggtcctgttgacttatgtttcaaaggagaacaatttcaacatagaactccactttccctcaagctgcagatgcaataaaatggctgtaagctgcaaaaactctttcaatatggcacgtattaaacctttcagaggtagcgctttgatttttaattttacgctcttggcaggcaatcagggtctttaatagtagggaggccagagggagaatgtttcaaaacagtgaggatcttatcatagtgtgcaattaatgaataattattaaaacccagaaatagctagaaaagaaggcaagaggtggcagagcaattctctggttttgggcctataatgaaccctctggagaggggaaatatgatactgagttccatgcaattaaatcttccatttttctcctactggaagatcagcaatttcaggggcaaagaaaaaagaaaaaaatacccaactcttaaaaagtcatttgctgacaatgatgcatttgatcagtttgattttcaacatttgttgtaatgacatcgaaaataaaataatactaatgacaagcgcaataataaaacacctgctccttgaaatcaatttctaagaaagcagtattggggcatgttggtggcaccagttagaacaggtacattgttgaacaaattcagtccatgagctgcacaattcccagctgtcatagggagaacccccctgcacatcttgtgaatacacatcccccggctccctgtcatttccaggcacaattgtgtcagctccttgctgtcgggatctctcctctgaaggtctcagtcccactgtttcctttttgactcggctctagaaaatcttgtcatctgtcaaatagctgtttacagtcaaagcccggcctgctgagtggccgtgtcacaggctggcaagatgtcatgctggccactgctaagcaggtacagatgccgctgcttcttggaaccctgcaaacaataaagtagcctggcagggcttggcatgtggcagaacaaccacagacccacattgattcagttctcagccatttcagtcaccctagggcccctgctagggctctgagagcatctggggtcagctcacctttaagtagccattagccccctccgctgcaaagctggggtggggtgcgggagcagggcgggcagaatcaatgagcacttgagatggcattttcctggcatgtggtcgctcattactgagggcctcagtgaggatctgggttttcatgattgatctctcagcagtgtttcaggagacctgccaacatcacaaggccaaatgggcctgcaaaataaagaaataaatagatggacaaacaaataaatggggagggggtgctgttgttcagagagcagtgagagaggatgttttccagtgtgtgacattgtacaaaggtgcccgggatgttttatttgaagctcagcttcaggagggtacacgacagcagataatagattgtaggtacgcggccatgggcccctaagagaaatctcagatgtgttgtactctgccagatgataagaatggggatggaaaggaagaggtaggtttcttcttcctcattgccagctgtgtccctggctattcttgtcaggccaggtgcttttcttagagtgctcagagggactatttacttagcacttgctccgtgccaggtattgtgctgtgtgtgtgcttcatgtactctggctcacgtaaaacctggagaatggtggtattaccccaatcattaaagatgagaaaacggagagtcagagaggtgaaatcacttatacaaagttgcacagttggaaaccgaggggtgcaactggggttgagttgaactcctaagtcagtgttcttaattactattctagatggcttcctaggcagggatgcaaaggccccttgcagcctctctccagcacaaggagcttctgatgatatattgaatgccagctgactctgggcttctcattgtgagtttagccatccttcctcatactggggcagaatcactgcagtccccttctggctggggccttgtcactgctgtctgccaaaagaccctctgccttttgctctgcttctgacatgttcaaaacaaatctgggtcccagtctttcccgctcaacctcaagacaagaggagcaagggtcatacccttcaacctggtgtcagaggtacttcctttgtgtccttgttttagagtgcctctccattgtcacctctgactacagccagcctgaccttccagctttgtaacttagcgcaaaccaagtttcctagttctgcaaagccttccccaacttctgtctctgcttggtacctgcctgttcatttgccaagactcagtttagacattccttacctggaaagtcttttctgacttttgcaagactcggtcagtgattctatcataactattgcatgcatggaatggtctggttacttatctgtctcatccacagtttgctgaatgaataggaatacctcacccttttggtcacagatcctctatcaagtccacatagagaatctaaatacttacatgcttctggtggtttgttcttttgttcaatgctaactggtccagaatggcctgggcttcagtgtcacaggtgtcaaatcacccatacttcctaggcgtagtcatcacacaagaacatgaagcattaattaagatgacactagctgctgtagcatgcaactccaaaatgtatcatgtatgatggcttgagagaagattatattccactcatgtaacatccaaagtgaaatgacagattggcaggtggcttccttaagtgatgattcagaaatctaggatcttttggctgggcacagtggctcacatctgtaatcttagcactttgggaagccgaggtgggtggatcacttgaggtcaggagttcaagaccagtgtggccaacgcggtgaaaccctgtttctactaaaaatacaaaaattagccaggtgtggtggcacgtacctgtagtcccagctactcaggaggctgaggaaggagaatcacttgaacctgggaggcagaggttgcagtgagccaagattgcaccattgcactccagcctgggcaacagagcgagactctgtctccaaaaaaaaaaaaaaaaaaaaagaagaagaaatctaggatctttccaccttggagctctgtcatcatcaactcatggcttccaaggcccctgagctcctctgaatcagcatgctggaagggaaaagggcatggagtaataaataggtgtgggacatttctagggctagggccagaggaggagcaacaatcacttccaccttcatttcattggttaggccacatggccacactcaatctcctgggaggctgagaaatgtggtctccctatggtccagtcagccatttctgccacactatctacctcactgtgcacaatctgcagaattttgaagcacccaacttccccgtgttctgagttcggacatagtgttccctttttaattctctgggggagaacacagtgcaggaaaatttgtcacttccagtttgcctcactggtggctgcactgtctgacgtttctttgcttgcaaatgtaagggctgaagaaggactggcttctagatttattaggcgtcttttacttggctgccaaagattcctaaccacgccaggtggtgaagattaatggccaagttggcatgttgagagtaacttaggtaaagcactctttctcactgccgtcctttagaggtcatctatcacctgattccgtttttgttttcaagtgacagagcaagtgcaaatttaggcgagaaatcagtaagctccagaaggctgggaagatactaaactatttgcatatttcagcttggttcaattaagcatgtccattgcttgtggttgttatgaccaattttcttctaggaaactgctccaaaggatgcttgaagacctggagtttgatttgcagaaaaaaaaaaaaaagtggagcttcatggctcaaagcaacccttttccagaaactttatctggtaatgccactcaacagtgagaacacccacatccttgttcctttagcatctgggatggagattatacagtgtaaatttctttctttcttttttgattgacttgcatttgttctaaagtaatttccttctgtgggcatctacatgtagtaaacatctcatagttctcttccttaaatgcagttagtgaagtgttaatgtgaggcattagcctttatcatgctgaataaattgaatgccctatgactgaaacggagcttctcatctacacccatacttaatattgcagaaaaagccaagcaaacatgtgagttcagcgtgcatttatctttgcccagaagctctttatggttgtttacatgtctctctccatccatccagcattgcagtgccctgaactgagttttctaaatcatcatgttaagttctaaacgctcaggccagacaattttttgctccaagaagcaagacccaaacatcttaatcttttcaccttgctcagccttccttcctttgtagaatcaaattgaaatttgctctccatctcaggagcttcccctggactcatgtatctcttccctccatggtttctgctcttttgacaccccctcaacagcctccccctcccctcagtcttgaataatttgttcttttgtgacatgaaaggtgcattttacattttttgacactgtggttttaatcagctcttattttaatcagttcctgcaaagaactctttgcttacttcaaagcaagaccacgttctatgctttttttctgacaagctatctttcacacttagatctgcactccttccagaattgacttttgtgtatggtgtcaggttaggcacaaattaatgtctgccctttggagattgccattgatcaagcaccacatactgaaaagccacttcttcacctatggttctaaagtgtcactgtgccataaatcaggtgaccttatatgtacagatatatttctagatcctctgttgctcagtttatttttgtgctaatatcacaccatcttcattattgtaactttataatacgtcatgatagctggtagtataagtctttatcatcattcttcatcttaaacactattttggctgtttgcatttctacataaattttagaatcggagtgtaaatgtctacaaaatatgtgctaggattttcattgatctaaaatctatctaggaggaatttaaatgtttgtaacctcgagtttcctaaccatggacatggtatacccctgttcatttaggctttaaaaatttctgttattaaggttttatgcttttcaatgtagaggtcttggtgacattttaaagatttattcctagatatccatattttaaaatgctattatgaactgtaccattttaaaattggctttgtgttcagggactttgctaaattcacattaatttcaacagtttttccatagatgcttttgggtttcctgtatatgatcatgtaacgtgtgactaatgagggttttatttcctcctttccaatcattttgctttttatttcttgttgcacttgctctgtgctctagctctgtcgcactccatgtagacagacacttgtgcaaggataaggaacatttatataaaacttaaataactctattgggcatgattttttatgtgcctctacatcctcccagaaaactgtccctttctccatcctccttaggcaaaacttatgcatccttcaagtcttagattaaacacctccttcaggatgatttccttggcccttctgagactgggtgtactgcagggagtgggaattctttgttatccaaggtgattaagcacagcccttaggtcatttacttcaaatgcttgtttgcaactttgtctctcctgctgaactgcaagcccttcaggggcagaaattctgcaatgttcattgctatatcaccatcacttagcagagtgtagggcatatcacaagcacatgataaaggtttagcttatagttctcctcctcatccttgtcctgatacttgtcctcatcttgttctttctcatttacttatggaagcatggccctcatcagtatcagtgtctattgaagtttagcacaaacttttccactagtgtctttttcactaggtcacaaagtcctcaagggcaaacatcttattcttcatgattgtatccccagtgtttaacacagtgtctacgtcttaatagacagttaacaaaagtatgacagagtgattatgtgtataaatacatgaatgaattggtggatgagtgctccttgttataagaaactgaggtccatagagaatgagttgggtagcaacttaagcatactcattctgtaggattaccatatacgcctaaagccaaaactaatgccttagtatagtttgaatttccctttgcccagaaggtcctcttgtgaattcttctagcatctttctccatccatccagaattgcagtgtcttgaggaacttgcttgcttttttttttgtttttgttttgttttgtttttgtttttgtttttattttgacagagtcttgctctgtcgcacagactggagtgcagtggcgcaatctcggctcactgcaacctccatctcccgggttcaagcgattctcctgcctcggcctctcaagtagctgggactacaggtgcatgccaccacacccagctaatttttgtatttttagtagagacgtggtttcaccatgttgctctcttgatctcttgacctcgtgatcttgatctcttgacctcgtcttgatctcttgaccttgtgatccacatacctcggcctcccaaagttctgggattataggcatgagccaccgcacccagccagccaaggagctttcttttaaaagtctcttgagatggagtctcgccctgttgcccaggctggaatgcagtggtgctgtctcggctcactgcaacctccacctcccaggttcaagcaattcttttgccttagcctcccaagtagctgagattacaggcgcatgccaccacaccaggctaattttttttatctttagtagagatggggttttaccatgtaggccaggctggtcttgaactcctgaccacctgcctcagcctcccaaagtgctgggattacaggcatgagccaccatgcccggccaaggagctttcttaaatcatcattttaagcttcaagaacttcagaaaacacagaaataattttcttactccaataatcaagaccacatcatcttatttattttcaaccttctttgtctgtcttttcttcccagaattaaagtttggtttccatctgagcaaccctctctagacccaggcatctcaccccttcccggctctgttcgtttgctgcctcccccatgcccaccccatgtgtcttggttgctttgctgtttcaaaagttgggaggtgcatttttaagttttcagacaccacggatttaattgcaactgccaaggtctagtcagagcttgggaagtacctatttttcatgatctgtcatcaggagctgtgataactcagccatgagctcacaacccagagacctgcatggcacacttttgaaaacagaatgaagctctgcagggtgcttctccagaatccctcactccaacaggcaattgcctccttccttctttcagcctcacctggaggcccacccccgctttggtgttaaccttcaccttgcgtgccttcctcgcaggcatcattgcacagtgccttcccatctaaaaactttatttcaccccatgcagaagggctgagcagcagagcagctcccaacagagactgtgctttattggagagcaggcctgggttgtgttaatgccagctgacttgagaaccacaggggtgtaggcagggccaattaacaggtgagatcagggtctcttaaatgccagctactgctccaggggtggtaggtcactaattgtagctgcactcctgcccttaaataaatacacttctctagcaagagggattagttgcttgcttacttctccctttagccgtatttatatttaattgaaattctactttttagaggttcacttgcaagtcactgttttgatgtgggccaagactagggttaggcaagctaggtacctgggatgcaaaatttaaggaggcctttactctcaggtgttgatcctgcacttgcctgacacagggaacaagtgtgtctttaaatgtcacgcactgcacacctggcttgtctcaccccattccagctcttttttttttttttttttggacccagttattttaagcaagtgattctttaacacagattaggcaagtatggtgagagtcacaggaatgcaaacagcctccctccctcctgcaaaccttccctgtcatcttcctactgaaccctgaaatgttttattagcctgtaacaaacccacccccatgttagagctattgtttattaagagacttttatatgtgggttctcagctgggaccacacttggttattatttattgtcatctgacaaacctgtgaggttggttggtatctcagttttgcagatgagcaaacctggggttaggggaggtggttcttcatataaccagtgagaggcagagccaggattcgacccagtctgtctccagtctttctgactccccagcatcctatattcattgagctgcctttatacctaataggacacctgtcaccatgcaaggtaatgctattgaatttttcagcgacagatttgagtgtggaggaaggcaaggagccagaagcctgagcctgtaggggcccaggaaaagaatgcagagtggagattctagaggtaatgtgaaggaaaagttggagaggccctattctctgactttacctgttcacagctgggttgaccttctgcagaataaaatgcttctctctccatgttccatgggtcttcatccatccagctttgtatgatctcctgttgtagggttgctgcttctgtatgtaggtcaactcctgatccagcatgagctccttgagggccaagactgggcttgcctcagtgcttttgtgcagtgttttaatggagccatgcataaatcccagatttcttttaccactttcccagagaattctgttttgctcaaaaaactgttttgaaagaatcaaatcataaggaattatataaagcagaaattgaaacacgctttctttctctcaatgccccgctcccgccacggtccctactgttgagctggatgctccttcctccagaagtttctgtacacaaacacaaatgcaccaacacaaacccattcatagagacatttttaaaaaatttttttccagtagcacagtcaaacagtgcacacgttttgtggattctctttctctatttaatagtgcaacgtagccttgggtcttccagtgcacacagaattgtctcatttgtttagcagctatgtgtagatgtactataagtgtttaatgtcttctgatgatggatacttggattggactgatcttttctggcagtgaacttccttgtactaaaatatttgcacttttttttttttggcttgtatttttatggcttggagtcctacagatggagttcctggggcaaataatatacactattggattttggaggatattacagagttgttttcgaggaggctgagcaggctttctttttaaattatgaatgggaatgcctttcctttgcttctctacttgaacctcattaatattgtaccaatctttagaacactttagtcattgtgaaaagttaaagatgagatttaattgctgtcttgatttacatttctttcatatattaataactttattttttatgtgtttattgccattagtattacatgttcattcccttagtctatttttctttgggactgtttgtctttctctattgaattctaagagcttttcttatgttgggtaaattagacatttttttgtcatacgtataggaaatgtcttccctagttgtttgttctgtgggttattgttagtagtagcatcttttacaaaagccttcctatatttaaatacttgtgaaaattcagattaagggcataagttttgaatgcagacagatctgagttcaaacacaggccacacagcttagtttgcagaagtcccttaaaatatctgagcctcagtgtccatgtgtgatacttagaagtaatgagaaggagataatggaacaggttaagcattgaccaaaatagatggaattaacagaggccagctccaaaagtcagaagtgggctgtggcctgttgcttccctgatctccctttactccccttactgtggctcttccctaaaactcgtcttggtctggagcattgattccccctaaatatgtcccctccatttcccactccaagaaaagccagatgagaaaattctgttgggccccttcctgcttaacagaagctggaaaaagaagacattccctaagttaagtggaaaaagaagacattccctaagttaagtgtgtgttctgccagccagtccatccggccacctgacaaaggtcactccaacattctcccatttacatggctggaacttgctgagcctcatcatttcagcctgagatcaatttgctggattttcatttcattttcaagttgtacgttccctctttcactcagactagtaatttcaggggctatattataattttgagttgttgcttttttgagacattacaaaacattaaactgcatttagccttgaattgtcacttaagattattgcaggaaatgagggctttctcgatcacaaatgtgacaatagatggagaacacagcttctattatgactaaatggggacaaagagtgaagaagagttaagtacacagccacatcttatgtgggtgccaaggagcccagggaaaccgaggccactgctggaaggatgaagggctgggctcggtggtgctttgggaggccacacatgcaccagggatgaagcagagcccccttcccacataagcaggcaaattatgaggctgcctgggttttcttatctcccattccacccaatcctcctctatcttcagcatcaccctcacaaaacctttaaaggccggcttcacttaatgccaggctgctggcctgtggttgtggaggtccctacggaactgagggcgtttagaagatgggagaggggccaagggtggacagccctgggaccaggatgtgaaggctgaagggccttgcccttttgtgtttcttcagtttgtggcagaaataaacgggaactgcccacagacttcctgggagtcggcaggcctggtaaccccgaggacggacccagtagcaccaggcagtggggcagcatccacctctgctccataactctggctgctacacccccacaggcccttttccagggtgctgggttcctgatgcagggtctgcagcccagtgcactttcttctccacccgaggccaacccagcaggtgcgagatcatggtgaggtgcacaccaaccctctcttttgccaaggccaaatttgctgtggaatcaggctatgcacatccttagcagaaagctatgatcacagcaatttgaggcactggactgggtggctgagaaatccagtgaaagatccggcaagcatgggtaagggccctcgcaacaggctccatatgtcctggctggtttgcccaccgagcgtgtctttggtcccagctgggaaggcagaactgacctccaccccttgagccttcaggggcagaaccttgtggcaggcagtgacagtcccactttgtagacagtcacagaacggccaagaaaccaagtagagggagctcatgttcaaactatttctacccagttgtgcttcatttctatgggcaggaaggctgacggcttctccccagagtgggagttatgtaagaagttttcatttaggaagtctctgtcccctggaacctgtctaggcacagcctcctgggaggaaaggtggctgtccaattggtgcagattagacctactttccttgcactggcctgggtagttaggcaatttggtttcagatccttgccatatactctcatcagtccttggggctcagcaaccttttatccaaaggctcctccccaacatacacacagacacagacacagacacacacacacacacacacacacacagacacacacacactctccacaccctacaccccacaccacatccccatcacttcaggattgcctcccaaacctgccctagctctctgaatgaggcctgctcaccagccccttcacctgcgcaaatctctgccctttctcgtgctaatctgccaaacccactggtgtcaaaatgctcaactccttagcggggctttcaagcctttattgatgtggtccaagtccccatgcctcagtcagctggggtctctctgttcagaattcagattcctgaacttcttcctgagggtgaggcccagaggtctgtgcttgtaagcaactccccaggagaattttttttacatgaaagttgataaatacccaggcagttccctccggaggcaggaggctgcagctccagcatgagttgtctcaagatgccattagtggcctcagagaaataagccctggggactggaggtttgcccagagggttcctcatgctgtgtgccaggatctcgcaatatcttctggcctgtgactcagtcatgaaagggacattctgaggagggggacttcagctactcagtcacccctcccatctcagtttcctgggactgtgaatctcagaggccacaccatctccagtttcactgcaaaccctgccccacagcccctgtgtcaggtctgggctcagacgcccctccttcccccctgcgtggctcaggtgctccacattaggcagggaaggcctggcatgaggagtcctgtgtctacaagttgtcttccctgcctccctcccagtgtctcttggggctaggtttgcccagacacttcccctcgcctctctgttttcccttctctctccttcaccagtgggtgctattgaactcagatcacaaccttcacattttatttttatttatttagttattttgagatggagtctcgctctgtcacccaggctggagtgcagtggcacaatctctactcaccacaagctccacctcccaggttcacgccattctcctgcctcagcctcccaagtagctgggactacaggtgcccaccaccacgcccggctaattttttgtatttttagtaaagacggggtttcattgtgttagccaggatggtctcgatcacctgacctcataatccacccacctcggcctcccaaactgctgggattacaggagtgagccactgcgcctggccaccttcacattttaaatatgtccattccccagagaaatcgggaaagacctgttgtgtgtctccggtgcttgagtagtttccctttgaccgcagctgcttccctggcttcagccacccatccctagagtccctctcccagctggacctggaagatttccaagttcctgcctcatatctggaattggctgtgctgaaaacgggtccctgaactcaggtgaattcccttagctcattaccagtgtctctcagagagcaagttaacacggaaatgcaagtgtcaccagcgttgctgcagatgaccatgacttggcgcttacctctccctgagcctggtgtctagagctgccagtgcccaaggtctcagcagaccacacagagggtgtcagccacatgtcttgacttgtgataagtactgctttattctgttttccaattgattggttcagaacctgttctaccatcagcactgccagctctctgtgggagagtcagtgcctgagatgtcgcttatcacctacaggcctgggcaaatggcccatgtagtctaacacttgtcaagttgccattttgaggtacaagtagggacagctggggtgccacagaaggtttgagtatggtggaaccagagagattccagctcagaccctgtctccagcccagccagctggtgtctttggacaagcctgtttcccagctgttaagtgggttcagtgatgtccatcttccaaggttattgcagggcgtgaatttataaaaccccaagctgggccttgggcaatgcaatacattgcagccttctggttccttcgtcctaagtaagaaggcatcttctctatttccagcagcttccatagggtgctggggtgtggggcattagagaggtcctgtcacaaatctcaggctggcgatgagagggatatgcatagagatggccacctgtccacctaactctgctcatgctctcctgccccagagggtactcctgctgaggtgaggggtcccctgggctggggagagacctttgagaaggacgatggaaaaataaaagtctgccagaattggcagggtgcagtggcttatgcctgtagtaccagcattttgggaggctgaggtgggtggatcacttgaagtcaggagttcgagaccagccaggccaaaatggtgacaccctgtctctcctacaaatacaaaatttagccaggtgtggtggcgcacacctataatcccacctactgtggaggctgaggcacgagaatttcttgaaactgggaggcggaggttgcagtgagctgagatcgcaccattgcactccagcctgggcgacagagtgagactccctctcaaaaacaaaacaaaacaaaaatctaccaaaatatctaaggtttattctgagccaatatgagtgaccatggaccagggaaacagtctcaggaaatccttagaaagtgcacttgaggcagttgggttacagtttggctttatatatttcatggagtcagaaattgcaggtaaagccataaatcaatacctggaaggtatatattgattcagcctgaaaaagctggataccgcgaagcagaagcttacaagtcataggtaggtttagggattctttttgtggcaattgattgaaagacttaagctttgtctaaaaatttggagttgatagaaaggaatacttaagttaaaataagggggtctgccacccatcatgtgatgccataccagaagaaggttgaaaagtgagccacattgtagtagatcaaaaaataagacctgttggccaggtgcggtggctcatgcctgtaatcccagcactttgcagaccgaggtgggaggatcacaaggtcaggagttcaagagcagcctaaccaacctggtgaaaccctgtctgtactaaaaatacacaaagtagccgggtgtggtggcgggtgcctgtaatcccagctactcaggaggctgaggcaggagaaacacttgaactcgggaggcagaggttgcagtgagctaagatcatgccattgcactccagcctgggtgacaaagcgagactctgtctcaaataaataaataagacctatttaatgagattttatggtttgtaaggcatgactccccaggccccttcaaaaggaaaaaaaaagtcagagctcagtcctcaagaagcttgcccaagccccagagaggcagtggagcccctgggatggacgagggaagcccagcacagagtttcattgacttgcctaaagccacacagctgggaaaacccagtgccctggactccacgctcctgataccgttgaaggaagatctgaaaaagaagggctgtggccaggggcgcctgaagggaaggagagagggacagtaaagaagagtaagaaaagaatggagggagaaggaagactgggacagtctggtgccacctcaaaagtcaggaataaagttaaagcttataaaagaagttaaactattccctttatcccttttcctcgccctgcccttcaaaaagcgaaggcaaaaatgactcagcattcagagccccagtccggaaacctggctcctcactaactagctgtgtggctttggccagtttcctaacttctcttgatgtttctttcctcatttacaaaatgagaaggctgggtaagatgatctctgttgtctcttctagctggaaacatttctgtgatgattaaagcaaaaatcctggaaccccttctgctgtgattgctttgaggtggagaagcccgcacaattgccttgggaaggtggctcactcctttttagttcagccaaggaagattttggaatgatgggaaagccagaagcagcctggagctgatgctccagggtagaggagcagcccactcccttgaccaccccctcacctccaccagcagcccaagatccttctgcctccctggaaatggcttaatttacatcacagtaacctgcttaaaaggaagccagggataacctgggtgacaacatgagtttgctaggggctaccatgataaaataacgtgggttcggtggcataaacaacagacatatattgtctcacaattccggaggctaaaagtctaagatcaaggtgtcggtagggttggctcttggggcttctctccttggctcacagatggccctcttctccctgtgtctttctgtggttgtccctcttgtctgtgcatgtctgtgtccaaatttcctcttcctgtaaggacacaagtcatattagattggggctcattgtaatgaccccattttactgtaattgcctcgttaagaccctatctccaaatacagtaacaattagatgtagcagtggttagagatgcaacatatgatcttcatgatagtgaccatgacatttattatcaatgctggaataattcgaaagaaatatttttgaactttttattaaagtttacaacatacatactgaaaagtgcacacattagatgtttatagcttgaacatactcacataaccagatgactagtactcctgaaatttctgctttgtgtcctcttgtacttattccctctcaggtaaccatcattctgacttctaacaccataccttagcttctcttgtttttgtagtttctctacaaaatcaaacaaaatgtaatcttccgcatctgccttcttcagtggacatatgtttgtgagatttgctcatgttctagggtgcagctttagcctgctgatcctcactgctgtgtgcagtgtatagtatgtcgttgcgtgaatattccacagttagtctgtgttttctaccattgatgagcttttgtgtagttcccagtcggggatcaatatagacctgaagatcctagtgcatgtctttaggtggacatattttacccttttctctttgcatatacttagaagcaaatttctgggtcataggttctgcacatgaacagctctactagagactgtcaaacacttttccagagtagttgcaccaatttacaacccacgctggcagtgtacgggagttctaggtgctccaattttttttttttttttgcttctacatggcttttttacttctacatggctttttgctttgcttctacgtggctttttcccctctacctttcttaatttggccattctgttgagtacatggcgacgtcttgctgtggtgttaatttgcagttatgtgatgactcctgatgagggacatcctggcatttgttgactggccacttggctggcctccttcctctgtgaagtgccttttcaagtcttctgcccattttctctattggattatttatctttttttcttgttgttttgtaggaatactttatatattctccatgagttttctgctgattgtaggacaatttttggagtcaaagtggggagttgtggataataagctgtaataagtgccataaaccagcaccactagacagattggcaaacttgacttctcggcacatagtgcattccagttttacgaagatttaaagagacaaatttggaagcaccaatggctcatatgagaacagaagggggggaaatgccatgttttcagtatacagctttatagggctttcagttccttctcttcctacatctttttgaagatgttcaccttcagagtccaacattggaatgagtttttattcctctgtgctgctgattcagcactctgttttctatatgtctgtgatcatctgccttagcttcattaaccttctgacattttatgattctcttagtccaaccccccaattttattaataaagaaacaagcctggctgggtgcagtggctcaccagctctttgggaggccaaggcgggtggatcacaaggttgggagatcgagaccatcctggctaacacggtgaaaccctgtctctagtaaaaatacaaaaattatctgggcgtggtggtgggtgcctatagtcccagctactcgggaggctgaggcaggagaatggcgtgaacctgggtggcggaggttgcagtgagccgagaccgcaccactgcactccagcctgggcgacagagcgagactccatctcaaaaaaaaaaaacaaaaaactaaaaaagtagcctaaaatggttaaatgacatcccccaaggtgacactgctggttagtacagagctgggactagaatccaaggctactgtgcttttctccaaaggcatcttcacaagtctttagtatttaaatcaacccataagtacctttgaccatgtacagggtcattggaggcattggtgtcagctggaatattggggttggagggcaggccctggcctggaagctggaggacttggctgctgatgatagtggctcagcgagcagcctctgctttcacattggcgagataataaggctgcactacagtgtcctctgacagcccttccatccctgagttctacatccaaaaatgtctcccctgagggaagagaaaggagagctggttttttctttttttaaacaagaaccaagtaaataagtatggatttcctttgaaaggaaatgattgggtttctctagtcaataaagagaaaggagagaaatagggcttcaaataagtaaactcctttgtgatgtgagtggtattgaatagtctctcagttcaaatgggcaaaaggaaatgtctgtttatggttggaggcctccaggttatccctgagagactaagtgatgttaccttaggaggctgaacaacctccccgcaggccactacattaaagacatttatataattgagactcttatggttggaagtaagtgaaaaccatattcacattggcttaagaaaaaagaatgtattagcttatataattgaaaagcctataggtagatcctattttaggattgtaggatccaggctcaaacaatattagaaataattctttctccttctcacaatgttatgtctttgccttcctgtgcattggcaaaggagagcttttcagggaagccgccccagtgttggggatgtcatggccacagagttacaggcttgttttcctggtttagcaactccagcagaatatttttttttttccagcagatgtcctgaggttgcctcttacgggcctgatctggatcccatgttcatcacggaggggactggccctgtgtccctgattgtccactgcttctctgtgtacccacctctgggtatagagagcgaggactacctccaacctgagctggagggattgtcagggacaatggctccccagaacatcgggtactcttactggaggaagagaggattagttttaggcaggcatgaaaactgctgtctacttaaccatccaagtacaacagtgtgcagaaaaccacggaaactcaggacaggatggtggcaagacactactttgtctttacctcaaacccaggattctaggaagcagagagaaagaaataatatttatcaaatgtcaatatgccgagtaatgatgtacagtctcattttagattccagtcatctttcatggaagatattagtttcccgattttgcaatcaatgaaaatgaagataagagggttcataacttgctccttagagttgcatgctagcaaataaaggggcctagctcataaacaagggctcttgattctaaaatctccctcactgcacagtgctgttttggaaactgggttttcagtgcccagagctgtgtgagtcataaacataaagttgaaaggagcctcggccgtgggggaggagaaaaagatctagcttggattttgctccatccctagcagctgcccagctggacaacctcaggtgaatttcctgccttctctggatccccctttcctcatttacagcttggcagggttgggaaaatctatgaggtgttccaaggctgactgtggccagtctgtgattaagtgagggcaggtgactggctgtgccagcaatgacccaggtggacgcatcccaaagtggctcaggtgttatattttgggcttctggttgtggttctctactcctatcattccacccccatgttggtttcctcttttctccatctcagatgcatctcagggcatggactgcccccagcccccaaacatgcacctgagcaaatacagccttgctctgggaagcattactcctagaagagttccagaatttctggagcctaatgtcctggagttccagatttctggaacttgccccactggtgccctgaggctcctgccctactgcttcccagccttcctttctggcttgcactggtttgcttggaggagttatttggtttcctatgtctttctccatcctctcccagactcagctcagaatgcccacaggcttgggtcacatcaaacctgagagaccagcagactcaaatgtggtctctcaagtttgggagggccctggcaggagagaggaggagtcctgctcctcactcatgcagggccagcaggcagcctctccagaaaataattgggctgtcctttgccctcctgccctatctccgtccaggctttagagcgacctgaaactactctattctatctatgcacatctttctgggaaagaggataactgttttttctcctttaagtttgtaatcatttttctaagtaccattaccctagaaaaccattttctaagtaccattacccatttctaagtacccttaccctaatataaacaccctatattttctaagtaccattaccctaataaagtagtacatagtaatacgtgtgtgtgtgtgtgtttgtgcaatcaattctagtttagtccacaattgaggataagaccttggcacacactttaatgagattcagttttttccatatttttcaataaacacatattgagtccctactctgctgtactaggcatgtgctggaacacagcccttgccttccaagtgctcagagtgacccaggcatggaaattcatcactcatgtggttgtcctgtcttggaagcaagaacagtatctgggaggttctaaaaagttagggagcccttcccagaggagaggatacttgagctggtagcagtttcctggaatctgtcttgggcagagacatggagcgtcctggaattaagagtcattggaaaaaagctggagcactggactcagatggagactggtgataaggcttggaagacaggcagcagggaagttacaaaaggcttagatgtgatgctatgatgctaggactgtagtgtaagccacatgccatctggatgtcttgttaaaatgcagatcctgaccacaggtctaagatggggcctgagcttctgcacgtccaacaagctctcgggatatcccatgcactacactctgagtagcaagagtgaaggtgcccaggcatgactgagaactttccataagagagtgatcataattccttgaacctatgtatctaggaattctagaaagtgtaagtgtattgtctaatttgattcatataatgtgaattatgtgtaatgtgatttatatagttcatgatttttagatgtagatcctgcagtctagggaagttaaacaactagagttttgtagctgaaaagggctgcagaaattgaagacaacctctcaatttacaggcaaggaaactcatctgtcatctttgaggtcgttcctggtctaaaagcccaagtttctgtgattcgaatgtgttgctcatagttttctaattaaagacaaaagttgaatgaaaatcttcagtcagtcctgggaaaggccctaggcttgcttccctctctgggctaaactctggaggagggtgtgggattgtatctctggatgatagcatggtaaacatggaaacataatgctgggggtgatgcacttgaacttggtggacacccttgattggaagttcccagttttcaggctgctgtccactcattttctttgcaacctggaccaaattggttcaacgatagtgcgtcttattgttttcatctgtaaaaatagggataacagctctgtcactgcatggttgggagaatcaaattggcaggtcttcataaatgtattgttcatctaccatgaaccagacactatgccaagcactgcagacgcagacatagacatagacataggatagatccagcctcgaaccccatggagctcacatggcggtgcaaagactgacatccaagacacaagttctggctaattatgtccaagtacacagaatacagccaagaagtatgagggcaataaggatctataacaggaaggcctaacaaggaggtctcagacacttcttccaggaagaagtgatccttcagcagagaagtgaaacatgaataacagttaacaaggagagaagagagactaactgggtcagagccctgaggcaggagtgagttggctggcatcaggaaccaagagagggttgggtgtgaggagcaggtacagcaaggaaagaaggaagttcaaggacagactggaggaataagcctggttagatcctgtaggacttgttgaggattctggaccttattctaaggttaataacaagccatcgaaaggttttaagcaaggaggtgatgtgaactcttctgtgacttaaaataatcctggcttgtatggagaatggcttgagcaggagtgacagggagacttctgcctggtgtaagcaggagatgatggtagtagccccaatcagggttgtggcagtgggaatggtgagaaagggacagatttgggaggtataactggcaagcttagggatcgattggatgtgggggtgagaggggaagaagtaaaacaggacgacttgcaggttcccagctagaaaacctcaatgcatggcattggaggttattatgattgggagtagtgcagagagggcagctttgggtgggtagctgatcattaattcagtttggacatgtcccattgtaggtatagataagctctccaagctgtgatgttgagtaagtagttggctgcagggttctggccatagttgtctactgatgctggtgacatcgatttgggaattgtatatccctagagatgatatttcaaatcagagtgacggaggaggtaccccagggagagggaaaaagaagggaggtagagagctgagggcagctcctggaggtgctctgccatttggcgattatcaagtgagataacagatgaagaatagctttaaaaattaaagcaggatgttctcattgttgcgctgtactgtgcttactacgtacaacaatgtgcatctccgacatttactgctgcacttggatgggagagattatatttaatgttcacaaatttgcaagactatttcctccaagttattttcacccctattaaaagaaaagcccaccaggagggatttattcttatcatgttgtgcaacagcaatttcattttcaaatcattaacaggaaggcatcctcatctgatcattcttgcctcaaaaccctatcttagaagcctgataccatctcaaccttcctgagagctttactgatttctgttgagaccctcagctctaattcaaacacagtgtgagcctggctcctgtgtgcacctctcttagtatctctcccgtcagttgattttgtttttctgcctctggtcctggcatttggctgcagattattccaagaatttcattgctaacttacatgagatgaacagataataagaaatggaatttattttctaatttattttgaaactgaattccagattctgtttatggggaggggcggagtcagcctatgatgagtgagaacagtctttgactcaatttaaatgaagtttttcttcttcttcttcttttttttttttttctgagactgattctcaatctgtccctcaggctggagtgcagtggcacaatcttggctcactgcaacctctgcctcctggtttcaagcaatcctcccacctcagcctctggggtagccaggattacaggcatgcaccaccatgcccagctaatttttgtattttactagagacggggcttgccatattggctgggctgttcttgacctcctaacctcaagcgatctgccctcggcctcccaaagtgctgggattataggtgtgagtcactggacccggtcaaatgaattttcatgggcaagtttccttccccaggactgtttccaggcctggcagtgggggtggggtggaagttcttgctttccataaagtaaatccaatcaaaagcagacattctgcaggagtctagcttgccagactcctattcaaagctagtttgcttctttttagcttctctcttagcaacagaaaagtttattgtgtttcccttacaagtaaaaaggcccttccttgtcacagagaggcatcagagaggatctttatttcttgccagctgacattgtgttcttcaccatgacacccacaggaagaaattcattcctgaacttgtggccatttcaattgaattaccttaatttgcatttgcgactcagaaagcattggacttttgatctcctgaggtatgctttccagacaaagcagctggctggggctgtgtgtttcggtgcatgaactctggaccaggctgcctggtcaaacttctggccctgacactttcctgctgtgtgagtttggacaggtcacctaacctatccatgcctccacttttctatttgtataagcattgaaattcagcagtggccacctcatggagcttattgtaaggtttaaataagcaagtgcaagttaagtactcagaagagtgtctgtcatacatgtactatattaattttagctgagtattacctctcttctggggcagatgattggattgtctaataaggagtatgagctgccattgatcactgctgctatgctgagtgcctgacatatgataatgaggtggatactattattttatcagtttcacagagatataggtccatggtcacacagttaataagtagtggggctgagattcaaacccaggtctattttgactccaaatcctagtcctcacctccccactgctgcctccactgtacactttgcctgaagaatggggggtaaagagggtaaagaagcaaggtcaaggtcatgtggaaaggtatttttggccaattaaccagatgaccaggcagttctagagcatccctgccccttgtcatttcacctggacgggaagcatgtgagcacagggagttggggaaaggctcagagctctagtccttgggggatttgcaatttttccctcttgttgtaatcctaccttctatcaatttccccctttattatatcctctactttttttccactccttatctttaaactccaaatacctctgtgtgtgtgtgtgtgtgtgtgtgtgtgtgtgtgtgtgtgtgtgttgtaggagttaaggccttagggcagagtgggaagagctccatttccaggtagtggaaaagaactttgggctgttaaacaggctgttaatctggtcctttctctgctactgaatagaagaataaccctgagaaagtcattgactctttctgggccttatccatgagtttgggattgaggattggaaggtatctgacatcctgtggttctagtcagccttctcctagatctctgacctctaggagtggtcttggtgacagtgatgatggtggtggtgagtactgatggtggaggaggtgatgagataatgacgacaaaggaagttgttggtagaggtgttaatgatggtggtggagatagaggtgaatgcttggtgattgtgacagagacagaggtggaagtcatggtagagatggtggcagtggctgtagcagtgatgttggtagaggtggaggtgatgatgttggtgggggtggtagcggcattggtgttggtattgttggtggtataggtggaggtgataataatggtggtggtgtggtagcagtgttattagtgttggtagaggtggaggcagtggtggaaacagtggagttggtgtagaggtggagatgatgatggtggtggaagcagtgttggtgttggtggtaggggtggaggtgatgatgatggtgggggtggcagtagtagcagtggtgttggtgttcgtggtgatggagggtgatgatgatggtggccatagtaggagcagtggtatggtgatagaggtggaggtaagaaagatggtggtagtggtggtggtactggtagaggtagagatgattctggaggtgagatggtcataattgacagtggtccttttctgacagcagtcactgtggtcagcactatcccttcagtgtctcctttgatcctcctggcagctagtgttatctccatttgcagatcagaagcccgaggagcctgaactttagagagtaaggctgagcatcttggtgctgggtggaactgttccagtcaggtagaggcaaagccggaggtgtccaaggaatcctttgttgggaaatctgtgataggcataaggagggaggggagtcaatactggccatattcatgttttgtccttcccaaatcctttcctgtgacaacccagttgtgcccagatggaaattgagggttataattgtcagattttattccctgaggccacacagcatagagtgtcaaaatggcttccatgcttctgcacacgtcctctaagtactttattatttgtctacaaatttccttctttggcagcagaccccagccttatgctctaggtcctggcctgcagcttctctgacaaaggcttgtattgtccatggaggggaagggcccccctcaggtgaattattttggcataagtgaatgtcctctgatatgtctttggtaaacagggttttctgtgtcctgttatacccattgacttgcatatgtactctgtttgtaccccatagggccatcacagacagaaacagaaaaagaaatgagtttttagtgtagagaactcagggttaatcagtagcaaagggggcttcaggttaaagccacctgccttgaaggcagttgtcagaatccaagactcctcaacccctgtctagttctcctttagggctgagggtgctggtcttgtttggatgagaaagtgatcccttctctccattcccactctttctttttcttcctctaagtacagagatggaaatgagccaggcactaggccccaagcttggagggctaatactgacctctttgacagagaagctggcttcaaatggattccatagaggttcaccagagcccctcacctggaactctctttccctcctgcaaacatttattgagcagctactatataaacgttttctgttacacattgagaatacaacagtgaagatggagcatgttgccctccttgaatttctagtctagtttatactgcagtgttatgatgatgtgagtaggaatgaacattcttggtgaactcatagaagggaacttgatgtagacttgtgaagtcaaggaaggctccctggaaggagtgacatttaagcagaaacttctggactaagatctggactaagtgtgggcaattggtgtgagaggaatagggaggaaggaagagagaaggaggaaaagcaggggatgaggagggtgtggtctcagcaaaaaagcagcgtgtgcagaggcatggaggctaaagaaaagagatgggggagggggcctagcaggtcatggggcctggggcatagaagagtgccatcctatgctgtgaactgaactgtgtccctctcaagtcatacattgaagccctaaccccaaatctgactgtatttggggatcgggcttttaggagctgtttaagtttagttgaggtcataagggtgggactctgaataggacgagtgaacataaaagaagaggaagagagcttctccccacctctatacccttacttctgccatgtcggagaatgcagagagatggtggctatctgcaagccaggaagcgagccctcacccagcaccaaatcggctggcacgttgatctgggacttcccagcctctggaactaggaggaataaatttctgttgtttatgccattcagtctgtggtattttgttatggcagcctgagttgatgagtacaccccatatctagacaagggtagacagaaactactttcttgcctttagtccttgttgctaattctatagcagtaacaagaagtggtagctggtgtctggttttacctttggataatataggtcaatattatctcctagctcacacctcattctctcttctgggacggttcagctgtaaaaaagactcccatggaggaagctcttagctctgtgctccacccatgctgggcctccccaggttgggttggaaggccaggccctggctagccactcctctgcctcagtcacaggctttgggggctggtcctcccagggtctgggagcccactcagggatctcaggaaaggagacagtggggaagcagggtctgtaggcatgcttgtttgtctccacactcctgaaatgcccatgcaggagagacctggctaagtgcactggctggcttcatctgagggctgcatgattttaccagactctaaagggagctgggccagtgcaaacagcacctgcctgggaagccccacgtttggactcatgggctgtgtaaatttgggcacctccttccacttctctggggattctgctagctcatcagtagactaaactctgaggtcttttcagtgccagcattctagagttttaattctctactatttatagggagctgaattgtattaacagtgcagcctttcagctgttaatcagtgtttataagtggcatggctagagcccgtgtggtatgcatcgacttgctgttttggttgccccagctgcaagcttcttcattatatgctctgcagcttccccggtgggcttggaggacatcatgctcctcattaccaccacccactcctgtgctgtgtgttactagagaagtagcatttggcttcatctgccaggctgagagatagctacaggtttatgtagctgcaccacattttaggacttactatcagtggattgagaatagattgcatagaaagccacacagctacttacagttgagatctacatagaaaaatatttatttagcagattccagttgatcatttatcatgcatcataaaggtacaggagcactaaaccacaatgatgaccctaaactccatttactttgagtgcaagtgtctgtcctacagcttccagacaggagggtctattttagaaatatgtgtttgttatggtagtgattgatagtttttcttcttgtactgaagcttgtacagcagaatgaaatagctgtaatgcttagcaaattgcagcccatttggaatctggcttctgtggcacatttcagaggcctctggcctcaacgtggtggatggagttgcactggggagagagttctttcctgggctccatcaaacagctggaacaaggatgagacatcaaaccgtctgtcttcatggacagaggcagccatctgtggcatttacatcattttgaagttgtggcctgcgcctttctgaaaaccaaatcccaacagttcttctgtcttctaaaagaaattcctcagtaggaaaaagggcaagaaggaagatctgcataaacgaagacctccaagctgcaggtcactagaaaagtgattgcaaagtttccaagaaagtcctagcttggacttagaccttgtcagaggacatggtacctggatttagctctcagggaaggtgcagtcagtccatggtcaactgcatcccatccatgccgctcccaatgcctctctgccttccgttgacaaactcagcaatgggcggagattgccctctctgccacctccctgttagctattaaggaactggcttgaagctgacccaattgccttctcaagatgatccgaataaataatgggaagggagaggtgtgggctgggaatggttgcacatggcttgatttgtggtgatcttgaataaagatgggtagggagcaagagggaaaaatagaagagaaaagagatgtgattgctttacatactggagaaacatgtacagaaagaggagaaatggaagcaaaaaaggaaaggtggggaaaaataagaggaaaggggagggaaaaagagacagagggagaaaggataggagaagaaagaagacaggatgaggaagagctgtgtgtggaaataagtgggactggcaggacggttgtctaggagtggaaccagagggagggagtttggagctaccgtctgctttgactgtagacactgatgaaaatgtgatgctttaaaggcttcagtgacagtgctagggtccctacaagtgcccactgagccaggggctccacctcaatttatgcttctcttagaccagtgttctccaacttgtgtgagcagcagagtcaacagagggcttgttaaccccagattgtgggccacaccctcagagtctctgattcaggagatctgggttggagcctaagaatttgcatgtctaagaagttcccaggtggcgctgatgctgctgttccagggaacactcctttgagaattctgtctcagccgttaaagactaaaccaaggttggtgctgatttggacgcctcgggtcagacaaggtcagtgagtgagatcaacatctcagctgacttgcagaagcagattgcaaacactaacatataaattgagaaagtgctaaaatcttttattggatgtatttgtctctttctggctcttcattcaactaaccatatgcttactttccactggcaattgctatttaaatgtcagttgacaagcagatgcttctcaccctactacatgcaagttaatttattgtccacaaagcctgatggagtgctctctaaccatgctggtttcccactgtccccacccacccttttgttgcaaccacgctgagccttgcagctcacagaaggtaagttgcctttgtgtttctccatcccctgctcatgccctgtctctgctggtgctgcccttttccaggctgactcttactctccttaactttctgtgtgaatgttcttgcctgtgggaatgtttatccagctcttgttgctgcagtgttgttcggctcagaccattctcctagcccttagaaaaccaggctggggccaccttgtacagctcagctttgtatcatcagtccctaggacaggatccttaataggccccagccatcaagaagcaattgccaagtaaataagcaaagtacagagaacttgaatggggggataaaagggggataagggctgggggctggtggggaggtggagatgtctaacccttgctcactatggtcaggattagagagaaattgaaaaatagagacaggaacaggcaggaggaggacagagcagacataataatcacagaaatcctaaatcatcatcaacatacccctgcaccctcaaggcttcaatgattccataaaatgggactccaacagtaagtagaaaagctaatattgggaatttatttaaattacacaaaatatctttgcttgggaggtgatcaactttccagatattttgtgcttaatacaagctaagtatccatttttagtaggtacttatgtaagatggatggacggatgaatgggtagaagagagatgatagatagacagatggagtcattgtaggctaggtcaccaagtcatgacctgaagtaatattttgttttaatcttctttggctcccttgggctgggactttaccttcctttgagcaggaaacgttctccagagttttgccaaatgcctgttcttggaggacccgcttctaaaactgaagcaagacagtgcataggaaaggtgttgtatagacatgccacttgctgcatcccatgctgtcaatggtcagcacttgagtctaaagctggaaaaaaaccctaaaattacagttaaaaaaaaataatgggcttgcttggcaatcgagggtagaatcaatccagtgttctaagtagtatgaccaccctggccccaggagatcttgggcaaatcacttaacctcagtttgctcatgtgtaagacaagggagttacaaggctggtctcaaggtctcctcttgatctcctgatctctaatgactctaagatggaattctggggaacacactagtagttactttgactttaaaggttagaggggagaaaatagagcatggtgtcagatacatcaatgccaccatgtcccagcctgcagagcttaatgcacttaagatgaaaccaagcaggctgcctctaatgctgttgaaatgtcaggcttcagtgcagggtgttgttagacatctgcatttcttctgttttttaaacaacatgactctgccaagaatgaatctgtgtcatcatctaatggctcttgtcattttagtgtagtgatcaaggaggaaaaatgaaagtactttatgtggaaaaccagataagaaggtatttcatagcccagagtgcaaggctgtctggagtataatacagatctatcagtaattcagttaaaacagtttacctgctttacatgagtgggttcagttcattgatcttcattcaagttcacactaaagttatttaactgtgggctgcacattacaccacacagaccaaagaattatagattttttccagatgtgatatacaaatccaaattgtgattgcagccaaacatgcatttagtcaaatctttaatacactctattagggcgtgaataagactttaaagctttgtcttagccacagggtagctgggctagagtagagccaatcgcaaacagccagaatagaaagttaccttgggatgcagtatttattctcaacggtgtatcatctagaacaacaaactttttttaatgtaaaaatgagcaattacttgtcattataaaatgacaaattttacaaggggtcaaatttggttttcttcccctgagaggctcacctccattaccgtgctcactggtacatgtctcatgtttgtcattggctgtacctgtatgcctaatgctccattttcctagagcaaaactatctttcaaaacacaggaagaaaagcgccagccattttccccacctccagttgaggcaggggaagtttatcccaacagccctgccaagtagttggcatgatctgcattattctaggatagctaggcaaagtttagaatgagaaatgcaaaatacatccttgtgttttcaggattatataagttttaaatgatttagagttcccttatatggaaggctttctaggaaaagactggctaaccctgttcctcgctatagctgagaatgcatactcagagatttaattcagcattggttgcattgtagtgtaacaaatacaggctatgtgggaggttccttggggcttccttggtttgatataactctctggaatgtggttgttaaagggacagttgggggaatgggaagagggggagccttgctgctctggggaggggctaggaaggattcttttagtgggtgctgtccaatactgtagacactagccacatgtgtctcttcccaactgaggcatactgtaagagtaaaacctatactgggtttcaatgacttagtattaaaaaatgtaagacatttcatcaataatttttatattgattgcatgttgaaattacatgtgaaataattattttgggagtgtatcggattaaacagcagtattaaaattgttttcacccatctctttttctctttgaatgtggctgctagaaaatttaaaactacatatatggctcacattctgtatttccagtgaacagcactgtgctatatccattttacatggtggaattatggtgtttactttcttgcttgtgtttctgtatttttcaaactgaaagtatgaatagcaaacaatattgtgttttgagaaaaaaatacacagcatggattttggagtctggcaaagatgtgtcctagctattgcacttgggcaactaactttctctgagcctgcacttcctcatttgttaaattaagagaataactattttgacctcaccaggtcaaagctctccaggttgttgtcaggagtgagaaatgcatgggaaattagcagagtgcttagcacagaaactggcttaggaaaaactcagtaataaatattctgcattattataggttatttcaaaacacccatctggtgcacaatatgaaaatctctgcatttctaattcaggtctttgtctctcttgttctacaagtttgttcttgctattatatctacctacttttacacccagaaaaccaaacttccccttctttgcctcatcattgtgactctgagttggttttctgttacttgttcacactgagcttcttcccacttatttttgacttcagagcaggaattttatcctggctacaaacaacaccacaactctttatctacccctgcctttgccttgtacctggaggctgggtcttgctttttactgaactctgctgcttttgatgggatgatcagtgaaggacagttgacaccaggccagtgcatgtgggaagctgtcagaagagtaagggtcatgtaaacaacagatcaagagaatgaggagcaaagacagggcagaagaaaagcaatgttatcattctctccccttgtttcacaagcctgccttatcttctcattgcctttgtctgttggctttaaaagctgtgctatgttcagctcatggttagtacaaggtgtttctaattgcctttctggattctcaccgcctgaagtacaacctcccatggtgtagcacagttcacatctaaaaccgtgcaatttccatattctgggcaataactcctcagatgaagatggttgtacatgttctctgaaattcagtgacaggaaagagaaaaaaaatgcaaaactttgtgaaaatatgtggcttcctcaggtatggtctttttcctagttctttcacaattaatgagatgagcctctcaatcagagctggatgagatgcaaacaaggagcaggaacttaagatgaatttggaatagcacaagtggctgggaacacctgtactcctcgaagtgggagaaaagtcccggatttcttatgtatttttttaaaatcagaaatttttgttgttgctgttgttgttcctatccagcatctgtaactaggtgattcagaataaactcttgaattaagatggtatttttttaaccattttttcatcagatcaatatgttagttcacttattttagttttagatttactggatgttctcaggatagcaaactcaaaggaaaaaataaacaaattggcttatatttcaaagttttaggctgggagttgacaggagaaacctgtggaaattaacaaaggagaagagtttccaaggccttccttgctcacatatggatttgtggaggatttgaacacagctagggtcccctccaacagcaggcaaggaatactcaggccagtgcatacaggaggctcaattctggatgtgtgaatgtggctgttttttcctggagcatttatttattggtttattgagacagtttcactctgtcagccaggctggagtgcagtggcacattcgtgtctcactgtagccttcacctcctgggctcaagtgatcctcccgcctcagcccccaaaaagtatctgagaccacaggtgtgtatgtaccaccatgcctggctaagtttttctttttttgtagagatggggtcttgctatgttgcctaggtgggtctcaaatttctaggcttaagtgatccttctgccttggcctcccagagtattgagatatcaggcatgcgccaccatgtctggcccccatttattaatagaatatttaccatgggtcataggcaggaagcattcattgccaactgtcacttccctagggtttctagaaaatcagaagattgaaaatgtgagtaaatgtttcttactacgattgaaatgtaggagaggaaggaagcatttctgaaaatgcaaatcctgctttaaggtagcagctctctacaggggaatttactgtgggtgtcttggctccttacgaaaagagagagcaaatgcttcacagatcccctgatcttcctttgttcttttttgcttttgtcactgtaactaaactctcatgatacctgtgatttcagttgtttgtggtctatgtagcatctttatctctgtcagtcagaattgcagaactggtggtggttacttaagttggaatacaaatatgtgggcatgcaaacaaatgtacatgcagtaaacatttgatctacagaagggcctttgagtggtctcttctctagggcctgattgcttctgggctgttgacagcacagctcagtgctgcaaaggaagggaacatgttactggctgaactagaaggaagttttatatttgccatctctgaataattctttttccccacatgagggatctaaaagtgtctgaaaagaaacacatatgctgttgcagatatgagcatcatgattataggtgtgcatacctagtatgtatatgtccaaaaaacattcttggcgacaggctattcctgactttgcttcccctgaaactgaatgcaaaaccagtgtcattaaatatgctgctttgttgccaaagggacacttcttccatttgatttaaaaatatcactaggtcttctttgtgcagacatcctttaaaatacaaacactgctttatctaatgcagctatactgtatgtatacatctttttctttaaaacaaaaaaagacaaaaccagatttatggataacatgaactgctttctggatacgcaaacaaacaccaatgaaaacatttttttaaaattaacagacatcaactggtataaatacactgtctaaagcatttaatggtctttctttaacacagccaactcccccgggtttgaaacagtgttaaattctctcttgcttgtggcaaaagaagctgtcaagtccaacactgaaaaattggtaccatttcctggccagtaagcacagaacagaggggctaaatattttatggttttattcatttactgtgttctcatgctgtgtttttcttttctctgtctctccctcctgctcgtgtctgcccagggctgattgttgtgacattggccgtatgctggatgcccaaccagattcggaggatcatggctgcggccaaacccaagcacgactggacgaggtcctacttccgggcgtacatgatcctcctccccttctcggagacgtttttctacctcagctcggtcatcaacccgctcctgtacacggtgtcctcgcagcagtttcggcgggtgttcgtgcaggtgctgtgctgccgcctgtcgctgcagcacgccaaccacgagaagcgcctgcgcgtacatgcgcactccaccaccgacagcgcccgctttgtgcagcgcccgttgctcttcgcgtcccggcgccagtcctctgcaaggagaactgagaagattttcttaagcacttttcagagcgaggccgagccccagtctaagtcccagtcattgagtctcgagtcactagagcccaactcaggcgcgaaaccagccaattctgctgcagagaatggttttcaggagcatgaagtttgaatgtcaagcgagggagccttgagtgggaactggccctccagccctaagaaaacgtcactctcactctgcagtctcaaactatgcccccatcagggatggaatggacactggaggctttacaaaaggcagatgcccacctcagtgacttctaaggactgactctgccagcctggccttgactccggttacacagacatgggggtgaactttcactccacctccttccttcaagtacatactgaaaattcagtcaggctgaatttattcagaatgctttaccgagctctttcattatttgcacaggaacaaaagagaacacggactcccgctccctacccagaataaaaggacacccagaagaaactcactcagggaggtggggggttgggggcgagggctggaagaacaatgcaggagggggtggcatctccttcagcttcagcagtgtgccgagaagagggctaatttgaggaacaggatggtggtgcggagccctggcctgagggccgaggcagaacttccccttttcttgggccttggcccgttacaaagaggggtgttgcagcagctgatgcaaactgagttcagtttccctggggagcagaaggactggtacccggcagaggcgatgagacaggccgctgatgatgcacaggacttgcggtacatgatccctgtaacacagacccaaaggagctgagttaacgtgcaccggcaaaagaatagctgtccctctcagcccaaatccaaacggacagctcttccttactcctcccacagcccagagactaggtgaggtcagggaagtgcttcggattgtctcattgatattcaagatagatggtgaaagagacaggcactatttcattagttttaacaaaactgttccaaaagcgatttgagatgccaatacctgtgaatacctgttaataaagagctgttaaatagacttatttacattttaagtcagagttcacactgtgtacaaga

SEQ ID NO: 319 - DNA, 24542 bp, Homo sapiens
aaggtggaagctttttaataaagaaattgcatttataaatgatctgtattagaatataataaatctccagttatagtcaattactacccatgttgtacaacagataccttctattttagttgctaataaagggctacacaactcaaaataaataaataaataaataatttaaaaaataaataaaaataaactgaatgaaattgaaaacatatcaatgtgagatgccactaaagtcatactaaaagggaatttacaccacttactgcctacattagaaaagaagtctcaaatcaatgcaaatcaatgacttctgcctttacagtaagaaaccagaaaaagagcaaataaaatccagtaagcagaagaaaggaaacaaagatcagaacagaaattaatataatcaggaaaagagagagagagagaatcattgtaaccagaagtttgaggaaaatcaaatcaattggtaaacctctagccagacagatcagaaaaaaacacgaaagacacaaaccagtctcagaaatgacaggtagcatcattaccaacattaaaaggataagggcatgttaaaaggataagggtatcaatagaatcaacaccttagatgaaatatataaaaaatttgagctctttctcagtgaccagggcctgtgcttaggcatagacgggcaagtggagccaacatgccagcggcccagagctgggtttgttgccaaacttatgtgaccctgcagagacccttcgagaaacctcatctcgaccaaaagctaaagctgattggtgagtatgggctccagaacaaatgtgaggtctggagggtcaaatttaccctggtcaagatccataaggccgcccgggagctgctgacgcttgatgagaaggacccacggcgtctgttcgaaggcattgccctgctgcagtggctggtccgcactggggtgctggatgagggcaagatgaagctggattacatcctgggcctgaagatcaatgatttcttagagattcctacagacccaggtcttcaagcttggcttggctaagtccatccgccacgctcatgtgctgattcaacagtgtcatatccgtgtccgtgagcaggtggtaaatatcctgttcttcactgtccgcctggattcccagaagcacattgacttctccctctgcttccctattggggtggccaaccccagccacgtgaagaggaagaatgccagcaagggccagggtggggctggagccagagatgacgaggaggaggaataagcctgcttgtcccctcctgggctggtggattgtctagttttcctgccaaatgataaaacaggatcaatgctttatttaaaaaaataaaattatgaaaaacagaaattaaggtcactcaagaagaactaggccaggcacggtgacacaagcctgtaataccagcactttgagaggccaaggagggagaatcgatgtagcccaggagttcaaccagtctgagcaacacagtgagactcccatctctaaaaacaaataaaaataaaataaaataaaaaattatccaggcaggccgggtgtggtggctcacgcctgtaatcccagcactttgggaggccaaggcgggtggatcacgaggtcaggagttcgagaccagcctggccaacatggtgaaaccctgtatctactaaaaatacaaaaattagctgggtgtagtggcagcgcctgtaatcccagctactcaggagcctgaggcaggagaatcgttggaacccaggattcggaggttgcagtgagccaagatcgtgccactgcactccagcctgggtgacagagcaaaactccgtctcaaaaaaaaaaaaaaaaaaaaaattatccaggcatgactgtggcacacttgtagtcccagctactagggaggctaaaggggaggatcacctgagctcaggagactgacgctacagtgagccacgactgcagcactgcactccagcctgggcgacagagaagaccctattaaaaaaaaaaaaaaaaaaaaaaaaaacagaaatagaaagcctaaatagccccatatccttaaaacaaggttccaaatgatctttttttttttttttgaaaagtctcactctgttgcacaggttggagtgcagtggtgcaatctcggtttactgcaacctccgcctcccgggttcaagcagttctcctgcctcagcctcctaagtagctgggattacaggcacgtgccaccacacccaggtaatttttgtatttttagtagagatgggggtttcaccatgttggtcaggctggtcttgaactcctgaccgcgtaatccacccgcctcagcctcccaaagtgctgggattacaggtgtgagccaccgcgcccggaccaaatgatctttaggagaaaaaagaaggaaatactgggggaggcacagtaggagatcacagcaggggcccacctccggaacctcaagtaaggacttgagagagaaggtagagtcagagtaacagagacacaggcgggttagccagctctgcatggaaaaggctgagtcgtgatgatgtcatggttctccccaaatctcaaagtcactgatcaaacaactcagtttacactgaagacgatggatgagactctaattttgtgcccacagcttgacacacctttgggaatttggtttaactttctttgccggtacacagatctgtgagaacatatgatcaatccagatctttatagatctatatcctccctggacaaacctaaatgcagacacttttagcacccgtaggagttaggtaggattaaataaaaacattccctcccacttgggggcacattcactgggaatcccagagcgatgtcgcctgcccacacctgctaagtgcgctcacagggcatctagttccctctcttgagttccttttaagcaagcaaggcaacctatgtccagagaagcagttactgtgtctaagtaagtcactgcatcttaggaaaaagcaaacattcgcattttgcagtgcatgatgggcgcacacccaagaaaattactcagcacttgtttttctcactttggggttttcccaaaataatttcttcagtccagttgccaagaatctggagcccccgactgacccatcaaggtccgatttggcttcggacacctcgcagatcaccccgcggctcagagcccggatcctgaagggcgcagcgtgggcagggggcgggcccgggagttggaacagagggcacagacggcccctcctcggaggggagggaccggagccggggcctttttctttaagactcgcagcactggatcccagaacttagtctgcgcggcggcattgacactagctgggctcctcggggcgcgccccaggtggtccgaagcccggtccgccctccacgcaggtgccccgcgctccccgctcagccatgtcgtcctgcagccgcgtggcgctggtgaccggggccaacaggggcatcggcttggccatcgcgcgcgaactgtgccgacagttctctggggatgtggtgctcaccgcgcgggacgtggcgcggggccaggcggccgtgcagcagctgcaggcggagggcctgagcccgcgcttccaccaactggacatcgacgacttgcagagcatccgcgccctgcgcgacttcctgcgcaaggagtacggggggctcaacgtactggtcaacaacgcggccgtcgccttcaagagtaggtgcagggcttgggttggggccccctggagcgctccgagggtgcggaggtggccagccgcaggctccccacccgtccacttgagtgaccgaggagggtggcgccgacccctagggatgcgctcagcccacgcctcccgcgaggcggttttcgctttccgtgattcgctgagccccaggcgggcccgggcgacaaacagcgcgccccgcccgccggcctgtgagggcctgtgcgcggcccggggccctccccgaactgtcagccgctgttgtgtgcaggaaaactggcctcctgggagggggcaacgccctgctagagttcatcagctttccttccaacgcgagaaacattttctctgcaaagaaacggtctccgctcgctttgggctttcgctttccttgaaagggcgcattcatagatgcccggaggcatttgctcgggaaaggaaatgaatcgctaaaacaggattagcgcgcgcttgcccttggtggacttgacaatttgtgtaatgcagagctttgataggctctggcaaaaaggaagcgagccttctcgttcccccacccccgcccggggagcttatgtttgttataaaatacgtgcgtgtggtcttaaaagcatcttccttaaggagaggggcggggatcaagagattgcttattctaactactactgaagaaaattacaggagggcgcagtggctcacgcctgtaatgccagcactttgggaggccgaggcaggagaaacgcttgaacctgggaggcagtgagccgagatcgcgccactgcactccagactgggagacagagcgagactccgtatgaaaaaaaaaaaaaagttactacggagaaataaacaggccggcttcacctccaacctagtggggaaaaaaagcctaagagggagtgaaatgaaggatgggggagcagaagtctccacccctccctttggccctaggcactccgcattgttgtgcatggggacctgagactttctttgacccgcacgggcaactcagcctgccggctttctgagagctggggtgcaggagtggggattaacaccccctaatgcagccctcagccatgggctgagagattggtggataaatacccggcttcctggacgacaggcggagggacttccccttgcctttcaaggtatggggaatggaccaccagcagctgcaaacctgggcgctcatggcaaggcagaatctcccgccttgccccacacctgctgaatcaaaatctgcgtttccgctgggcgcggtggctcatgcctgtaatcccagcactttgggaggctgaggcaggcagataacctgaggtcaggagttcaagaccagcccgggaaacatggtgaaacaccaactctactaaaaatacaaaaattagctgggcatggtggctcactcctgtaatcccagctactcgggaggctcaggcacaagaaccgcttgaacccaggaggcagaggttgcaggaagaggagattgcacccctgcactgcagcctgggcgacagagcgagactctgcctcaaaaaaaaaaaaaaaaaaaaaaaaaaatctgcatttcaacagaatccccagctccctcctacgcacctttaagtttaagaagtggtagtcaaagccaagtgttctcaaggtgtggctggagaccagtagctgtcacatcatctgggaacctagaaatgcaaactcaggccaggtgcgatggctcacgcctgtaatcccagcactttgggaagccgaggcgggtggatcacatgaggtcaggagttggggaccagcctggccaacatggcgaaaccctgtctctgcaaaaagtaaaaaaattagctgggtgtggtggcatgtgcctgtaatcccagctactccagaggctgaggcaggagaatcacttgaacccaggaggtggaggttgcagtgagccgagatcgcgccactgcactccagcctgggtgacagaggaagaaaagaaagagaaagaaagaaagaaaagaaaagaaagaaaggaaggaaggaaggaaggaaggaaggaaggaaggaaggaaggaaggaaggaaggaaagaaaatgcaaattctggagcccttactccagccctttgcaatcagaaactccaatggtgaggcccaggaagctgtgttttaacaggctctacaagtgattcggatgcagactaaagtttgagaatcaccgacctcgttcttaaaaattgttttaaaattaacttgtttttcctttagttgttaggagttaggatccactttgtcatgtgagtttcagggggaaaaatatgactttctttttgtttctttctctttttgaaaggtgatgatccaatgccctttgacattaaagctgagatgacactgaagacaaatttttttgccactagaaacatgtgcaacgagttactgccgataatgaaacctcatggtaagcccaacgtgtggacagtcgggttgcatccctcagtaagaagtgggctacaggcttcccggagcagggctaccctgcagaaatcactcaggggtgctatttctctgaagggggaaaaatagaaaattgcttcattttcccacagtgtttggcttctcactccaacattttagtttagtttagtttagtttagtttagttttgttttgtttggcagtggggtgggtggtgggaagaaattttgctcttgttgtgcaggctgtagtgcaatggtgtgatcttggctcactgcaacctccacctcccggggtcaagcaattctcctgcctcagcctcccgagtagctgagattacaggcacccactaccacacccggctaattttttatatttttagtagagacgtggtttcaccatgttggccaggctagtcctgaactcctgaccttcaggtgatccacccaccttggcctcccaaagtgttagaattacaggcgtgagccactatgcccagccttagctttaagttccaaagataagtgtgacatatcacaatgcttttgggatccatgtcatgaactcaatcctagaatgatagaatgctgtgagtccccaaaggccgcttgcctctggtcaatctcatgagtcctccagccctccaaggtgatgggcccacatctagctcatctctggaccttggtatctgttttagcattacaacttttcctatattcctttcttcttataccatactttctcaagttgattcagaaaacccaaaagaaattttcttttctttttttttcttttctttttttttttttttttttgagacagagtctcgctctgtcatccaggctagagtacagtggcacaatttcggctcactgtagtctccgcctcccaggttcaagcgattctcctgtctcagcctctggagtagctgggattacaggtgtgcaccaccacgcccagctcattttgtatttttagtacagatgggatttcactatgttggccaggctggtctcaaactcctgacctcaagtgatccacccacctctgcctcccaaaatgctgggattacaggtgtgagccaccatgcccgaacgagaaattttctttattaggaaatgtcttgcctatacctgcaggtattcaataaatgttactattatacttttcctacaaacattggagtgcctgccatattccaggcattatgctgggatctgggtgtgcaatggtgagcattatagacagggaccatctcattggtggagctgaaactctagtgggggagatatccattagcaaagaatctgaagtgtgaaatgacagctgtgctggggtacagggaagcttgcttccttgaggattttattccccaagaagttaactgtggattcttagaactgtggtttttattaaaaatgtgcttgctttttctttttttttttttttttttgacagagtttcgctctgttgcccaggctggagtgcagtgacaggatctcagctcactgcaacctccaccttctgggttcaagggattctcctgccttagcctcctgagtagctgggactacaggcgtgtgccgctacgcccggctaatttttatatttttagtagagacagggctttgccatgttggccaggctggtctcgaactcctgacctcaagtgattcatctgcctcagcctcccaaagtgctgggattacaggtgtgagctactgcacctggccagaagtgtgcttttcttaatttaacatttcgaatatggattattggccgggtgtggtggctcatgcctgtaatctcagcactttgggaggttgaggcaggaggatcacttgagcccacgagtttaagaccaggctgaaaaatatggcaagaccctcatcactttaaacaaacaaacaaaattatctctggatgcaaaaccttttttttttttttttttttttctgagacagagtctccctccgtcgcccagactggagtgcagtggcatgagctcagctcgctgcaacctccgcctctcaggtacgagagattctccgccccagcctctcaagtagctgggtttacaggcgagcaccaccacgcccagctaatttttttgtatttctagtagagacagggtttcaccatgttggccagcttgatctcgaattcctgacctcaggtgatccacccgccttggcctcccaaaatgctaggattacaggcttgagccaccgcactcagacgcaaaaagttcttaacctaagaaggtgaatggtgagagttgcacttgtactctgtcagtttctgagtgggatgagatcatagaaagcctgcagggagaactgcaggtgctttgaaggggatggagtttctaaatgcaaatctgagccaatataaacgcacattttaaaaactctcctttttacacagaaggtaacatttcatacaatgtttgccactttgctttttttactccttatgtctggggctctctccaggtttggtcagaaagcttttatcttttttgtggctatatagggacgcagccattatagggatgtcttttacccagtgttgggaagttttctcccgataaatttttgaatgggaacttgagagctgcaaggtattaagacacctttaaaactccatccccttccagagcacctgcagttctccctgcaggctttctctgatcccatcccactaaaaaactgagcaagtacaagagtacaagtgcaattctcaccattcacctttttaggttaagaagtttttgtggccgggcacagtggctcacacctgtaatcctagcactttgggaggccaaggcaggcagaccacgaggtcaggagatcgagaccatcctggctaacacggtgaaaccccatctctactaaaaatacaaaaaaattagccaggcatggtggtgggcacctgtagtcccagctagtcgggaggctgaggcaggagaatggcatgaacccgggaggcggaacttgcagtgagcccagatcgcgccactgcactccagcctgggcgacagagccacactccatctcaaaaaaaaaaaaaaaaaaagaaagaaagaaagaaaagaaaatatcataagaatggacttaatcctgagcaacatatggagaccccagctctacacaaaaaatgaaaattaaaaattagctgggcatagtggcatgttccagcttctcgagagactgaggtgggaggatcgcttgggcccaggaggttgaggctgcagtgagctatgattgtgccactgtactctagcctgggcgacagagcaagtccttgtctcaaaaaaaaaaaaaaatgcatttaacgcatctgacctaccaaacaccataggtcagcctcgtctagcttcaaggtgctttgaacgcttacattagcctatagtctggcaaagtcatctaacacaaagcctattttatcataaaatgttgagtatcttatgtaatttattgaatctgtactgaaagtgaaatgcagaatggttgtatggggcctccaagtacagattctgcagaatgcatatcgcttcctcatccatcagtgaagtcagtaagtcctaagtggaaccatcagagggcagggaccatctatctgtatttgacttgcttatttgttcaaggttctgagtcaataggacaagcaactactaagccactagagggcgcaacttgcctactctttctagagtaaggcagcaggtgtttcgggaccggtggggccacctggacctcagtggagggtggtgtgggtgcagcccttcccagggctgatgacgcatctggctgacgaggctgactgtcagcctctggcctctctcccagaggtgtgccctcagatcaaagaggacacctcctccccttaagaggatttatttcctcgaaggcacagcttctatgatctgtgtttttctttcttcctttcccattcacatttaattccttgtagccgccaagtttctgagaacaaagctgtttagaaagcaatgaagaacacaacatcactgatgtagtattcctggccaaaatattgatgtgactctcctcatgagaacagaccaattcactttgagagaaatactacaaaataatggtctacagtcttcaaaaaagtcattgccaactaccttacattaaaatatatgaaagagatgtgacaattaaatgcaatccatgggccaggtgcggtgactcacgcctgtaatcccagcactttgggagaccaaggcgggcggatcatgaggtcaggagattgagactatcctcgctaacacggtgaaaccccgtctctactaaaaatacaagaaattagccaggcatggtggcaggcgcctgtagtcccagctacttgggagactgaggcaggagaatggcatgaacccgggaggtggagcttgcagtgagccgagatcacgccactgcactccagcctaggtgacagagcgagactccatctcaaaaaaaaaaaaaaaaacgcaatccatgatcctactttggaccctggattaaagcaaacaaaaactgtaaaagaacattactgggacaatttggacacatttgaatatgggctgtattttagataatagtgttgtataatgataaatgcctggcatgtggtcataactgtagtaatgtaggggaatgcccttgctaccatatataatactaaagtgtttaagatgaaggtttatgatatcagcaacttggagagaaaaagggacagagagggaaaaagcaaacacagcaaaatgttaacaattagtgaacttaggtgatgggcatagggtatttatcgaactattcttgtaacttctctgtaacaggaaagaaatacatacatacacttcatctttgaaagtgagagagagaaggaaggaaagaaatactgaatagtactaggtacctggggggatgagtgaggtgctagtttccaaggacagagtgagggtatctcttgtgggattggggtccacaagaatgtgcagctcccttgcaatgggaacttgtggggaatgccattcagaaaatgaaataaaatctacagatccggccaggtgcggtggctcatgcgtgcaaccccagcactttgggaggccgaggaaggcagagcacctgaggtcaggagtttgagaccagcctggccaacatggtgaaaccccatctctcctaaaaatacaaaaattagctgggcatggtggcgcacacctgtaatcccagctacttgggaggctgaggcaggagaatcacttaaacccgagatagaggttgcagtgagctgagatcgcgccactgcactccagcctggacaacagagcaagactcatctcaaagaaaaaaaaaaagaccctattggacacagagaatatgcattcagaataatacataataaaagaactcactaaaattagtggggtttgatgctgatgaaatgtgtaaattaacacatttactggtttttggatttccaccagtacttcaaattgtaaaatttttggcctacatatttgtttctatgggcacaattgtctctttagtagctgtgaatcatgatcaacatgaatattaattcataatttaatgaatattaatattatcaaatagggactaaaaagtaatgaaatcaggccggatgcagtggctcacgcctataatcctagcactttgggaggccaaggcaggcagatctcctgagctcaggagtttgcgaccagcccggccaacatggagaaaccccgtttctacgaaaaatacaaaaattatttgagtgcagtggtgtgtgcctgtgggcccagttatttgtggggctgagacaggaggatcacttgagtctgggaagtggaggctacagtgagccgagatcatgccactgcactccagcttggctggcagagtgagattctgtctcaaaaaaaaaaaaaaaaaaaaagtgatgagataaaaaccaggatggaaaaacagcccattccacacgtgaagtgtccataatgaaggacagacagagtcatccccagggattccttactgctggttgtggcactaaggaattggggtggctgcccactgtcctaggacattgggtgtgcctaggaaattgagagctttagtccttagggtgagagcactgtccctcagaaagcaggtttataagtacttggagtgtgtatgctggggaggagcagttttataaaactgccagcgggctgggcacacggtggctcacacctgtaatcctagcactttgggaggccaaagcgggcggatctcttgaggtcaggagttcaagcccagtatggccaacatggtgaaacctcatctctactaaaaaaatacaaaaattagctgggcatggtggcacacaccttcatcccagctacttgggaggctgaagcagtagaatcacttgatcctgggaggcggaggttgcagtgagccgagattgtgccactgcactgcagcctaggcaacaaaacaagactgtctcacaaaacaaaataaaaaatttttaggccgggtgtagtggctcacgcctgtaattccagcactttgggaggctgaagcagtagaatcacttgatcctgggaggcggaggttgcagtgagccgagattgtgccactgcactgcagcctaggcaacaaaacaagactctgtctcacaaaacaaaataaaaaaattttaggccaggtgtagtggctcacgcctgtaattccagcactttgggaggctgaagcagtagaatcacttgatcctgggaggcggaggttgcagtgagccgagattgtgccactgcactgcagcctaggcaacaaaacaagactctgtctcacaaaacaaaataaaaaaattttaggccaggtgtagtggctcacgcctgtaattccagcactttgggaggccgaggtgggcagatcacttcaggtcaggagttcaataccagcctggccaacatggcaaaaccccatctctactaaaattacaaaaattagctgggcgtggtggtgggcacctgtagtcccagctacttgggaggctgaggcaggagaattgcttgaacccggaagtcggaggttgcagtgagccaagattgtgccactgcactccagcctgcgtgatagagcaagactgcgtcttaaaaaataaataaataaatttaagtaaaagtaaaaataaaactgcctggggaatctacaaatttactacctcacccatctctcagcgaatccctgagaaagggagccccccctgtcactgatggaggtgtgttcttccccttgggagaatagggccaaaaaaattaaatcccatgggtgcatagattttatgccttctatagtcacatttttaatctttttttaaatttgattattactttttgagaaagggtctcattcgtgtcacccaggctggagtgtagtggagtgtagtggtgtgatcatggctcactgcaatctctacttcctggattcaggtgatcctcttacctcagcttcctgagtagctgagaccacaggcacacgccaccacacccagctaatttttctattgttagtagagacagagttttgccacgttgcccaggctggtcttgaactcctgggttcaagtgatccactcctctcagcctcccaaagtgctgggattacagatataagccacagcatccagccacttttttgtttttaatcagcaattaaacctacacaatggccaggtgcggtggctcacacctgtaatctcagcattttgggaagctgaggcaggaagatcacttgatgtcaggagttcaagaccagcctggccaacatggtgagaccctgtctctactaaaaatacaaaaattagccagaatatggtggctcacgcctgtaattccagctactcaggaggctgaggcaggagaattgcttgaacctgggaggtggagtttgcagtgggccgagatggcaccagtgcactctagcctgggcaacagggcgagactctgtctcaaaaaaaaaaaaaaaaaaaaacctgcaccaagactcaatcatatgtttggtatattattcaaccagtggttgtacctctgtgatatgctttcatatatttatcattctgtttcagggagagtggtgaatatcagtagtttgcagtgtttaagggcttttgaaaactgcagtgaagatctgcaggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatgacaaagttgtgcaaaactggtaaacgtctgcttcggagcttgctgcttaataaatgttggtggaatgaatgaatgaattgatgctgtggtttgattatttctgttctttttttttttgagacggagtctcgctcttgttgcccaggctggagtgcagtggcatgatctcagctcactgcaacctctgccacctgggttcaagctgttctcctgcctcagcctcctgagtagctgggattaccaggcatctgccatcatgcctggctaatttttgtaattttagtagagacggtatttcaccatgttggccaggctggtctcgaactcctgacctcaggtgatctgcccaacttggcctcccaaagttctgggatttcaggcatgagccactgcacccggcctttttttctctttcttttctctctctctctctcttttttttttttttgagatggagtttcgctcttgttgcccaggctggagtgcaatggcatgatcttggctcaccgcaacctccgcctcccaggtttgaatgattctcctgcctcagcctcctgagcagctgggattacaggcatgtgccaccacacctggctaattttgtatttttagtagagatggggtttctctatgttggtcaggctggtctcgaactcctgacctcaggtgatccacccgcctcagcctcccaaagtgctgggattacaggcatgagccaccacgcctggcctctttctgttcttgaaaaggaatgttcataagaatctccctgggagaaacgtgtctagttctggaatctggagctgaacaacattgctatgcccaactcttcagcctgagagggagaagaacatagtctcaaattttagtgggcatcgggaccacctggagggctgattaagccagattgccggttccactccccacaccaattcacttcatttctaacaagttctcaggtggtgctgacactgctggtgctgggactgcacttagaaccactggtgtagcaagtggtttcagaactatggagccattttctagctgttccttgctgtttccagttttttgattctgtaagggtgatgctttatcctctatttccttagctctgcaagctttctttgcatctcattctgttttgagtatatttttattggttgttttactttttttttgcttgagacagaatctcactctgtcgcccaggctagagtgcagtggcacaatctcagctcactgcaacctctgcctcctgggttcaagcaattcttctgcctcagcctcccaaatagctgggactacaggcgcccaccaccatgcccagctaatattttgtatttttagtagagatggggtttcaccatgttggccaggctggtctcaaactcctggcctcaagtgatccgcccaccccagcctcacaaagtgctgggattacaagcatgagccaccacacccggctggttcttatacttacaaagtagcagagcttgaaggactcaggaggaatatcttctttaactgggacatgatttcttctagatttttcagctgggttttgcattctgcattccttcccagaatgtttacgaggttgcccagccaccgcaactgtatctctttactgaaactcatgcagatgtcttctccttaacctatgcacactccctgtgaactacagcccagggtgattcttcagtaactccctaagcctttttttttttttttaatttgagacagtgtcttgctttgttgcccaggctagagtgcagtggcacgatcatgggttactgcagcctcgacctccagggcaagagacttccatgactaaaacctcaagtgatcctcccacctcagcctcctaagtagctgggactacaggcatgtgccatcatgcccaaataatttaatttttggtagagacagggtctcactatgtttcccaggttggtctagcactcctgaactaaagtgatcctcgctcctttgcctctcaaaacgctgggattccagacatgagccaccgcacccaccctctttcataatttttttttttttttcagacagagtcttgctcggtcgcctggctggagtgcagtggtgccgtcttggctcactgcagcctccacctcccaggttcaagcaattctcctgcctcagcctcctgagtagagtggctgggattacaggcgtgcaccaccatgcctggctaatttttgtatttttagtggagatggggtttcgccatgtaggccaggctggtcttgaactcctgacctcaggtgatctgcctgccttggccttgcaaagtgctgggattacaggagtgagccaaagcctcttttataatcattatgacaataggtgagttcacattctctgctttcaaatgggattggttttgcaacaggcctcctggcttctggttacaccttgtagaaaaaagtcttggagagcaaggagtcttctgaaatagaagaaatgtactcgcaaaggcttgcaagagtgtcaaggcttcggcaagaaggctaatcacacaaaaaaattcagtggaatttacattccggctggccacagtggctcaagtctctgatcccagcactttgggaggctgaggcaggaggatcacctgaggtcaggtgtttgaaaccagcctgggcaacacagcaggcctccatgtctgcaaacaaatcaaacaaaacttagccagacatggtggcacacacctgtagtcctagctacttggtaggctaaggtggaaggatcagttgaacccaggagttcaaggctgcagtgagctatggtcgtgccactgcactgcagcattctgggtgacacagccagaccctgtctctacttaaaaagaaaacgaatccattgaaagatggaaaaaaaccaaagggaaataactacaaatttgccaaggttaccaagtttatgataggctgctcactgtgtgaaattagaaatgttgtcacttgattatcaaacccacaaatgtcacatcatatcccctgacataggtaagcactgcagtcataagagataatgccgtttttccttagggaatcagtaaagtatgggaatgctcaagtttcttttatttgggggaactgaactgcacaggatgacctggttatttctggttcatcacagtatgtagctatttgtttttcttaactctctgatttacaatggcagcacctcaaagtgtcagtttaactctcacagcctgcacccactttttcatccacttggggtagggggaagtctgaatcccacctagactgcatttaacatcttgaggccagatggagtggctcatgcctataatcccagcattttgggaggccaaggcaggcgggttgcttgagcccagaagtttgagaccagcctggacaacatagcgagacccctctctacaaaaattcaaaaagatcaggcagacgaggtgcacacctgtagtcccagctactcagaggctgaggttgggaggatcacttcaacctgggaggtcaaggctgcagtgagccatgattgcgccactgcacttcagcctgagtgacaggacaagaccctgtctcaaaaaaaagcctaaaacaacaacaaaaacttcctttagcctatttgtatgtcactgattaaatccaacatgctcttatggtattcatctcaggctacagctcctaagacattttaatgtctcctttcctggctctaaaaacaatttaatggctttcaatcagcttcccgagtatcttttgtactctcgcctccctctgcagccaaactccagtcctgctaatgccgggcaatagcccaggaaccacagagcacttcaggctctgcctgacaaagttacagacaggaagttcagaagaaatgagccagtcccttttatttcttcttcctcttttgtctctaaccaatcctttttggataagtgtgtaacccacttcctcttttgtctctagccaatccttttaggataagcatgtagctcatttggatgacccttaactgtcaactgctggtcagaatgacatttctcattcttagagaagggctgccattagcccttattggatggtctgcccagcaccctcttccaaaatatgatctcctgccctcccctgccccctgcttccttcccatgtttgcagctgcagctgccacaaggtgaccttgcctctgttgactgctccagctataggtttttcctctaaaaagaaccagctggattggatcagagttgttactgtgcatctcaccccctgtgcctgaggagcagagggagccagccattgccagagaaagaggccaaccatcaagaggagcatttaagccaggtgtggtggctcctgccagcacaatcccagcactttgggagatcaaggcaggtggatggcttgcgctcatgagtttgagaacagcctgggtaacatggtgataccctgtctctacagaataatacaaaaattagccaggtgtggcagtacatgcctgtagtcccagctacttggggagctggggcaggaggattgcttgagcctgggaggtgtttacagtgagccgtgtttgtatcagtacactccagcctggatgacaaagcgagaccctgtcttggggaaaaaaaaaaaaaaaaagaaaagaaaagaagtggcccaaagagaaactcccttccctgtcctcagatcattcctgaaatcttgaattctcagagatgctccaagatacccttgtatccttaaaatatattttctttttcataagctatattgaattgggtagttgttgcttgcaatcaaaaggaacctaactaatagaagtgcattaacatgttttatagtattgtgaaaggaaaataaatcttggggccccaaaatcactaagctaaagggaagagttaagctgggaactgcttagggcaaacttgccttccattctattcaaagtcaccactctgctcactgagataaatgcatatctgattgcctcatttggagaggctcatcagaaactcaaaagaatgcaaccatttttctcttacctacctatgacctggaagtcccctccaggcttccagctgtcctgccttcacctggagctgtcccacctttctggattggcccaatgtacatcttacacatattgattgatgtctcatgtctccctaaaatgtataaaaccaagctgtgccctgaccaccttgggcagaagttctcagaacctcctgaggctgtgtcatggttgcccatcctcaaccttggcaaaataaactttctaaattaactgagacctgcctccgatgttgggggttcaccctatgctgtaggaaaaaaaacaattgggcttggaatcaaaaggagaaaaaaatcatgaattgagaacctatggcaaattagaccatatgtcctgcttaatgctttcccaacatggttttaggtaattctgactatagtcctttgccttagttcattttgtgttactataatggaatatcacaaactaggtaatttataaagaaagtaaatttgcctgtgcacagtagctcatgccaataatcctataactttgggaagccaaagtgggagcatcacttaaggccaggagttcaatgccagcctgggcaacatagagaaaccctatctctacaaaaaataaaaattgaccaagtgtgatcatgctcacctttagttctacctacttggtaagttgaggtgggagtatcacttgtgcccaggagtttatggctgcagtgagctatgatcatgccacttcactccagcctaagcaacagagactctgtcacttgtctcaaaaaaaaaaaaaaaaaaaaagtaagtttatttctcacaattctggaggctgggaagtccaaaagcatggcactagcatctggcaagggcctgcttgtgtgttctaccatggcagaaggcagaagggcaagagaatgctcacaaggtgcaaactaaactcatccttctatcaggaatccactcccctgataaaggtattaatccatttatgagggcagagtcttcactcatgatcttaaaggttccactttgcaacactgttgccttggggattatgtttctaacacatgactttaggggacacattgaaaccactgtatcctttaaggtaggaatcaatgtcatatttgtcatatttcgaacgaagaaataaaggtttggagaggttaattaacttgcccaagatctcagagctaaagccaggatcatatctaggactgactacaaagtcctgtggtctccagtgcttggcaggtccagcttcactgatgagtctagagagtagtaactctcttggtgtaagaactaagggagatgatacattaaatctaagtgtaaattagattatgcttaaagtataagtcatatggttattattaatagatccccaagttagcctatatgtgaacttttccatagagaaatgaagcatggtttcaatgcagcatattttaaatggattatctcatacaatgtgttttttgtttgttttatattgtttttgttgttttctgagacagagtcttactctgttgcccaggatggagtgcagtgacatgatctcagctcactgcaacctccaactcccgggttcaagtgatcctcctgcctcagcctcccaagtacctgggagtacaggtgcatgccatcacacctggctaatacaatgtgttttttttagacaccagagggagccagtggttctttccacatcagcttttctgtgaaacatttttcttttttttgaaatggagtttcactcttgttgcccaggctggagtgcagtggcgccacctcagctcaccgcaacctccccctcctgggttcaagtgattctcctgcctcagcctcccgagtagctgggattacaggcatgagccaccaggcccagccttgtgatagatttttctagactgttgcatgtgtggtacacccacatacaatatcagctttagactcaaccctttgactttgccttcacctactgaacagcaacaaggattgtgacagaccaagaatctgaagaaggatgcagtgtggagacgaaacaggtgtcaatgacaaaggtttagttgttatttcaagtcaactgcaaagtggatgcggtatcaagtatagaaactgcacaggacttctccactaagaacatggggagggcaaagggaatggatgttttgagaaaggaggcagaagccaacagagaacagtggttattaccaagatgggtggagtagaagttagtttatagaagacattggcttaggcctggtgcggtggctcacgcctgtaatcccagcaatttgggaggccgaggctggcagattacttgagggcaagagttcaagaccagcctgaccaacatggtgaaaccccatctctactaaaaatacaaaaaattagctgggcatggtggcgcacagctgtaatcccagctactcaggaggctgaggcagaaaaatcgcttgaacctgggaggcggaggttgtagtgagccaagatcacaccactgcactccagcctgggcaacagagctagactccatctcaaaaaaaaaaaaaaagaaagaaaaaagaagacactggcttagagggtcaccaatatctgcatatcaaaactaagaatgaatttacttggccaatctctctactgggtgatcagcctgagccagataatgcagtgggttctgatttataatgccttctttactgtcaagaggggtaaggattaaagttccggtttaaattaaagttgaaatgctttacttggtttgagtattattatgaaaggaccctgaccgtttctgcatgtcttaaactgatgaaagtagctaagtagacttttaagttgtgacaagacaacttgatccaagaaaacatatttcttgtcagaatatgcaattttttttttttttttgagatggagtctcactctgtcactcaggctggagtgcagtggtgtgatcaaggctcactgcaacctctgtctcccaggttcaagcaatcctcctgtctcagcctccccagtagctgggactacaggtgcacaccactacacccagctaatttttgtatttttagtagagacagggtttcactatattggtcgggctggtctcgaactcctgacctcaggtgatccacctgcctcggcctcccaaagtgctgggattacaggcgtgagccactgcgctcggccagaatactcaaatctcaatgttgtacatttactgtcaatcctgtcagtatcagtatattgtatacagtatacagtaattgacagtatactgtcaattataaattgagttttttaaattatgatttacaaatgaatttgtcaaaattaaattaaacccccccacacgcacacacacctggaatcctttacagataggtggtatatgaatacaaggcacagattgtatgtgcatggtggctttggcacaaacagactacttcttttttcaatgttaagtgtaaagcagttctttcatctctgttcagtgcagtgttgagtgtgactaggatttgaagaacctaaaaaaaaaaaaaactcacctgcttgccatcttcttgttttttttttgttgttttttggtttttgctggttttgtttgctgcttttgtaaaaccagtttatcatattctcattaggaaatcaattttcatgaaattaattttttttcctgctaactatggctcaatcttttcgtttctctctgcttctatcttaagaccattcctcaaattgaccatgagaggatttacatctggggcacttggtatatgccaaatggagacaaaatcagaatcagcagcctggctgggccacaggtccagcatcccaagctattaaaatattcttagtgtttccagggaagtgatagatccactttggaagctgataatatacccctcccctagaaacatgcatatacacaaagtgttctaaacaacttccaggtgctcatgacctcccccacctcccaagctcattgaccactgcctcgccttcacgaactccagacctggtctgaacatttctaaaggacgctcgggagttaaaaggagcgaggccactgcagaaatgacagccttcatccacaagtggcccacttcgggttggctggagccacagctgggtggggacagggcctgtgctcaggtgagcactgcctaccgcgcaccctccaggtgcgtcctaccctgaagcggtcggactggaccgtctaggtcccagcgctcgagaggatggcaggcaggggctggtgattgtctggagatatgaatgctttctaaggttgacgtcaaggtctccttcctgagccacagtccacgtgataagctctgtccaggtagaaatgatctcacctctcctgtcgcccagggtcggaaacctgaggcccgtgcgggctggggcaacttagcaggggtcccaagcccgccgcgccccctgcgccccaaacgtgtgtggagggcttggacgtggtccagagggaaaagatggggtgaaccaggtgccgcgcacccttcgaggagcccccgcttctccgtttctgtgagtgactccaaagcacctccgagggccgacacacgcgcggacgaccttgggcgggcactgaccaatgtccccttccactcggttgtgtcgggggtccccaggtgaggcgcgaacgccgccccgctcacctgtacgaggcctttcccggagcagcccggctacgaagcgacacccatggcggagaagctaaggaagactcccgctccctcacaccgcggct

SEQ ID NO: 320 - DNA, 24542 bp, Homo sapiens; identical to SEQ ID NO: 319

SEQ ID NO: 321 - DNA, 11598 bp, Homo sapiens
gcgtgggcagggggcgggcccgggagttggaacagagggcacagacggcccctcctcggaggggagggaccggagccggggcctttttctttaagactcgcagcactggatcccagaacttagtctgcgcggcggcattgacactagctgggctcctcggggcgcgccccaggtggtccgaagcccggtccgccctccacgcaggtgccccgcgctccccgctcagccatgtcgtcctgcagccgcgtggcgctggtgaccggggccaacaggggcatcggcttggccatcgcgcgcgaactgtgccgacagttctctggggatgtggtgctcaccgcgcgggacgtggcgcggggccaggcggccgtgcagcagctgcaggcggagggcctgagcccgcgcttccaccaactggacatcgacgacttgcagagcatccgcgccctgcgcgacttcctgcgcaaggagtacggggggctcaacgtactggtcaacaacgcggccgtcgccttcaagagtaggtgcagggcttgggttggggccccctggagcgctccgagggtgcggaggtggccagccgcaggctccccacccgtccacttgagtgaccgaggagggtggcgccgacccctagggatgcgctcagcccacgcctcccgcgaggcggttttcgctttccgtgattcgctgagccccaggcgggcccgggcgacaaacagcgcgccccgcccgccggcctgtgagggcctgtgcgcggcccggggccctccccgaactgtcagccgctgttgtgtgcaggaaaactggcctcctgggagggggcaacgccctgctagagttcatcagctttccttccaacgcgagaaacattttctctgcaaagaaacggtctccgctcgctttgggctttcgctttccttgaaagggcgcattcatagatgcccggaggcatttgctcgggaaaggaaatgaatcgctaaaacaggattagcgcgcgcttgcccttggtggacttgacaatttgtgtaatgcagagctttgataggctctggcaaaaaggaagcgagccttctcgttcccccacccccgcccggggagcttatgtttgttataaaatacgtgcgtgtggtcttaaaagcatcttccttaaggagaggggcggggatcaagagattgcttattctaactactactgaagaaaattacaggagggcgcagtggctcacgcctgtaatgccagcactttgggaggccgaggcaggagaaacgcttgaacctgggaggcagtgagccgagatcgcgccactgcactccagactgggagacagagcgagactccgtatgaaaaaaaaaaaaaagttactacggagaaataaacaggccggcttcacctccaacctagtggggaaaaaaagcctaagagggagtgaaatgaaggatgggggagcagaagtctccacccctccctttggccctaggcactccgcattgttgtgcatggggacctgagactttctttgacccgcacgggcaactcagcctgccggctttctgagagctggggtgcaggagtggggattaacaccccctaatgcagccctcagccatgggctgagagattggtggataaatacccggcttcctggacgacaggcggagggacttccccttgcctttcaaggtatggggaatggaccaccagcagctgcaaacctgggcgctcatggcaaggcagaatctcccgccttgccccacacctgctgaatcaaaatctgcgtttccgctgggcgcggtggctcatgcctgtaatcccagcactttgggaggctgaggcaggcagataacctgaggtcaggagttcaagaccagcccgggaaacatggtgaaacaccaactctactaaaaatacaaaaattagctgggcatggtggctcactcctgtaatcccagctactcgggaggctcaggcacaagaaccgcttgaacccaggaggcagaggttgcaggaagaggagattgcacccctgcactgcagcctgggcgacagagcgagactctgcctcaaaaaaaaaaaaaaaaaaaaaaaaaaatctgcatttcaacagaatccccagctccctcctacgcacctttaagtttaagaagtggtagtcaaagccaagtgttctcaaggtgtggctggagaccagtagctgtcacatcatctgggaacctagaaatgcaaactcaggccaggtgcgatggctcacgcctgtaatcccagcactttgggaagccgaggcgggtggatcacatgaggtcaggagttggggaccagcctggccaacatggcgaaaccctgtctctgcaaaaagtaaaaaaattagctgggtgtggtggcatgtgcctgtaatcccagctactccagaggctgaggcaggagaatcacttgaacccaggaggtggaggttgcagtgagccgagatcgcgccactgcactccagcctgggtgacagaggaagaaaagaaagagaaagaaagaaagaaaagaaaagaaagaaaggaaggaaggaaggaaggaaggaaggaaggaaggaaggaaggaaggaaggaaggaaagaaaatgcaaattctggagcccttactccagccctttgcaatcagaaactccaatggtgaggcccaggaagctgtgttttaacaggctctacaagtgattcggatgcagactaaagtttgagaatcaccgacctcgttcttaaaaattgttttaaaattaacttgtttttcctttagttgttaggagttaggatccactttgtcatgtgagtttcagggggaaaaatatgactttctttttgtttctttctctttttgaaaggtgatgatccaatgccctttgacattaaagctgagatgacactgaagacaaatttttttgccactagaaacatgtgcaacgagttactgccgataatgaaacctcatggtaagcccaacgtgtggacagtcgggttgcatccctcagtaagaagtgggctacaggcttcccggagcagggctaccctgcagaaatcactcaggggtgctatttctctgaagggggaaaaatagaaaattgcttcattttcccacagtgtttggcttctcactccaacattttagtttagtttagtttagtttagtttagttttgttttgtttggcagtggggtgggtggtgggaagaaattttgctcttgttgtgcaggctgtagtgcaatggtgtgatcttggctcactgcaacctccacctcccggggtcaagcaattctcctgcctcagcctcccgagtagctgagattacaggcacccactaccacacccggctaattttttatatttttagtagagacgtggtttcaccatgttggccaggctagtcctgaactcctgaccttcaggtgatccacccaccttggcctcccaaagtgttagaattacaggcgtgagccactatgcccagccttagctttaagttccaaagataagtgtgacatatcacaatgcttttgggatccatgtcatgaactcaatcctagaatgatagaatgctgtgagtccccaaaggccgcttgcctctggtcaatctcatgagtcctccagccctccaaggtgatgggcccacatctagctcatctctggaccttggtatctgttttagcattacaacttttcctatattcctttcttcttataccatactttctcaagttgattcagaaaacccaaaagaaattttcttttctttttttttcttttctttttttttttttttttttgagacagagtctcgctctgtcatccaggctagagtacagtggcacaatttcggctcactgtagtctccgcctcccaggttcaagcgattctcctgtctcagcctctggagtagctgggattacaggtgtgcaccaccacgcccagctcattttgtatttttagtacagatgggatttcactatgttggccaggctggtctcaaactcctgacctcaagtgatccacccacctctgcctcccaaaatgctgggattacaggtgtgagccaccatgcccgaacgagaaattttctttattaggaaatgtcttgcctatacctgcaggtattcaataaatgttactattatacttttcctacaaacattggagtgcctgccatattccaggcattatgctgggatctgggtgtgcaatggtgagcattatagacagggaccatctcattggtggagctgaaactctagtgggggagatatccattagcaaagaatctgaagtgtgaaatgacagctgtgctggggtacagggaagcttgcttccttgaggattttattccccaagaagttaactgtggattcttagaactgtggtttttattaaaaatgtgcttgctttttctttttttttttttttttttgacagagtttcgctctgttgcccaggctggagtgcagtgacaggatctcagctcactgcaacctccaccttctgggttcaagggattctcctgccttagcctcctgagtagctgggactacaggcgtgtgccgctacgcccggctaatttttatatttttagtagagacagggctttgccatgttggccaggctggtctcgaactcctgacctcaagtgattcatctgcctcagcctcccaaagtgctgggattacaggtgtgagctactgcacctggccagaagtgtgcttttcttaatttaacatttcgaatatggattattggccgggtgtggtggctcatgcctgtaatctcagcactttgggaggttgaggcaggaggatcacttgagcccacgagtttaagaccaggctgaaaaatatggcaagaccctcatcactttaaacaaacaaacaaaattatctctggatgcaaaaccttttttttttttttttttttttctgagacagagtctccctccgtcgcccagactggagtgcagtggcatgagctcagctcgctgcaacctccgcctctcaggtacgagagattctccgccccagcctctcaagtagctgggtttacaggcgagcaccaccacgcccagctaatttttttgtatttctagtagagacagggtttcaccatgttggccagcttgatctcgaattcctgacctcaggtgatccacccgccttggcctcccaaaatgctaggattacaggcttgagccaccgcactcagacgcaaaaagttcttaacctaagaaggtgaatggtgagagttgcacttgtactctgtcagtttctgagtgggatgagatcatagaaagcctgcagggagaactgcaggtgctttgaaggggatggagtttctaaatgcaaatctgagccaatataaacgcacattttaaaaactctcctttttacacagaaggtaacatttcatacaatgtttgccactttgctttttttactccttatgtctggggctctctccaggtttggtcagaaagcttttatcttttttgtggctatatagggacgcagccattatagggatgtcttttacccagtgttgggaagttttctcccgataaatttttgaatgggaacttgagagctgcaaggtattaagacacctttaaaactccatccccttccagagcacctgcagttctccctgcaggctttctctgatcccatcccactaaaaaactgagcaagtacaagagtacaagtgcaattctcaccattcacctttttaggttaagaagtttttgtggccgggcacagtggctcacacctgtaatcctagcactttgggaggccaaggcaggcagaccacgaggtcaggagatcgagaccatcctggctaacacggtgaaaccccatctctactaaaaatacaaaaaaattagccaggcatggtggtgggcacctgtagtcccagctagtcgggaggctgaggcaggagaatggcatgaacccgggaggcggaacttgcagtgagcccagatcgcgccactgcactccagcctgggcgacagagccacactccatctcaaaaaaaaaaaaaaaaaaagaaagaaagaaagaaaagaaaatatcataagaatggacttaatcctgagcaacatatggagaccccagctctacacaaaaaatgaaaattaaaaattagctgggcatagtggcatgttccagcttctcgagagactgaggtgggaggatcgcttgggcccaggaggttgaggctgcagtgagctatgattgtgccactgtactctagcctgggcgacagagcaagtccttgtctcaaaaaaaaaaaaaaatgcatttaacgcatctgacctaccaaacaccataggtcagcctcgtctagcttcaaggtgctttgaacgcttacattagcctatagtctggcaaagtcatctaacacaaagcctattttatcataaaatgttgagtatcttatgtaatttattgaatctgtactgaaagtgaaatgcagaatggttgtatggggcctccaagtacagattctgcagaatgcatatcgcttcctcatccatcagtgaagtcagtaagtcctaagtggaaccatcagagggcagggaccatctatctgtatttgacttgcttatttgttcaaggttctgagtcaataggacaagcaactactaagccactagagggcgcaacttgcctactctttctagagtaaggcagcaggtgtttcgggaccggtggggccacctggacctcagtggagggtggtgtgggtgcagcccttcccagggctgatgacgcatctggctgacgaggctgactgtcagcctctggcctctctcccagaggtgtgccctcagatcaaagaggacacctcctccccttaagaggatttatttcctcgaaggcacagcttctatgatctgtgtttttctttcttcctttcccattcacatttaattccttgtagccgccaagtttctgagaacaaagctgtttagaaagcaatgaagaacacaacatcactgatgtagtattcctggccaaaatattgatgtgactctcctcatgagaacagaccaattcactttgagagaaatactacaaaataatggtctacagtcttcaaaaaagtcattgccaactaccttacattaaaatatatgaaagagatgtgacaattaaatgcaatccatgggccaggtgcggtgactcacgcctgtaatcccagcactttgggagaccaaggcgggcggatcatgaggtcaggagattgagactatcctcgctaacacggtgaaaccccgtctctactaaaaatacaagaaattagccaggcatggtggcaggcgcctgtagtcccagctacttgggagactgaggcaggagaatggcatgaacccgggaggtggagcttgcagtgagccgagatcacgccactgcactccagcctaggtgacagagcgagactccatctcaaaaaaaaaaaaaaaaacgcaatccatgatcctactttggaccctggattaaagcaaacaaaaactgtaaaagaacattactgggacaatttggacacatttgaatatgggctgtattttagataatagtgttgtataatgataaatgcctggcatgtggtcataactgtagtaatgtaggggaatgcccttgctaccatatataatactaaagtgtttaagatgaaggtttatgatatcagcaacttggagagaaaaagggacagagagggaaaaagcaaacacagcaaaatgttaacaattagtgaacttaggtgatgggcatagggtatttatcgaactattcttgtaacttctctgtaacaggaaagaaatacatacatacacttcatctttgaaagtgagagagagaaggaaggaaagaaatactgaatagtactaggtacctggggggatgagtgaggtgctagtttccaaggacagagtgagggtatctcttgtgggattggggtccacaagaatgtgcagctcccttgcaatgggaacttgtggggaatgccattcagaaaatgaaataaaatctacagatccggccaggtgcggtggctcatgcgtgcaaccccagcactttgggaggccgaggaaggcagagcacctgaggtcaggagtttgagaccagcctggccaacatggtgaaaccccatctctcctaaaaatacaaaaattagctgggcatggtggcgcacacctgtaatcccagctacttgggaggctgaggcaggagaatcacttaaacccgagatagaggttgcagtgagctgagatcgcgccactgcactccagcctggacaacagagcaagactcatctcaaagaaaaaaaaaaagaccctattggacacagagaatatgcattcagaataatacataataaaagaactcactaaaattagtggggtttgatgctgatgaaatgtgtaaattaacacatttactggtttttggatttccaccagtacttcaaattgtaaaatttttggcctacatatttgtttctatgggcacaattgtctctttagtagctgtgaatcatgatcaacatgaatattaattcataatttaatgaatattaatattatcaaatagggactaaaaagtaatgaaatcaggccggatgcagtggctcacgcctataatcctagcactttgggaggccaaggcaggcagatctcctgagctcaggagtttgcgaccagcccggccaacatggagaaaccccgtttctacgaaaaatacaaaaattatttgagtgcagtggtgtgtgcctgtgggcccagttatttgtggggctgagacaggaggatcacttgagtctgggaagtggaggctacagtgagccgagatcatgccactgcactccagcttggctggcagagtgagattctgtctcaaaaaaaaaaaaaaaaaaaaagtgatgagataaaaaccaggatggaaaaacagcccattccacacgtgaagtgtccataatgaaggacagacagagtcatccccagggattccttactgctggttgtggcactaaggaattggggtggctgcccactgtcctaggacattgggtgtgcctaggaaattgagagctttagtccttagggtgagagcactgtccctcagaaagcaggtttataagtacttggagtgtgtatgctggggaggagcagttttataaaactgccagcgggctgggcacacggtggctcacacctgtaatcctagcactttgggaggccaaagcgggcggatctcttgaggtcaggagttcaagcccagtatggccaacatggtgaaacctcatctctactaaaaaaatacaaaaattagctgggcatggtggcacacaccttcatcccagctacttgggaggctgaagcagtagaatcacttgatcctgggaggcggaggttgcagtgagccgagattgtgccactgcactgcagcctaggcaacaaaacaagactgtctcacaaaacaaaataaaaaatttttaggccgggtgtagtggctcacgcctgtaattccagcactttgggaggctgaagcagtagaatcacttgatcctgggaggcggaggttgcagtgagccgagattgtgccactgcactgcagcctaggcaacaaaacaagactctgtctcacaaaacaaaataaaaaaattttaggccaggtgtagtggctcacgcctgtaattccagcactttgggaggctgaagcagtagaatcacttgatcctgggaggcggaggttgcagtgagccgagattgtgccactgcactgcagcctaggcaacaaaacaagactctgtctcacaaaacaaaataaaaaaattttaggccaggtgtagtggctcacgcctgtaattccagcactttgggaggccgaggtgggcagatcacttcaggtcaggagttcaataccagcctggccaacatggcaaaaccccatctctactaaaattacaaaaattagctgggcgtggtggtgggcacctgtagtcccagctacttgggaggctgaggcaggagaattgcttgaacccggaagtcggaggttgcagtgagccaagattgtgccactgcactccagcctgcgtgatagagcaagactgcgtcttaaaaaataaataaataaatttaagtaaaagtaaaaataaaactgcctggggaatctacaaatttactacctcacccatctctcagcgaatccctgagaaagggagccccccctgtcactgatggaggtgtgttcttccccttgggagaatagggccaaaaaaattaaatcccatgggtgcatagattttatgccttctatagtcacatttttaatctttttttaaatttgattattactttttgagaaagggtctcattcgtgtcacccaggctggagtgtagtggagtgtagtggtgtgatcatggctcactgcaatctctacttcctggattcaggtgatcctcttacctcagcttcctgagtagctgagaccacaggcacacgccaccacacccagctaatttttctattgttagtagagacagagttttgccacgttgcccaggctggtcttgaactcctgggttcaagtgatccactcctctcagcctcccaaagtgctgggattacagatataagccacagcatccagccacttttttgtttttaatcagcaattaaacctacacaatggccaggtgcggtggctcacacctgtaatctcagcattttgggaagctgaggcaggaagatcacttgatgtcaggagttcaagaccagcctggccaacatggtgagaccctgtctctactaaaaatacaaaaattagccagaatatggtggctcacgcctgtaattccagctactcaggaggctgaggcaggagaattgcttgaacctgggaggtggagtttgcagtgggccgagatggcaccagtgcactctagcctgggcaacagggcgagactctgtctcaaaaaaaaaaaaaaaaaaaaacctgcaccaagactcaatcatatgtttggtatattattcaaccagtggttgtacctctgtgatatgctttcatatatttatcattctgtttcagggagagtggtgaatatcagtagtttgcagtgtttaagggcttttgaaaactgcagtgaagatctgcaggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatgacaaagttgtgcaaaactggtaaacgtctgcttcggagcttgctgcttaataaatgttggtggaatgaatgaa

SEQ ID NO: 322 - DNA, 14913 bp, Homo sapiens
atcataaaatgttgagtatcttatgtaatttattgaatctgtactgaaagtgaaatgcagaatggttgtatggggcctccaagtacagattctgcagaatgcatatcgcttcctcatccatcagtgaagtcagtaagtcctaagtggaaccatcagagggcagggaccatctatctgtatttgacttgcttatttgttcaaggttctgagtcaataggacaagcaactactaagccactagagggcgcaacttgcctactctttctagagtaaggcagcaggtgtttcgggaccggtggggccacctggacctcagtggagggtggtgtgggtgcagcccttcccagggctgatgacgcatctggctgacgaggctgactgtcagcctctggcctctctcccagaggtgtgccctcagatcaaagaggacacctcctccccttaagaggatttatttcctcgaaggcacagcttctatgatctgtgtttttctttcttcctttcccattcacatttaattccttgtagccgccaagtttctgagaacaaagctgtttagaaagcaatgaagaacacaacatcactgatgtagtattcctggccaaaatattgatgtgactctcctcatgagaacagaccaattcactttgagagaaatactacaaaataatggtctacagtcttcaaaaaagtcattgccaactaccttacattaaaatatatgaaagagatgtgacaattaaatgcaatccatgggccaggtgcggtgactcacgcctgtaatcccagcactttgggagaccaaggcgggcggatcatgaggtcaggagattgagactatcctcgctaacacggtgaaaccccgtctctactaaaaatacaagaaattagccaggcatggtggcaggcgcctgtagtcccagctacttgggagactgaggcaggagaatggcatgaacccgggaggtggagcttgcagtgagccgagatcacgccactgcactccagcctaggtgacagagcgagactccatctcaaaaaaaaaaaaaaaaacgcaatccatgatcctactttggaccctggattaaagcaaacaaaaactgtaaaagaacattactgggacaatttggacacatttgaatatgggctgtattttagataatagtgttgtataatgataaatgcctggcatgtggtcataactgtagtaatgtaggggaatgcccttgctaccatatataatactaaagtgtttaagatgaaggtttatgatatcagcaacttggagagaaaaagggacagagagggaaaaagcaaacacagcaaaatgttaacaattagtgaacttaggtgatgggcatagggtatttatcgaactattcttgtaacttctctgtaacaggaaagaaatacatacatacacttcatctttgaaagtgagagagagaaggaaggaaagaaatactgaatagtactaggtacctggggggatgagtgaggtgctagtttccaaggacagagtgagggtatctcttgtgggattggggtccacaagaatgtgcagctcccttgcaatgggaacttgtggggaatgccattcagaaaatgaaataaaatctacagatccggccaggtgcggtggctcatgcgtgcaaccccagcactttgggaggccgaggaaggcagagcacctgaggtcaggagtttgagaccagcctggccaacatggtgaaaccccatctctcctaaaaatacaaaaattagctgggcatggtggcgcacacctgtaatcccagctacttgggaggctgaggcaggagaatcacttaaacccgagatagaggttgcagtgagctgagatcgcgccactgcactccagcctggacaacagagcaagactcatctcaaagaaaaaaaaaaagaccctattggacacagagaatatgcattcagaataatacataataaaagaactcactaaaattagtggggtttgatgctgatgaaatgtgtaaattaacacatttactggtttttggatttccaccagtacttcaaattgtaaaatttttggcctacatatttgtttctatgggcacaattgtctctttagtagctgtgaatcatgatcaacatgaatattaattcataatttaatgaatattaatattatcaaatagggactaaaaagtaatgaaatcaggccggatgcagtggctcacgcctataatcctagcactttgggaggccaaggcaggcagatctcctgagctcaggagtttgcgaccagcccggccaacatggagaaaccccgtttctacgaaaaatacaaaaattatttgagtgcagtggtgtgtgcctgtgggcccagttatttgtggggctgagacaggaggatcacttgagtctgggaagtggaggctacagtgagccgagatcatgccactgcactccagcttggctggcagagtgagattctgtctcaaaaaaaaaaaaaaaaaaaaagtgatgagataaaaaccaggatggaaaaacagcccattccacacgtgaagtgtccataatgaaggacagacagagtcatccccagggattccttactgctggttgtggcactaaggaattggggtggctgcccactgtcctaggacattgggtgtgcctaggaaattgagagctttagtccttagggtgagagcactgtccctcagaaagcaggtttataagtacttggagtgtgtatgctggggaggagcagttttataaaactgccagcgggctgggcacacggtggctcacacctgtaatcctagcactttgggaggccaaagcgggcggatctcttgaggtcaggagttcaagcccagtatggccaacatggtgaaacctcatctctactaaaaaaatacaaaaattagctgggcatggtggcacacaccttcatcccagctacttgggaggctgaagcagtagaatcacttgatcctgggaggcggaggttgcagtgagccgagattgtgccactgcactgcagcctaggcaacaaaacaagactgtctcacaaaacaaaataaaaaatttttaggccgggtgtagtggctcacgcctgtaattccagcactttgggaggctgaagcagtagaatcacttgatcctgggaggcggaggttgcagtgagccgagattgtgccactgcactgcagcctaggcaacaaaacaagactctgtctcacaaaacaaaataaaaaaattttaggccaggtgtagtggctcacgcctgtaattccagcactttgggaggctgaagcagtagaatcacttgatcctgggaggcggaggttgcagtgagccgagattgtgccactgcactgcagcctaggcaacaaaacaagactctgtctcacaaaacaaaataaaaaaattttaggccaggtgtagtggctcacgcctgtaattccagcactttgggaggccgaggtgggcagatcacttcaggtcaggagttcaataccagcctggccaacatggcaaaaccccatctctactaaaattacaaaaattagctgggcgtggtggtgggcacctgtagtcccagctacttgggaggctgaggcaggagaattgcttgaacccggaagtcggaggttgcagtgagccaagattgtgccactgcactccagcctgcgtgatagagcaagactgcgtcttaaaaaataaataaataaatttaagtaaaagtaaaaataaaactgcctggggaatctacaaatttactacctcacccatctctcagcgaatccctgagaaagggagccccccctgtcactgatggaggtgtgttcttccccttgggagaatagggccaaaaaaattaaatcccatgggtgcatagattttatgccttctatagtcacatttttaatctttttttaaatttgattattactttttgagaaagggtctcattcgtgtcacccaggctggagtgtagtggagtgtagtggtgtgatcatggctcactgcaatctctacttcctggattcaggtgatcctcttacctcagcttcctgagtagctgagaccacaggcacacgccaccacacccagctaatttttctattgttagtagagacagagttttgccacgttgcccaggctggtcttgaactcctgggttcaagtgatccactcctctcagcctcccaaagtgctgggattacagatataagccacagcatccagccacttttttgtttttaatcagcaattaaacctacacaatggccaggtgcggtggctcacacctgtaatctcagcattttgggaagctgaggcaggaagatcacttgatgtcaggagttcaagaccagcctggccaacatggtgagaccctgtctctactaaaaatacaaaaattagccagaatatggtggctcacgcctgtaattccagctactcaggaggctgaggcaggagaattgcttgaacctgggaggtggagtttgcagtgggccgagatggcaccagtgcactctagcctgggcaacagggcgagactctgtctcaaaaaaaaaaaaaaaaaaaaacctgcaccaagactcaatcatatgtttggtatattattcaaccagtggttgtacctctgtgatatgctttcatatatttatcattctgtttcagggagagtggtgaatatcagtagtttgcagtgtttaagggcttttgaaaactgcagtgaagatctgcaggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatgacaaagttgtgcaaaactggtaaacgtctgcttcggagcttgctgcttaataaatgttggtggaatgaatgaatgaattgatgctgtggtttgattatttctgttctttttttttttgagacggagtctcgctcttgttgcccaggctggagtgcagtggcatgatctcagctcactgcaacctctgccacctgggttcaagctgttctcctgcctcagcctcctgagtagctgggattaccaggcatctgccatcatgcctggctaatttttgtaattttagtagagacggtatttcaccatgttggccaggctggtctcgaactcctgacctcaggtgatctgcccaacttggcctcccaaagttctgggatttcaggcatgagccactgcacccggcctttttttctctttcttttctctctctctctctcttttttttttttttgagatggagtttcgctcttgttgcccaggctggagtgcaatggcatgatcttggctcaccgcaacctccgcctcccaggtttgaatgattctcctgcctcagcctcctgagcagctgggattacaggcatgtgccaccacacctggctaattttgtatttttagtagagatggggtttctctatgttggtcaggctggtctcgaactcctgacctcaggtgatccacccgcctcagcctcccaaagtgctgggattacaggcatgagccaccacgcctggcctctttctgttcttgaaaaggaatgttcataagaatctccctgggagaaacgtgtctagttctggaatctggagctgaacaacattgctatgcccaactcttcagcctgagagggagaagaacatagtctcaaattttagtgggcatcgggaccacctggagggctgattaagccagattgccggttccactccccacaccaattcacttcatttctaacaagttctcaggtggtgctgacactgctggtgctgggactgcacttagaaccactggtgtagcaagtggtttcagaactatggagccattttctagctgttccttgctgtttccagttttttgattctgtaagggtgatgctttatcctctatttccttagctctgcaagctttctttgcatctcattctgttttgagtatatttttattggttgttttactttttttttgcttgagacagaatctcactctgtcgcccaggctagagtgcagtggcacaatctcagctcactgcaacctctgcctcctgggttcaagcaattcttctgcctcagcctcccaaatagctgggactacaggcgcccaccaccatgcccagctaatattttgtatttttagtagagatggggtttcaccatgttggccaggctggtctcaaactcctggcctcaagtgatccgcccaccccagcctcacaaagtgctgggattacaagcatgagccaccacacccggctggttcttatacttacaaagtagcagagcttgaaggactcaggaggaatatcttctttaactgggacatgatttcttctagatttttcagctgggttttgcattctgcattccttcccagaatgtttacgaggttgcccagccaccgcaactgtatctctttactgaaactcatgcagatgtcttctccttaacctatgcacactccctgtgaactacagcccagggtgattcttcagtaactccctaagcctttttttttttttttaatttgagacagtgtcttgctttgttgcccaggctagagtgcagtggcacgatcatgggttactgcagcctcgacctccagggcaagagacttccatgactaaaacctcaagtgatcctcccacctcagcctcctaagtagctgggactacaggcatgtgccatcatgcccaaataatttaatttttggtagagacagggtctcactatgtttcccaggttggtctagcactcctgaactaaagtgatcctcgctcctttgcctctcaaaacgctgggattccagacatgagccaccgcacccaccctctttcataatttttttttttttttcagacagagtcttgctcggtcgcctggctggagtgcagtggtgccgtcttggctcactgcagcctccacctcccaggttcaagcaattctcctgcctcagcctcctgagtagagtggctgggattacaggcgtgcaccaccatgcctggctaatttttgtatttttagtggagatggggtttcgccatgtaggccaggctggtcttgaactcctgacctcaggtgatctgcctgccttggccttgcaaagtgctgggattacaggagtgagccaaagcctcttttataatcattatgacaataggtgagttcacattctctgctttcaaatgggattggttttgcaacaggcctcctggcttctggttacaccttgtagaaaaaagtcttggagagcaaggagtcttctgaaatagaagaaatgtactcgcaaaggcttgcaagagtgtcaaggcttcggcaagaaggctaatcacacaaaaaaattcagtggaatttacattccggctggccacagtggctcaagtctctgatcccagcactttgggaggctgaggcaggaggatcacctgaggtcaggtgtttgaaaccagcctgggcaacacagcaggcctccatgtctgcaaacaaatcaaacaaaacttagccagacatggtggcacacacctgtagtcctagctacttggtaggctaaggtggaaggatcagttgaacccaggagttcaaggctgcagtgagctatggtcgtgccactgcactgcagcattctgggtgacacagccagaccctgtctctacttaaaaagaaaacgaatccattgaaagatggaaaaaaaccaaagggaaataactacaaatttgccaaggttaccaagtttatgataggctgctcactgtgtgaaattagaaatgttgtcacttgattatcaaacccacaaatgtcacatcatatcccctgacataggtaagcactgcagtcataagagataatgccgtttttccttagggaatcagtaaagtatgggaatgctcaagtttcttttatttgggggaactgaactgcacaggatgacctggttatttctggttcatcacagtatgtagctatttgtttttcttaactctctgatttacaatggcagcacctcaaagtgtcagtttaactctcacagcctgcacccactttttcatccacttggggtagggggaagtctgaatcccacctagactgcatttaacatcttgaggccagatggagtggctcatgcctataatcccagcattttgggaggccaaggcaggcgggttgcttgagcccagaagtttgagaccagcctggacaacatagcgagacccctctctacaaaaattcaaaaagatcaggcagacgaggtgcacacctgtagtcccagctactcagaggctgaggttgggaggatcacttcaacctgggaggtcaaggctgcagtgagccatgattgcgccactgcacttcagcctgagtgacaggacaagaccctgtctcaaaaaaaagcctaaaacaacaacaaaaacttcctttagcctatttgtatgtcactgattaaatccaacatgctcttatggtattcatctcaggctacagctcctaagacattttaatgtctcctttcctggctctaaaaacaatttaatggctttcaatcagcttcccgagtatcttttgtactctcgcctccctctgcagccaaactccagtcctgctaatgccgggcaatagcccaggaaccacagagcacttcaggctctgcctgacaaagttacagacaggaagttcagaagaaatgagccagtcccttttatttcttcttcctcttttgtctctaaccaatcctttttggataagtgtgtaacccacttcctcttttgtctctagccaatccttttaggataagcatgtagctcatttggatgacccttaactgtcaactgctggtcagaatgacatttctcattcttagagaagggctgccattagcccttattggatggtctgcccagcaccctcttccaaaatatgatctcctgccctcccctgccccctgcttccttcccatgtttgcagctgcagctgccacaaggtgaccttgcctctgttgactgctccagctataggtttttcctctaaaaagaaccagctggattggatcagagttgttactgtgcatctcaccccctgtgcctgaggagcagagggagccagccattgccagagaaagaggccaaccatcaagaggagcatttaagccaggtgtggtggctcctgccagcacaatcccagcactttgggagatcaaggcaggtggatggcttgcgctcatgagtttgagaacagcctgggtaacatggtgataccctgtctctacagaataatacaaaaattagccaggtgtggcagtacatgcctgtagtcccagctacttggggagctggggcaggaggattgcttgagcctgggaggtgtttacagtgagccgtgtttgtatcagtacactccagcctggatgacaaagcgagaccctgtcttggggaaaaaaaaaaaaaaaaagaaaagaaaagaagtggcccaaagagaaactcccttccctgtcctcagatcattcctgaaatcttgaattctcagagatgctccaagatacccttgtatccttaaaatatattttctttttcataagctatattgaattgggtagttgttgcttgcaatcaaaaggaacctaactaatagaagtgcattaacatgttttatagtattgtgaaaggaaaataaatcttggggccccaaaatcactaagctaaagggaagagttaagctgggaactgcttagggcaaacttgccttccattctattcaaagtcaccactctgctcactgagataaatgcatatctgattgcctcatttggagaggctcatcagaaactcaaaagaatgcaaccatttttctcttacctacctatgacctggaagtcccctccaggcttccagctgtcctgccttcacctggagctgtcccacctttctggattggcccaatgtacatcttacacatattgattgatgtctcatgtctccctaaaatgtataaaaccaagctgtgccctgaccaccttgggcagaagttctcagaacctcctgaggctgtgtcatggttgcccatcctcaaccttggcaaaataaactttctaaattaactgagacctgcctccgatgttgggggttcaccctatgctgtaggaaaaaaaacaattgggcttggaatcaaaaggagaaaaaaatcatgaattgagaacctatggcaaattagaccatatgtcctgcttaatgctttcccaacatggttttaggtaattctgactatagtcctttgccttagttcattttgtgttactataatggaatatcacaaactaggtaatttataaagaaagtaaatttgcctgtgcacagtagctcatgccaataatcctataactttgggaagccaaagtgggagcatcacttaaggccaggagttcaatgccagcctgggcaacatagagaaaccctatctctacaaaaaataaaaattgaccaagtgtgatcatgctcacctttagttctacctacttggtaagttgaggtgggagtatcacttgtgcccaggagtttatggctgcagtgagctatgatcatgccacttcactccagcctaagcaacagagactctgtcacttgtctcaaaaaaaaaaaaaaaaaaaaagtaagtttatttctcacaattctggaggctgggaagtccaaaagcatggcactagcatctggcaagggcctgcttgtgtgttctaccatggcagaaggcagaagggcaagagaatgctcacaaggtgcaaactaaactcatccttctatcaggaatccactcccctgataaaggtattaatccatttatgagggcagagtcttcactcatgatcttaaaggttccactttgcaacactgttgccttggggattatgtttctaacacatgactttaggggacacattgaaaccactgtatcctttaaggtaggaatcaatgtcatatttgtcatatttcgaacgaagaaataaaggtttggagaggttaattaacttgcccaagatctcagagctaaagccaggatcatatctaggactgactacaaagtcctgtggtctccagtgcttggcaggtccagcttcactgatgagtctagagagtagtaactctcttggtgtaagaactaagggagatgatacattaaatctaagtgtaaattagattatgcttaaagtataagtcatatggttattattaatagatccccaagttagcctatatgtgaacttttccatagagaaatgaagcatggtttcaatgcagcatattttaaatggattatctcatacaatgtgttttttgtttgttttatattgtttttgttgttttctgagacagagtcttactctgttgcccaggatggagtgcagtgacatgatctcagctcactgcaacctccaactcccgggttcaagtgatcctcctgcctcagcctcccaagtacctgggagtacaggtgcatgccatcacacctggctaatacaatgtgttttttttagacaccagagggagccagtggttctttccacatcagcttttctgtgaaacatttttcttttttttgaaatggagtttcactcttgttgcccaggctggagtgcagtggcgccacctcagctcaccgcaacctccccctcctgggttcaagtgattctcctgcctcagcctcccgagtagctgggattacaggcatgagccaccaggcccagccttgtgatagatttttctagactgttgcatgtgtggtacacccacatacaatatcagctttagactcaaccctttgactttgccttcacctactgaacagcaacaaggattgtgacagaccaagaatctgaagaaggatgcagtgtggagacgaaacaggtgtcaatgacaaaggtttagttgttatttcaagtcaactgcaaagtggatgcggtatcaagtatagaaactgcacaggacttctccactaagaacatggggagggcaaagggaatggatgttttgagaaaggaggcagaagccaacagagaacagtggttattaccaagatgggtggagtagaagttagtttatagaagacattggcttaggcctggtgcggtggctcacgcctgtaatcccagcaatttgggaggccgaggctggcagattacttgagggcaagagttcaagaccagcctgaccaacatggtgaaaccccatctctactaaaaatacaaaaaattagctgggcatggtggcgcacagctgtaatcccagctactcaggaggctgaggcagaaaaatcgcttgaacctgggaggcggaggttgtagtgagccaagatcacaccactgcactccagcctgggcaacagagctagactccatctcaaaaaaaaaaaaaaagaaagaaaaaagaagacactggcttagagggtcaccaatatctgcatatcaaaactaagaatgaatttacttggccaatctctctactgggtgatcagcctgagccagataatgcagtgggttctgatttataatgccttctttactgtcaagaggggtaaggattaaagttccggtttaaattaaagttgaaatgctttacttggtttgagtattattatgaaaggaccctgaccgtttctgcatgtcttaaactgatgaaagtagctaagtagacttttaagttgtgacaagacaacttgatccaagaaaacatatttcttgtcagaatatgcaattttttttttttttttgagatggagtctcactctgtcactcaggctggagtgcagtggtgtgatcaaggctcactgcaacctctgtctcccaggttcaagcaatcctcctgtctcagcctccccagtagctgggactacaggtgcacaccactacacccagctaatttttgtatttttagtagagacagggtttcactatattggtcgggctggtctcgaactcctgacctcaggtgatccacctgcctcggcctcccaaagtgctgggattacaggcgtgagccactgcgctcggccagaatactcaaatctcaatgttgtacatttactgtcaatcctgtcagtatcagtatattgtatacagtatacagtaattgacagtatactgtcaattataaattgagttttttaaattatgatttacaaatgaatttgtcaaaattaaattaaacccccccacacgcacacacacctggaatcctttacagataggtggtatatgaatacaaggcacagattgtatgtgcatggtggctttggcacaaacagactacttcttttttcaatgttaagtgtaaagcagttctttcatctctgttcagtgcagtgttgagtgtgactaggatttgaagaacctaaaaaaaaaaaaaactcacctgcttgccatcttcttgttttttttttgttgttttttggtttttgctggttttgtttgctgcttttgtaaaaccagtttatcatattctcattaggaaatcaattttcatgaaattaattttttttcctgctaactatggctcaatcttttcgtttctctctgcttctatcttaagaccattcctcaaattgaccatgagaggatttacatctggggcacttggtatatgccaaatggagacaaaatcagaatcagcagcctggctgggccacaggtccagcatcccaagctattaaaatattcttagtgtttccagggaagtgatagatccactttggaagctgataatatacccctcccctagaaacatgcatatacacaaagtgttctaaacaacttccaggtgctcatgacctcccccacctcccaagctcattgaccactgcctcgccttcacgaactccagacctggtctgaacatttctaaaggacgctcgggagttaaaaggagcgaggccactgcagaaatgacagccttcatccacaagtggcccacttcgggttggctggagccacagctgggtggggacagggcctgtgctcaggtgagcactgcctaccgcgcaccctccaggtgcgtcctaccctgaagcggtcggactggaccgtctaggtcccagcgctcgagaggatggcaggcaggggctggtgattgtctggagatatgaatgctttctaaggttgacgtcaaggtctccttcctgagccacagtccacgtgataagctctgtccaggtagaaatgatctcacctctcctgtcgcccagggtcggaaacctgaggcccgtgcgggctggggcaacttagcaggggtcccaagcccgccgcgccccctgcgccccaaacgtgtgtggagggcttggacgtggtccagagggaaaagatggggtgaaccaggtgccgcgcacccttcgaggagcccccgcttctccgtttctgtgagtgactccaaagcacctccgagggccgacacacgcgcggacgaccttgggcgggcactgaccaatgtccccttccactcggttgtgtcgggggtccccaggtgaggcgcgaacgccgccccgctcacctgtacgaggcctttcccggagcagcccggctacgaagcgacacccatggcggagaagctaaggaagactcccgctccctcacaccgcggct

SEQ ID NO: 323 - DNA, 129734 bp, Homo sapiens
tcccacagtgcctggcccagaagccttgctaaatatttgaacaggattgcccagtgagtttgtgcacagttgtgtttgtggacacgtgtcttctgtagctctgggttgggaatgatttgtatccccaaatggctctctcatttggttattttttgatttgcttttagatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggtatgtagggtgtatcctatttggattgcatggaggtggggacgtaattgtctttttattattataagaaattacatgattatattatttgtattttataatctttatatcattacatattatacagtataatctttatattatttcaaggaaataccattatatatacaatgatgattacaataattagaaaatatagaaaagaaaaaaaccactcataattctgtcctccagtgttacccactgttaacctatcaatgtatgtacctccttccagctttttctgagcataaaaatatatatagtgttcgtatagttgaagtctttttcttaacaatgttaatgtctagacaagataaaatttaaaatggtcaaattaggtattcaaagactgttctttgtatactccttaggatttttatttatttttcttctttgatctacttttttgatccttttactgctgtctggtaactcctagaagaataaaagttgaaataaatattgaaatctgcccaaaacttgtgtgtgtgtgtgcatgtgtgtgcatacgtgtgtgcatgtgtgtgtatggggtcagatctaggaaaaccaaaactggtcacacgtgggcttgaccttgtactctatatcaggggtccccaacccccaggccgctgaccggtaccagtccgtggcctattaggaaccgggacgcacagcaggaggtgagcggtgcgagcgagcattactgcttgggctctgcctcctgtcagattagtggtggcactgggttctcactggagcataaaccctatcgtgaactgcacatgtgagggatctaggttgcatgctctttaggagaatctttttttttttttttttgagacagtctcactctgttgcccaggttggagtgcaatggcgcaaccttggctgactgcaacctccacctcccaggttcaagcgattactcctgcctcagccacccaagtagttgggattacaggcacgtgccaccacacctggctaatttttgtatttttagtagagactgggtttcaccatgttggccaggctggtctcgaactcctgacctcaagtgatccacccacctcggcctcccaaagtgctggggtcacaggcgtgagccaccacacctggccactctttatgagaatctaactaatacctgatgatctgaggtggtacaacagcagatctacagtttcatcctgaaaccaaccatgcgccctcccacccatctgccaccccatctgtggagaaattgtcttccacgtggccagacgtggtggctcacacctgtaatcccagcactttgggaggccaaggtgagtggcggatcacaaaatcaggagatcgagaccatcctggctaacgcggtgaaaccctgtctctactaaaaatacaaaaaaattagccgggcgtggtggcgagcacctgtagtcccagcttctcaggaggctgaggcaggagaatggcgtgaaccagggaggcggagcttgcagtgagctgagattgcaccactgccctccatcctgggtgacagagcaagactccgtctcaaaaaaaaaaaaattgtcttccacgaaactggtccctggtgccaaaaaggttgggaaccacatctctatataagtgacatatagatgggagcattatattttcccatcctttctttcccagaaagaaagtgacacagggactttcaagtgctcagatgaccactacaacatgtaggtagatgatatctgggcttagataagctgtacctggctctgttgctgttcagacaggacctgagtttggagcccaagtgctaggtgggagttaggagatgtctaactctactctgcagatctcagctccccaggccaaacacaccaggggaactggggtgagtgaagaatttcagcagcctgaccctccagccctgacagatggctatcaggcacgctgcagatgggcagttcttacagctcgtggccagtaagctgctggtcttttgcaaggtatatttacgacctgtaaatgtcacggctccgtgctggctggggtggataaatgtttctaaggtctttaaaacaggaaataagagcttgcaaattctttggttttacagctctatctcaggaattctctaggtgaatgcagattgcattcgcagacttgctctgaaggtggattgctttttgaggggaaagggagaagcagtagaaccgcattgagtcccacattcttctggatgtttcacttttcagtactcagccctcctggagtctaagaacagcctactttttctttcttttctttttctttttgaaacagtcttgctctgtcacccaggctggagtgcagtgacacgatctcggctcatgacaacctgagcctcccaggttcaagcgattctcctgccacagcctcctgagtagctgagattagaggtgcccgccaccaggcctggctaatttttttgtatttgtagtagagatggggtttcaccatgttggccaggctggtctcgaactcctgacctcaagtgatccgcccacctcagcctcccaaagtacagggattacaggcatgagccaccgtgcccagccgaacagcatatttattgttggggagggcacagtcttcattatttctgttttttctttttctttattgagataaaattcacataacacaaaattcaccatttacccattttaaagtgcacagttaagtggcctttagtatgtttaccatgttgtgtaacccttactatctagttccacacattttcatcactccaaaaggaaacccgtacccattcagcagttcctccccattcctccctccccccagccccggtaaccacgaatctactttccctctctacggactttccatggaaatggaatcataccacatgtggctttttgtgactggtttatttcatttagcataatgttcttaaggttcatccatgttatagtatgtgttagaattaccttcctttttacagctgaataatactctattgtatgggtaagtcacattttcttttcttttcttttctttttcttttttttttttttttttttcgagatggaatctcactctgtcatccaggctgaagtgcagtggcacagtctcggctaactgcaacctccaccttctaggttgaagcgattctcctgcctcagcctcccgagtaactgagactacaggcgcacaccaccacacccggctaatttttgtatttttagtagagacagggtttcaccatgttggccaggctggtcttgaactcctgacctccagtgatctgcctgccttggcctcccaaagtgctgggattatagacatgagccaccgcgccgagccacatttttctttatccattgatcagttgatggacatttagatttttaccttttggctattgtgaatagtgttgctatgagcattcatttgcaagcttttgtttgaacctcagttttcaattctttggggtgcatacttaggaggggcattgctgggacatacggaaacgctatgtttaacttactgaggagccaccaaattgttttcccagcagttgcaccattttacatatccaccaaaagcaatgcgtgagtgttccaatttcctaacatcctcaccaatacttattttcaagtttttttttttttgacactcgctctgttgcccaggctggagtgcagttgtgcaatcttggctcctgcaacctccacctcctgggttcaagcgattctcatccctcagcctcctgagtagctggggttataggcgttagcgaccatgcctggctaattttttatttttactttttaatacagatggggtttcaccatcttggccaggctggtctcgaactcctgacctcaggtgatctgcccgcctcaacctcccaaagtgctgggattacaggtttgagccactgtgcccagcctattttcagttttttaaaaatgataaccatcctagttgtgtgaagtggtctctccctgtgggtttttttttttaattaataattttaaaaaataacttttattgagaccccaccaggtgcaaaacctgttcctggcgttaagctccttcttcctttgcaattcggtctttctcgagtggtcccatgaatgctttcttctcctccatggtctggaagcggccatagccaaacttggaggtggtgtcagtgaacttaaggtcagtcttctccagagcccatcgtctggtctgcaccagcaaagatgtgcagagaatgagcactcgcttcttggttcccaccacacagcctttcagcataacagagttattggtcacttcaccatagtggacaaagccacccagaaggtcgatgctcttgtcagacaggtcatagtccgtggaggcattgttcttgatcggtttgctgtcctcagtaaggtagccctggtcaatcttacagatcttcttgttgatctcagtgtggtgatggtcgcctttctgcccagcacatgccatggagaaggccacatggtcaggatgccatgccccaatccaggccaccttgcacaggcctcggtgggtcttgtggggcagcttcttggtgtgccaacaactggtgacccctttgtagcctttgcccttggtcaccccgatgatgtcgatcatctcgtccagcccaaacgcttggttcacaggtacctgctgctgtagcccctcctgggctcagtccagcttctcagccatggtgcctccgttcacttggatctccatcagctgggccttcttctggcgcagaggaagtaggcgcgtctgggtgtgggcagcgaggcgggtgacttggcagtgcttcctcatgctgctgaagtcttctccagctgcttcttgccatcctcatcctgccatttcttgcagtacttggtaaaggccttcttcctagatttatgccggttgttagagaaacaccttttgcactcatcgttgatgtgctcagcaaagatggccttgaaggtccggaggcctcaaggggtttccacgtagcccgcaatgcccacaaccaccataggtggtgtctccacagtagtcatggcctctaccacctccttcactttcaccttggatcttggcctgtcgacttcccgtgtgatgtgggtcatgccagccttgtatcccaggaaggctgtgacgttgaccagcttggaagggtcatccttagggaagctcttcaccttcccacgttgcctatttcttcactcctatggcaggaagcagagggacccatgtctgggagtggagaactttctgtgagacatcacacaatcaaattccaccggtagagctctccctgtggttttgatttgcatttccctaatgactaataattttgagcaccttttcatatgctttttgggcatttgtgtatctttttggaagaaatttctattctaggcctggcgcggtggctcatgcctgtaatcccagcactctgggaggccgaggccggcagatcatgaggtcaaaagatggagaccaccctggccaacatggtgaaaccccatctctactaaaaatacagaaattagctgggcatggtggcatgcacttgtagtcccagctacccaggaggctgaggcaggagaattgcttgaacccgggaggcagaggttgcagtgagctgagatcgtgccactgcactctagcctgggtgacagagtgagactctgtctaaataaataaataaatatatatatataaaattattatttatttatttataattatccagccgtggtagtgcttgcttgtcctcccagctacttaggaggctgaagtaggaggatcgcttgagcccaggagatcaaggctgcagtgagcatgatcatgccactacgctgcagcacgtagtgctgagtgacagaacaaaaccctgtttcaaaaaaaaaaaaaaagacataactttgttagagttgttacctgaggattcccatcccaagggtctcctcttggatctcatttcttgttccctgctgctgtgattaactgttgagtttaagcagccaccttgaagaatttgcaagatacggttgggacaaaggtgatgctgtcagtccctacctctgctttgcctgaggccgctgacattcatggagagctcactgcgtgctaaggagttgacgtgcattattgtataatacttaaaatgtatcttgagatccgtctcaggttcaaccacttgtgcaaggccactgccagccagtggcagagagagggctcagaccccgaccagcctggttccaaggcccatgctcatgagcagagcctccagccttcttcatgtcagtatctgtatagcttacgtaaggggaaagggctgtgcttctttgctgccagggaccctgtctccatcacccaaatgcagtaggcgcaattattaggcccattttaccgatgaaggctaacctacttgcccagtgtcttatggcaactgagtggttattatggattgaattttggcctccgtgaaagaaaccctggagtcttaacccttagtacctcagtatgtaacttgatttggaaacagcatctttacagagctaatcgagctagaggaggtcattagggggtggccctaatccagtgtgactggtgtcctgatgaaaaaggggaaatgtagacacagacatgcatgagggaaggcaccatgtgaggatgaaggcagagaccagaaagatgcatctacaagccaagaagtgccaaagaatgacagcaaactcctagcagcggggggagaggcacgggacagattgtctatgcagccttcagaagaaagccgctctcttgacaccttgatttcagacttaacatgagagaatacatttctgttgttgaagccacctggtgtgtggcacttcgttatagcagccctagaatgctatgacagtggtaggacaagatctgttaacacctcagtgctggggataaggcattgaacactaagcccctgctctcatggaaagaaatgacgctttcttggcgagagacagacgacagatgactgtgtgatgtcagatgctgaatgctaagaagaaaaataaactggggaagtggggtatggaggaaggaggagggagtgctattttagacagagaggacactgacagcgtgaccttaaagcagaggttggggtgaagtgagcaagctggtgggaagggcaatctggggcatgggcctgtgtccaaggcatgggaaggggacaggagtagccagaggacagagtgaccagagatacagcagggtcaggccactgataggattttgctctggcggggaggggaagccactgagcttcctcccagggaggctgtgagcaagggaacctctgcctcacccattccaagaattccccgggccgtcagcaagcacaagagccagtgtggatgcccgcaccattaggcctgagatcagttcctgccgttactggatgtggagggtttggatggtgctggagggagcacatcttgatcagcatcaggaatacttggttctgtgaaacttgcaacttctgcattcaagggtccctgataggagttggtatgaataaagaattttcttcactgggtgcagtgatgcatgcctgtaatcctagcactttgggaggctgaaggcagaaggatcacttgagcccaggagtttcagaccagcttgggcaacatggcaaaaccttgtctctccaaaactacaaaaattatctggccatggtggtgcacacctgtagtccagctactcagaagcctgaggtgggaggatccctggagcctcagcctggagctcttgcaccactgcactccatcctgggtgacagagtgagaccctggctcaaaaaaaaaaaggaatttttttaaggctttggtgatcgtcacatttcttggacttatgcacagaaattcagtgagtaagagttgagagttgggcggggcgcagtagctcacccctgtaatcccagcactttgggaggctgaggcaggtggataacctgaggtcaggagtttgagtccagcctggccaacatggtgaaaccctgtctctattaaaaataaaaaaaattagccaggcatcgtggcgaatgcctgtagtcccagctacttgggaggctgaggcaggagaatcgcttgaacctgggaggcagaggttgcagtgagccaagattgcaccactgcactccagccttggggacagaggaagactctgtctcaaaaaagagttgagagttgaattagcaaaattctttataatacagatttaaacaatgatataggacacaaaagcttagggtcaacattcttttttttaaggtaggtaactaaatgttataatgcataaaacttagatttggaggagaagactcatccagtcaacccttttttcaactaagaaaactggttcccagaaggtcttggtatgtccagctgtagacagattctaatggtatcattttcaaacttgctcaatgtttcagcatcatttttagaatttttctgtgttagagaatagtttatctttttttttttttttgagatggagtcttgctctgtcgcccaggctggagtgcagcggccccgtcttggctcactgcaagcttcgcctcctgggttcaagcaatcctcctgcctcagcctcccgagtagctgggactacaggcgcccaccaccacacccggctaattttttttgtatttttagtagagacggggtttcaccgtgttagccaggatagtctcgatctcctgacctcatgattcatccgcctcggcctcccaaagtgctgggattacaggcgtgagccgccgcgcccggcccaagaaaaacattttcatcaagtgcccttttgagccctgaacccaggtgctctaccaagcctgatttacagctttgattttggaagtgaaggctaatagaaataaattaactctggatttaaaaatcttatcattaaagctctttaaaaaaaaaaaaaagttataatggtcctaaatgaaccagttttttttgttttttgttttttcgctgcttttatctgatgacacactacggtttcacagagcagccatgaacaggaagggcagcatgaggtctgtggtgtcacacagttcagcttccggagtcttcatcagttagctacaagcacctcctgtttaaagcagagcctcctgatggtgtgtttcagaattagtgctgcagtgtggtgggaagaacacgggttggagcttggagacctagtgaactactccagccctttacagatcggctgcaagaactctttacctaaaaacttggtgagaggccaggcgtggtggctcacgtgtgtagtcccagcactttgggaggccaaggtgggtggattacttgaggtcaggagtttgagaccagccttgctgacatggcgaaaccccgtctctactaaaaatgcaaaaattagccgggcgtgatggcaggcacctgtaatcccagctacttgggagactgaggcaagagaatttctggaacctgggtggcggaggttgcagtgagccgagattgcaccactgcactccagcactccagcctgggtaaccaaaaaccaaaataataaataaattaataaaaacttgggtgagtccaacagaatccttcttctttttttgaggctggagtgcaatggcatgatctcagtttactgcaacctctgcctcctgggctcaggccatcctcctgcctcagcctcccaagtagctgagactacaggcatgtgtgcgctaccatgcctggctaatttttgtattttcttttcatagagacagggtttcactatgttgcccaggcaggtctcaaattcctgagctcgagtgatcctcacaaagtgctggaattataggcgtgagccaccgtgcctggccgggatcctgattttttacccctgcctgaatcaactcctcttccctgttgactagtattagttcacataaatcctcttcagcctggagtctgtgttagtctgctagggctgccataacaaaataccactggcagagtggattaaacaacagattgttttgtttcacagttctggaagccagaagtccaatatcaacgtgtcggcagggttggttcttctgaggcctcgctgcctggcttggagatggtgtcttctccctgggtcctcacaggatcatccctctgggtgtatctgtatccagatttcttcttcttcttcttttttttttttgagatggagtctcactttgttgcccaggctggagtgcagtagcacgatcttggctcactgcaaccttcacctcccagattcaagcgattcttctgcctcagcctccaaagtagctgggattacaggtgcctgccaccacagccagctaatttttgtatttttagtagagatgtggtttcaccatgttggccaggctggtctcgaactcctgaccttaagtgatccgcccgcctcggcctcccaaagtgctgggattacaggcgtgagccaccacgcctggcccagatttcctcttcttacaaggacaccagtcagactgcattagggctcaccctaactgcttcattctactttgattacctatttaaaaatcctgtctccggccgggtatggtggctcatgcttgtaatcccttggcctatgggaggccaagatgggtggatcacttgaggtcaggagttcaagaccagcctggccaacatggtgaaatcctgtttctattgaaaatataaaaacgagctgggtatggtggcgcatgcctgtaatcccagctactcaggaggctgaggcaggagaatcacttgaacccagaaggtggaggatgcaatgaaccaagatggcactgctgttctctagcctgggcaacagagtgagactctgtctcaaaaaaaagaaagaaaagaaaaagaaaaagaacctgtctctaaatacagtcccagtctcaggtggaggtcaggaagggctttgccataggagtttgagagggatacagttcagccatgacagaatgtgatgaggaggtgcaggctgtctctccacctgtcacctgtttacaaagctgatctctggtagaagcccagatggtcttttatcacacaccttgtggaggaacagaggaagtgtgatttctttagtcttgttcttgatccaggagcccagtgaggagcttcgactttggggtgtgtgtgcgtgtgtgtgtgtgtgtgtgtgtgtggtgatacagttaagcacccagaactgctgagtcaggaaagcgttccaggtgatttgtgccccctccaccgcatgccaagagctctgcaccagcttatttatggggcactgcattgtgggggtatcctacatgtctgctgggggtggccctttcagccttcctcccccactggagccttggtgctgctgccacagttgactctgcactccttatccctgctggccagaccctgcatgctcagtgcctagaacaaggctacgagccctgccagcctccttgtgtatgagctgcatctttcagcctgcagggtgcctggtttcatctcagcatctcacttgtagggcatcctctgttagagcgtgacacctaaatttggggctatgattttagccattttctagcaacctttgttctgatgacctctgtggctatgaccgtgagggtggaggtggccaggtaagtgcagggccagggtcatcgtggaatgataagggcctgaattgccttctgagaagacaccaaatggaaaggatgctgttgatgggaattcttgactggcttcacgttaaactagatcctgtacctctgcaggagaggggccagcccagcatccatttgtctctggcagtgtcctgatgctcttggcaccagtatttagaagatgcagatccaactcccgtttttttccctcccctcccctttcttttcttttttgagacagagtctcactctgtcacccaggctggagtgcagtgacccaatcttggctcactacaacctccacctcccaggttcaagtgattctcctgccccaggctcctgagtagctgggatcacaggcatgcgccaccacacctggctaattttttttgtattttttgtagagacagggtttcgccagactggtcttgaactcctgacctcaggtgatccgcctgcctcgacctcccaaagtgctgggattacaggcgtgagccaccgtgcccagtcctaactcccatttctaaggtgtggcaaaggctgctgaatcctttgctgtcgttctgttgtgggtgccatgctggggctctgatgatgttgcagcttcaccccttaccccaggttatctgaaggagctgagggtgttcaagagcactgctaccccaggcttcacagcagcctcagtgagggccactcacactgtaagatcgagatggtctttttgaaaagagcatttctctttgctgaaaagagtctgatatgcttttcgataatttgtagccaggatagtctatttactttgtgtttgagtgaaggaatatttttgccattcttcctttcaggtctgctgtggggctggaggtagtccagatttagagatgaattattcctccagtgctgtgatttgaatggctcttccaaagtccatgctgaaacttaaccccaatttgacaatattggggttgggggggcctttaaaaggtgaccagaccatgagggctctgttctcataaatgagttactcgacgtatggattaatgcattgataggttatcctgggtgaggaactggtagctaaataagaagaggaagagaggcctgagctagcattagcatgctcggcctccttgccatgtgatatcccacaccacttcgggactctgcagagagtctccaccagcaagaaggccctcaccagatgcagccccttgagcttggcctctgtaactgtaaaaagtaaatttattttctttataaatgacccagtttcaggtattctgttataagcaacagaaaatagactaaaatatccagcaatctaacagaattgagtttatagataagggaaagggtttgtgacccacctacactatataaattctcccaagaaagttaggagctagaaactccatgtcacgccttggtgtggaaggtgctgtggactgaattgtgtttctccttctcccctcaaactcatatgctgaagtcttaaccccagtgtagctgtatatcaaggtaggatctttggcagatggtttaggttaaatgaggtcatgaggatgagaccctaatttaataggactgtggccttataagaataggaggagggcaggcacagtggctcacacttgtactctcaggactttgggaggctaaggcaggtggatcacttgagcccaggagtttgagaccagcctggacaacatggggaaaccccatctctacaaaaacaaacgaacaaacaaaattagcctggtgtggtagcatgcacctgtagtctcagctacttgggaggctgaggtgggaggtttgcttgagtccaggagtctcttaagaaaaaaaaaaaaaggaagaggaagagacagacttcctcccacctcccaccatgtgaggacacagtgaggagatggctgtctgcaagccaggaagagagctgaaactgctggcaccttgattgcggactcccaacctacagaactgggagaagtaaatttctgttgtttaagccgcccactctgtggtattttgttatggcagcctgggccaactaatacagaaggaactaagttaaacttgtatttttcagaaaaaaagcaactgtttgaacaggaataccaacattcaagcttgtatttgagtcacatacaggcattcccatttacctatcttttaaaaatagtcttttccttttaaatttctttccaactttattgggcatacaataaactgcaagcatttagaagtgtataatttaaagagttttgacataacgtttatccctgtgaaaccatcaccacaatcaagacaatgagcatggatctgtcacccccagaagtttcctcctgtccttttgtcgtctccctccctcccttgtccccagacaaccactgatctgttttctgtcaccatagatttgtttgcattttctgaaagtttatataaatggaatcccacagtatgtgccgtctctctccttttctggtctggcttctttcactcagcaaagctacttcgagagtcattcaggctgttgtgtacatcaaagtttccttcttttttactgctgagtaagagtccatggatatatacaatttctttatccatttcccattagtggacatttgggttgcttccagtaggtatatgtttaattttttaagaagctgccaaactgtttgccaaagtggttgtatcattttacattcccagctgcagtgtatgaaagctccagttctcccccatcctcttcaacacttggtatggtcagtctttttcactttggtcattttaatgagagtgtaatactctcttattgtggcttttgcattttgtacatgacagatgattagaaaatcagtaagtggtcattgtaactttgttttaattccatagacacataacataaagatcactgtaagaatcttcactgttttattgtaggtaatagcaaaaaattgggagtgaccacccctggtaggggagtagttgtgaagtgagtcatggaacgacaatataatgcacacacagccatggaaccaagtagactggtagttactaacatgaaaaatgcttattataaataagggggaagaaaggacaggcgaacagtttacatatagcccactcaatcttgtgtgtgtgtgagagaaagggagggggtactgtataggagtggacaagatctcgaagccccttattgtaggactagtgtatttccagtttttcacgactctgaataaagctgtaatgaacatctttacgcacgtggctatttttgttaagataaattgctagaggtggagtagctgggtcagtggacgtacagtgaagcctctggacacaggggtatgtgctggcctgcctttgcccctctcctctgcctgcacagatgccagagccacagcctgtcacctgctgtactttgtcatgtgtttatctagcaggaccacattctctatcccaatcttgtcactcttctgattccagaatttctccactattcccatgttgggaacattaggataatttataaagttaaaaaaaaactagagggggttattgatattaaccattataggtaataacaatttagattattctgggaagaagtgacatctttacacacttgggcccttccatatagaaatgtggtagtttccatcattcattaaaatgtactcactttgctggccgcggtggctcatgcctgtaatcccagggctttgggaggctgaggcaggcagatcacctgaggtcaggagttcaagaccagcctggccaacatggtgaaacctcatctttaccaaaaatacaaaaaattagctgggtgtggtggcgcacacctgttagtcctagctacttgggaggctgaggcaggagaatcacttgaacccaggaggcagaggtcacagtgagctgagatcaggcctgggcaatagacggcgctccagcctgggcaagagtgaaactcggtctcaaaaaaagaaaaaaaattgtggctgggcacagtggctcatgcctgtaatcccagcatactgggaggccgaggcggggggatcacctgaggtcaggagttcgagaccagcctggccaacatggcaaaaccccatctctactaaaaatacaaaaaatagctgggcatagtggcgtgcacctgtaatcccagctacttgagagactgaggcatgagaatcgcttgaacccatgaggcggaggttgcaatgagccgagattatgccactgcattccagcctgggttgtcagacagagtgagactgtgtctcaaaaaaaaaaaaaagtattcacttatgtccttaagagttcttcttaaataagaccttcctgttcctcaagtatattaagtattttatacatgtgtttttgctattgtgaatgggattattttcctcaggtagacaggtataccgtcaaccaatactgatttgtatttttttctaatattttgctagcatttcctggaacagtgttgaatagcaatgttgctatcagtgtgttaaccacggtaatgttggctgctataacaaagaagtccaaaatcaatgtcctcgatgtaattgaagtttatcctcactcatgtatcagttaagcatgttattcagatgggtgggcagctctcttctacacggtcattccagaaactcaagctaggactctgtcttcttttttttttttttgagacagtgtcttgctctgtcagtcaggctagagtgcagtggcacgatcttggctcactgcaacctccgtctcccaggctcaagcaattctcctgcctcagcctcccgagtagctgggattacaggcgtgtgccaccacgcccggctaatttttgtatttttagtagagacggggtttcaccatgttgaccaggctggtcatgaactcctgacctcatgtgatccacccccctcagcctcccaaagtgctgggattacaggcatgagccaccacgcccggcccaggactcttgtcttcttgaacacgtggctttcacagttcctcttttcattgccattctgtcccacaggaaaagggaaggacacagagaagcacacatactgaggttttaaccagccaggtcctgatggcacgtgttatgtccacccatgcctcccagggagactgggcagccatggcccagctgcagccctaactgaagaagaagggagccgtgatttgggtgggctgggcccagtgcctgcactcaccttccatttaatggaagggtctgtagtgtttcaccatcatctctaccctgtgacctccctctgtttcttgtgtcataaaggatcagtttattccttggttactaactttaataactacttatctttatatggcaagaaaggcatgtcatttcattacctgatcaacatgtaaagtattgaattgctttttaccaagcatcacagttctgccttatatattactcttgtgtttgggggtcattcttgtacttaggctagattttcccaatgcctaggatgtgcctgggaagcaaatatgttggaggataatctaattccgatttgtggaatgcaggaaggagcccggaattggagcacctggggtcatgttcagactcaccatttctgagattggggcagatgcactggttacccaccgataaccattctgccctcttctttcttgccaatagagaaccccagttatatttggggatcaggtggtgatgcgctgcagggtgggggccccagcagtaaatgttattgttctaggacttcatcctaaaaatcctgctttccttggcagggattaatttcgaggtgggcacatgacctgctctagcccaatgagatatggcgggaaggctgcagggtggcttctggaaaggtttttttctcatacaaagagacaaaaaggaacacacactgccacgacagggaaagataggttaagagtcaattcactggcagggcgtgctggttcacatctataatcccagcacttggctgaggcgggaggacagcttgaggccaggagtttgagaccagcctgagcaacatagccagaccccatctctacaaaaaaagttaaagttagccaggtgtgacggtgtgtacctgtggtcccagctagttgggaggttgaggcaggagaattgcttgagcccacaaggttgaggccacagtgagccatgtttgcacaactgtcctctagcctgggcaacagagcaagaccttgtctaaaaaagaagagtcaattcatcattgacagcatgtaaggcaccagaatgcttggatcttttggggatgtcactgagcccttgcaggaaccaaatgcagaaatgagctcctttagccctggtttcccagccttggcatgctgtggcatggcagacattctggctgcgggtgggtggtggtctgtgcactgtaggatgttttcttttgtttaagaggcagggtctcactatgttgcccaggccagagtgcaggagctgtttacagatgcagtcatagctcactacagcctcacacaatcctctcgccttcgcctcctgagtagctgggatcacaggtgcgcgccactgtgcccagctctctgtaggatgcttattcccatcctggcctccctgacttctgtccagtagatgccagtatcaccccctcctccacccaaagttgtaacagccagaaatgtttccacacattgccaaatgtcccctgggggcaaaatttccccagttgagaaccactgctgtagacctttggttttgtgaggcaatacattgcttcatttaaacctgtatggcttgatggtctgttctttacagccacacatgtcctagctgagctcacaaccctggaccatcctcaacccgagagccagagcctgtttcttctgcaggctgacgtggacgtacttgtctgttgacagtaaaggtattttgtgcatccttaaaagatgcagtgtcttgcagctgttggagtggtttctggctgggagcaggacgcctacagagcagttgcagaggaccttctgtctccccatggcggaggcaccattccaactacggaacctttgttgtgttttggagggggtcgtgtgcttccagcacctgccgcctctgccagccacagcactctgcctctttgttctgagtgcccgggacagagttgtatagctgctgccttttggagagaggagtcagctttgggcttgaatgtatctggagatagcccagctttcatgccatcttcacatttcctgtgtacatggtttcttttttttttttttttagatggcgtctcactctgtcgcccaggctggagtgcagtggtgcagtctcaactcactgcaacctctgcctcccaggttcaagctattctcctgcctcagcttcccgagtagctgggactacaggtgcgtgccaccacgcctggttaatttttgttttttgctttttctattttatctttttttgagacagagtcatactctgtcgtccaggctggagtgcagtggcgtgatcttggctcactgcaacctccggctcccaggttcaagtgattctcctgcctcagcctcccaagtagctgggattacagatgtgcaccaccacacctggctaatttttgtatttttattagagatgggatttcaccatgttggtcaggctggtctcaaactcccgacctcaggtgatccacctgccttggtctcccagagtgctgcgattacaggtgtgagccaccacgcccggcctaatttttgtatttttagtagaggcgggtttcgctatgttgcccaggctggtcttgaactcctgacctcaagtgatccacccacctcggcctcccagagtgctgggatcataggcatgagccaccgtgcccagcccctgtatacactgttgcggccccttcccacccagctgccgagagatggttctttcacaggtctcctgcttccgtgcaggtagcttattccagggacagggaagcaggaggaaaaagcactaggaggaagaccgcagactggattcagaacaggctatcgtggagagctgtgtgcttcgctgccggcctgaggctctgcgttcccctccttggtgctcaggctgcccggcatacgcagcaagtgctgacccagcaggcagcccacgtgcgcttcaggtgtgggaggctctgcgggctgcggggaacaggatcgctgtgggaggttgagcctggagctctgaacagccactctgcgcccaatctgctgtagcgctgagggtcaggaaggcctctgggagttctctagaagaaggcgctggggaggaggagttaacatctcatttcattagagcatgccagttctgttctgggtgtgacttttgaagaatattgagttctaccagtagaactttggggactgaaacctgttgaggatttgtagtaagactgtgtcccgaaggcgttcttccttttcttctgtctctgactttaacaagcaggtttccctataagctttggtgtttgttaaacagatcatttgtatgtgcaataaaatatgtttaaaaattagaaaaataacatctcccgatactatgttattttatatttttaatggtatgattacttttatttgattttctggtttgtgatgataaatgcataagaatggcagtgttctctgcatcatgtacatttcaaggtgtagactgtgttctgaagggagagtcggccccacatccttaccttcttttcctgtggtttattgcagaactcagctgccttcacctcctcctgccatttttcatcacttctgagactgttagctcttagaccccccaaatagaacagtttcctttgtgagcccctattatatgcttgccaccattgtttttcaaacctaggatcctccaaactcagtgccactcagcctcttctactgatgaagaaactggagttcaaaggcttgcttgcagcttcccaggtgtatgacgagtatttcaggtcggccagcgccttgtgaagcccacactccagggttgagggcaacatgtaacaatgtcagggaaggctgaggaagtgctgtgccatcgcaaaagaataaaatataagtctagaaatgcggaaggtactgtacagcatcacagctacctaaacttcctctatgggaagacagggaaagtaggcgttagtggcaagacagagtggctttgagtctaagtgtcataataaactctgacggggaaaaataaggggcagcatttgcacatgtgtgctgcagattacccgctgtgaggcagcggtgagtttgttgccttgtgttttaaaaagtaattttctgggccgggcgtggtggctcacacctgtaatcccagcactttgggtggccaaggcaggtggatcacttgaggtcaggagtttgagaccagcctggccaacgtggtgaaaccttgtttctactaaaaatacaaaaattagctgggcgtggtggcgggcgcctgtaatcccagctacttgggaggctgaggcatgagaatttcttgaacccaggaggcagaggttgcagtgagctaagattgcgccactgcactccagcctgggcaacagaacgagacttcgtctcacaaaaaaaaaaagaagtaattttctgatctagcatgtggattcttgagtcatcttaactaagagattgggagcagcctgtgtggctgacaggccctattgctcatgacttgtgtatgtgtacacgtgtgggatgtgtgtatgcatgtgtgtatatgtatgcagtgtgtatgtgtggagtgtgtgcatgtgtgtacatgtatgcatgtgtagagggtgtgtgtgtgtatatgtatgggaagtatgtatgtatgtatttgtgtgcctgcatgtgtggacatgtgtacgcatatccagtgttaaccctgacacactggggaagtggaaatagaatgaataccctgtatgtttcagctcctttttgagtttatcctgcacgaccagcttatgagtaggtgatggtatatttttggtcacctacagcacttcctcagcctcccctgacatgtctacatgttccacccccacccccggagtgtgggctttgcagggcgctggcggacctgaaatactctgcacacctgggaagctgcaggcagacctctgagctccagctcgttcttcagtaaaaggggctgaatggtgctgactttggaggattccaggtttcagaaataatgggtgagaaagcagagcctcagagctatcaggtgacttgtgacaggcttgctcagatgagagctggagcccggactcggacccaggcctgccactcagagcctggcctctgtcacagttcccctcccattgactttcggggcccgtcttaggagctcgaccggcggccagcaaaacattccctccacagcagagccacctctgggtaaactgataaaaatgagcttctgaacctgccaaggtgccagggctcaggccttggcttcagcaatgtcattcccccagcagacggtgagtgggtgccagccacagtcaagcacccactgtgctcttcccccaaggcctggcctgggttagctggctgtcctgcccctcccctcccctcccttcccctcctctcccctcccttcccgggggagggtgcttgactgtggccagcgcccattcatcgtctgtggggagaatgacattgctgaagccaaggcctggctttcgacaagagttttgctctgttgcccaggctggagtgcagtggcaccatctcagctcactgcaacctccgcctcccaggttcaagtgattctcctgcctgagcctcctgagtagctaggattacaggagaccactaccacatctggctaatttttgtttttttttagtagagatggggtttcactatgttggctaggctggtcttgaactcccaacctcaggtgatccgccttcctttgcctcccaaagtgctgggattataggcataagccactgtgcccagcctatttattttattttttattttatttttgagacagggtctcactttgttgcccaggctggagtgcagaggtgcgatcgtagctcgcccacagccttgacctcctagttccaagtgatcctcctgcctcagcctcccaagtagctgggactacaggtgcacatcacatgcccagctaatttttgtattttttatagagacagggttttgccatgttgctggtcttgaactcctgggctgaagcaattcacctgcctcggcctcccaaagtgctgggattacaggtgtaagccactgcgcctggcctgcttcttttttttctgagcatgcttttaaaatctctagtaggtgatacacccagccttcagttctactcctactcaagcagcatggtaattttaagaaaattttaaaaggaaaaaaaaagcatattctaatgtgtcttcttacctgatgcagaagatggagttagcctgagtgacccattccttgctagcagctttattggaagctgggatttgggtatgtggataactcatgctgagagctgattaatcacgtgcatggccctgttagggttcaactgacttaggtaaatacaacacaatgatatttcagctgtgacctttcagagaaggaagctccttgtttacataggagttatagcagcactgctctcccagttcaacaaaaactggtctcactggttacctgtggaaccccgactccctgagatggctctcggcagccttgccttctgcctgtttctccagcttatctcttgccaccgccactccctcaagctggcaaagcaaccgggtcatgccatttcagtcaaggtggaatgccacaccatgagcacttgggaagtcctggccaagtgctggtctgttccattttcgtcctgtctaaagggcactaacagtgccccctggcaggtgcttcactgagcgtttgagcctgtgtcacctggcctccctgactcactgtgccactgtgcagcttcctttcagtggcatgaaaagaacacccttacaaagatgcctgacttccagaaggaagacatgtcagtgtttcaccgtgaaaaatgcaactcctcgtttgcttggtgggagacgtgcttttaaattggctgacttacatttctttctagacaaagacatctggcattctgaagtcagcattgtactctgtgcaaaagtagggtgactgtctcttctaggaacttttaaaggaaacatttaacatttttattttacgggctaaataaagcgttttaaaaatgaaacataattctgtccactccccacccatatggttaaattactccttttttaaagcattttaaattgtggtaaaatacatataaacaaattgtggtaaaatacatataacataaaatttaccatcttaaccatttttaagcatattaacttgtgtccatgtgtagccttttggaatttttcatcgtgttccctacacagaatgcttctaaatcatgccgtgtcctggggactgtcatactgtcaggttgtgtaaagtcaaaggaaacaaagatattttcttgggtggagcaacagtgacacttcctgatttctattaagcttggatgtagtttgaatctttttttttcaaacatactttatacttaacattttagtattttcttttaaggtcagcctactgagcctatgcatataatgaggtcaaaaatgttacaattatgtcctaattatagctcaaggaatgcttttagaacagtgtagttcctgagtgaaataaataagaaagtttaatttcctgtttaatcagtttctcctttttaaatttttttagcactttaaaaagtgattttgaaggctgggtgcagtggcttacacctgtaatcccagcactttgggaggccaagacggtggatcacaaggtcaggagttcgagaccggcctggccaatatggtgaaaccccgtagctgggcgtgctggtgcacgcctgtagtcccagctactctggaggctgaggcagcagaatcgctagaacccgggaggtggaggttgcagtgagctgagatcacaccactacactccagcctgggtgacagagcgagactctgtctcaaaaaaaaatgggattttgggttaggcacagtggctcacgcctgtaatcccagcactttgggaggctgagacaggtggatcacgaggtcaggagtttgagaccagcctgaccagtatggtgaaaccctgtctctactaaaaaatacaaaagttagctgggcgtggtggcatgcacctgtagtcccagctacctgggagactgaggcaggagaatcgctggaacctgggaagtggaggttgcagtgagccaagatcacactactgcactccaacctgggtgacagagcgatactccgtctcaaaaaaaaaaaaaaaaaatgattttcagctgggcacagtggcttacacctgtaatcccagcactttgggaggctgaggcaggcagattgcctgaggtcaggaattcgagaccagcctggccaaaatggtgaaaccccgtctctaataaaaatacaaaaaataaaaattagccaggcatggtggcacatgcctgtaatctcagccactcaggaggctgaggcaggagaatcacttgaacccaggaggcggaggttgcagtgagccgagattgcaccactgcactccagtgttgggggacagagtgagactctgtctctaaataaataaattaattaaattaaaagtgattttgaaaacatggccatttttcctggccagttcatctctttcttttttttttcttttcgagatggagtctcgctctctcactcaggctggagtgcagtggcgcaatctcagctcactgcaacctctgcctcccgggttcaagtgatcctcccacctcagtctcccaagtatctgggattacaggcctgtgctactacgcctggctaatttttgtatttttagtagggacagggtttcgccatgttgcccaggctgatatcaaactcctgacctcaagcgatctacctgcctcggcctcctaaagtgtgggattacaggcgtgagccattgtgccccacctcagttcatctatttctctgtgatatttattctatagttgcagaagaatatttctcatatgatacgtatattaagcttactggccagccagtttgggtttctggatagtgaaactgtcctggaagtgtttgctgagcttttcttgctggagaagattcttggcaaagcctggatggaggatggagatgagaaaggtagtgtgagggtggcacacctgttttgtgctaattccagtcttggcagccctggacctgccgggagagggatgacagtgacatgtggcccagtttttgctcagagaaggaaaagtcaccaagaccgaccatgagggcaggagctcttgcttctcctcctagatgagagttagaaggaatttgagagcaaggcttctttcttgggatccaaatacttcttaccttggagttttcctagccgtggctagtgggtcataatgtcagcgacattgccaaatgggagcggaagagtgtcgttgggggaagggtgaagacgctgtcagagaataagacataccccactagaactttaaaaaacaagtcagaaaaaaaaaaaaacaaaaaacagaaaaaaacccacatacccacacatacaccctgaagagggaatcaggagtttgcaagccctagaaggtagttattgtggtaattaaagattgaaagctcactctcaagagagctgcaccaaatccctgggctgcctcagggtttgctgaaatgagtcccactcttctctggtcagttcagtccaggaggggctggcgtgcaagtgtcactcaagaattcatggctaggctgggcgaggtggctcacgcctgtaatcccaacactttgggaggccaaggcaggtgaatcacttgaggtcaggagttcgagaccaatctggccaacatagtgaaacctcgtctctactaaaaatacaaaaattagccgggcatggtggcacgtgcctgtaatcctggctacttgggaggcggaggcaggagaattgcttgaacccggaaggcggaggttgcagtgagccgagatcacaccactgcactccagcctggcaacagagtaagactctgtctcaaaaaaaaaaaaaaagtttatggctcttacagccttagccagcaagagcaattgccatgaaacagcattatttcttttctctttatgctattgtggtaaaatacacatggcctaaagttgaccattctaaccatttttaagggcacagttcagtggtattaagtacattcatattgtgtatcctgccatccatctccagaaccttttcatcctcccaaacagaaacttccagatggagtcctaccgaattgcccaggctagtctcaaactccttaggataactttcattcttggctgggcatggtggctcatgcctataatctcagcactttgagaggctgaggtgggtggattgcttaagctcaggagtttgagactagcctgggcaacatggcgaaaccccatctctacaaaaaatatagaaatcagccaggcgtggtggtatacgcctgtagttccagctactcgagaagctgaggagggagaattgcctgggcttgggagattgaggctgcagtgagccaagatcacaccactgcactccactgtgggtgacagggcaagacactgtcaaaaaaaaaaaactaccaaaaactaattttcattctttttttttttttttgagacaagagtcgcccaggctggagtacagtggcatgatcacagctcactgcagcctcaacctcctgggctctggtgatcctcccacctcagcctcccaggtagctaggaccatagccatgtgccaccacacccagctaatttctttgtatttttttagtagaggccggtttttgccatgttgcccaggctggtctccaattcctaggctcaagtgatctgtccttcttggcctctcagagtgctgggattacaggtgtgagccactatgcccagccactttcattcttttttttttttgaaatggagtctcactctgttgcccaggctggagtgcagtggcacgatctcggctcactgcaagctccacctcctgggttcacaccattctcctgcctcagcctcccgagtagctgggactacaggcgcccgccaccacgcccggctaattttttgtatttttttagtggagatggggtttcactgtgttagccaggatggtcttgatctcctgacctctgatctgcccaccttggcctcccaaagtgctgggattacaggcatgagccaccatgcccggccccactttcattctttagaacaaggaaattcatactgttttatctaagaaagaagctttcctaagtcctgtacttggacgagggcaccggtgttgtctttgggtacagggcattagcaattgtaaagaacagtgttgaaggggtgaataagtaatatcttttcctcatccattgcgaggttcatggctgagacccctataacgaaagagagattaacgagagaaaagcatgcaaattaagttttacatggcatgagagccttcagaaatgaagacttggagaaacagggattccaatctgtgtctctgtgcttgggtttgatgaagtgtgacagtcgcgtagaatgactggatgcgggctgtgatgattcaggaataccccggggggaatttagcaaggcctgtttgttcaggttcttcttggtgcctctgggagacattccttccctctgggtatagggcaggacgcctgtcacagggcgttcaggggagaagggagggagatcttgatctccctaggctttatgagctgcctaggctttatgagctgccacagggaggaaggtgagagtatccttcctgcttctgctgttttctcagtttcccaggtaccatattttggggtagcatttcctgcaccccattagtatccaccagagaagtttgccctaaaaatgtgctgtccctcttgtgtctggtgctggccttcagtgagactgaagggcatcacggaaaagtctcgtaaggtggaattgcggggagcccgagtgggaacctccatggtggcctttaccactgatccaagcaactggttctcccttctccactgggctacagctctgagcttctgcacaaagagtggagtctccatctttaaatattctgcttatttttcaatttgtcattatactaagaggtcatgtgtgtggattacttactttgtgctgggcagtatgctaaattctttatacatggtaactctttatgcttgtaacttcgtgaggtatcacagtcctcatttttacagatgaaacttcagcccagaaaggtaatttgcccgaacagcaaattctgaaactggaattggtggctctggtgcccaagcttgcatatttagaccaggcatcagtaatagcctcagttttgtttattgctttgttaagccttagttttgaagcacttgttaagtgcgaggctccatgtagagtgtataaacactcaatctctgtgtgacgacagctccaaggagcagtccagcaagttctgtctggccaaatctagacctggttttgattaactttgttcatgatctctagatcactctgctctatgcttgaacctgtatgcttgagtcaagcttacctctctgatgggtgaagaaaatgatatttcactgttatattaattttatttttcttaccacaaaggaaggatatctcttcatttttctaagtcctgttggttcattgcctttgcttttgctgcatttctctctctctctctttttttttttttttttgagacagagtctcactctgtcactcaggctggagttcagtggcacaatctcgactctctccaacctccacctcccaggttccagtgattctcctgcctcagcctcctgagtagctgggactgcaggcgtgtgccaccacgcctggctaatttttgtatttttagtagagacagggtttcatcatgttggccaggctggtctcaaactcctgacctcaggcgatctgcccatcttggcctcccaaagtgctgagattacaggcgtgagccactgcacccagccttcttgctgcatttttaaagaagacaactgcagcttgtctctcttgataagcagtctgagtttgcctttagtgcaccttttcttcaacagaaatcagttgcctgtctcagatgggccttgctcacattattcacatgggctgggtacagtggctgacacctgtaatcccagcactttgggaggccagtgcaggtggatcaattgagcccaggggttcgaggccagcctgagcaacatggcaaaatcccatctctacgaaaaaataccaaagatgctgggcatgatggctcatgcctgtaatcccagcactttgggaggccaaggcaggtagatcacttgtggccaggagttcaagaccatcctggccaatgtggctcaacttgtctctactaaaaaatacaaaaattagccaggtgtggtggcacatgcctgtaatcccagctacttgggaggctgaggtgggagaatcacttgaacctgggaggtggaggttgcagtgagctgagattgcaccactgcactccagccttggtgacagaacaagactctggctcaaaaaaaaaaaaaaaaaaaaaatccccccaaaacaaaaaaaaaatcagcagggtgtggtggtgcacgcctataaccctggctactcaggagactgaggtgggaggattgcttaagcctgggagttagaggttgcagtgagttgcaatcacaccactgcattccagtctgggtgacagagtgagaccctgtctcaaaaaatcaaaacatgataaacatggtcaacatacagtgaacaagttcattccacttttactggttacagcctcagttctgggctatgtgtctttttctatgtctttttcacattaaatgaagtgaggtaacacatgtaaatgagaaaaaatagcaatcagttctattaatttgaaatgagtggttgtggttccttgcaattgcgttcatatgaaaagagatctatcagtcaggatagggaaagttatgcacagtaacaaacaatcctcaaatcatggtgacttttacaacatggtttatttctgccttactggatcagaaagtagtttctgctttctgaaatttctcaggggctttatctcaacctgtgtttccataatcttagaggcagggaaaagagaagtgataagctatgagttggctttgaagatctgtgccagaagtgactcccataattctattcatcttgttggccccaagtatgtcacgttgccgtgcctatactcaaaagagcagaagaaagggatcctgctgtgtgcacagactgagggaacctcttaggaatcccagatgctccccatgggaagtacttaacatcttttttgtcccaaatagcagaagtcttagagtataatgagcaaaaatgagatttggtagtgttaaaaagagaaaactctgccttgacaaaaataatggtacaggtcaagacagcttttagctctcctgctcttgaatccatggagaaagcttgttagcctgtgatcagtaagccatgggagtcgtggaaatgttttctgcgggctggctgggcattgctggtggtgaagctggatgttggctgcctgaccgttctatgtgtttgaaattgcccatgagcaaatgtactgtttgctatccattatccacgttcattccttctctgctgctaccgtcagtctgttttcatcctttgtgacagtgtggaagttaagtggcctctcctctgttctttttttttttttcctttttggaacataagcacattttttcacattattttattagcattccctttgttttaaggtatcacattcttcataaatgatgttttaagggctaggcgcagtggctcacacccataatcccagcattttgggaggctgaggcaggaggattgcgtgagcccaggagtctgagaccagttgatcattctgagcaatgtagggagaccttgtctctacagaacaatctttttaaattagccaggcttggtggcatgcacctgcagtcccagctattcaggaggccaaggtgggaggatcactggaacctggaggttgaagctgcatggaaccatgatcgcacacttgctctccagcctgtgtaacagagtgcaacccttttttgatgaccactagttatatctgatttttttttttttttgagatgagatggagtctcaccctgtcgcccaggctagagtgcagttggctcactgcaacctctgcctcctgggttcaagtgattctcctgccttagcctcctgagtagctgggattataggcacgcgccaccatgcccggctaattttttgtgtctttagtagagacagggtttcatcatgttggccaggttggtcttgaactcctgaccttgtgatccacccacctctgcctcccaaagtgccaggattataggtgtgagccactgcacctggccatatctgattttttttaaagatgtcattttattgaatttgagaattcacttagaccacagatatctgatgaaaaatattcttgttttccttgtcttcctttcatgtcctgcataacctgagtgtgctttagaggtgggatcgtagtgtttgcgtacaagaggaaagttgtcatggccctgtggtcatgaggctgagggcccacgattctgatgtggatggaatgcagctggcattgcacatgtcttagatgctcttcccaactgcccgctttgttctaggcactgtgcagggtgctggagacagcagagaagagtgagatagtccctgccctcgcactgtagagggaaggcctgttctgcctccctgagatgggggcactgagctaaatcacacgtgaggaagagttagcaaggtggccggaagggcatttaggcaaggggcagtgaaaggaaggctggagccgtgcttgggagaccttttaagaaacgtgaacttggccagatgcagtggctcacggctgtaatcccaacaatttgggaggccgaggcgggtggatcccttgaggtcaggagttcgagaccagtctggccaacatggtgaaaccccatctctactaaaaatacaaaaaattagctggatgtggtggcgtgtgcctgtaatcccagctactcaggaggctgaggaaggagaatcgcttgaacccaggaggtacaggaggtggaggttgcagtgagccaagatcatgccattgcactccggcctgggcaacagagcaagactccgtctcaaaaaaaaaaaaaaaagaagcgtgaacttttaccctgtaggccttcagtaaatatttgtgtgagcaaatgaactacttatgcagatcattccctgataacatcagacactgtgttataagattaagccggccaggcgcagtggatcacatctgtaattttagcactttgggaggccgaggcgggtggatcacaaggtcaggagattgagaccatcctggctaacgcggtgaaaccctttctctactaaaaatacaaaaaattagtcaggcatggtggcgggcacctgtagtcccagctacttgggaggctgaggcaggagaatcgcttgaacctgggaggcagaggttgcagtgagctgagattgcgccactgcattccagcctgggtgacagagcaagactgcatctcacaaaaaaaaaaaagaaaaaaaaagattaagccatgaggggcctcccacgcacaaagttctgcccatggttactctgtgccacgaaggacagcatcgatctgttcacactctcgaccttgcttctcgggtacagcaagcactctgggatgctttcccgcagacgtgtcgtgtatcctgcttatggaagcctagcttgggactaccattgctccagcccagtggggtggtgctgttttcctcctggagaacacgggttcctcccagcaccatctccaactggtagaaatgtcaggcgtcacagcctggaaggctttaatcccaatccatatcttctgagtgagcccctactcatggcttcctgagatggagaagcacacggccctcacccatcacgggctcagaggtgtgaccgagaagctggccacctactaagaaagtccttgtgcctgcctcatctccagcgctgccagagctgctgtggactctcgccatgcagtccctctgcccctttgttgtgtatgtctctttcttacagccacactgggacatggctgcagtctctctggcttcagcagatccactctccattgtaaatatcgctgccttcttcctcatgtgttttttttgtcttgtttgacaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacaggtgcgattgcttctctgctgtgttcctttttattacccaagtaaccggtatttcagctcacaagatgagaaaatgacaaacaggcaaaataagcgtagggctgtgtgtgcaacagtttatcataaagccatcaccaggagacgtcactgggcgccttctggagtctatccgtcctaactttgctttctttctttttttttttaaatttaagttctagggtacatatgcacaacgtgcaggtttgtcacacatgtatacatgtgccatgttggtgtgctgcacccattaactcgtcatttacattaggtgtatctcctagtgctatccctccccactcccccgaccccatgacaggccccagtgtgtgatgttccccttcctgtgtccaagtgttctcattgttcaatccccacctatgagtgagaacatgccatgtttggttttttgtccttgcgatagtttgctgagaatgatggtttccagcttcatccatgtccctacaaaggacatgaactcatccttttttatggctacatagtattccatggtgtatatgtgccacattttcttaatccagtctatcatcgatggacatttgggttggttccaagtctttgctattgtgactagtgttgcaataaatatacgtgtggatgtgtctttatagcagtttgatttataatcctttgggtatatacccagtaacgggatggctgggtcaaatggtatttctagttctagatccttgaggaatcgccacactgacttccacaatggttgaactagttaacagtcccaccaacagtgtgaaagtgttcctatttctccacatcctctccagcaccccattttgactttgctataagggaactttagcatctgaacgtgcggacagcttcattgctggcttgttacgtaacagtgttttgtgaccatctcatgtcatacccacacatcgaaaccagcagtttaaatggccagctgtttgcttgtgaaaactcccctcggctggcttgtcacctgggacttctgactgggtatcttatttctgccccgctccctctcgttctttctcgaagctgcgggttatttcctctcctggcacacgcggcggtgtcggtgaggccggtgctgctcaccctgtacgagaagtacttcctcccactgcagaagctgctcctgcccagtctgcaggccttcatcgtgggcctgctgcccggccttgaagagggctccgagatctccgacaggtgcgtgggcgtcttgtccaggctgtgtttactccactgctttataagacgcggggagggggccgggcgcagtggctcacgcctgtaatcccagcactttggaaggccaaggtgggtggatcacaaggtcaggagatggagaccatcctggctaacacgatgaaaccctgcctctactaaaaataaaaaaatttagccgggcatggtggcgggcgtctgtagtcccagctactcgggaggctgaggcaggagaatggcgtgaacctgggaggcggagcttgcagtgagccgagatcgcaccactgcactccagcctggacaacagagactctgtctcgaaaaaaaaaaaaaagacacggggaaggaagtgcagagacatgggaagcagcagtaggtgtggaggtcgggttgctctttcacatttccttggtggttgtgatttcaaattcctcccgggaatctctcttgtctctttaccaaaggggaagtcccgagcccggagagatgagatcctttaggcggagagaaatgtagctcattaataagggagaccatagtgcagggttcccatgatgtcctgtcccgttacggagttacccacagagtcaccatgtgtggagggaagacataccctcttagggcgcctagtgtggaggaaatgaagggaccctttcctgggcacttgcagcgtgcattacacacatgatcacattgtgtaatgaattcctctgctccaggagttacctccatttacaggtgagggtcagagggtaagaaggtttcccagtcgcacagtcagtgagccccacagctgggattctattccactgtatctattggattcttttttttttttttttttttgagacagagtcttgttctatcacccaggctggagtgcagtggtgcgatctcggctcactacaacctccgcctcctgggttcaagtgattctcccgccgcagcctcccaagtagccaagattacaggctcgtgccaccacacccagctaatttttgtatttttagtagagatggggtttccctctggcggccaggctggtctcaaactcctggcctcaagtgatccgcccacctcagcctcccaaagtgctgggattacaggcgtgagccaccacacacggctcatatcagattctaaagtccttcttctttccattaaactaggctgcttctaaattaaaaagcaaagccagggcagggcttgagaaggcaatttagtgtgatgtgaagcagaatatcttgacaggtttcagtagcaccttggagaaatctatagcactcatatgcacaaaagttcatgtagctttgtgtgtgtgtgtgtgtgtggtcactgcttaggaatgggagaaagtgtgaatctgttccgactattgagtatggccgggcacggtggctcacacctgtaatcccagcactttgggaggccagagcaggtggatcacttgaggtcaggagttcaagaccagcctggccaacatggtgaaaccccatatctactaaaaatacaaaaaaattagccggacatggtggtgtgcgcctgtaatcccagctacttgggaggctgaggcaggggaatagcttgagcctgcgaggtgaaggttgcagcgagccgagattgcaccactgcactccagcctgggtgacagagtaagactacgtctcagaaaaaaacaaacaaacaaacaaaaaccagactgttgagtatacacagtgacctttgtttccggagaagtataaagtaagaactcacttccagcttattaactcttctgagagatgccacagtgattcacctctgttaatgggacctgttttaagagcccatgttcagtcactggtgacttttgtgcttgtaaaagctgccatgtgattacacaacgcgctgctcatattaccctgtgctggaggccctagtcaggtcaccctttcctgtggtgtcagctgtgactgaggggtgcaggaggctggagtctaacccaggaatcaatccaaggtccatttgcacggctcccccagccttaagtaaaccaagtaatcagaatggtttgaagggttagttaggaagtggccaagggtgcatttcgtgagctctatatcaggacttgacagatgtaactaaaacattgcactttaaccatttcaagctctcacatagaccaggtgttggctctccatttcccaaaggagaatccacctttacagtttctaccttaggaggcagaatctgtctcgttgcggttttaagcccagcgccaggccctgtggctggtacacggtgagactcggtaagtgtgtgttgagttaacgagtggtccaggtcacataggaggcagctggaggacattgccagactccatgccaatggactcctaatcccaggccctttctagaagttctgctgtgtttgtgttctgatgacagatatgtgagtatacatcctacatgatttttccatcattggacagatgaacacattagttccctaaagcttactgtgatcttttaaatctgtgtgaatcacactagaagtgtaaatagttggagtgtttttgttttcttagttgataaataaaggttcatttgaacagttgctaaagttgcttaacattgattttttttctgaatattgtgatttcttgacattgaaccaagagccaagtaaagcttcatgaatcaccgaatctatttagctgtgacagaaaaccaaatgcagtgtggcacccagaagtgattagttatcagctctccaaggtggatgcaggtgaaaggttatacaataatctctgagccagtgtgttgcagccacagtaattgaagtgactgtacaagattttttggttgctatatccatttcagtctgagacggtttggtaactgttcccagaagtgcttgggtagccaggtgtggtgacaggcacctgtaatcccagctatttggaagactgaggcagaagaatcacttgaacctcggaggtggaggttgcagtgagccaagatcgcaccactgcactctagcctgggcaacagagcaagactccatctcaaaaaagaaaaaaagtgcttgggaattgagtgaaacaccccaacaaatgtgcagagagcagaaagggagggtgcagtggggggggtcatgatgagcacgtgggtagaaattgcaaagtggtgagttaggttgagctggtgaaggctgggatgactcacaggtttcatgtaggtggaggctgtccctggtgtgtgctttttagtgaaccataaggaatgaaacttttggcccctgttagaacttattatccaccctggctttctaaccctttggggtctgcagataacctatgactggtcagaaatcctttttttttttttttaagtgcccatgaaatagctacatagctgtgttttgctgtactaagaaaacaagattagaacagggaaagcactaaactcttcttctcaggagatgaggagaggtgaatgttttaaatggtttgtaagaaggcaacaactagctcaccagatatttccatttaaatcagtaattttcaatgtagtagtaattttgcctctcagggtacatttgacaatatctggagacagttttggctgtcacaactgggggtggggagggtgctactgatatttagtgggtagagtccaggagctgctgaacattttacaatgcacacaggtgccccgacaacaaagacttacctggtcccagatgtcagtggggtggacgttcagaaaccctggcttaaagagttgaaaaatatttattgacatttcttttcttttggagctcattaataagggaggccatagtacagagtttccatgatgtcctgtcccattaaagagttacccacagcgtcaccatatgaagaggggaagacgtaccctcttagggcccctatcgtggaggaaacaaatggaccctttactgagcacttgcgacgtgcatgacccacatgatcacattgaattccagggtcttgctgtgtacccaggctggagtacagtggcaggattatagctcactgcagtctcaacctccaaggataaaacgatcctccggcctcagccttccaaagcactgagattacaggcatgagccaccccttttggctgacatttctattttttttttttttttgagacagtctcgctctgtcgcccaggctggagtgcagtggcgcaatcttggctcactgcaacctccacctcccgggtacaagcgattctcctccctcagcctcccgagtagctgggactacaggcatgcaccatgacacctggctaatttttgtatttttagtagagacggagtttcaccatgttggccaggctggtcttgaactcctggcctcaagtgatccacctgcctcagcctcccaaagtgctgggattacaggcgtgagccactgcacccagcaccaacatttcttttggttggtttcaggcactgtgatcatgatctgtgctggttcgaggctttttttttgccccctctttagcgctgtttctgacctgcagtttacagtacagggtgctgttgtcactgccctgcctcttcagtttcagatgattgtaccaaagcggtgctgtcttgtgacagcttggctttccatggttgtccttttggcaagcagctgcagaaccaaagttgtggagtgcttgggatttgcggtgcccggcccatgccactcacctgctctcagttgtggagtggagcatgccagtgtcatttgaaggagctgcgtttgcaggaggcatgagagagcataagctgggatgagttaggaaggatggaaatacttggggtttggaagttgggtttttttttttaatgtttgttggttttttgtttgtttttgttttgttttttgagatggagtctcactctgttgcccaggctggagtgcagcggtgcaatcttggcaccctgcagcctccacctcctgggttcaagcaattctcctgcctcagcctcacgagaagctgggattacaggtgcgaaccaccatgcccagctaattttgtatttttagtagagacggggttttaccatgttggccaggctgatcttgaactcctgggctcaaatgatccacctgccttggcctcccaaagtgctgggattacaggtgtcagccactgtgcctggcccgtttgttggttttgaattaaaagtttagggttcccagtggggcatggtggctcatgcctgtaattccagcactttgggaggccgaggcggggggttacctgagctcaggtgttcaagaccagcttggccaacatggtgaaaccccgtatctaccaaaaaaaaaatacaaaaattagccaggcatggtggcggctgcctgtaatcccagatactcaggaggctgagccaggagaatcacttgaacctgggaggcagaggttgcagtgagccaagatcgtgccattgcactccagcctgggcaacaagagtgaaactccgtctcaaaaaaaaaaaagtttagagttctggactgtaaactgcacactaatattggaatttaacaaccgagatgatcatagtaactcttgttgagtaggaagttatttcgtttttaaccccgtttattttgctctctcataccaaaggtttgtcatagttgctgttgtttctactatgatgtcatttaaattgttagtatgcatccattttttttagaataaaatgagacttaaaaaacaaagctggctgggcacagtggctcacacctgtagtcccagcactgagaggccatgcagggtggaccacttgaagccaaaagttcaagaccagcctgggcaacatggtgaaactctgtctacatataaaatgcaaaaattagcccagtgtggcagcatgggtgtgtagtcccagctactcagaggctgaggcaggaaaattgattgagcccaggaggtcagggctgcagtgagctgtgttcatgccactgcactccagcctgggtgacagagtaacaccctgcctcaaaaaaaaaaaaaaaattatttctttaatagaaagctagtagccagttttcagaatattgaagagacaacataggcagcgtttcccatactttttgagggtggaacccctcttctgtggaacatctctagtggccagtgttccatggaacatactttgggaatatgcagttctaattaaagggggactgtgacaccacgatgtgtgcattatagtgtttgtgatgatttcagagctaggcaaagacaagctctatttgtttactcagcctttaatagaagaccaatcaataacctcagccattaaatcgccctgcctacttcttctatacacttagccattacttatgtctcttcatttttattttttctaagaagacggtaccatgcattatttcctgcaatattttacaggaagttcagactaattttaaggagaacaaaatgtacttttaatataacgcgatggtagatatttttgaaggaaatacaaaaaaattaaccgaggggtttttcgagtgccaacctggagtcacttgctcaaataggcactggggctgtgacagcaaacagagtggacctagtagtaattgcaggcggcatggcccaagcattaggtctgttcttctgggttgagttttttttttttctttttttcttttcttttttttttttgagacagagtctcactctgttgcccaggctggagtgcagtgacggcctctcggctcactgcaaactccgcctcccggcttcaagcaattctcctgcctcagcctccccagtagctgggattataggcacctgccatcatgcctggctaatttttgcatttttaatagagatggggtttcaccatgttgtccaggctggtctcaaactcctgacctcaggtgatccacccgcctcagcctccccgagtgctgggattacaggcatgagccaccacgcccagccaaacagttttttttgttttttttttttttttttttgaggggactctcacttcattctcacaacatctccacgaggtcgaggctccttcccctgtcttttagctgagcacgggcgtgcacagatgttaaactggtcctaggtcctgcatctaggaggcatcacaaccaggatctggacacgggagggccaactctggcaagctctgtgaaccaacacattccaccgggttggtttttctgattgttttttgtggtctttgcagataggaagcatgtgagaaactgaatcctttcaggtaatgagtcagatccttcgtggggtgatatcccttagggggaatgtgcctctgctgttttactggtagatgctgtcacccagcctgcagattgtgtgcactgaggacagggaaagggccgcagtcagctgcagggacaccaccgaacagacatgggcctggccttggtcagcgtcaggggaaaaacgagccctgatccactggtgacgctgcttctcttaaaaggatgcatgagaaggtgctgactttgtatcacgggagacctagataaagataagaggcgaacaaatgcccggcctcagcacaagagcccctgggagcgggagtcagcacatgcaggtgctgtgggcagactgaaaggaaacaccactccaggctgatggaatttgcagggtcgtgggaggccccaggcagatttgcccctagcatttctaaaggcagatgtcacttggcacatttttggctgtgctcaagttggtggcatctaattgcttaagtctttgatcagtctcctcagcatatgcttgtttttgatacaccaatggctccttccgcttttctgtgaagtggctgacctgcctatccctcttatggtggaacctcccttccgtgagcacctaggcatccgtggcacggccagggtggagatgggtctctgccctgccacgcacgactgcttagccactttccattggccaagacaccgcgctgcctagtgacattggttttggcaaatccagggtcagtgtgacagccagcaggtggacacacacagcagggtgagagatggcagcggctcccggcgatgaggaaggtggggcttccccagccaggcgaatccgctgtggttcttcatgcagcattcgcagagcagtgtgcagtgggactcgggaagatggggcgagcccttgaaccctatcctctctcatcaacagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgggtgctgtgttcctcacagggcatggggaggaggcgacatgtgggcacagcatcctcatgggcaggttgtcactgaagctgcaaagggacatccaggaaagggaggtgcaccaagcttaagtctgggtaacgaacggctgagcaaggcgagaaggaggccttgtgcagttgaggctggtggtggcttttttaacatatgcattaaggttttttttgtttttgtttttgttttgagacggagtctcgctctgtcgccgaggctggggtgcagtggcacaacctcgactcactgcaagcttcgcctcccgggttcaagcaattctcctctctcagcctcccgagtagctgggattacaggcacccaccaccatgcccggctaatttttgtgtttttagtagagatggggtttcaccatgttggccaggatggtctcgaactgcctgcctggcgggtgatccacccaccgcggcctcccaaagtggcattaagattcatacattcaaataagtgttcacaccctcagaggtcccttctggaggcccctggctttgcagaaatgtgcttagctgcacacggcgctcagacggcctctgcacgcagagggtctgctgcattggcgggtctttgtttccttcctctgtcctgtgtcacgggggccactgcccactcacacatggaaaccccctcctcccttggcgtcctccccctcctctcttgtctccattggctgctctcaaacctaaattattggggtcccccaggtatccatctccaggcccttcaagggaagctctcttccctggtaacgacatcccttctcgtgcccttagaaatggtaacctcccagatctttgtctcttttccccaaacctgcctcttgtgcttttgtgtcttgctgtctttcgccacctggtggtgttcccacactttgatcttaaagtgttcagattgaattcgcaggtgagaagatctgcagctgagtgtgaattaccctctggttccatttctctttgcaaaatgggggttgtagacctgcttcacaggatctctctgatgacaaggtggaaaaatggatgaaaagcgcctcgcacaatgatcaggacacaggcgaccccgatgaacacgtccctttcctgccccgtcagtatcccctttgtctctttctctccatcgtctcagccctgctctggcttcttgtctcttactcttggatctgactggtttcttcccatcccaaatctgctaagagatttgggatggggagaaagcctagctttgctcatatgtatcctgtgctttaaaaatgtctgacttcccggctgggtgcggtgactcatgcctgtaatctcagcactttgggagccctgaggcaggtgaatcacttgaggtcaggaggtcaagagcagccgggccaacatgatgaaaccccacgtttattaaaaatacaaaaattagcctgggcgcagtggctcatgcctgtaatctcagcactttgggaggccgaggcgggtggattacctgaggccaggagttcaagaccaccctggccaacatggtgaaaccccgtctctactaaaaatacaaaaatgagctgggtgtggtgatgggcgcccgtagtcccagctactcaggaggctgagacaaaggaatcgcttgaacctgggaggcgggggttgcagtgagctaagattgcaccactgcactccagcctgggtgtcaaagcgagactctgtctgaaaaacaaacaaaaaaaattagcagagcatggtggcgggcacctataatcccagctactcagctgtctgagacacgagaatcgcttgaacgccggtggcagaggttgcagtgagtcaagatcacaccactgcactccagcctgagtgacagagcaagaccctgtctcaaagaaaataaaaaaataaaaatatctgacttcccattgccaacagctatagtccaagctcaagagcattctaaccatctgctcccagccacagcacctcactcttccctgcaggccctgcgctcccacacgactgccacagggcctggcctcacagtgcctttgctcccggctgttcccttctgtccccctggctgtgcattcctgcccttcttcgaggtctcagtgtagctccttcctgttcttcaagcccagctttcccgtggagcatcattgttctctgcagttgaaagagctctcctcttctgaactctgagcgtttgtctgtggctctaatttcttatgcatctctagtctacctatctgtattcagaaaagacactcagaatatctactgaattgatcaggaattattttcccatgtgtcttcagagctttagtttaaggttcctgttggatcctttctgggatcgtagaatttgagatcatagaacccggccatctggtccaaacccctccggctctcacgtggaacagtgaggtctgcagctgaacgtcttctccgatgtcacgcagcctgtggcctcgagagctagaacccacaccctcctgacctgtggctgctggttctcttctgagtgatataacgcaggagtttcaagattcccgggaaaggttactttcgtttttatgaccataaagagtagcctgaaaatgctagtgccgtttgatcgtttacaggtgaagtctttgcgtgcctccctgttggactcaaatgttcttgtgcaaagaaataatctggaaatcgttctgtttttcttcccattttatacctgtctggtaagtaatttgtactcttctggtaagtcactggtgtttcccaaggggtgggatatagatctcaagcagttctgtcgtacgaggacagctcagccactcatgggcattatttgctggtagccagtgaaaagtccttgttcatttttgcaaggatagcgttttcattgcacgtattgaatagcttctttccatgggtaatgtgtaaggaaccagcccattttgagatagagctttgcagaccagcaaggaagggctgcgtgtcaaaaagtcagcaatctgccctatcattcccttgcagtaaatttctctgtccttctaataggattccaatgagagagccatccccctcctcagatctgacatcgtgcgcattctctcagccgccacccagaccctactgagaagggacatgtccctgaacagaagactgtatgcatggttactaggtactgagcagtatacacccttttaaagtcaaagttaatatgaaaccttttagtgctgacttctggaataagatttggtcttggtgatgtatctctgaatcatgaagtatggaaagataccacaatgactaaatatggcactggtcagttgaggtctgctgcctacacatagcttggttattttgcagtttcttttttaaaaaaggggaaataataagtgggatttttaaaatgccaactgaattccatttaagagcttgaaataccaccaaaaagtggtagcaaaaccttattcaggtagaagcctgttgctatggagaagttccatgggatgagggtgtatcgtggagaaaacttacaaatattgtggaagatatgtagataaaggaggaggttttgtgtaagtgtaaatgttttgggagacatttggataactttggagatcacgagagcccctgggccatgtttctgtgtgtcagagtgtgtggactgcctataaatttgttggcaaagggcccttgactattggttggaaggcctcccagggacagagcctaggaaattgcaactttaaagataacacgttcatgaattttctaaagtcccatattcacgtacctaagaaaacgtatacaaaacgattgtgacaggacttaacagctctgatcaactctcaacatttagatcttttttttcctttttgagatggagtttcactccgtcgcccagactggagtgcagtggtgcaatctcagctcactacaacctcggcctcccaagttggagtggttctcctgcctcagcctcccaagtagctgggattgcaggcacccaccaccccggctgggtaatttttgtatttttagtagagatggggtttcgccctgttggccaggctgatcttggactcttgacctcaggtgatctgcccacctctacctcccaaagtgctggaattacatgccaccacactcagcctagcattcagatcttatcaaagatcttaccaaagtcaagaagtcctcttcagtccttcctgctgttctccctagttataaaactttagaaagtcattgcatggaagcttactaaggattttaagaagactatttgtaggctctttaaggatttgtatgtaaaggatgattttgtcaagggcacagctctgctcctacgggacttgatatgctgtgtggaggacactgggcctgaccacagtgccagctctggctcacttacttgcggccccaggagccccatattctttgcccataccatgaggatgcactttcttgccctgagaaccttgcagacttatccagggctccagctgatgggagcatgtgcatgagaataccttgatctcacataatgctggacaaaaaaacactggttttaaaaagtgatcctcagccaggcatggtggctcatgcctgtaatcccagcactttgggaggccgaggcaggtggatcacctgaggtcaggagtttaagagcagcctggccaacatgctgaaaccccttctctactaaaaaatacaagtgattcttctgcctcaacctcccaagtagctgggattacaggtgtgcgccatcacgcccggctaattttttgtatttttagtagagacggggtttcatcatgttggccacgctggtttcgaactcctgacctcaggtgatccacccaccttggcctcccaaagtgctgggattacaggcgtgagccaccgcgcccagccaacagggtgaattcttagaacaaactaaattgatacccattgaggtggaattctgcctgtctgatcattagccacaccactgtcagaagaagaaaatctgacgtggtctttctggatctgattttggttttccatcagaagaatgatatttttaaaaatattggagcatgagacttttgcacaatatgatgtcctttaaaagcacagctctctttacagctcggcgcttgttcttttgtaggctcagacataaaaggaaataccgttgtgccagaatctgaaatctcaaattcttatgaagaccagtcgtcttatttttttgaaaaatactccaaggatcttttagttgaggtaaaggagcatttccggaaagttcagggtatccttggtgacgattctccagtggatttctttgggaggcttccacataggcagtgagcacgttccttggcccctggtttggggaactgcagggtatttgttgcatgctgggtgactggttttccttctgtcccagagtatttaacaattagaatagccagtaatgttgttacactttatgatatacgatattctaatatgtggctttttttaaataatagggtttggctgagatattgcatcagaagttcatagatgctgacgtggaggaacgccatcatgcatacctgaagccttttcgcgtcctcatcagtctgcttgacaagccagaaataggtaatgttagaaatgctgcttctatcctatgctgaatacagattacctgttttcagggaaatacaacatggtgagatacaaccaaagcgttattttgaatataatttaatatttggaatttcacaactttgaagtcatgttatatggttcaatgatcatatctgtggtcacttacaagttttgcatggctgggcgcagtggctcatgcctgtaatcctagcactttgggaggtagaggaaggaagatcacttgagctcatggatttgaaaccagcctgggtaatatggctgaaaagccatgttgaaaaaccccatctctataaaaaaatacaaaaaaattagccaggcgtggtggtgcttccctgtagtcccagctaccaagtggctgaggtgggaagaccacctgagcccagggggtcgaggctgcagtgagctgtgattgtaccacggcactccagcctgggcgacagagtgagacccagtctgaaaaaaaagttttgcacaataatttgaacattttttgttaggaaaatacctttgagctcctatagtgtctacagaacatgtggtatttcctttttaagcctattttttcaatgtcatacttaaaatgagctttggtttgattttcaattaagtaggggaccccgtccatctttttgccttgggatcctgggcaagccacttcttttcactgtggagagtaaaaacattttcactgtaaaatgaagagggttgaactagactctggtcaccaaaggctcccttcttagatactatggtcctatgagcataggttgagaaaagtgaccttctctcactatttatttatttatgaatgaatgaatgaacgaatgaatgaatggcagagtctcgctctgttgcccaggctggagtgcagtggcgcaatctcggctcactaaaacctctgtctcctgggttcgaacaattaattctcctgcctcagcttccccagtagctgggattacaggcatgtgccaccatgcctggctaatttttgtattttcagtagagacagggtttcatcatcttggctaagctggtctcaaactcctgacctcaagtgatccacctgcctcggcctcccaaagtgctgggattacaggtgtgagccactgcacctggccctctccctcactttaaaaagaaatttgcgaccaggcacggtggctcacacctgtgatcccagcactttgggaggccgaggcaggtggatcatgaggtcaggagttcaggaccagcctggccaagatggtgaaaccccatctctactaaaaatacaaaaattagctgggcatggtggcgcgtgcctgtagtcccagccactcgggaggctgaggcaagagaatcgcttgaaccagggaggtggaggttgcagtgagccgagattgcgccactgcactccagcctggcgacagagcaagactccatctcaaaaagaaaagaaatttgcggccaggtgtggtggctcacacctgtaatcccagcactttgggaagctgaggcaggtggatcatgaggtcaggagttcaggaccagcctggccaagatggtgaaaccccatctctactaaaaatacaaaaattagctgggcatggtggcgcgtgcctgtagtcccagccactcgggaggctgaggcaagagaatcgcttgaaccagggaggtggaggttgcagtgagccgagattgcgccactgcactccagcctggcgacagagcaagactccatctcaaaaagaaaagaaatttgcggccaggtgtggtggctcacacctgtaatcccagcactttgggaagctgaggcaggtggatcacctgaggtcaggagttcaagaccagcctggccaacatagtgaaaccccattcctactaaaaatacaaaaattagccaggcatgacagtgcacacctataatcgcagctacttgggagtctgagtcaggagaattgcttgaacccaggaggtggagattgcagtgagctgagatcgcaccattgcactccagcctgggcaacagagtgagactccgtctcaaaaaaaagaaatttgctaccatatcagctcactttaaggtctgcatctgcttatgtgagccctataccagggaaaagatccccatgtcttccataggattgcaagcctaagaatgtcatttcagtgctccaggtgtacctacctcctggtagctgtttgcagaggacaagagagctgagggctggccgggtgtggtggctcatgcctgtaatcccagcactttggaaggccaaggtgggcctcacttgaggtgaggagtttgagaccagtctagccaatatggtgaaaccccatctctactaaaaatacaaaaattatccaggcatggttgtgcacacttgtaatcccaactacttgggaggctgaggcacaagaatcacttgaatctgggaggcagaggttgcagtgagcagagttcacaccactacactccagcctgagtgacagagcgagactccatctcaaaaaaaaaaaaaaaaaaaagagagctgagggcattagtgaagtggcctctctctggccttgggatggaggcccttcgcttatccattcaaaagcacagagcatctgccatgtggcagggatggtgccagctctagggggacaaaaggggagcagcttctcatgaagttagagggaaggggagactccatgttcctggagtgtttttactgttcattaataataaccatggctgacattttttgagcaattattttgtgccaagtgatttacatacatccttttatatctgtctgcacacacacctctgtccctccaacaaccccaaggtaggttctcccactatgcctgttttacaaatggaaagactaaggttgggtgggagtaggtaatttgcccagggccagtcaggagcctaagctgggtttgtcagcaccccccgatgcttgcctgattgcactcagagaagtcctacccgagatgtttgcctctgtcaccaggtgaactttattccaagagttgtgcagctctcgtcattcttaacgaaagtccaagtatgaagcttttgttcttccaggctctgcccatgatgtgctgcctcagggtgtctgcactttgttcagattcctcttcccatctgcccgctcccaccttaaaccaaatagattttcctgctagtgtagagtaactgcagctctgaaaaatcatgatttagtccaaaaagtggaacacttatataaatgtattgggagcttgctgtgtaacttcagggaagtattaaaagaagaaaatataacttagcattctggagatgtgtgttttatgtcaaagccatgcaccttggtgagccaagtaaacgttgctgctaacttggctccaggtcgtattttctggaagcaaatgaatatcacgctcctgcccaatcataacagtcacttaatttactctttccaattttttagctgtctgcaagaaatcacactcaggaggcaaaggaggtgattatacagaactagaaggcacaggacggccattcagtccagtccatactttttgtggctgggctttagccatacctcatttcctcctccatcaatcaaggcaacaaaattgccttcatttttgtaacaagcatttagcattcttatgctgtagataaaatacacaggaagccaaggccaggtgcggtggctcacacctgtaatcccagcactttgggaggccgaggcaggcagatcacctgaggtcaggagttcaagaccaacatggcaaaaccccacctctactaaaaatataaaaattagctgggcgtggtggcacacacctgtaatcccagctgcttgggtggctaaggcgagagaattgcttgaacccgggaggcggaggttgcagtgagctgaaatcatgccactgcactccagcctgggcaacagagcaagactctgtctccaaaaaaaataataataaattctatcttaaaaaaaatacacaggaaacttagcatgaaaataattctctcagaggcacatcttttggttttgtgaaaagaagtgtaaaagattggattaatctgcttttttgccagtgttgacagagctttcattttctctgaattgattgtgtgtttctgcctttggatacatgggtaagaagtcaggccctcagctgcctgagggttgcggtttgcggagcagcaatgccctgcccatcccctgcctggttgcagggaagcttctctaacatgcagctggtccagttcttttgtgccatctttctcagcgtttcaggatagccatcatttcttttgtgttgctccagctcatgactaaaggaattgaagaagttgccctgctctctggatatttctgttgagtaacgtccctggccagcagtttatgcacacttaacacacgtagtctgcgctctgcctctatctagcagaatctgctttgggcaagttacttaacctctctgtgcttccatctccttatgtgtaatcagcagtacaggatctgtctgcatggctgttacgagggtttaatacgttaatagatgtaaaacgcgtagaagggtgtctggcacacaggaagttctacaaaaatgttggctattttcatgaatgttgtttccccagctaaagttgtcaccagtaaagttaagtttctgtatattttagactatataaaatgtctgtctgcacaggtttactgtatatatgtcttatgtatatacatatgtcacttactgatttaaaggggattgttaatctgtctctgaccatcttccttctaattacagggcctcaagtggttgggaatttgtttctcgaagtcatcagggccttttattcttactgcagagatgcccttggctctgatcttaaacttagctacacccagagtggaaattcgctgataaggtatgggtttggccttgaacctcacgcatctctctccctccccggtactgtgattttttttttcctctcttgcttactataaattgtgaagtggtagagaaagcagagatgcagcaggtgagaccattggtgaaaataatcaatgcgttgaagtcagtccatgggaattgactgttccctactgagtacggtgaagagtttaaagggagtttgatatagtctttcccccagcctgggatggacaggtatttattgattttttgatcaagtatgaaacaatgaaatgtatgtattgatcaagtatgaaactcgtttaacaaaggcagcttgatctagtatacccaagtggtgagttacagggcagagagaacagagaaaatggaggggagggcacctggcaagtggaaaggggatgtgagtcttcaggacaggagtccagggggtgttgggggagattgggggagacccaggcagggcaccggagagcacaggctccattcccccagaggcagagtgagtggtgtttggaagacagcgggcacattggcctcacgtgcgcagttacacacaaaccctgttttgtttgtttattttgttccttttaagggaatacaactttttcctttttgctttactcttaatgtaatttccttctgcctgaactagcattgggtacattgaaaatttaaatcaatgttaatatttttctggtttgttagttgtaagtgtactaagagttcttagtgtttgcttttttctcccagaatgaaagcggtttattgtttttctgagtatgaaagtaatacatgctcattgttgcatttactgatatttgaaagatcaagaaaaaaggtgtcacacgtaatcctagcactcttcagagaaaaccataaaacatttttacttctttctagatttctactacatacataaatacatagatgcctgtcttttattttaaaggtagaattacaccagttatttagttgcttggggttttctttttgttttcttgttggtttgtttgtttggttttgagacagggtcacccaggctggagtgcagtggcgtgaacatggctctctgcagcctcagtctcctgggctcaagcgatcctcacgcctcagccccttaagtagctgggactacagacatgcaccaccatgcccagctaattttttttttttttttttgtggagatgaggtttcaccatgttgctcaggctggtctcaaactcctgagctcaagcaatctgcccacctcagcttttcaaagtgctaggattataggtgtgagccgccatgcctggtactctctggagtgtcactctccagcatgacaaggtctcactctgtctcccaggctagagcacagtggcaccatcaatggtcactgcagccttgaactcctgggatcaagtgatcctcacacctcagcttcccaagtagctacgactataggcacacacaaccacacctggctaatttttaatttttctgtagagacaaggtcttgctatgttgcacaggctggtcttgaattcctggcctcaagcagtcctcctgcctcagcctcccaaactgctgggactacaggtgtgagccactgtgcccggccactgcttgttttttaaaatgcaagttgtgagtagctctacactattctcctatgggattagttgccttagatatttgttaaggatttatcatttatttaaggccaagtgcagtggctcacgcctgtaatttcagcactttgggaggccaaggcaggcggatcacttgaggtcagcagttcaagaccagcctggccaacatgacaaaacctggtctctacaaaaaaaatacaaaggttagccgggtgtggtgggccatgcctgtagtcccagctacttgggaggctgaggcatgagaattgcttgaacctgggaggtggaggctgcagtgagccaagatcgtgccactgcactccagcctgggcgacagagcgacacttcatctcaaaaaataaataaaaataataaatcctgactgaccaatttcttattgattgacttttagacagtttctgctttttcagttttgtttgtttgtttgcttttgagacagagtcttgctctgttgcccaggctggagtgcagtgatgtggtcttggctcactgcaactccacctcccaagttcaagtgattctcctgcctcagcctcctgagtagctaggattacaggcacctgccaccactcctggctaattttttgtatttttagtggagatggggttttcaccatgttggccaggctggcctcgaattcctgacctcgtgatccacctgcttcagcctcccaaagcactgggattacaggcatcagccactgcgcacagcctgtttgtttgtttttgagacggagtctcgctctgtacccagcctggggtgcggtggcgccatctcggctcattgcaacctccacctcctgggctaaagcaattttcgtgcctcagcctcccgagtagctgggattacagatgcccactatcatatctggctaatttttatgtttttagtagtgacagagttttgccatgtttgccaggctggtctcaaactcctgacctcaagtgatctgcctgcctcggcctcccaaagtgctgggattgcaggtgtgaactaccacacccggcctttttcagtattttttaatggccatttagtggtacacttctgcacacatctatgtagctgtgcagggatttcggtaggataaatttcttgaataaatttcctgagccatagaagataaaatttaaggctggatgctatggcttatgcctgtaattccagcactttgggaggctgaggcaggtggatcacttgaggtcaggagtttgagaccagcctggccaacatcacggtgaaaccccgtctctactaaaaatacaaaacttagctgggcgtggtggtgcacgtctgtaatccatcctagctactcgggaggctgaggcaggagaatcgcttgaacctgggaggcagagattgcagtgagccgagattgtaccactgcactccagcctaggaaacagtgagactgtgtctcaaaaaaaaaaaagaagataaacatttaaaatcttggctgaatttccctgctgaatatccatgtaccatgttattccaccagtagagtatggactaaaactgattttctgtacaaattctttttacagtagctctgaaattattattattttatttttatttttattttttgagacagagtctcactctgtcatccaggctggagtgcagtggctcaatctcagctcactgcaacctccgcctcccaggttcaggcgattctcccacttcagcctcctgagtacctgggattacaggtatccgccatcatgccctgctaatttttgtatttttgtagagacagggtttcaccatgttggtcaagctggtgcacccacctcagcctcccaaagtgctgtgattacaggtgtgagccaccgcacccagctctgaaatttatttttaagagactgtatcaatataaatattgtttacgatggcattatgcaaacacattataagaacagtaatattttcatttttatcagggtgtgtcagcttctctagaaataagttgcagatggtgaaatcaattacagttttttggacactttttgtaattcaggatttttttatagacatatttattcatgtcctccccttttacagtgcaatcaaggaaaacagaaatgcctctgagattgtcaaaacggtaaatttgctgataacttctctaagcacagactttctctgggattatatgacaaggtgttttgaggaatgctttaggtaagtatgcagttcaagaatgcagaatatttaggaaggatgagagggtttaataattttgtagctgcttagaatatcagattatatataagtagctgaagctgagtagtctttcctgagttttaaaattcaactaaaacaggattggaaagaattcacttaagattctagcagaataaaaacatctccaataagaaggttcacataatctttgccatgtaattctgaagctgctttaaaagtctaactttagaaaatcctcagcgcattttctggttacattcatcaaatcagctttcctctcctggctgcccgatctattgaaagcagcttagttttgtggctttgtgactggatagagtgtttttgaaactcttgctgaaatgaatgtaactggtcagataaaagcattaatgttttaagctactataatcagctttaccatctcttttaaccgggtgaattgcaccacccctaaattgtttgcagtggcgtaccccaggaataccgagctttcctggagagccctttcccatgccattttctttacgggaggaataaggtcatgtctcaaaccctgttttgtcctgaggcatgctgtaaaacttatttcttgttcatctccactgtaatgctcttggctgtttcagagtcttacttctcagctgctaccactacacttttctgcccaaataagctcacaaccctgggaaaaataagttaattgcaattggatccacaggcaacagcaaggccatattatattgaggttagagtatgctttggtcagcctggttgttatgttattttttattttatgacggagtctctgtctctcaccgagactggagttcactggcacgatcccagctcactgcaacctctgcctcccaggttcaagcgatcctcccatcctggcctcctaaatagctgagactacaggctcagcctcccaagtaactgcgactacaggtgcacgccaccacacccagctaatttttgtatttttagtagagacagggtttcaccatgttggccaggctggtcccaaactcctgacctcaagtgatccacccgccttggcctcccaaattgctgggattacaggcatgagccgccgcatctggccatcctggttattaaaaaaaaaaaaagaataaaatgtttctacccagatagagctgactctccatctttgcaacattttgtcctcttttcatcccagagttaatccctgtcctgagattaatgtctgtcttcagtgtaacatggctttgctgttgcctgtggatcctattacagttaatttattcatcccagggttatgagatgaaaagcaatagatactttttaacttacccatttatctagtagcctgtttattttaaaagaagtcttgaatttcagtataagataagcaactaacaatagttgattggtggggttacacttctctacagaagctgaaactttctaggcaactcaggtgctgataaactcctggaattacttggagaggagtagtcccaggccactcctacagcagggtgaacagccatgtggactgtggtgttctccagcccagcctcgttcccttggatcgtgcttttgggcttggactggggacttgggattacatctgtcgatggtactccaggtctcctgggagacacctgaattggtagagttcaagtcagagggaatctgtttggacaccaacagattcaggacacttattgacacttctacatgttagatacttttagtcaccaaaatttagttatgagaactacaaaagctgccttccattatgtttgaagtagaataacgttactggaaattgtaagaaatgcttggacttaccgcaggaagaagaattgattttttttttttttctgagacagagtcttgctctgtcacccaggctggagtgcagtggtgcgatcttgtctcactgcaacctctgcctcccgggttcaagtaattctcatgcctcagcctcccaagtagctaggactacaggcgtgggccaccacacctggctaatttttttgtactttagtagagatggggtttcaccatgttgcccaggctggtctcagactcctgagctcagacagtccacccatctcggcctcccaaagtgttaagattataggtgtgagcctccatgcctggccaaagaatggattttttctttgctgtgatttatagaccagtgaagcagcgttacagcgtgaggaacagcgtcagccctccccccacggtctcggagctctgcgccctcctggtcttcctgctggatgtcattcctttggtgagtgctggggaagggacatctcaacgcctgctattatttacattcttactggtggtgatggcctgctttatcaacctcacattactgaaaatgttttacataaatatgcaacactgttttgatgtttgttttggcataaaagatatagctggatgtaatctcttaaatttttaatgtcttatttaaaaggggctataacttttgggccagttgtaagtgggcaaagctgaagttaggtcaaccagctgaagaactgggtatcattcccgtactacagttactttagggaaagagtcaatacatttcctagttaaaattgtgctgttggctaattttctcaaaggaaactaatttccttaatgtagaaacgtgccaattttattttttattagaaagtgtaaagccacttgcaaggagaggagtaacatccttgatttgtctagatcaaattgaaataccgagcctagctctgtggtatgcgctcgtaattcccagctactcaggaggctgagattggagcattgcttgagcccaggaatttgagaccagcctggacagcataacatgatccagtctcaaacaaaaacaatagaaatgttcttttcttttctctgtctctctctctctttttttttttttctcctgtgacagagttttgctcttgttgtccaggctggagtgcaatggtgtgatctcggctcactgcaacctccgcctctggggttcaagtgattctcctgcctcggcctcccaggtagctgggattacaggcacctgccactacgcccagctaattttttgtatttttagtagagacagggtttcaccatattggccaagctggtcttgaactcctgacctcaggcgatccaccagcctcggcctcccaaagtgctgggattacagatgtgagccaccatgcccatcctcttttctcttttttgagatagagcctcactgtcacccaggctggagtgcagtggcatgatctcagctcactgtagcctcatcctcccaggctcaagcaatcctcccacctcagcctcccaagtgtctgagaccacaggcatgtgccaccacatctggatagttttagtattttttgtagagatggggtctcactgtgttgcccaggctggtctcgaactcctgagctcaagcaatctccctgcatcagcctcccaaggtgctggctgggattataggcatgagccactacgcctagtcttcttttgttttctgatttgaaaattaatatggtatggtggctcacgtctgtaatcccagcactttgggaggccgaggtgggcggatcacaaggtcaggagattgagaccaccctggctaacacggtgaaaccccgtctctactaaaaaaaatacaaaaagttagccgggtgtggtggcgggcgcctgtagtcccagctactcaggaggctgaggcaggagaatggtgtgaacctgggaggcagagcttgcagtgagccgagatcacaccactgcactccagcctgggtgacagagtgagacttcatctcaaaaaaataaataaataaataaataaaataaaataaaataaaaaagaaaattaatgtgggtcaggcacggtggctcacgcctgtaattccagcactttgggaggccaaggtggatggatcacaaagtcaggagatcgagaccatcctggctaacacggtgaaaccccatctctactaaacatacaaaaaattagccgggcgtggtggtgggcacctgtagtcccagctgctcgggaggctgaggcaggagaatggcgtgaacccgggaggctgagcttgcagtgagccgagatcgcgacactgcactccagcctgggctacagagcaagactctgtcaaaaaaaaagaaagaaagaaagaaagaaaattagtgtgaaatttatgccctaaaaaattgaattagatgccattttgagatgcattgtttttctgattgtgaaccaacattgtggggttaacctacacgtttatttcacaggaactttactctgaggtgcaaacccagtatctccctcaggtgctcggctgcctggtgcagcctcttgctgaggacatggaggccttaagtttacctgaactcacgcatgccttgaagacgtgtttcaaggtgctcagcaaagtccagatgcctccttcctacctcgacacggagtccaccagcggaacctcggtgtgtactctgaggggcagaaatggttctgggggctaaaagcagcttatgccttcctgggagtagaaagtctttagggttggttaggataggaataaagatgagaagatacccaggtgatatgtcaaatatgcttgtaaaaccctcactttaaaaggttttagcacctggcatggtacaatggctcacacctgtaataccaacactttcggagactggggcaggaggattgcttgagcccaggagttcgagaccagcctgggcaacatagcaagccttcatctctctacaaaataaaaattaggccaagtacagtggcccacacctgtaatcccagcactttggcaagctgaggcgggtggatctcctgaagtcaggaattcaagaccagcccaaccaacatggcaaaaccccatctctattaaaaatacaaaaattagccaggcatggtggcacatgcctgtagtcccagttacttgggaggctgaggctggagaatctcttgaacctgggaggcggaggttgcagtgagccatcacgccactgcacttaagcctgggcaacagagcaagactccgtttcaaaaaaaaaaataaataaaaataagggctgggcgcggtggctcacgcctgtaatcccagcactttgggaggccgaggcgggcagatcatgaggtcaggagatcaagaccatcctggctaacatggtgaaaccctgcctctactaaaaatacaaaaaattagccgggtgcagtggcgggcgcctgtagtcccagctactcaggaggctgaggcaggagaacagcgtgaacccaggaggcagaccttgcagtgagccgagatagtgccactgcagtccagcctaggcgaaaaagtgagactctgtctcaaaataaataaataaaataaaataaaataaaataaaataaaataaaataaaataaaataaaaaggcatggtggtgttcacctgtagttccatctactcaggaggctgaggtgggaggatcgcttgagcccaacaggttgaggctgcagtgagccatgattgcacggctgcactccagcctgagtgagagcaagaccctgtctctacaaaaaaaaatttttaagtttagcaccctttgtttcacccattctcatgctacttgcctgctctgtaactgcagttaatggttagatacagttaataactatgtaactacagttaatgggctagttataactagccctgcactgttttatgtgtgtgtttgtggcatgtgattttggttatttcgaatataagcgagatgaggtactggattagtttgctgggactgccataataaagtaccacagactgggtggcttccacaacagacacttgttttctcatggttttgaaggccagggcctgacacgaaggtgtcagcaaggttggcacctcctgagtgcactggggaaaaagagtctgtctcatgcctcccccgagcttctggtggtttgctggcaatattcagcattcctcggcttgtccaggcatcagcccagtctcggcctttatgttcacttggctgtcaacctgtgtgcatgtctgtctctgtgtccagatctctcctttttataaatccagtcctactggatttgggcccactctaatgatctcatcttaattggatcatctgcagagactctattttcaaattaaggtcacattcacaggtattgggagttaggacttcaacctatttttgggggacaccgttcaacccataacgtacactattctctgacttgctttaccttttttttttttttttttgagacagagtctctctctgtcgcccaggctggagtgcagtggcatgattttggctcactgcaacctccacctcatgggttcaagcgattctcatgcctcagcctcccaagtagctgggattacaggcacccaccaccatgcctggctaattttttgtatttttagtagagatggggtttcaccatgttggccatgctggtcttgagctcctgacctcaggagatccacccacctcatcctcccaaagtgctgggattacaggcatgagccaccacacctggccttattttatttcttcatacctttattttaccctcagctcagtttcctcattcatatttgttaatttgtcggaaacagttctcgctctgttgtccagagaattgtggcaggtgatccgcccgcctcagcctccctaagtgctgggattacaggcttgagccaccacgcctggcagaaacaattcttaaacaacttttttgaactctaaaggggttatatatttagacaaaaacacaagaaaaataggcccaaaagccagcctccccagagagcatgtgggtgtaccagcctcctctttgctacccaccgctctccttctcctgctttgggtgcctcctaaatttcattatacacttaacacagggattctctagtctggagagtgatgattttgaaaaacagaattgaaatacattcatgatttcaactgatacttaaatagcttggtgttaagagatgcacaattcacatctttttattttttacagagtccagtaaaaggtgaaaacggcaaaataattttggaaacaaaggcagtgattcccggtgacgaagatgcttcgtttccccctctgaagtctgaggacagtgggatcgggctcagtgcctcgtcaccggagctctctgagcacttgagggttcctcgagtttctctggaaagggacgacgtttggaagaagggcgggagcatgcagaggacgtttctttgcatccaagagctaatcgccaactttgccagcaagaacatttttggagtacagctgacagcgtcaggagaagaaagcaagtccgaggagcctgcagggaagagggacagggatgggacgcagagcctggcagccaatgattccagcaggaagaactcttgggagcccaagcccatcactgtgcctcagttcaagcagatgctgtcagacttgttcacagcacgagggtctccattcaagacaaaaagttcagagtcaccatcgtcttcgcccagcagccctgccaggaaaaacgggggagaatgggatgttgagaaggtggtcattgacctggggggttccagggaggaacgcagggaggcctttgccgccgcctgccacctgctgctggattgtgccactttccctgtctacctgtccgaggaagagaccgagcagctctgtgcaacgctcttccagctgccaggtgagaggcagccctgccgaagtccctctttgggaatcatacgatgaggcgattgacgtgggtggaatatcccctatccacaatgctagggaccaaatgtattttggatttcggacttttttcagatttttggaatatttgccttacacttaccgattcagcattcctaatccagaaatccaaaatccaagagctccagtgactgtttccttcgagcatcatgtcagtgctaataaggtttcaggttttggatttggaattttcagattagagattctcaacctatatttaaagactagctcaaattgtgtaagccaagaaggtgctattggcctcatttgttcccttcctcatttgtaattagtacatttttgacttgtgtctcaccacatggcaaagtggtaagggtggggcctatgtttttaaaccctgggtgtccagcacagcccatcagaagacctagaacatgagtggcattcagtgatagtaaatagactatttcatgatgcctgttgataaagttttttttgtgttgggtttttttgttttttttttttttttgagacagggtctggctctgttgcccaggctggagtgtggtgacaccaactcagctcactgcaacctccgcctcctgggttcaagtgattcttctgcctcagcttccccagtagctgggactacaggcacgtgccactacgcccagctaattttttttttttttttttttgagacagcgtcttgctctgtcgccaggctggagtgcagtggcgcgatcttggctcactacagcctccgcctcccgggttcaagtgattctcctacctcagcctcccaagtatctggggttacaggcacacgccaccacacccagctaatttttgtatttttagtagagacagggtttcaccatgttggccaggatggtctcaatcttttgacctcgcgatccacccgcctaggcctcccaaagtgctggggttacaggcgtgagccactgcacctggccccctaattttcatatttttagtagagatggggtttcaccatgttggccaggctggtctcaaactcctggcctcatatgatctgcccgccttggcctcccaaagtgctgggattacaggcatgagccaccgtgcctggccaatattttatatattggtttgctagggctcctctaacaaagtaccataaactgagaaatttgtctcatagttctggaagccagaagtccaagatcaaggtgtcagcagagccatactcctcctctgagaccctggatggaatactttttggcctcttcagcttctggtgctggccggcaacccttggagggctcctcaccttgcagctgcatcagtcccgtctctgcctttgtcttcacagggtgtcctctgtatgtcctgtcttcccttgacatgtccctcttacaaggacaccagtcatattggattagggcccaccctaacaacctcatcttaatttgattacctctgtaaggaccttatttccaaataagtctcaccagcgggaggttagcgcactgctgtccaggtggatttctcaggtaacttcccagatctagggtgctgtagaatctgcagactggggacccattctcacgtggttctgcttgtttctgcctctccggctggcttcctttcaggagccggtgattccagttttccatcttggctgaagtccctcatgactatttgctgctgtgtgactgactgctacctccagaacgtggccatttccactctgctggaagtgataaaccattcccagtccctggcgcttgtcattgaagacaagatgaaacgctataagagctctggacacaaccctttttttggcaagctgcagatggtgacggttcctcccattgctccagggatattgaaagtcattgcagagaaaacagatttctatcaggtatttcccactgggaacactcttcttatggcctccttctccccctgagcaaaactcagaaccgtattgctggggatgggggcagtggcccacttctctgagagtgatattctatagggcactgggcagaggcagtagcctttggtcttcctctcccagcatgtaactttcaccctccaggaaagctacagtgagagcaactggggccccagtattctgggcctgccaggactgagtggaacccctgcctgggagtggggtctgggtggaggcagggagcccatgactcctccactgcactcacctggatttagcctctgccacatccagcagaggggtgggaaggtgacgtgctggtggcctgcccctcccaggaggtgcaaaagcccttgactgggagctggggaaagagagcacccttttgcttggccacatgcaccagagtggatagtgacgtttccatggagctaagctggggaaggaaggagatgatgagcaggtcatggctcaagtgccatgactcttgctgctttgaccgaaatgtcgtaggttttccggaataaatgtttctttatttcctgaatgtcctttggataatttccagactctaaatggttggttgttgttggttttaaaataattttcaccagttatggttgtgttgcttgggagagggtctgtctgtggaactcctcacaccgctcagctttggttccatgtgggacaccatctacggtgtcaggtcctgggggagcttttacttaattgctcattgactttttttgttgttgttgttgagacggagtcccgctctgtcacccaggctggagtgcagtggcacgatctcggctcactgcaacctctgcctcccatgttcaagcaattctcctgcctcagcctcccgagtagctgggactacaggcacctgccaccacacctggctaatttttgtatttttagtagagatggggttttaccgcattggccaggctggtctcaaactcctgacctcaggagtttgggaggcccgcctcagcctcccaaagtgccagaattataggtgtgagccaccgtgcccagctgcttattgacttttgtaccacatttcttcttcctgctagagttgagtcacattagatcttgaatagacagaacttgaaaccaggactggaaccgctataagcagcagtgattaagcaagtgtcatcttggccctacatagatcagagatcagaaaatttggcatatttacactatatataggcacaggggagaaaaaagaagaaagaattgagatcatgaatctttggaaaggtactcatagaataaaagtggcagcattaaatacattccttttattttggggcagtgagggaagcttttccaagttcttactgaagccttgatttttactttcattttcatgtagtacatattcaagtacttaccatttgcctggcactagagcatacttttcttttttttttttccttgagacagagtcttgctctgttgcccaggctggagtgcaatggcatgatcttggcctctgcctcctgaattcaagcgattcccctgcctcagcttccctggtagctgggactacagatgtgcgccctcacacctggctaatttttgtatttttagtagagacggggttttaccatattggccacgctggtctcaaactcctgacttcaagtgatcctcccacctcagcctcccaaagtgccttacaggcgtgagccaccgcacccggccaagagcatactttttttattgacatgtaatattgtatatatatatgggtacaatttgatattctgacacatttatacattgtatgatgatcaaatcatggtaattagcatacccatcaccttaagcatttatcatttctttgttgtgaaaacattcagaaccctctcttctagcaatttgaaatacacaatgcattattgttagcagtagtcaccctactgtgcagtagagtaccaagatttattccttggagcacacttttatgtactgtacagttcttgagagttgaggacagcggcagctagtgcctgtccctgttgcagatgctggaactagagacacagcaaccttacccatagccaggacgtgcccccaattctcagactccagacagggctgttgtctgatctttcagcctttttttaatcctgcgggaacagctcacataccagagttcctgcttcccacagtgcaaacaagaaaaggtcagatagcccaagggtgccctgacctttcttatcaggtagtgttggcagatttcagataactaagacaacacccagaacagaggagtagagtaaggtttaaacatgtgaaggaaggcccggctcggtggctcacgcctgtaatcccagcatccagcactttaggaggctgagggctgcttgcttgagctcaggagttcgagaccagtctggccaacacggcaaaatcccatgtctaaaaaaaaaaaatacaaaaattaacctggcatggtggcacacacctgtagtcccagctacttgggaggctgaggtgggaggatcacttgagccaaggaggcagaggttgcagtgagttgacatcgtgccactgcactccagcctggggcacatagtgagaccctgcctcaaaaaaatatatatgagggagtaggtatggatttgtgatcggcatcaactctcaaaaaccttgcaaaaaaattttttaaaccttccggaagggagtctcttgcatatatatttgccatagtgacagcaaggaagtcggggggggggcggtctacgtagtcaaaaagttatatatcagaattcaattgtaatgtgattgttggaaatcactttcccttagagaaaaagtaacaaaataatggttaggagtttgagccagtcagtggttaacttgatctatgcagagaaagacggttttgttgagtagaaataaatgggccaaagaagttatttgatctaagttatgcctaaaatactccagtctatgagatataaacttcatatagtctatgaagtataagaatgtctttagaaatttagaaatttccctcccggaagtggggaccagccctccttctgggtctcacccttgttggggcaggcacactggctcctgctccctgccacttggcaaggggctgtagccctttgcagaccatgcatgtttaatgagctcagttcagggctgggaagatggaggacacgatttgggggtataatagtgttttgaaagtgaggcaggcacctgccacagcgttgtgcagggaaaagggaagagtcaagttagtggaattaaagctggtaggcgtggctctttatccatgctgcgtggtaaccaattcgagcagaccccagaggtgaccaagtgctgtggagctgaaccccagaatgagtgatcttgacaaccactgtaaattcaccaaactccccagagggtacatctgtgcattccccagtgcctgctcggcacctgcctgttgaaagaatgcttcaacccctttggtccagtttccagttaattctctttctgaaagtaatgttgaggttgaggcaagagctgcagtgttcttagtcggccagaaacctccaggtttgacctcctataacattgcctgctgcctggatgactttggtgggtttttcctttttttcttttttctttttctttttctttttttttttttttttgagacagagtctcactctattgcccaggctggagtgtagttgcatgatctcaggatctcagctcactgcaacctccgcctcctggattcaagtgattctcctgcctcaccctcccaagtagctgggattacaggtgcccgccgccacacctggctaatttttgtatttttagtagagttggggttttgccatgttgaccaggctggtcttgaactcctgacctcaggtgatctgccccacttcgacctcccaaagtgctgggattacaggcatgagccaccgctcccagcctttggtaggtttcttgctttatttgttggtgatttgtctctgagcatggaggattctcacatggcaagtataggtgagatccagtatgtcggggctgggactgactgagtgaggatgtgagcggatgttgcctgtgttgacctggtcccccaccgcctgccttttccttgtcccagagggtggctcgtgtgctttggaatcagctgaacaaagagacccgggagcatcacgtcacctgcgtagaattgttctaccggctgcactgcctggcccctacggccaacatctgcgaggacatcatctgccatgccctcctggaccctgacaaggtgagcctttctggccgccacctccatcctgcagcaccccggcccctgctgtacgtgcccttagccaactgacatccattcggtcgaagtctttctggggctgagtggacatcgtgattaataaaataagcagaggtgttctaggatttcagtactggaaggccactagaagcatgagccattctttttacagccctggaaatgtggtttgtgaccatattgaggctcaccagggaaacctgcccaaacttgctggaaggacttgcagggcttctgcaggtgttggcaaaataggcagttgtagggaatttattgtccctttaagaacttattgaagcagggcgtggtggctcacacccgtaatcccagcattttgggaggctgaggtgggagaaattgaggccaggagttcaagacctgcctgggcaacatagtgagatccatctctaccaaaaataaataaataaataaggccaggtgcagtgactcacgcctgtaattccagcactttgggaggccaaagcaggcggatcacctgaggtcaggagtttgagaccagcctgggcaacatggtgaaaccctgtctgtactaaaaatacaatattagccgggcatggtggcacatgcctgtaatcccagctactcgggaggctgaggcaggagaaccacttgaatctgggaggcggaggttgcggtgagccgagatcgcgccactgcactctggtttgggtgacagagcaagactccgtctcaaaaaataaataaataaaaataataataaaccaatttttttaaaagaatatattttattgagaatttatcgtcctgggtctcctttccagtctgttgtgtctcctcgttctttaagacacttgggcctgacacttgcaaggaagccatgctcctttgtgttttcctttggctgcagaccacaggggtgaccctggactctaatactgagttctgaatgtgccgctgtgttaaagtgaacaatcagagagagaggatgcaggttctccttttccttctggccgaatcagtcaaaggagaatgcagcgtctttgctgtggttgctgtcagttctgctgaagtctttgatctattgtttaaatggggtttatggtgactgaagacagtggtcagttacaaaaccaagttcctcactcccatgtatctcctcatcaagggaacaaggctggaagctctgtttagattttccgtgatctggcatctgacaagagagatccaaggcagtcgagtaacatctcacaatcgctcctttgataggtgaggcggccttcgttatgatctaccgttaactcacgaggaaactccacagaggtgcctgcccaacgtgtggggctggggagggagaggagcgtgcagttgaaaacatgaacccatatgaccgggtgtggtggctcacgcctgtaatcccagccctttgggaagccgaggcgggcagatcacttgaggcctggagttagagaccagcctggccaacatggtgaaaccccatctctaccaaaaatacaaaaattagctgggcgtggtggtgggcacctgtaatcccagctacttgggatggtgaggcagtagaatcacttgaacccgggaggcaaaggttgcagtgagccgagactgcgccactccactccagcctgggtgacaagagcgaaactccatctcaaacaaagaaaagctgacccctgcacatgacccctccgagcacagccagtggttcccataaacccctaagtgaatttaggccagacacatgtgaacacatgttaggaattttcttaatttggttgggatgtgaggaatcctggcatgccccgggatcacctgtgcagcttttacggcatgcccctatgaggggactttgcagggaggtcagatggcctagacctcccctggagcagtgaccatacttggtgtgtgtgcttgtcccatcactgtctcatgcttaagaggtgaacttgattgcagcccattgtattccacattgtttttcccgagtgcctctgaaactctaggtgtgaggccaggcactcggccttagagacaccagctgattctgatgcctgaggcccaggcccagactcagatatataacccatttggggtgaggcctgagcattgggattttaaatgctcccactggtgattccaacgcgaaaccaaagttgagtccccattgtgctcatctacttgggtctggaagtccagcttgggtggaggtcctagggtacctgtgttgggtgacgccctatgcccagtgtctgccacggtgcctggcgcacaggggtggctgcgagtgaactcactggtgtgtttcccactgcaggtccttgtttgtcgtgctggacagcctggcctgcacggatggtgccatcggtgcggcagcccagggctggctggtgcgtgcgctctccctcggggacgtggctcgcatcctcgaacccgtgctcctgctgctgctgcagccaaaaacccagagaacctccatccactgcctcaagcaggagaactcggccggtgagcagcctgcacaggacccgagggtgagggaggaatgggtggggggactggacctcagcagtgatagctgagagactgaggcccactagggggttttgttagatgcaaatggtactttgtaaattgtgaggacttcggcaatttaaggacctagtgatctagcatttagaactattagggagtgggtttgctgttttcactgaaaaaccagattgttttgttattaaaaaaggaaagttggccaggcacggtggctcacaactgtaatcctagcattttgggaggctgaggcaggtggatcacctgaggtcaggagttcaagaccagcctggccaatatggtgaaaccccgtctctactaaaaatacaaaaattagccgggcgtggtggtacatgcctgtaatcccagctactcaggaggctgaggcaggagaatctcttgaacccgggaggtagagattgcagtgagctgagatggtgccactgcactccagcctgggtgacagagagagactgtcattcataaatacataaataaataaataaaataacttatttgtgaaccttcaactacaaggtaagtggtttattttctatctgtgctctaagattcttttagactataaaatcttgttaatcagattatcagaaatgaagaagaaataaacctttcagttcagagaacttccagaggcatctttaacacaaacataaaagaatataggtagaaattaggaaagaaaagaaaaactaaataagcctgatgagtcaattaaacttcagtgattaatatctaatgcattttatgaactaacattacttcctacaatagctgtatttaatgacttcacaattttctaagggatggtttgcaaactttgagtgagtttgtttagcttgaggcagaaatttaaaaataataataagaagaagtactgcattcattcattccaagaaaagtaacagacaaggctataagaaggttgtagtgacctagtctaagaagtaaaaaccaaggcccagaatgtggcaagacaagggttaaaaagtaaagaagggctggacggtggctcacccctgtaatcccagcactttgggaggctgaggcaggcagatcgtgaggtcaagagatcgagaccatcctggctaacacggtgaaaccccatctctactaaaaatacaaaaaataagccaggcatggtggcaggggcctgtaatcccagctactcgggaggctgaggcaggagaatggcatgaacccaggaggcagaggttgcagtgagccaagatcacaccactgcactccagcctgggcaaaagagtgagactccatctcaaaaaaaaaagaaagaaaagaagaacaagttttcctctgcctagcaagctcacttcaaagacagttataagctaacgctgttcgagaagttgaaaccaaaggaataagctccagacacccccctctccagatcaagggtgaaggaaaaaaaggacaaatgtctgtatttagccagttcttgttttttcttatcctgtatttatcttaatctttttttttttttttttttttttgagacagagtctcgctctgtcacccaagctggagtgcagtggtgcaatctcggctcactgcaacctccgcctcccgggttcaagtgattctcctgcctcagcctcctgagtagctgggattacaggcatgcaccaccatgcctggctaatttttttttctttctttctttttttttttttttttttgtatttttagtagagacagggtttcaccatgttggtcaggctggtctcgaactcctgaccccaaatgatcctcccgcctcagcctcctaaattgctgggattacaggcatgagccaccacgcctggctatctcaatcttatcttacagagaaaagcaacccattagctaagtaagcagaggtgtgtgaaatggtttcctgtctttataaggctcctggcctaaacctctaacctctggttttcctttaggggaaaagctggctgccctatcaaataggaaacattttattgttccacattgtaagaaagtaaaactgaaagaagtgtaaacaaagaaccttcttaaaagtttggctactattcatggcagctacattttttagtatttctttttctttctgttttaagaggaaagctctatctccacagttccttgggcattattattattattattattattattattattattattgaagaagagtctcactctgttgcccaggctggagtacagtggtgtgatcccaagtcactgcagtctttgcctcccaggttcaagcaattctcctgcctcagcctcccaagtagctgggattacaggcgctggccaccacagccaactaattttttgtatttttagtggagacggggtttcaccatgttagccaggttaggtctctaactcctgacctcaagtgatccatgcgcctctacctcccaaagcgctgggattacaggtgtgagccaccatgcccagccttagttttggtatttttagtagagatgggtgtttcgccatgttggctagactggtcttgaactcctgagctcaagtgttccacccgcctcaaccttccaaaatgctgggattacaggcatgagctactacgcctggccttccttgggctttaaaagttccccagcactaccttgctgcttcctctaatctgtgtttcctgctgaccacagaaatggtctgctacctccgaataggagagaacatctttgctctgccattttctttctctgaaaaaaatgataagtgtcctgcttaccccaccctatttctgtaatcctgtagaaatctatttttaaaatactgctatgcacttcaagcagctcatcaatttctgatgtctgattcttcttcatttcttgatcttgcttaatgtccatggcatagagtttttttaaagctcttttgtgtgcctttatcttgtttgatcatcctaaaaaccttatgagaatgacagatttcttcttttcttttttttttttttttgagatggagtctcactctgtggcccaggctggagtgcagtggcgcaatcttggttcattgcaacctctgccttccaggttcaagccattcgcctgcctcagactcctgagtagctggcattacaggcacgcgccgccacgcccagctaatttttgtatttttagtagagatggggtttcgccatgttggccagactggtcttgaactcctggccccaagtgatccgcccacctcagcctcccaaagtgctagaattacaggtatgagctaccatgcccggctcatggcatagatttattgaacactgcttatttaaaatgtttggcaatatcaaagacttttgactcactaatttttttttccttttcttcttttttttttttttttaaataggcagtggtcagtggcctatttgacttctcctaaaaaagacttcaatattttaaagtgtcatacgttttctgattatagaagtactaacatggttagttttaaaatggaaataatgaggacataaaaacctaagtggaagtcctttgtaatgctagttgatagaactagggattgttaatggcttgcaggtagtctcccagactttcctagtggctgtgtattatacatactctctcctaactgggctcattctacataatactcttctgctgcttgattttttttttcctttctttttagagacaggggtctcactctgttgcccaagctggagtgcagtgacaccatcatagctcactgcagtctcgaactcctgggctcaagagaccctcctgcctcagcctcccgagtagctaggactacaagtgtgtgtcaccatacctagatagcttttaaattttttctagagatggagtttttccatgttgcccaggctggtttggaactcttgggatcaagcaatcctcctaccttggccttggcctcccaaacaatcctcctaccttggtctcccacagtattgggattacaggcataattcactgtacctggcctgatttttcctttcctttttttttttttttttttttttttgagacagagtctcactctgttgcctagtctggagtgtagtggcatgatttcagctcactgcaacttccatctttcaggttcaagtgattctcctgtctcagtctcccacgctgggactatgggcacgcaccaccacgtccagctaatttttgtatttttagtagatggagtttctccatgttggccaggctggtctcaaactcctgacctcaggtgatctgtcctcctaggcctcccaaagtgctgggattacaggcatgagccaccatgccaccacacccagcctccagtttgtctttatacacatgtgacatttcggtgaatatccacatccttatggctttgaaagtcttctgctgacatttctgcaggatacatttctgtttttttgttttttaagacggagtttcgctcttgttgcccaggctggagttcagtggcacaatttcagctcactgcaacctctgcctcctgggttcaaatgattctcctgcctcagcctcccgagtagctggaattacaagcacctgccaccacgcccagctaactttttgtatttttagtagagacagggtttcaccattttggcgaggctgatctcgaactcctgacctccggtgatctacctgccttggcctcccaattgctgggattacaggtgtgagccactgcacccggccaggagacatttcttgaaagagaattcctaggaaaaaataatacgtatttttaaaaattgctcccctccaaaaaattaaaatacttaagtttactataacaatgtaactaaatgatcccatccttgaacattctgtaaaacctatccaccttcctttgtctacttttgtctgtaatgtaaaccggactctggtggtggtgtttcatgtgagaattttaggaatattgatctttctgtctggctttaagacaaagaccgccctacagctaatgtatcatagctgacccttctgtctaaagtcatttgtcatcttgtaattttcagatgacttgcaccgttggtttaacaggaagaaaacctctttcagagaggcatgcgcagtgcccgagcctcaggagagcggctctgaagagcacctgcctctgagccagttcaccacagtggaccgtgaagccatttgggccgaagtggagaaggagcccgagaagtacccgctgcgaggcgagctgagcgaggaagagctgccctactacgtggagcttccagacaggacggcccacggcgccccggacagcagcgagcacaccgagtctgcagatacaagctcctgccacacggacagcgagaacacgtcctccttctcctccccttcccacgacctgcaggagctgagcaacgaagagaactgctgtgcacccatccccatggggggcagggcgtaccccaagcgctcggccctgctggcggccttccagtcagaaagcttcaaggctggggccaagttaagcctggtgcgggtggactcggacaagacgcaggcttctgagtcgttctccagcgacgaggaggcggacttggagctccaggccctcaccacatccaggctgctaaagcagcagcgggaaaggcaggaggccgtcgaggccttgttcaagcacatcctgctctacctgcagccctacgactctcggcgggtcctctatgccttctcggtgctggaggctgtgctcaaaaccaaccctaaggaattcatcgaggctgtgtccaggactagcatggataccagctccaccgcgcacctcaacctcatctccaacctcctcgctcgccaccaggaggccctcattggccagagtttctacggaaagctccagacccaggtccccaacgtgtgcccccactctctgctcctggagctgctcacctacctctgcctgagcttcctgcgctcctactacccttgctatttgaaggtctcgcaccgagacattctcggcaaccgggacgtgcaggtcaaaagtgtcgaggttttgatcaggataatgatgcagctggtctcagtggccaagtcttcggaagggaagaacgtggagttcatccacagcttgctgcagaggtgcaaagttcaggagtttgtcctgctctccctgtcggcgtccatgtacacgagccagaagcgctacgggctggccaccgcccaccacggcagggccctgccagaggacagcctctttgaggagagtctcattaacttgggtcaggaccagatctggagtgagcacccgctgcagattgagctgctgaagctgctgcaggtgctgattgtcttggaacaccacctgggtcgggcccatgaggaggcggaaaaccagcccgacctgtcccgggagtggcagagagccctgaacttccagcaggccatcagcgccctgcagtacgtgcagccccaccccctcacctcccagggtcttctggtctctgcggtggtgaggggtctgcagcccgcctacggttacggcatgcatccggcctgggtgagcttggtcacgcattccttgccctacttcggaaagtccctgggctggacggtgacaccctttgttgtccagatttgcaaaaacttggatgacttggtcaagcagtatgaaagcgaatctgtgaagctctctgtcaggtgcgttacgctccttgtgacatctttattgctttagtgatggtttttataacgaatgactgttttgccacggatgtggatgtcggttggaggataatttcatcccaatgagaagcctgtttagcattatcaagaggggtaacaagcaactaaatgttctgatccattatgttatgttatgttatgttatgttatgttatgttatgttatgttatgttatttttgagacagagtctctgtcacccaggctggagtgcagtggcatgacctcagctcactgcaacctctgcctcccaggttcaaacaattctcctgtctcagcctcccgagtagctgggattacaggtgcctaccgccacatctggctaattttttgtattttagtagacacggggtttcaccgtgttgcccatgctggtcttgaactcctgagctcaggcaatccccctgcctcggcctcccaaagtgctggggtgctagagggagccactgcgcccagccctgatcctttatttcaaatccgcacaggtacccagtctagctcagtgttgcagggcatgtcagctactctctactatttttgcaaaacagaaataaaaatgtgaatcatcttcacagaaattctaaaacattgaaaccatttttccaaagtgactatatgaatgtaaaatcacacaaaggatggttaacattattataatgatattctatgacgagagctccagtttatttgggatggtgatctctccctagttcctgtgtttatatataggattagaaacccttatggcctcattctttaaaaattctcaaaccagtttctcttttcttcaccacagcacaacctccaagagggaaaacatttctccagattatccactcacccttctagaaggtctaacgaccattagtcatttttgtcttttggaacaagccaaccaaaacaaaaaggtaaatttttttttttcctgagttcaaggcaattttcatgtattgttttgtctttgggctatgactgtttcaaataagtaacgtatgtatgtaatgtctgtaactaatatgcgtatggaggtgatgcaaatgtgaatgcaaatattacataagtcacgtacacacgtatgcaaatgcatgtgtgttagcaatgcaagtgcctacgcaaatgcatatgcaaatgcatgtatataattaacgcaaatgcataagtatgtatgtcagccatgcaaacatagttttcttcctgctggcactccctgtgccagccctttgcccattgttccatcagtagcctgtgagataacttataaagccacttgtttgattttaggcttatagtcatctttttccatgtattttttacttgctatcatggtgttcatgaaatctgagtaggcagacattttagctgttggttattctaccctgtagaataccctgggattaagtcttagaatacatctaacactttggttgaatggttgaaaagtttgtaatttagaacatcagactcacagctgtctctgtgaaagagaaccatgggttgaaatgcacagagaagcttattgctcccagaccaccacatgtatgagttgcttagaagagagtccaacagcccagacctaatcccgctagcactgctgccctcgtgggaagaaaaaccattccacagacacagcctgcctcatgtattcattttaatttttagaccatggctgcaggtgatcctgccaacttgaggaatgccagaaatgccattttggaagagctgcctcgaactgttaacaccatggcccttctctggaatgttctcagaaaggaggagactcaaaagagacctgtcgatctcctaggggccacgaagggatcctcttccgtttactttaaaaccaccaaagtaagaggatgtctctgtagttctgtcatttacttggtcttgtattgttccacccaaaataaatgtgtataggaaagtgtgcatgataaacagatgtgctcaatgaaacccaagtcagagatcagaagtagaaatctctagttcatttgttatcagtaagtttcctatacctgaaatggaggagtctgagtggtttcagcctgttttcttcttattttccattcaccttattttgtagttaaaaataaagtcttggccgggcatggtagctcacacctgtaatcccagcactttgggaggccaaggcggatggatctcctgaggtcaggagttcaagaacagcctggccaacatggtgaaaccccatctctactaaaaatacaaaaattagccaggtgtggtagcacgtgtctgtaatcccagctactcaggaggccgaggcaggaaaatcgctggaacctgggaggcggaggttgcagtgagccaagattgcaccactgcaccccagcctgggcaacagagcaaaaccccatctcaaaaaaaaataaaaataattaaaataaataaagtctctagagctaggcgcggtggctcatgcttgtaatcccagcactttgggaggccaagatggggtggattgcttgagctcaggagttcaagaccagcctggccaacatggcgaaaccccatctctacaaaaaatacaaaaattagctgggtatggtggcaggcacctgtagtccgagctactcaggaggccgaggcaagaggattgcttgagcctgggaggtggaggttgaagtgagctgagatcacgccagtgcactcaagcctgggtgacagagtgagaccctgtctcaaaaacaatagtctctagtggttcaaagcggggatacctagatcctcacctctaaatgatctagagaccccagccttgagtctctaaagcatttctgcgagacagctcatctctgttctgcttttagcggtgcctgtcaaacatggccccatcagagtggaatgtcagggtgcctttgagttcttaaaccaaaaacgcacaactgtgaatatttatattatagtttagtctttggttttcagtgtctgcctcagaaggctgtaggcgcaggactcggtcgctcaccatctgtgttactgtgtgtggcatctcagaattatctgccacatctgacatcagttgagagcccccaggtgccagatgtggccgcagggatgagccttgccatcctgcatttaggtaccacggtgcgttgttggcctccagacattctgtcggttcctagggtgccaagggaattctgtatttcaagctcctataagaacctgctcttaaaaagattcagaaaaccttttttctcactcagaaaaaaagattttctaaaccttttttaggggagcttcctgtagcactcagcctctctgagcctccatttcctcgtctgttaaaccaggctgtggctagcatcctgtcctcatgggttgagggaaagagtaattacgataaaggccgatgctcattaggcacttaactcctagccctccctgaggaacccagggccggggagcgggaccccacattagtccctctagagcagaagccatggtggaaaagaggggacagctccattgctggctcagttgtatctaatgtgaaataaacatgggcggttgtcacaggaagcgctgggtaaatccgtctcttcgacagacattttgtgcctgctgccacgcaccaggctctcttgctttaccggtggacaagagagatgaagtccctgcccctgtggcagaggcagacattaactggcagtgtaataacgatgtgagcagggcttcaaagaaacacagggtttcctgagagtgtgtgaacaggaggcctggcctgacctggggttcctgaggcggcatggcttagctgaggccccaggcggagaggatttaactacggtgggcactgcaggctgagagagcggtaggatttacagagcgagaaacgtggcgggaacacagagaaattcataagtagcaaaacagagggtgctgagtgacatcaggaccatgttacaggtttaaattgattacctgataaaattagttaaatggtgcttatttctggaaattgagcaacaactttcctaatgaatataagcccttccgcagcagatggagtcaggctgaggctgtggggtttccagatggaagcagtgctgcaaagccttgcccggcttcctgcaagacccccactgtgctcacagcagcaagggtgatattcatcgtctcccgagatgctcctggccaatcgagctggccatccgtctctccaccttggctgctcactgccccttccccccgccggcatgacacgccaacatcacacatctagctccttgcggaaagggtttgattcctcccattgctgggatccacccatcagggaagcacctcagcacaacattgggcacaaacatgacagggtccttgctctcggtatggacagcagtggtggttcaatgtatatgatgccatagccccaatattactctgcagtaacttttttttccctattttctagaccataagacaaaaaattttagacttcttaaaccccttgacggcccatcttggggttcagttgacagcggctgttgcggcagtgtggagcagaaagaaagcccagcgtcacagtaagatgaaggtaaagtttaaaaagttacaggagtggttaaacttactgtgacaaagaaataccacagaatcatgtggaatcaaaggtgacattggaagccagcatgggaaactattgagttgatttaatcattttatcttattttatttctttatctatttgagatggagtctctctcttttcacccaggctggagtgcagtggtgcgatcttggctcactgcaccctccacctcctgggttcaagtcattctcctgcctcagcctcccatgtaactggaattataggtgcccgccaccacacccggctaatttttgtattttttagtagagacagggtttcgccatgttggccaggctggtcttgaactcctgacctcaggtgacccacccacctcggcctcctaaagtgctgggattacaggcgtgagccaccacaccttgccgatttcatcatttgaaatgcatgagataatatagctgtgtctcagtacaagtagaatgtgtattgggcaggtagggaagagcgcacctgacttctgttttctaatttttctgtaatgagtatatagtacttgtgtttaatctttttaaatctaaaatacatataagagtatatataacatgaacatttttaaagaataaaaatggcacagtggctcacacctataatctcaacactttgggaggccaagacgggcagatcgcttgagtctaggagtttgagaccagcctgggcaatatggcaaaaaattagccgggcgtggtgttgtgcacctatagtcccagctactcaagaggctaaggtgggaggatcacttgagcctgggaggtggagggtgcagtgagccatgattgtgccactgcattccagcctgggcgacaaagcaagtccctatctaaaaaaaaaaaactttacctaagaacatgccacccatttggcttaagaaatggtcacttatcctagcactgtgggcctttttttatttgtagtaccatcttattgcttttttaatgtgtagaaatcacacttgttagctgggcatggtggtatgcgcctatagtcctagttacttgggaggctgagatggaaggatcacttgaagccaggaatatgaagctgcagtgagctacgattgtgccactgcactctagcctagacaacagagtgacacttcatgtaaaaaaaaaaaaaaaaaaggaaattacatttgtccatgataataaagaaaattgaaatcaccaatcatatttctatgcccaaagataatttctttttttttttttctattgagacagagcgatctcagctcactgcaacctctgcctcctgagtttaagcaattctcctgcctcagcctcctgagcagctgggattacaggtgcatgccaccacactcagctaatttttgtaattttagtaaagacggtttcaccatgttggccaggctggtctcaaactcctgacctcgtgatccgcctgcctcggcctcccaaggtgctgggattacaggcgtgagcccaaagataatatcagtttgtattttgcccgttctttatccacttgactggtccatgatgaagtcctgcaggggtcggcttacctttttcaacctcaatcctcttcctttgttccctcccacccctgctccatcccctgctcgggatctgctgctgcacctccttgacactcccccagtgctcagcctttgtggcagacatgggcgcctgttctctgaggaagagtcagtggtcagtgtccaaggccaccctcctgagcgcctgtcggctccttccctggtgaggaacctggtgctagttgtttttcttccaaatgcccatgaccagggtatgcagacttctgtcatcaaaaatatgcctcccataccagggctttccttccaaggctagcaaatgggagcctggtttatctgtttttacttcctgtcttcgtatttttgattccatctcttgtttccttcaaatttagtatatttgtttctaaaatgctttctactaaattcaaacataccactattacagccccatcatggcctgcaccttttattcctaatttgtatcaaattatgttgttcccctgggtggagcctttacctagttcaataggaaatgtttgtttaagagattaaaacaggccgggcgcggtggcggctcatgcctgtaatcccagcactttggaagaccgaggcgggcagatcacctgaggtcgggagtttgagaccagcctagccaacatggcgaaacctcatctctactaaaaatacaaaacttagctgggcgtggtggtggccaagatcgcaccactgcactccagcctgggtgacagagtgagaccgtgtttcaaaaaaaaaaaaaaagagatgaaaacagattgatttctccagggacgactactgtagaatacaataaggatgtgtcatccttatttttactttctctctataagctttcaaggaacttttttttttcttggcagattatcccaacggcaagtgcatcccagctaacccttgtcgacttggtgtgtgcactcagcaccctgcagactgacacgctgctgcacctggtgaaggaggtggtgaagaggccaccccaagtcaaagggggtgatgaggtgaggagcctggggaagcctctgggcttctgcagattagtgggtggcatttgtcataactctacttccttataaatcgtgtttgggagggaaggataggtaacaagagctagtgggaatgcttggggtagtgaagtggaggtgctgtttgctgtgctttgggggagacctatgaagatctggtgcttcttttttaagttgggaactgcctgaggtcaggggctctcattccttgtaccctgctgctgaggacactgcctggtacatgggttagcgccttctgggcaccaagtggaataaaatctttagaaagaggaaatggcacctgcctcaaggagctcgcagccataaagatgccaaagataaacaaaaccagactctagtgaaagatggtaaagacagatgtgattcaataaccactgcggtaagggaaagtgttgggttcagtttagatttgtgtggagatgactgggaaaggatgagggaggagggagggggaaggagcaggaagtttaaggagagttggagaagtagaaaattacaaaagagcaggtggggaggctgctcagtccatagatgtgattaggccatctgggtttgctaactggggcttatccaaatgaggctcctaccctcccacagaggctgggagatcgagactctgtctttcttgatgattctgtttcaaagggatggctcccaggtccttgagaaacacattcctaggttgtgggagacacatacacatctcaaagggacagagaaagtatttatcattgtaaacttaaaagaaaatgctctaagaaagggaggtcaggggtctcgcaggaacaaacagtaaattatttggcaaccttgagctttctcggacaagtgtttgaagaggactggtgtccccatcctagggatccatgctagtgttgtttggggctgtgggggtggacagaatcatttgtcaagcagagggctcagaggagcctagctagaatcagctcaaggagagagtctttgtcaagggcaaattaaaatttgtgtaacttttttttttttttttttttgagacacagtttcactctgtcacccaggctggagtgcagtggtgcgatctcagctcattgcaacctccacctcctgggctcaagtgattcttgtgcctcagcctcctgggtagctgggagtacaggtgcatgctatcactcctggctaacttttggttttgttttgttttgtttagttttttcgagatgaagtctcactttgtcgcccaggctggagtacagtggtgcaatctcagcccactgcaaccccgcccctggggttcaagtgattcttgtgtctcagcttcctgagtagctgggattacaggtgcgcaccaccaagcccggctaatttttgtatttttttttttcttttagtagagacgggattttgctatgttggccagactggtcttgaactccacttgccttggcctcccgaagtcctgggattacaggcgtgagccaccgtgcccggccaaaatttgcataattttttttaaaacttttttttttttaagacaggatctcactgtcacccaggctgcagtgcagtggcacaatcacagctcaccatagcctcgacctccccaggctcaaatgatcttcccaaatagctgagaccacacatgcacaccaccacacctggctaatttttatattttttgtagtgacggggtttgccacattgcccaggctggtctggaactcctaggctcaagcaatcctcctgcctcggcctcccaaagtgctgggattacgggcgagagccaccatgcctggctgcataattttttataaaggtagaaaataaatgtcagagaacataactaatgatagacactctgagaaagaggagatttcatctggctgctgtgaaacagaaaccttcagggtgatgtcattgaaccgagaagttccttgtaatttttctgctcaatttcattacagcagcctggagggcccatgttgtctagagagcttcttcaattatacacggtggatttaaaacagggcaagctgtgtggtttaatatttgcattcccttagagtcttctatttctgtttttaccaaagcagtcttcatcattgaaagcagcagagctgttttgctcttaattaactaatttaataaaaaccagggatttatttcaatcttgaaataattgccttctgtcgaacagtttaaaatcatacagttagcaaaaatttaagaataatctaaatgaaaattaggggggccgggcatggtggctcatgcctgtagtcctagcactttagtccaggagttcgagaccagcctgggcaatgtagggagacatcatctctacagtaaatttaaaaattagctgggtgtggtagtgcacacctgtagtcccagccacttgggaggctgagacaggaggatcagttgagcacaggagttcgaggttgcagtgagctatgattgagccactgcactccagcctgggtgacagagtgagaccctgtccaaaaaaaagaaaattcgtgcaatggaaaaagtgattattaaaaaatatagctatacttgaacaggtgtttgtgtaccgatgttcatagcagcattattcacagcagccaaaaggtggacgcaatccctgtgtgtctcagtgggtgtgcggataacaaagtgagatctgtgcgtgcagcgcgttagtactcagcctcgagaggaatgaaattctgacacgtgctacacaacatggatgtcagatcctcaacatggatgaaccttgaagacattaagttgaatgaaataagccagtcacaagaggactaacacagttctatatctggaaaaaaaaaaacaactgtgtcctcactcaacaacataacaatcaacacagaagacttctcttaccccaaatatgcggggagttctccccaccagcaagcaagcaattgattccgcagtggacaccagttgggtgtcctccaattcaattcctactctatctgcttggagatagtgtcagatcccacagggtgagggctcagtccccaagagcacccttcacttcagacaccagtcacaagtctgggcctctggaacttctgactgactagcttcaagttgggattcccacgaaccccctctttgggttcagttaatttgtcagagcagctcccagaactccagaaacacgtttactggtttattataaaggctactactgaggatacaaatgaagggatgcgtagggcaaggtatgggggaagaggtgcagagctcctgtgccctccgtgggcacagaaccttcatgtgctctgctctctggaagctcaccaaacccagtcctcttgggccttttatggaaacttcattggatgggtatgactaaagcatggacaaccgtgtcgaagtgtgattggacaaaaagagtgtgatctaatacttaatacagtgactggggaaacctagcagggcctgcctgttcagattcttcttggcctgtctgcacagcactgcttcctccagggtgtgggacaggaccctctccagaatgagggtcttatgaaccgtagtcagattagagtcctgccttggggcaggtcaaaggagggcaggagttatgaaccaagaactgcagacaaacacgtaaaaacataggttgatacgtagatagatgatagatagatagatagatagatagatagatagatagatagatagaagtagttaggtaaatagatagatgtaggtaggtaggtagatgtaggtaggtaggtagagagatggatgtaggtaggtaggtaggtagatagatgtaggtaggtaggtagatgtaggtaggtaggtagagagatgtaggtaggtaggtaggtagatgtagggtaggtatgtagatagatgtaggtaggtaggtagatgtagataggtaggtaggtagagagatagatgtaggtagatgtagttaggtaggtaggtagatgtaggtaggtagatagatgtaggtacgtaggtagatagggagatagatgtaggtagatgtaggtaggtaggtagatgtaggtaggtaggtagatgtaggtaggtaggtagataggtagagagatagatgtagttagatgtaggtaggtagatagatgtaggtaggtaggtagatgtaggtagatagatagatagatgtaggtaggtagatagatattatgattttagagtgttaaagggtggctcactcctgtaatcccagcactttgggaagccgaagcagggggattgcttgagcccagaagtttaagaccagcctgggcaacaaagtaaaaccttgactctaaaaagaaaaaaaaaattagccaggcatggtatgcacctgtagcctcagctacttgggaggctgaggtgggagaatcacttgagccagggaagttgaagctgcattgagtcaagatcacgccactgcactccagtacagagcaagaccctgtctgaaaacaaaagaaagactttttttttttttcacatcagacaatgtgccgaccattgtaacaaagtttgagggtggcacatatcacgcatgtgcgtgaacacccaatcatcacactaatgaactgcagatgaatcggaagacttttttttcagccatttttttcagcctcacatatgacacggggcagccccctatagaaatgtccaggccccgagggcctggccgttgggcgtcacccagtcagttatcctccagctcctggtctcttccttcgttccagtgttaatcgacaatgctctatgtgcactgagtggtgtcgtggaggctaaatagtggaaaaagcaattcctgccctcagtcctcctatattctaggttggcaaagaagagagaagagaagagaagccatcctaaaaaataacagcactgcgaggccaggttatggagcgagctcagtcagtgcttaaggcttcgaatgtaaaaggacccggatgacttccacagtatttcttggggatctggcccaggtctcccaatcttccaagaacgtatggtcatcctgttgcctttcactgtttttttttttttttttttttgagacgaagtcttgctctgtcgcccaggctggcgcaatctcggctcactgcaagctccacctcccaggttcatgccattctcctgcctcagcctccctagtagctgggactacagtcgcccgccaccacgcccggctaattttttgtatttttagtagagacagggtttcaccgtgttagctaggatggtctcgatctcctgaccacgtgatccacccgcctcggcttcccaaagtgctgggattacaggcgtgagccactgcgcccgggcttttttttttttttctttttttttgagatggagtctcgctctgttgcctagcctagagtgcagtggcgtgatcttggttcactgcaacctctgcctcctgggttcaagcaattgtcctgcctctgcctcctgagtagctgggattacaggcttgcgccaccatgcccagttaatttttttgtatttttagtagagatggggttttgccatgttggccacgctggtcttgaatgcctgacctcaagtgatccacccgccttggcttcccaaacttccgggattataggtgtgagccaccgtgcctggcctcctttcattcttgtccataaatgttaggagtgggaatggtgctccacagggcggtctgtgctgctgcaggcttggtcgccgtagaaccaaggggttcttcgaggtcctgaagacagctctgcagaggctatgacagccagagcgagtgtgtttaggttgtattccttcacattacttgaatttctacaaatacctgcaatttctagtctttcctgggctataaaggaaccggattttatctagctgactgatttttggcggttcaaataacaaaactacattttgtggttagtttagttaattaatagctgcaaatagctttttacaagcaaggagggggtaaaatatgtgttttagaacttgtttccaagtagttccagccacagggtttttggggaagctgtctgagctgggcttggagtcatcttctaaactaagaactagaattttttggccgggtgcggtggttctacttgggaggctgaggcacgaggatcgcttgaacctgggaagcggaggttgcagtgagctgagattgcaccagtgtactccagcctgggcaacagagcaagactcttgtaaaaagaaaaaaaaaaaaggaaagaaggaatgcaaagaaagaaaaaggaaagggaagggaagggggaagggaaggggaagggaagggaggaagggagggaggaaggaaggaaggaaagaaagaaagaaagaaagaaagaaagaagaattagaattttttcttgcctcttggtaatcatatgcattcactggagtcaacactggccctagctttctgtttgggaagttcggttacagtgccaattttcccgaaatgcctgttgacgcctggaatgtaaagtaggtgcacagggtgggagatcactgtagaagtctaaggggatgtgaatgatttggggactcataggacacacttgttttaattgtacatgatgggcactatcatgtctgttgttatatctgaaagattctttagtcaaaaacctttgctttgttaggctatagatctgtttcattttgtatctgaattcttttagccttatttcccaccaactcggagtaattggttttactttcattttcagaaatcgcccctagtggacattcctgtgttgcagttttgctatgcttttctccaaaggtaatacagtcccccgtcctccaaaaacttccttaaatacagatgctattgcagtgagcatgcataataaatatctggttttatttctagactactagagagccattgttcagaaaatatcttaaagttgtcataatttcttcccaaggtattgatctatgcttttccttctccagagagttaacatcttaaaatctgtgcagcgtactttgaacactttatatgagcgaagctttatgtgaggcctgttaaactttaaaaggcttggatttgcattaaattgatacagaaaaagaaaaaaaccacatatagggaagtgttaaagacctcttttagaaaaaggagaaatgggccaggcgcggtggctcacacctgcaatcccagcactttgggaggtggaggcaggcggatcacttgaggccaggagtttgagaccagcctagtcaacatggtgaaaccctatctctactaaaaatacaaaaattagtccggcatggtggcgtgcgcctgtaatcccagctactcgggaggctgaggcaggagaattgcatgaacccaggaggcggaggttgcagcgagccaagacctcaccactgctctccagcctgggtgacagagcaaggctctgtctcaaaaaaaaaaaaaaaaaaaaggcaaaatgattgtttctggtggcgttctcagtgtgccttcccatgttttatgtggagaggtatctgctttgatttgctaagttaatatatgtattaggtgtctcagctaagagagcattaaaggggattccgcaggtttttccccatggatgaaaaagaagctttactggacctcattcagatcttacaatggctgcatcccaggtgcagctctgtgttgcagaaaatgagggtgaggtggctgggtgcggtggctcaacgcctgtaatcccagcactttgggaggctagagtgggtgagtcacttgaggccaggagtttgagaccagcctggccaacgtggtaaaaccctatgtctactaaaactacaaaaaattagccagggcttggtggcagcatgcctgtagtcccagctactcgggaagctgaggcaggtgaatcacttgaacccaggaggcagaggttgcagtgagctgagatcacaccactgcactccaggctgggggacagaatgagactctatctcaaaaaggaaaaaaaatgggggtgggaagggtatagaccacttctcagggaagcctcactatgcctacatagccatcaggagtctcactgtaaataactccaacaaccaggcacaggctccttgattcacacagttaacattacatagttattcccactcaccacattctgaagttgcaggacggtaaattgaggcctcctggtagatgaccagggtggggttaaattcagaccacttcccttgtgagcatcattgttgttctttcctccaggagttaaagatgagccggtcacttccctcctgtgacagcgaatatatattgcgttgctggcgaatgttgagtgtagtggcctgagggacagctgagctttcccaggagctgcaggttagatttggtcatcctccttttgcagaggagaaaccgcctaggtcacacaataggtagtaagttggagaaccaggacttggacctgggacactctgactgtagtctgagctttcactgcctggactgtgcttcctcgctttggagcggtgatctcagaatcctcatcctgagagctacagagcggggtaggccagtttcctggtgagtgtcctgggacctaatgctttgcagccttctgacaggtgatgctgtgttaccagccacttcagggaagcagaatattagcactagaaaggcctgagagatcagccgggcacggtggctcacgcttgtaatcccagcactttgggtgaccgaggcaagtggatttacttgaggccaggagttcaagaccagcctggccaacatggtgaaaccctactaatctctactaaaaatacaaaaaattagcccagtgtgttggcccgcgcctatactcccagcttgggaggctgaagaacgagaatcgcttaaacccggggggcagaggttgcagtgagctcagatcgtgccactgcactccagcctgggtgacagagcaagactctatcttaaaaaacaataataaaataaataaataaataaataaaataaaataaaataaaatagaagaaaggccgggcgcagtggctcacgcctgtaatcccagcactttgggaggccgaggcgggtggatcacctgaggtcgggagttcgagatcagcctgggcaacacggtgaaaccccgtcgctactaaaaatacaaaattagccgagcgtggtggcacatgcctgtaatcccagctattcgggaggctgaggcaggagaatcgcttgaacctgggaggcgaaggatgcagtgagccgagatcacgccattgcactccagcctgggcaacaaaagtaaatctccgtctcaccaaaaaaaaaaaaaaaaaggcctgagaggtcaaggtcgatcatctaatttaaggcttttattttagagacaaagaaaccaggagtatctcacctgccagcagtaggatttcaggttctcaaactccaagtgtttgccagaataccaaagtttagctcatgtacattgtaagtttttaaaaagaaaaaggtcagtgaggtatgctgtttaccctttgctttccaactgccaggatcttaaatatgcttataaataaatgtattttgacttgttcgtggttgagtatttttcctatcttttaaaaaaacaggctcccagtaccagccttgcaagagaacttttcttcactgttgggagtattgaaagagtctgtacagttgaatctagccccacctgggtattttctgcttctcaggtatcatgtcaccacattgtcattgtgtaatattttctcttggcacatattttatttctgcagcatttttaatctgaagctgattgtctcccaacagcatgctgaatgactttgtaacaagaactcccaacctggaaaacaagaaggaccaaaaagacctgcaggtttgtatatgaaagaggttcagccaaatgatattaccccagcagtgctgtcctcctttgggggatatcagatagcaggtagacaagagacattggacagaatctgaggttagctttgcacttgttctcaagtcttacttctgccatcactgtctctagagagttcggacagtcccggggcccgggttttctgatgaaggttcttgtgtaatgcttgagcaatcgattgtggaattgacagctgcacccctcaccctccacactgtatgcagatgtatgtggatctcactgtaaaacataaatggaataagaaatcttatttccccccagacgcggtggcgcatacttgtaatcccagtactttgggaggctgaggcgggcagattgcttaagctcaggagtttgagaccaatctgggtaacatagtgagacctcatctctacaaaagtacaaaaattagcctagtgtgatagctacacctatagtcccagctacttgggaggctaaggatcccttgagcctgggaggttgaggctgtagtgagctgtgatcacaccactgcacttcagcctggcaacagagagagatcctgtctcaaaaaaattttttaaaaaaggaagctatctccatacatggatatttctttttttcttttttttttttttgggccagggggttggacagaatctcactccatcacccaggctagagtgcagtggcacggtctcagctcactgaaacctccacctctggggttcaagcgattcttctgcctcagtctcccaagtagctgagattacagacatgccaccacgcccggctaattttttgtatttttagtagaggcgggctttctccatgttggctggtctggtctcagactcctgacctcaggtgatcctcctaccttggcctcccaaagtgctgggattacagacgtgagctaccacacccagcctccatacatggatttctttccttaaacgccttatcccccattataacagtaatatatgctcataacaatttgtttaatactgaaaaataaaactcatcataggagaaggaaaactcagagtggaatgccaactaataaatacggaagttatgatgaagttggaaaaatcactgttttgcaaaccattatagacattgattcagttggcttttctatcacatttatagccttggcgatactactgctaatctttatgatccctggcatttgtgaaaggtatatccagaaacagcctcaggtccacagttctgaaccacaagagtactgtataaagtgcagtaggccgtgtgcggtggctcacgcctgcaatcccagcactttgggaggccaaggtgggcggatcacctgaggtcaggggttcaagaccagcctggccaacatggtgaaaccccacctctactgaaaatacaaaaattagccatgcctggtggcggatgcctataatcccagctactcaggaggctgaggcaggagaatcgcttgaacctgggaggcagaggttacagtgagccgagatctcaccaccgtactccagcctgggcaacaagcgtgaaacttcgtctcaaaaacaaaaaacaaaaaaacaaaaacaccataaagcataattagaaaattccagtgcctcctcctttggccttgacttgtagccagagaagaaaacgttacaatgccgatgctgcacgtccaggtgctgggatagcacttgctcacctaagccctccctgctttcgtggcctgttgcctgtagcaggcccctctgtcttcagccagcctggacagggctctggccacaggcattccctccgttgttgcagctggcatgcctcttctctgctccttttggttgcggggaccaggtggcatctgcttctttctgtctcatgacacctggcctccccgccactaattccttcctactgttttgagcgacaccctatgcttcttccccactgaggatatagaaaaaaacaaagtgtgattttcctaccacactctcgtaacatagaatccttctgtgacctcgtaaccaaaatgtgtgggaattgcttcccaccagcaaccaagctagtagttctgcagtggacactagataggcaccgtccaattccattcaattctggcattccccacctagagatagcttgagatcctgcaggttgagggctcagtcccacaagactgccccaccccctcagatgccaatcacaagccccaagtggtttcatctgtgcttttgacagaccagctctaaactggggttctcactacccaccccttgggttctgttaattagctggagtggctgatggaactcagggaacacattgaacagtttattttatttatttatttatttttttgagacagagtcttgctcttgttgcccaagctggagtgcaatggcacgatctcagctcactgcaacctccgcctcccaggttcaagcgattctcttgcctcagcctcccgagtagctgggattacaggtgcccgccacaatgccagctaatttttgtatttttagtagaggtggggtttcaccatgttggccaggctggtctcgaactcgtgacctcgtgatccagccgcctcagcctcccaaagtgctggaattacaggcatgagccaccacacccggctgaccagtttattataaaggagattagaaaggatacagatgaagcgatgatcaggcaaggtacgtgggaaggggcacagagcttccatgccctcctagggcaccaccctctaggaacctccacatgtttagccatccagaagctcatccgaacccagttactttggggtttgtggaagcttcattacataggcatgatggattaaatcactggtcattggtgatcaatttaacctttagcccctctccccttcctggaggttggggagctgaagttctctgggggcccccagccacaaccatctaagacacgtattactttggagaatccaaggaatttaggagttatagctgggaaatggggagaaaggccaaaaacatttccacaatatcacacccgtccactcagtgctttcatcagtccttacgggaactcctctaagcccctaatcccttttcctgactttccttgtgcccttcacaccctgccctgcctaagttagccaattcgccacttccctcgagcgcacccttctctcacccagcaggcaggtgtgccctgcttcacacctcaacacaactgctgagcctaggaaccgtgtggcacagttgaggtcaggattataaaattctcggatgtcaaggattatagccactcgtagctggtgacacttgatgacactggctgagaagcctgcttcgagtttctgtctctccagctactaaccagattctttactgatcatactcctgagagtggatgactcctcacttcaccccactgagtcagtttaacttactgacctttatttcttgtatattattgaaagatgcatttctaggaagaacccgtggtcctagagaaaccagaaagccaatccactgaatacaatttatggttttttcatcagcgtgctgcaatgacttgtgttctctgtatattttacctacattggccagtatagtagccgttagccacaggtggctgttgagcacttgaagtgtggctagtctgcagcctgggcaacatagggagaccccatctctacaagaaatttaaaaattatccagatgtggtggcatgcacctgtagtcccagctacctgggagcctaaggatggcttgagcccaggaggtcgaggctgcagtgagacttttttttttttttttttgagatggagtcttgctctgttattgggggaactcacccccagtatttcaatgtaggttctttctattttccgtaagtgtcggccggctgagaaataaagggacacagtataaagagaggaatgttacagctgggccaccaggggtgacatcacgtatcagtaggaccgtgatgccctcctgagcctcaaaccagcaagtttttattaagggtttcaaaaggggagggggtgtaagaacagggagtaggtacagagatcacatgcttcaaagggcaaaaagcagaactaataataagggtctaacaaagatcacatacttttgagggaacaggacaaagggcaaaagcagaactactgataagggtctatgttcagcggtgcacgtattgtcttgataaacatcttatcttaacagaaaacagcgttggagagcagagaaccggtctgaccacagatttaccaggatggagtttttccccactctagtaagcctgagggtactgcaggagaccagggcgtatctcagtccttatctcaaccgcataagacagacattcccacagtggctgtttatagacctcaccccaggaatgcattcctttcccagggtattaatattaatattccttgctaggaaaagaatttagcgatatcttccctacttgcacgtctgtttataggctctctgcaagaagaaaaatatggctcttttttcccaaccccacaggcagtcagaccttatggttgtcttcccttgttccctaaaaatcactgttactctgttctttttcaaggtgcactggtttcatattgttcaaacacacgttttacaatcaatttgtacagttaacacaattatcacagtggtcctgccatgatgtacatcctcagcttatgaagataacaggattaagagattaaagacaggtgtaagaaattacaaaagtattatttgggaactgataaatgtccatattaaaatgaaatcttcacaatttatgttcctttgctgcggctccagtcggtccctttgttcggggtcgctgacttcccgcaacactctgtcaccaggctggagtgcagtggcactatcttggctcaccacaagctctgtcatctgggttcaaatgattctcctgcctcagcctcccaggtagctgggattacaggcgtgcaccaccacgcctagctaatttttgtatttttagcagagacggggtttcaccatgttggccatcatggtctcaatctcttgaccttgtgatccgcctgcctcggcctcccaaagtgctgggattacaggcgtgagccaccgcgcccggctgcagtgagtcttgattgcaccactacactccagcctggttgacagagcaagaccctgtcctgcccaccacctcctaaaaagaaaaatgtggtagtctgaattgaatgcactgtaagtgcaaaacacacattggatttcagacttagggcacacacaaaagagaatgcaaaatctgattaataggttgtttttgttttttctttttgagacgaagtttcgctcctgttgcccaggctggagtgcaatggcatgatctaggctcactgcaacctccacctcccgggttcaagtgtttctcttgcctcagcctccaaagtagctgggattacaggcatgcaccaccacacccacctaattttgtattcttactagagacagggtttcaccatgttggtcaggctggtctcaaacgcctgacctcaggtgatccgcccgcctcagcctcccaaaatgctgagattataggcatgagccaccacacctagcgtattaataatttttatattgagtgcatgttgataatattttgtatatattgggttaaataaaatacattattaattttttttttgaaacgaagtctcactctgtcatccagactggagtgcagtggcatgatctcagctcactgcagcttccacttcctgggatcaagcgattctcttgcctaagcctcccgagtactgggactacaggcatgtgccatcatgcccagctaatttttgtattttttttagtagagacagggtttcaccatgttggccaggatggtctcaaactcctgacctcaagtgatccccctgcctcagcctcagcctcccaaagtgctgggattacaggcatgagccactgcacccagcctatattattaatttaactttaactgtttatttttaccttcaatgtggctcctagaaagcttaatggtacgtatatgctcacagctgtggcctgcattttatttctactggacagtgctgttttaggcacttaacattcttttccttaattaacttcctttccccctcctcctgataattctcaggaaatcactcagaaaatcctagaagctgtggggaacattgccggctcttccttggagcaaaccagctggctaagcagaaacctggaagtgaaggcccaacctcaggcctctctagaagaatctgatgctgaggaggacctgtatggtaggtggagatgggttggctgatagtgcctctggtcagcgcgtggttctggcttttccttaagagagatcttgagtgttctcaccacaaaaagaaagaaagtacttaaggtaggctgggtgcggtggctcacgcctgtaatcccagcactttgggagaccgagatgggcagataaagcaaggtcaggagtttgagactagcctggccaacatggcgaaaccccgtctctactaaaagtaaaaaaatcagctgggcacagtggtaagcacctgtggtcccagctacttgggaggctgaggcaggagaatcgcttcaacctgggaggcggaggttgcagtgagccgagatcacgccactgcgctccagcccaggcgacaaagcaagactccgtctcaaaaaaaaaaaaaaaaaaaaaaaaaagtatttagagcagtgacaagatgttagtcaaactttagaaaacatcactttgaggccaggcatggtggctcacgcctgtaatcccagcagtttgggaggccgaggtgggtggatcacctgaggtcaggagttcaagaccagcctggccaagatggtgaaaccccatcttaactaaaaatacaaaaattagccgcgcgtggtagtgggcgcctgtaatcccagctacatgggaggctgaggcagagaattgcttgaacctgggaggaggaggttgcagtgagccaagattgtaccactgcactccagcctgggcgacagagtgagactacacctcaaaaaaaaaaaaaagaaagaaagaaagtacctgaggtgatgcatgtcttaacttgtgttttttcacaatgtatgcatatatcagcagggatggtgaaatattgaaaaaagaaaacatatatcaaaacatcatgttataacctgaaatgtataccagttttatttgtcagttatatctaattaaaactggtaagggaaaagatgttggaaagttaaaaaaaaaaaaaaagtttaggcataggaaaaagcaaactaccttctcaagtctgtgttcattcacccagactctttctttgttttttgtttttgtttttttgagacagagtctcgctctgtcacccaggttggagttcacccaggttggagttcacccaggttggagttcacccaggttggagttcacccaggttggagtgcagtggcgtcatcttggctcactgcaacctccgcctccctggttcaagccattctcctgcctcagcctcccgaatagctgggattacagacatctaccaccatgcctagctaatttttgtggttagtaaagacagcgtttcaccatgttggccaggctggtctcaaactcttgacctcaggtgatccacccacctcggcctcccaaagtgctggtattacaggcgtgagcctctgcgcccggcccagactcttcctttgtatccatagccagatgactgaactgtctgttttgactttttacaacatactatgtgtgtgtgctaaacaccgggaccccttagctggtgtcccaccatgtgtatgccatcctgctgaccttcactgagcctcagtggggctccagaaagtaacaccccaagaccatttacctggacatggtgatagaaatctgtgtgggataaagatgatgagaatgtgtgtgtttctttttgcagaactatggaaagagaatttagcaaatcaagctgggagggttggctcatgcctgtaatcccagcactttgggaggctgaggtgggcgggtcgcctgaggtgattacaaatgatcctttttttttttttttcaggattaagcatatcttggggcaagtgattttctttgctactgtcagtgtcatttaacacagggaaggacagtatgcccagtgccagtagagcttaatacaacgtgagaaaggatgtttggtcccagttttatttaatacaggaacaagaaactacatttcagttttcagtgtaaactatcacagtacctgccacagagtaatgttcaaatattgttatctttcattattacttctacgaaaattgttagcagggctgggtgtagtggctcccacctgtaatcccagcactttgggaggccaaggtgagaggatggcttgaggctacaagtttaagactatcctggttagcgggcatggtggctcagacctgtaatcccaacactttgggatatactccatttaaaaataaatcaggccgggcacagtggctcaggcctgtaatcccaggactttgggaggccaaggtgagtggatcacccgaggtcaggagttcgagactggcctggccaacttggcgaaactccatctctactaaaaatacaaaaattagccaggtatggtggcgggcatctgtagtcccagctactcaggaggctgaggcagaatgacttgaacccggaaggtggaggttgcagtgagccaagatcgtgccactacactccagcctgggtgacagagcgaccaaactccatctcaaaaaaaaaaaaaaaaaaggactatcctagtaacacagcaagaccccatctcaggccgggcgcggtggctcacgcctgtaatcccagcactttgggaggccgaggtgggcggatcacctgaggtccagagttcgagaccagcctgaccgacatggagaaaccccatctctactaaaaatacaaaattagctgggtgtggtggcgcatgcctggaatcccatctactccggaggctgaggcaggagaatggcttgaacctgggaggcggaggttactgtgagccaagatcgcaccattgcactccagcctgggcaacaagagcaaaactccatctcaaaaaaaaaaaaaaaaaaaaaaagaccccatctctacaaaaggggaggcagaggttgcagtgagtcgagatggcgtcactgcactccagcctgggcgacagagcaagactcatctcaaaaaaataaataaataaaaataaggccaggtgcagaggctcacacctgtaatcctagcactttgggaggctgaggtgggcagatcacctgaggtcaggagttcaagaccagcctggccagcatgatgaaaccctgtctctactaaaaatacaaaaattagccaggtatggtagtgtgtgcctgtaatcccagctacccgggaggctgaggcaggagaatcactggaacctgggaggcagaggctgcagtgcgccgagatcgtgccactgcactccagtctgggcaacagagggtgcaaactccatctcaaaaaaaaaaaagtttttttaatgactaaaagaaagtaaattaccaagagaatttcaggtgggacttagtactgcgaggaaagtaagagtaatgtgataaggagtggctggtagtggggcagggccactgtgagtgttacagaacatgtccccaaggaggtgacagttgtgctgagagatgaaagacaaggggacagccctgcagaggtctgggaaggcactgccccgaggggattgcaggccttggccacgggagtgggcttagacccagcgacctgaagaccaggactctggagcttcatgaaagtggtgggaagaggtcagagaaagggtggagactgatgagactgatggttgtcgggcttggtagaaagcacactaaggggccgggcacagtggctcacacctgtaatcccagcactttgggaggccgaggcgggcggatcacgaggtcaggagatcgagaccatcctggctaacatggtgaaaccccgtctctactaaaaatacaaaaagaaattagccgggtgtggtggcaggtacctgtagtcccagctactggggaggctgaggcaggagaatggcgtgaaccagggaggtggaggttgcagtgagccgagatcgcgccgctccactccagcctaggcaacagagactctgtctcaaaaaaagaaagaaagcacactaaggagcttggatttcatcccacttgccacaggtagccttaaagtacttagagcagccacatgttagtcaaactttaaaaaccatcactttggctgctgtgatcagtacagtgtgtattggatgagcacagaaactggaagtccaggtaaaaggattttgcgctggttaaggcagaagatgattctggcttggaggcagggtcaacagaaagggacagtttaaatgcagagtcagcaggatttgctgatggatcggatgtagttattttagaaaatgcagccaaggatgacaggtttttggcttaagcaatttaccaaggtggaaaaaacagaagaaaaaacatttcgtagagaaaaattgagcttgattttgcacatgttaagtcggaaatgatggaaaagagaaggacccagcaaagatgattaagcagtcactgaggtgggtgaaccaagagagcatagagccttggagtctgggaggagacaatgtgtccgaaggccccaggggcagacacacggtggagggccgctgagaagcaaagtgcaacaggaaggggcaacaggagctgacaatgtagaattcatcggggtgggtggtcaggatggtgaggggacacttgagaaacaggtggagaagaggatgggaatggagcaaggggagacagtggaggtcggtaactctttgaggctagttgtccatagggcagtagccaagcagaattaaggaccagagaatgttttgttgttgttgttttgtgtgtttgtttgagatggagtctcgctctgttgcccaggcaggagtgcagtggcgtgatcttggctcactgcaacctctgcctcctgggttcaagcaattcttctgcctcagcctcccaagtagctgggattacaggtgcacgccaccacacctgggtaatttttgtatttttgacagagacagggtttcaccatgttggccaggctggtctcgaactcctgacctcaagcgatctgcccgccttggcctcccaaagtgctgggattacaggcctgaaccactgcacccggcctgatttgtttttaaatggaggatatcaaagcctatttgcatggtgacagaacagtacagcagagaggaagaaattaattcaagagagaggaaggataattagcagagtccttgatggccacagggccaggattgggatcataaatggaattattgttatttgataggagtcaggaacatatctattaaaacaggagatgaggctgggcacagtggctcacgcctgtaatcccagcactttgggaggctgaggctagcagtttgcttgagcccaggagttcgagaccagcctggacaacacagtgaaaaatccccatctctacaaaaattacagcctgtagtaatgggacctgtagttccagcttctgaggaggctgaggtgggaagatcacttgagtccaggaggcggaggctgcagtgagccaagattgcaccactgtactccagcctgggcaacaaagcgagaacttgtctcaaaaaaaaaaaaaaaagaattatgttggagagtgggaaagccagcaccccacctgggaacatgtggtagcatcaagtcccttgagagattcatggtcatgacataaagtaagatcagttgcttggtggtctggtttgctctggaacatttagctacacataactacgtagacagatcattgggtgtacccagcagtgcattcttctaggtgagtccttccgagggaaagaagcaaaggagtgaagggtagatgactgaccctgggtgtgggtgggaggtgaggacctgtagcagctgctgggtagttaggcagtaggactcagggactggaaagctgtcctaggatgcaggaaaatgccagaggggtggtcagaggaggatgctggaaacggagatttgagaagctggtgaggtcaagggtatgacagtggtggagctggagcggagtcggggatggttagaagagaagaaggccaggggcttagaggctgggatgtaggagggagcatccaaaggggtcgtgcagtttcaagaacgatgatgagaatggaaatggagaggatgttagtgagttagtgctaatttatttgatcaaaatatccagattcttagttgttgaaactgaatgttggcagggtgcagtggctcacacctatagtcctagcacttagggaggccaaggcaggcaaattacttgagcccaggaattcaagaccaccctgggcaacatagcaagactttgtctctataaataattttaaaattacctgggcgtggtgatgtgtgcctgtgcccccagctactcgggaggctaaggcaggaggatcatttgagcctgggaggtcaaggatagagtgagccatgatcatgccactgcactccagcttgggtgacagagcaagatcctgtctcaaaaataaaaataaaaaagttgaatgatggccaggcacggtggctcacgcctgtaatctcagcactttgggagaccaaggcaggaggatcgcttgaggccaggagttcgagaccagcctggccaacatggcaaaaccccgtctctactaaaaatacaaaaattagccaggcatggtggcacatgcctgtagtcccagttactcgggaagatgaggcaagagaattgcttaaacctgggaggtggaggctacagtgagccgagatcacaccactgcactccagcctgggtgacagggtgagactccatctcaaaaaaaaaaaaaaaaaaagaaaaagctgaaagttaacagagaggaatacctgagtcatatggacacaattggtatgaaaggcgggagctgatggctcacattcatgcagggcttttggggacagtaaatggtgacccatccatcatagttaacatacaaatggctctttctgttcacagatgctgctgcagcttcagcaatggtgtcttcatccgccccgtcggtgtacagcgtgcaagccctctctctcctggcagaggtaaatacacacctgacctgtcgtcctttatggaaatgagcgccatcacgaattgttgcaaagacatttgttcattcccaggtgccagtgagcgtgggccgcaccctcccaggtgagctcgtccatcaggcagcattggcctcaagctgcaccatggagttttgggttaggttttgctttaaggactgcacttttttttttgagacagattcttgctctgttgccaggctggagtgcagtggcgcgatctcagctcactgcaacctccacctcccgggttcaagcgattccgctgcctcagcctcctgagtagctgggactacaggtgcgcgccatcacgcccagctagtttttagtattttagtagagacggggtttcactgtgttggccaggatggtctcaatctcctgacctcgtgatccacccaccttggcctcccaaagagctgggattacaggcgtgacccaccgctcccagccataactgcttttcttattgttgctcgcttccaagggtttctgttttctttcttttttttttctttttctttctgttttctttttttgagatggagtctcgctctggagtctgcactcaggctggagtgcagtggcgtgatctcggctcactgcaacctctgcctcctgggttcaagcagttctcctgcctcagcctcctgagtagctgggattacaggacctggctaatttttgtatttttagtagagatggggtttcaccatgttggccagactggtctcaaactcccagcctcaagtgatccgccctcctcagcctcccgaagtgctgggattacaggtgtgagccgtcgcacctggccagtttctgttttcttagggccttgttcttttaggtactggcttccctcctggacatggtttatcgaagtgatgagaaggagaaagctgtgccgttaatctcccgtctgctttactatgtttttccatacttacgcaaccacaggtaacgtcatcttcgccatttcttcccacccatatgcagaaaaatatgttttcacaaatgaatcaagtagttttccttggacagtccttgaccttgacccttctctcttcccactcccactcagtgcctacaatgctcccagcttccgggctggcgctcagctgctgagctccctgagtggctatgcctacacaaagcgagcctggaggaaggaggtcctggagctgtttctcgaccccgctttctttcagatggatacttcctgtgttcagtaagatatgctgtcctgataacaacgtgctctgaatcttcaggtggaaatggcattttggtttacagaattctcattcctgaaatagaagcagagccataggatcaacccaaataacaggacgtccctgtcacaggctcgcatgttgaccatgtgttcatgggaaagggatcaagtcttttaaagtacaaagaggaatatcacttaattcagagagcatgttatttcctggctgggcacggtggctcatgcctgtaatcccagcattttgggaggctaaggtgggtggatcacctgagcccaggagttcgagaccagcctggccaacatggcgaaaccccgtctctacaaaaaaattcaaaaattagccgggcatggcagcgcacacctgtagttccagctactcgggaggctgaggtatgagaatcgcttgaacctgggaagtgaagcttgcagtgagtcaagatcccaccactgcactccagcctgggcaacaagagtgaaactctgtctcaaataaataaacagcagaacttggggttccagtgatacttgttctatctaatactgctttgtcttgtaatcacaaaataattggccagtgttaagatgacagagcccactgggtgaccctgggggtgtctttaccccacttctcggctgatactccacaagttcttactgagatcttgcagcagccaagcagagatccactgagactcagatgcaagatgtgctcctgggccttttcctgagataaagaaaatcactcagggctggtcatggtggctcacacctgtaatccaacattttgggaggcttaggcaggaggattgcttgagcccaggagttggagaccagcctgggcaacaaagtgaaaccccatctctacaaaaaaaaaaaatcaaaaaaattagccaggcatgcgggcatatgcctgtggtcccagctacatggaagcctgaggcaggaggatcgcttgagcccaggaggttgaggctgcagtgagctgtgattgtgccactgcactccagcctgggtgacagcacacgaccctgggccctgtctcaaaataaccagaaagaaagaaagaaagccactcctttattaatgacaggaaggcttagcgatagagggtagagattgggaaccctttttgtatggcatgaaagcatggccacccccagagggctgctggtggccctgtggcctccctccacgtgatcttgttgctctgctggggtagctcatttggaaagaaaagctaagggtggtatttgtcttcactatcccactcttttcatcaacacaactgtgtgaatatcatcctgtatgaacatatttaagaataacccttgaaaaagccagagtgccttgtcagtttgtttctttgtggtaaactggaaaaagtcatcattcattccctatgttagggttataaatgaaaagctttttcgtagctttcttttatatgtaaactatttatttctatcactaacctcttttcagaaagcagtttttttgtttgtttgtttttgagatggagttttgctcttgttgcccaggctagagtgctatggcacaatctcagctcaccacaacctccacctcccgggttcaagcgattctcctgcctcagcctcctgagtagctgggattacaggcatgcgccaccacgccctgctaattttgtatttttagtagagacagggtttctccatgttgctcaggctggtcttgaactcccaacctcaggtgatccgcccacctcggcctcccaaagtgctgggattataggcgtgagccactgcacctggcccagaaagcagtttttaatatatcttaagaggatatgttattttcttaatgttttgaatcaaactatcatccactgcaaatttaattgattttgctttctttaatatccagttggaagtccattattgaccatcttttgactcatgagaaaacaatgtttaaggatttaatgagtaagttctgtgttacttttgcataactcacacttgataggatcaatgccaatataaccagctttcatcatgtatttccgaaccctactcacactttcatggtgctgtctacgccacaaagactgtaatgtgatgttcataatatggcaggactaaatcaatgagtcttttccagttgcaatttattgacaagaacgccacgacaacctttttcatagttttatagtggagaaatactgccgaaagcatccagcttcacatcttgacatttgtgctgaaagtaataagtttctataatttactaggaggacttttctacacctcagatcccttctcatgcactatcattaagtatcattaaagaaataagtattgggctgggcacggtggctcacgcctgtaatcccagcactttgggaggctgagatgggcggatcacagggtcaggagatcgagaccatcctggctaacacggtgaaaccccgtctctactaaaaatacaaaaaatagccaggcatagtggcgggcgcctgtagtcccagctactcgggaggctgaggcaggagaatggcatgaacccgggaggcagagattacagtgagccaagatcgtgccactgcactccagcctgggcgacagagcgaaaatccttctcaaaaaaataaaaaaataagtattggctgggcacagtggctcacgccaatcccagcactttgagtggctgaggtgggtggatcatttgagcccaggggttcaagaccagcctgggcaacatagcgaaaccccatctctacaaaaaattaaccaggcactgtggcacgcacctgtagtcccagctacttgggagactgaggcaggaggatcgcttgaacccaggaggtcgaggccgcagtgagctgtgatcccaccactgcactccaggctgggtgatagaatgagatcctgtctcaaataagaaataaaaagagaaataactattttttaaatatacatgggaacagtaatctcatgtccttacttaataaagatcatgatttttcaccagggaatatagaattacactagtatgaatttcccatcacttccctccaattgtggttttctcactaagtaaaacattgctgtatttattctagacatgcagagcagttctttgaaactattctcaagttttgaacagaaagccatgctgttaaagcgccaggcttttgctgtcttcagtggagaacttgatcaataccacctttaccttccactgatacaaggtaagacagctgtcttagtctgttttttgctgctataacagaatacctgagactggggaatttataaaaacagaaatttattgcctcacagttctggaggctgagaagtcctatatccagggctggcgtctggcaagggccttcttgctgcaacatcctatggcagaaggtggaaaggcaaaagagcaagagggggctgaacctgcccttttattacagtaccaatcccatccatgatgtggcctaatcacctcttaaaggccccacttcccgataacattacatttacaataaaatttgagcatgcattttggacaggacaaacattcaaaccacagcaacagctgacctgccctcactgcccccacacacagatagacccatgaggggctgagatgattaagtactagaggggtctactgcgtgctttggcatgattgtcacttgttaaaacaagtattctgcagagttatagaacttcagaagtatattggtaaatctgaaactttattttaaaatcaattataggtcaggtacagtggctcatgcctgtaatcccagcactttgggaggcccaggtgggtggatgacttgagatcaggagttcaagaccagcctgaccaacgtggtgaaaccccatctctactaaaaatacaaaattagccaggcgtgatggtgcgcacctgtaatcccagctacttgaggctgaggcaggagtatcacttaaacccaggaggccaaggttgcagtaagccaagatcacaccactgcactccagcctgggcaacaagagcgaaactctgtctctaaataaatacataataaaatcaattacagtgttattaatttgtattagtttttaaaagtctgaccacagtataggaataatacttcctcagcactgtctcttgctagagtcctcctgcagtcaaggtactcggtgtttacagtactcccttaatcagcaccttcagctgaggccagggaaggggcaagattttggagaaggatctaatttttccttaacaatttttttttcatccccactacattctttgactgcatcaaaaataattattgctgactgggcacggtggctcacgcctgtaatcccagcactttcagaggccaaggcgggtggatctcttgaggtcaggagtttgacatcagcctgcccaatgtggtaaaaccccatctctactaaaaatacaaaaataagcctggtgtggtgactcatgcctataatcccagctactggggaggcagaagcaggagaatcgcttgaacctggtaggcactgagccgagattgtgccactgcactccagcctgggtgacagagagagactccattgcaaaaataaataaataaattgttattattattgccaacatcgtacgtgattgtcagggtttttttttttttttccttctcataaaatgttcaggtggcaaagttgacattctgttttgtttttgttttcattttgagccagggtctccctctgtcacccaggctggagtgcagtggcgcagtctcgcctcattgaaacctccgcctcctaggttcaagtgattctcctgcctcagcctccaagtagctgggattacaggcacccaccaccatgtccggctaatttttgaatttttttagtagagacagggtttcaccatgttggccaggctggtcgcgaactcctgacctcaggtgatctgcccaccttggcctcccaaagtgcttggattacaggcatgagccaccgcacccagccggaaagatcttgttttagttcaaagcattaacagcgttgactcgttagtcatgataacttacatatgcaataataaaacacctttacactttaactgacataatttccgcatgtagtgcacataagatttttaccttgtaatatcttgaacacttaagaaacatgaaagaaaactttcaaatattaacaagtccagttggcgtgccttgcttgaataactgtgataggaggatgatttaatcagacggtaaccaggagcaccagtaaaggtaatgtcagctctccaaagactgtggctaaatgcaaggtcagagctgaactttgttgcctccctacaaaatctggagagaaaaagaacaacaggaatcaccttttctttagttcatgtgcagtataggggaggattctttatgaacccaaccactagacagtggccctaagggaagcagtaagcctactttctcagtggaggaaaatgaaaaggagagcatattgggcaatgtacctgataaccctttcagtgccttttcagtctaagagcagacacctgttccttttttttttttttttttttttttcctttgagatggagtcttgctctgtcacccaggctggagtacagtggcacaatctcggctcactgcaacctccacctcccaggttcaagcaattctcctgcctcagcctccaaagtagctgagattacaggcaccagccaccacactcaggtaatttttttgtacttttagtagagatggggtttcgccatgttgaccaggctgatttcaaactcctgacctcaagtgatccgcctgtgttggcctcccaaagtgctgggattacaggcatgagccaccgtggccaaccacctgttccttctttctttttttttttttttttttttttgagacggagtctcgctctgtcgcccaggctggagtgcagtggtgcaatctctgctcactgcaatctctgcctcccgggttcaagcaattctcctgcctcagcctcctgagtagctgagattacaggcacacaacaccacgcccagctaatttttgtatttttagtagagacagggtttcaccatgttggtcatgctggtctcaaactcctgaccccgtgatccacctgcctcggcctcccaaagtgctgggattacaggcatgagccactgcgcccagccctgttccttctttctaccccatctcacactcctctcaaatttgggaggaagcccagatagctaaatagacagcattaggtgtatagaagctagaaccaaaaaaacaaaaagatagacaacattctgaaacaggggtgtggagaatttgaccatggtagagtttaaacacccagcaattctgagaaattatttctctgagagggagcaagcacaggcaatataatagaatatatatataaaaaacatgttttacataatatattaatatgttatataattatatgacattgtaacatgtaattattatatttgtattatattgacatgattgtaataactaataggtaatgattatataaatagtaatattaaatattatactatataacaatatacttgtttatattatatattcaaatatgcaataaaggcagcagaatgctaactgaaaatggaggtaggttttgggctcttgggaaaagagaaatttttttgttgttgttgggaggggaacggagtctcactctgttgcccaggctggagtgcagtggcacaatcttggctcactgcaacctccgcctcctaggttcaagtgattctcctgcctcagcctctcaagtagctgggattacaggcacccaccaccatgcctggcttatttttgtatttttagtagagatagggtttcaccatgttggccaggctggtctcgaactcctgacctcaagtgatccacccgcctcagcctcccaaagtgctgggattacaggcatgagccaccatgtctggccgggaaaaagaatttctaaataaatacgcttcgttttggatagctcaagtgctatatttctaaaaatactacgtgtttttaaaaaataagccttttgccctgttttcatttttgatgaactgacagtttacagagcactttcctacatgttgtcgttgtccccaggatgctcgtggataggcccagcccccctgagtcctgggttgatggcactcagagtgtcctctgccagagctgtgggacactgaacttgcctggagatgccctgtggagggatgatgcccacatctgcctcagagaggtagatgcatccagaagctcccaagaagtgtcccatagtaaatagtttgggcccaattaaaagaggcaggaggctgggcacagtggcctgtaatcccagcaccttgggaggctgtggtgggcaggtcacttgaggtcaggagttcaagaccaacctggccaacatggtgaaaccccacctctactaaaaatacaaaaagttagctgagcatggtttcaggcgcctataatcccagctacttgggaggctgaggcaggagaattgcttgaaccctggaggcggaggttgcaatgagccgagatcgcgccactgcactccagcctgggtgacagagtgagtgagactccatctcaaaaaaaaaaaagagacaggagtggagaatttctaacacttctctcctgggataccgtttggggtccttttccccggacactgttgcaccatcgagtagcagagaaggagatggggagctgagcagctctgtatgtctcggctcagagtgacatcagtcttacgtctttgggggctgggaagatgtaggtgaaaggatacgaaggtgcaattatggaggatgagtaagtctagaaaaggcatgtacaacatgaggactgtcgttaataacactgcatatgtactgggaatttgccaagagagtagattttaggtgctcttaccacaaaaaagaaaggtcaaagacaggcgcggtggctcatgcctgtaatcccagcactttgagaagccaaggagggcagatcacgtgaggtcaggagttcaagaccagcatggccaacatggtgaaaccccatatctactaaaaataccaaaaattagctgggtgtggtggtgggtgcctataatcccagctactcgggaagctgaggcatgagaatcatttgaacccaggaggcagaggctgcagtgagccgagatcgcaccactgtactccagcctgagtgacagagtaagactccatctcaaaaacacacacacacacacacacacacacacacacacaaaactgactgagcatggcagctcacgcctgtaatcccagcactttgggagtccaaggcaggtggatcatctgaggtcaggagttaaaagatcagcctggccaacatggctaaaccctatctctactaaaaatacaaaaaattagccgggcatggtggcagacacctgtaatcccaactactctggaggctgaggcaggagaattgcttgaacccgggaggcggaggttgtagtgagcggagactgctctgctgccctctagcctgggcaacagagtgagactccatctcaaaaaaaaaaaaaatttattactaatatactaatgtactaatgtactacagccgatcttagctagcatgactaccattcagctgtttgctgtagcaatttgttacattcctaggaaaccttaagctatggaagaaaaaaaaagtctcattctacaaacaagacatttcaggggagaagcaggggagagtgttaggggctagagagtgttatttgaaacacttttccctccataggaatgaaagtttttgtcatggccatcaagtttaaaccttactcagtaaatctgttatatttacttgctccgcttcccacccaccaccctcaaaatatggtgttgtctgccagccagtccatatgattgtgtaagtccattcctcaccatgggctgcttggtttctgcgtctcctcattcatattcttaaaagaacattgaaatggctgttggtcatccagtggatttctggtgacagatgttcatgtctttctactcagctgtggcagggggacggcctgtgggaatcatttccttaggtttggcaagagccatgaactgctgtatttcacaaagaagagggctggggtggactagttgcacaaaagcatctcctaacattctttttttttttttttttttttttttgagatggagtctcactctgtcacccaggctggagtgcagtggtgtgatctcggcccactgcaacctctacctcccaggttcaagcgattctcctgcctcagcctcccaagtagctgggactacaggcgcccaccaccacgcccgactaatttttgtatttttagtagagatggggttttaccatattggccaggctggcctcgaactccttatcttgttatccgcccgcctcggcctcccaaagtgctgggattacaagtgcgagccaccaagcctggcctgtaacactcattccttacactgggttgttactagaatgtcagaacagtcacagttttatttttctttgtctgataagaaaccctaaactgcatatttgtgtaacatctttacaatcttctttccttagaacgcctgacagacaatctcagagttggacagacatccatagttgctgctcagatgtttctttttttcagagttttgctgctaagaatatctcctcaacatttgacttcattgtggccaataatggtctctgaattggtgagtacaagtattgtaagtttgaaagcaaggttggagctttttaaaatgctttttcagtaacataacgtactatttcctatgtatcccattttatctaaatgttatttttaatcaggttggtagcacatggttagctcttggttaaacagagaatattttactctatgatcatatttgatctctcaccctgtcagttattccaactaacttgtaccatttgataatacttactagttttttatatacatataaatttgggctgggcgtggtagcttatgcctgtaatcccagcacttcgggaggctaaggtggatggatcacttgagcccaggagttcgagactagcctgggcaacatggtgaaactccttgtctacaaaaaaatacaaaaattaattcggcatggcgggaagttgcatctgcagaaggttgaggctgcagtgagccatgattgtaccactgcactccagactgggtgacagagtaagaccccgtcttattcattcattcataaattaatcgatttttaaaaataagtaaaaaaaaatatttgggtagatttaatctgtctcagatagtaacttgaatgcatttttttttcagattcagacattcacacagcttgaagaagatctaaaagatgaagatgagtcattgaggtaagcagtacaagatctgtacacaagaggaaaagatagtcacgattaaagcacgtcactttagatatagagttgtctaatgttaaatgctgttatcttgaagtacttgtgaaaggaccagctattccaaaaatttcttaaaaagaaaattcttctgagggacaggtcataggtgaatggactataacagatctgaatgaatttataacaagcgtttctttgcaaatttatagaagcaccaacaaagtaaacagaacgaaagtttcagtcccggatgcaaatggaccctcagtgggggagataccccagagtgaactcatcttgtatttatcagcttgcaaattcttggacacagcgctttcttttccacctgacaagatgccattatttcaaatgtaagtcagataggatcgtgtgtcctttttgaagtaagagattttgttttttccttttaagcactttcacttgtttttcatgtacagtttatgggaaaccaccatctgggtttctagtgacagctaagccagctcggaataccaagtttcagattacttgcaacatctgtggctctgcaaatttggctcacaggagtgtttatgaatgtgtttctatggtgtgtgtgtgtgtgtgtgtgtgtgtgtgtgtgtgtgtgtgtgtgtgtgtggtttttgctactgaatgcttataaaacagggcttacccactggtgctcctcactgcctttgtgtagacctttttgtctgtgtttagttagatacaaatgcctttatttggagcctgccatctccgattcactttgccccataggcttatgtttcctgccggcttagcacagctgctcatttgtttaatttcatgaccagccccagaggctatttctctctctcctacccccacaaagagagtaatcatatagaaatgtttgtggttaaagagcgggttctcttaaatgcacattgctaagtgaaagaagccagtctgaaaaggctacacactgtatgattccaaccatgtgacattctggaaaaggcaaaaccatggagacagtaaaaagatcagtggtcgccaggggttggggagagggaggcagggatgaatgggtgaagcacagaggatttttagggcagtgaaattattgcatacagagctataatggtagatccatgtcattgtccatttctccaaatccatacaatgtacaccaccaagagtgaaccctgatgtaaactctggacttgggaggataacagtgagtcagtagaggctcttcagttttaacaaatgtaccactctggtgcaggatgttgataatacggcaggcttgtatgtatgtaggatgggatgtacgggaactactttctactccattttgctgtgaacctaaagctgttctgcaaaagaaagtcttttagtttttaaaaagcaggtttgggccggacgtggtgtctcatacgtgtaatactagcactttaggaggctgaggcgggtggatcacctgaggttgggagttcgagaccagcctggccaacatggcgaaaccctgtctcaactaaaaacacaaaaattaggccaggtaccgtggctcacacctgtaatcccagcactttgggaggccaaggtgggtggatcacttgaggccaggagttcaagaccagcccggccaacatggtgaaaaaccctgtctctactaaaaatacaaaaattaggccaggcgcgatggctcacacctgtaatcccagcactttgggaggccaaggtggttggatcacctgagtttgggatcagcctgaccaacatggagaaaatccatctctactaaaaatacaaaattagctgggcatggtggcgtatgcctgtaatcccagctacttgggaggctgaggcaggagaatcgcttgaacctgggaggcagaggttgcagtgagccaagatcatgccatctgccattgcactccagcctgggcaacaaaagcgagactccatctcaaaaaaaaaaaaaaatacaaaaattagccagatgtggtggtgggcgcctgtaatcccagctacttcggaagctgaggaaggagaatcacttgaacccgagaggcagaggttgcagtgagccgacatcgcaccactgcactccagcctaggcaacagagcgagactccccctcaaaaaaaaaagaggccgggcacagtggctcatgtctgtaaccccagcactttgggaggccgaggcaggcggatcatgaggtcaggagttcaagaccagccaggccaacatggtgaaaccctgtctctactaaaaatgcaaaaattagctgcctgtattggtgggcacctgtaatcccagctactcaagaggctgaggcaggagaatcgcttgaaaccgaaggcggaggttgcagtgaaccgagatcgcaccactgcactccagcctgggcgaaagagcgaaactgcatctcaaaccaaaaaaaagtggaggctaggcgcagtggctcatgcctgtaatcccagcactttaggaggctgaggcaggtggatcacgaggtcaggagttcaagaccagcctggccaagatggtgaaaccccgtctctactaaaaatacaaaaaaattagtcaggcatggtggcaggtgcctgtaatcccagctactcgggaggctgaggcagagaattgcttgaacctgggaggtggaggttgcagggagccaagattgcaccactgccctccagactgggcgacagaacgagactgtctcaaaaaaacaaaaaagtgggttccgatatatgtgaatgtgcatagcaacattatttataataggcaagaagtagagacaacccaaatggccatcagctgatgaacaggcagatcatgtgacatatccatacagtggaatacggttcagcaacaaaaagaattgaagaactgagacacgctggaatctggatgaaccggaaaatatgatgctaagtgaaagctcgaaacaagggaacatatagtgtatgattctgcttatatggaatgtccacgatgagacagagtgtggattagtgggtgcctaggtctcaagggtatagggggttggggtggtgatggctgagcagggcaggatttctttttggggtaatgaaatactctaaaattgattgtgataatagacgtgcaactctatgaatataataaaaggcattgagttgtccatattaaatagatacagtatgtgaattatatcttaataaaactaattttaacgacgttgaaggcctcttaccagcagacctgaccttctgtttgttccctgcagttataggtgggcatttattccagaagtggacacagagggccctgccttcctgtcggatgtagaggagaatcaccaagaatgcaaaccccacactgtcaggattctagaacttctaaaattaaagtttggggtaagtgcttttcttttcttttctttttttttttttttggtgagacagagtttcactcggccacccaggttagagtgcagtggtgcggtcttcgcttactgcagcctccacctcccaggttcaagtgattctcctgcctcagcttccggagtagctgggattacaggaatgtgccaccacacctggctaattttgttttgttttgttctgagacggaatctcactctgttgcccaggctagagtgcagtggcacaacctcaggtcactgcaacctcagcctcctggtttcaagcaattctcctctcagcctctggaatagctggaactacaggcgcacgccaccatgcctggctaatttttgtttttttgtttttgggttttttttttttttttttgagacgaagtctcactctgttgcccagactggagtgcaatggcaggatctcagctcactgcaacctccacctcccaggttcaagcaattcccgcacctcagcttcccaagtagttggaactacaggcacatgccaccactcttggggctaatttttgtatttttagtagagacaggttttcgccatattggtcaggctggtctcgaactcctgacctcaggtgatccgcctgcttcagcctcccaaagtgttgggattacaggcgagagccaccgtgtccagcctgcttttctttttaaaaattatattcatgaggctggtaatcccagcattttgggaggccgaggtgggcagatcgcctgaggtcaggagttcaagaccaacctggcaaatatggtgaaactccatctctacaaaaatacaaaaattagctggtcatggtgaccggtacctgtaatcccagctactcaggaagctgaggcaagagaatcgcttgaacccgggagacagaggttgcagtgagccaagatcacgctgctgcactccagcctgggcgacagagcaagactctgtctcaaaaaaaaaaaaaaaggaccttatttcttaggttttgccacatgcatgtgcttcccagccatctcgagccctcagtaaaaccatatcattgttatgggtttgttttttctgcaggaaatcagtagctctgatgagatcaccatgaagagtgaattcccgcttctgcgccaacattctgtttccagcatcaggcagttgatgccattcttcatgactctaaatggtgcatttaagacccagagacagctgcctgctgatagcccaggaactccattcttggactttcctgtcacagatagcccaaggatcttaaaacaactggaagaatgcatcgaatatgattttctggaacatccagaatgttaaccatgtgagagagaatatgtttaatccatgtattggtactttactgaaaaccaggttatattctaaagaagaaagaaggcaggatagtgcttttgaacaagcctatttccattttgaaagtagatttcaggctaggtgcggtggctcacacctgtaatctcagcactttgggaggccaaggcaggcagatcacttgaggtcaggagttcgagaccagcctgaccaacatggtgagaccctgtctctactaaaaatacaaaaattagctgggtgtggtggcggcgcctgtaatcccagctacttgggaggctaaggcatgagaattgcttgaacccaggaggtggaggctgcagtgagccgagatcacgacactgcactccagctgtgtgacagaatgagaccatctccaaaaaaaaaaaaaagtagatttcagataatttactgttcagcaacaggacacacctccctaaatgccttgtaatatatttgaatctgattctgcatttcttcctcaatttatgtaatgaaaataaaattaatatatcatctaacagtagcacaaaatttgtaatatgaagtaaagtatgaagataatgaagaagttgttttctttgttgaagcagttatatgggtctttctcagtatatttctcttttctctaaaagtttaaacttattaaaagaatgttatttttaacctttca

SEQ ID NO: 324 - DNA, 6201 bp, Homo sapiens
acagtcgccatgacgaccggtaggtccgcaacggctgcggggacaagaccgttgaggctgccaggcgagtcaggcctttctggacctcgcctgactcggctgggctgtgcctgaaattgacccagctctatcagggattatgaaaaaacaaggagtaagcccgaagccgctgcagtcttcccgccccagccagtctaagcggcggtgcgggcctcccccttcccccccgcctccgccccggagccggaggtagaggaggtggaaaagtcggccctaggcggcgggaggtccttccggcggaggatccgaaatgtggaaaatcgaaaaggcttggagctaaaggtggtggccaagacccttcttctcggccccttcctgttggtccgtaattccctggcgcagctccgggaagaggtgcacgaactgcaggcgtggtggttccccagcagaaccactttggacttcggtaaggagagggcaggagagctccaggaggtagccgcatggcgcttttcttgagtcttgaaggagatcagtttaacaagcaagggtttgtgggtgcctagtaggaaataaaagcaaggtccgaatagaaagaagttggccaaaaatcttgtcattgaaccaggggagagagagagatagggagtatattggtctgaagggctgtcagatcgcagagagtgttttaaggtctaggagttttaaaggctgaggggaaggatcaagggaagaggatcagattaagattccaagagaggaaataattagtggagcaagtcttggaatatttggaggggtagaattaaaggcacaaatttgagaagctaactgtggaaaagaggagagagaattccttttctgagatggcagggagtagaaaagcgaggattactatatggagaaatgttaaagtggagataaaagaagttgggagtgctggcgtctaatggtctttgtttcagtgaagtatgaggctgggtcaccttcagaggtgagactgataggatgccggggtccaggggacatgcttctgtcacagcttggaaagggcatgtgataagcccttcaagcatttagaatactggcatcgttgcaacatatcatttttttcagatgtggtatgtgggttaagggagggagtgagagacacagaaagattttgagcatctttggaaagctggatgaatttggtagtatatttgaccttttccttatatatcatctgaagagtttttgccagtgtatataattgttaggagaattagaaataggatacaaatatagttgaacaggatagtctctgtatattttaaaattaatgaagcctaataaacagttaatgagcatctttacaaccatttaaagttttcaaccttttaaaaattatagcaaccgtgcttgcagacagtccaaaaatacaccatgggccatactttgcctatcctggtataaaacaagtaaatcttccaagaagtatttaagataagcccaggacagttagtaatataggaaaagatctgggtaagcatggttgacaatttcaacattgcaattttttaatttttaaaaatttaatttcttcaataattattgaattaatttgcatttattttgttagccaagtgaagtaatttttgaatttttaagaggctattattggtggtttgtaagatgacttgccaagtatatttgggataaccataagaaataccattataaaatctcagaagggaggtaggacttctggaatagccaaggaaatgcactcctccatgacgacaatgaaaatacttggaaaattatcaaaatcattttcttcaaaactttggaaattaaccaaaggtttacaacaatctaaagggcattaattcaagaaaagctgctgaacctctataagaatagcaaagtttgtggtgttttaacttgttctattccccactcttctctctccaggggaattgaaaacaagcaattccccaaccaaacaggggcacaggctgcgtttgcagctcctgtaaaagctccatacccagagcagtgtctcccagctcccaggtgaagtcttatgtatacatggggcgttggcacaggtgactccagactagtctcctaggccatctagtagcttctaggtctcggctcttgtaaagagcttgcaattcatcaagggttgagctgcacattggggcttttagatgtgctgctgaggaagtgatttcctgcatttaatcatcttctgatgaatgctagagaaactgatctagagtggctcctcttggttagaactagctgaagcatactgtatatacttacttcttttaaaaatttcatataaaggaatagaaaataatactgaaaaaaaaaaaacaaaaaaggtcgcaatcttccataattccatcactcttaccaattacctgaagtaaaaaaaccctctcaagtttctccctttgcttatcaagccctgctgcagagaggtaagctctgttcagaatttgctttgtgtcctggattttttcctatgctcatagagacaggattagctggccatcttgctttgtgtgctatctttctagacatgtaaaatactacatttgaaatacttgttttaatggtattttataataaagcagctattaataactttcctttttttctttattccagcagtccttgtggcttatctccattggtaagatttagtttcagtttgaaatatttaaaaacatttgaattaaaaattgccatctctctttgcatacagtaaaacaataacttctggctatatttgtagaacatctttatgtgcaccaatttatacatgtattttgcttttttacaaacctcatatgtgaaacagcatttacaaaatagatgcattaggggaatagtaacttacgaattaaaatatttttgctttactaaataattcaccacacgtttctttaaatatctagcttttctagtgtattttgcatgtgtagttcatttaaaaccttcctttattttatggtaattatatgttgctagtgaaataacttttttttttttttttttttgagacagagtcttgctctgtctcccaggctggagtgtagtggcgtgatcttgactcactgcaacctctgcctcccaggcacaagtgatcctcgcgcctcagccttccaagtagctgggattacaggtgtgcaccaccacacccagccaatttgttgtatttttggtggagacaaggtttcaccatgttggccaggctggtgtcaaactcctggcctcaaatgatccacctgcctcggcctcccaaagtgttgggattacaggcatgagccaccacattcagccagtgaaataactttggtgataaagttttagcaacacctgccaattggaaatcagttaaaaaagaagttaaagattctgcagtggttatatggttaaatggctctgagtctttcagtgtgcaagcctgtgtacattattttacaaaagtgtttataaaaatttgtaaaataatatttccttctggaatattttatttttacctgtgctcagtgatttctacccttgggaggtatgagatctgcccctatgttctattgacacagtgctgctctagacatttagtctgcagggagattttgatgttagaactgaggctgcaatggtagggaatattcctgcagtatttggtaccctggcatatggcctacatgtaaagaagggttagtggaaaacagggttaatatatggaactttgctttattttcaacttcactggaaagtactgactacataagttagctatagcataattgttggccatagctaattttgtttatcacatatgctcttttcttcactgcctatagctgttgagtttcactactaaaaggtcttcaagtacacacctgtattctttggcacttgaaagttgatcctttatgtgatattatacttattgtaagtctgctttgatctaaagtaattttatttaaaattatattctgaacccttttcaacagttatggaggtatttcccaaggctggtacattagaatcacttgaaacttaaaaaacaaacactaacctgcctctgttccgatttagaggcctgggatggaaggaagggtgaaaaaagccacaagaattttagatatacaattaaggtttttgttttgttttgttttgttttgttttgttttgttttgttttgttttgtttttgagacatgatctctgctcactgcaacctccacctcctgggttcaagaaattctcctgcctcagcctccctagcagccaggattcagacatgcactaccatggctggctaatttttgtgtttttagtagagacggggtttcaccatgttggcaaggctggtctcgaactcctcacctcaagtgatctgcccgcctcgggctcccaaagtgctgggattacaggcatgagccaatgtacccggccacaattaagcttaaaaaccactgagttaaggaatttcaggtgtgtgccgtactggattataaatgctgaaaaacatacaagttagtaagcaaattataaaattaatattataacaattgttttcttttttatggctttcttattgtttattttactgttagttttgaaacttgttcttattgtaatatgattcttcatttttttctaggttacatttagtaaaactttgtgaaaattatcgtcatttctctcacctctcatctttggaacgggagatgactttttgcaccaaaatggttaggtttcttcttctaacgaattaatttgtggtttaagaatagcgagactatgaggtagagatgtattaggaattgaaatgaacttttggtgaactgcactgtttcataagctataacccaggtttattatttaaatagtaaagtgtttgagattatttttctgttacttcattatctctcaccctttcctaatgcagacttctttttaagataataaagatgaattataatagctgaggaaggagaagaatgcaagctctgaaatgacatccttaaatgctgatactggttacaacctctttacctctctgaggaaattgtaacagtgtgtcttttagggtgtttttattttaccagcccttaagaaagatctctaatacgttttaatgcttttttttataatttcaagttgaagtgtttttaaaaacaccttgttttgtaatgttttgaatctcttgagatgtatttaccccactagatacatatttgccactggttagttctccatctaagctcaagaggttattcatctctctttagattccagtggtttttcttttaacttccaggtaaaatagaaactgctatggtatacaaccaaattttggggttaaacataatcagaaaagaaaatccagttaaatttatgaagtgagattttcagatcctagatcttgaatatagcaaaggtcttttcatcttgatggccccaaagcttgttggtcatagtctatttctggccattatcttcttaaataatctatttttaagccctcatttatttttggttttggatgaggaaagtcatgttttctaagtcctctcccctaataaaacctacccaacaatagtgctttgaaaagtggtagttatcttgaagatactcttgccaaatgcaaagataaacattctttttgtctgctttataaatatgaaatatgccagatctatagtattttaatgtgcatctactttaaatgagtcatcttggggtttttataattcccttacattcttgcccctctacacttgaaataacaaaataccttaattttatagattagttctcttatagtagacaggcagctatatgcagcaaaaccaataaagttatttttcaactttcatagttgtaaaatattttatagcaatacaaaacagctaagaaaacatgccacattttattttagcattttcaaataatttgtttttggtgtaagcacaggataaaaaaggagagcgtcaaagaaaagagacataacacctaacattcataaaaattaacaaagtatattttggatgatatttttacaggaaatattttaaataagttggtagaatttttaaaatggtactgtattagctaataaaatattcagtacaaatatatgtttggatttatgcattaaaaaactaataaaattatttccaacttt

SEQ ID NO: 325 - DNA, 10453 bp, Homo sapiens
gcggacgcggggcgccagcaggtggcgctggacgcgcaacggacaaggaggcggggcctgcagctggcttggaggctccgcgctctggaggctcaggcgccgcgtggggcccgcacctctgggcagcagcggcagccgagactcacggtcaagctaaggcgaagagtgggtgagtcccttgaatcgttctcactggccgtttgctcctcgagtccgcccgcgtgtccctgcaaggctgggcgcccgctcccagtcttgggaggggtgtagcgggtcgcaagccttctcgtgacctggacagcggccctcctgggcgagcgctgctcaattctccgcttatgcgcggctctggggcgcgctgccttccagcccagctgggttgtggccgggccgggggttggggagagccagggactcacaggaagccttttcgctaggggcttaaggttgtggtagattattaagtttgtgctcaggttggattttgatggcaagttttttaacgtggcaaagttgccagagtttgctgtgcattgacgaatgactggtgcacagtacttaaaatcgtgctacttctcgtcttcgggtttcctggtaacagaggttttcatttttagtccttagaacactggccctactctttcaggatctgggtggggttcaggttccctccaaaatagtcaatcaaggctttaaatatgtaattctggtcaaatccactggaaggtgtttgtagacataaattttttgtacacttccaaatttcttactttgttacttttgtaaaatacatttccctccacatcctgacgtgtaataaaaggttattcatttaacatgaatgttaagcacagagggaaagcaatgcttaaaaacagcccagtgaaaaaaaaaaacaaaaaactcgacttcacttagttaaatgtaaaacaagtgtgcacttgaaagtataaaaggttggaaatgcaatgcaacccacagtgtattccaggcattgggtttcttcatattctcaactgcgggacataaacatgagtaagttgggctgtgccaacatttaggaacaccagggcagccatcctggtacagcaaaacagcagtcgcattagaaatatgcttcactttttttaaaagggggtgaaagagaactttgggtcgaattctggagttcctaacattttaacaccaggttgttttctgttatttttctttttatgaaaagattttactgtagaacttaaatttcattttggttaatgtctgatggaaaccaacaaatttatttgactcatagtttattttcctggcttatgggcatagagttgactgtgggccacacagtcaacaagcttcctcactgtcatgggcttttccttggctttgctcttgagtgtggtctccttaccatgcagacaaatggctgggtaactctccagggccactctggttttccacccagactccgtttgtagtggccatcagtcagcaaacactgccaacctgctagctaccccaggactgggtctagaagacagcgctgagccttttcctctacttcccttcccatgccaccatctgcctgtaaaactttatcctcctctaggatacatcgctctaccatgcagttgaaatgcctgccttctctcctagacctcaaggtttttcagagcagaggctttatctcatttaactttgcattcctcctgccttacattgttgttcacaatatagttaatgaattcatattgaataaatgtaggtggatttgttagcatccttacgatactgcaaccctcaaagttaaaagatcttctaaacatagtgaattatttcttacatttgattatagtaggtgacacttccattcctagcacctccctcccccaccccacaaactattatgttggtgatatggtttggagctgtgtctctccctcagatctcatgttgaaatgtaacccccagtgagggagctggggtctggtgggaggtgattggaccatgggagcagtttctcatggtttaacaccatccccccttggtgctgttgtcacgttagtgcaggggtacccaaccccgtggccgcagactggtatcagtcagtgtccttttaggaactgggctgcacagcaggaggggagtggcaggccagcgagcattactgcctgagctccacctcctgtcagatgaacagtggcattagattctcctaagtgcatgaaccctattgcaaactgcacatgcaagggatctaggttgtgtgctccttatgagaatctaactattgcctgatgatctgaggtggaacagtttcacctcaaaaccctatcccccttcccctacttggaaaaattgtcttccacgaaaccagtccctggtgccaaaaaggttggggaccactgcgataatgtaagacgcctgctcccacttcaccttccgccatgactataagccctctgagccctccccagaagcagatgttgccatgcttcctttacagcctatggaaccatgagccaattaaatctcctttctttataataattacccagcctcaggtatttctttatagcagtgcgagaacagcgtaatacagttggttaagtcaccaaatgacttggaataatgcttcttaaggagatagagtgtcatttcctccagagcaggcatgagtgtcatttctatttttcctctttaatgttggtcacagagttgggttcataaatacttgatgattggcatatgctttactcagaattcttttacatgccagtggtgaacacccaaatcacactaacttaaaccaaaaaaaaagggaatgtgttgactgtctaactgaaaaattcaggatctagtctcaggggctctaaatactgaaatatgccgccaggactcttctgtgtctttctctgcttcttgttctgcttccgtgttggctttcttcttttctaatgaaaacatgttccttcttagagcatggagaaaaaagcatggcaggcttatactgtgctatcttaacaaaatgttaaagacatctcatctctctcttccacttccatatataaatatcagagaatgaccaggtttaagtagggttctgtgccatcgctaagccaatcaatgggaaaacaggaaactgcccaggcctgagtcatatacccacttctgtgaccagggaatgagcgttactattttacacaatctcccaaaatcacattggagggaggaagggcatttctccaaatggaggaaatgttttaaatcagaaaagaatgtgggcaaactaaaacaacagatatcttcatcatgaatgttctgtaattttgaaatagataatatctggaaaatattccaagagtacctcaacaaagtaaatgttggcatatgtaaaagcaactcgttattctttgttatagttaaacctttaaaacttggagaatgttttaagaacagtcatgtctcttcatgacaggatacattctgagaaattcattgtaaggcgggatttcattgttgaggaaacatcatagagtgtacttacataaacttagatggtacagcctcctacatacttaggctagatggtatagtctattgctcctaggctactaatctgtatagcatgttactgtgctgaatactgtgggcagttgaaacacaatagtaagtatttgtgtatctgaacatagaaaaggtatagtaaacatacatatatcgtacaaaagataaaaaattgtatatttgtacaggacgcttactatgaatagaacttgcagaactggaagttgctctgggtgagtcagtgagtgagtagtgagtgaatgtaaaggcctgggacattactgtacagtactatagactttataaacactgtacactaaggctaccctacatttattgaaaaatttttttctttaataataaattaactttagcttactgtaattttactttattaacttattgtttttactcttttgtaataacacttagcttaaaacatagtcacattgtacagccatacaaaatattttgtttatgtacttactccttaagctttttttctatttctaattttttttttctttttagacttttttgttgaaactaagacacaaacacacacattagcccaggcctacccagggtcaggatcatcagtatcactgtcttccacctctatatcttgtcccactggaaggtcttcaagggcagtaacaggcatggagctgccatcttctatgataacaatgccttcttctggaagacctcctgaaggacctgcctagggctgtttacagttagctctttttttgtaagtagaaggagtacacttcacaataataataaaaagtatagtattgtaaatactaggcaataggaatttttttgctccattatactcttatgggaccactgttacatatgcagtcagtcgttgaccaaagtgttatgtgacacatcactgtattttaaactattcctggaaacagctttccacctaaaaaagtactacacgtggtctaaaattcagaaacacttgggatattttctgtcaatcaaattgttgtatatctaatctgtttttctcattgaatttcataaagtgtaaattgaagatgtgttcctctggaaataaattcagaactaataaaaacaatgaatagtactgtgacatatgttttctttccctaaaaaatgttacaccaatcctggatgaggatctgtgagtttgctaaggaaaagattcttttatcaagtgagaaatttgaaaagttgttttccacagggttgaccagaagactgggcacatcattaattcggcacaactcaccattcccactggaaacatactagcaattcacatcttccaaacaagcaccaacctcttactccaaaagaaaaatggtactctgaaaatactgtttcagactccagtgtcaaccccaaaattctgttaaacataaatcttatatcagctacctccagcctccattgatgacattattactctcaatataatacattcctaattatatttgccattgaaaggagttggctttcctccagatggaaacctgaaattaaatcttcctcaagtaaaaggcaacatctgaccctttgtaatgcatacaggcacctgggttattcattgaacaaataagtagataaagaagagcagttactgttgataagagggcattggtttgaaacttacagattataatatgaagttaaatgtataaatcagtcactatttccatttttattgtattttatctgccattctagtctttaagtaagtaaattttttatattgttacatcaaacattcacatcataagtagaatggacatgaaagtaattatttttatttttacaggtggctgaagccatactattttatagaattaatggaaagcagaaaagacatcacaaaccaagaagaactttggaaaatgaagcctaggagaaatttagaagaagacgattatttggtaaaatattaataataacaataataaataataatttacatctttaaacataattcagatgccattctgtatctcctagtgttatgaaagtgatttttcaccctagtctgctgatatctggacttggattaccgtcactgatactgtgaaggacagagtagcatatgtgagagacatagtaccttcactgattgtcagggacttagctgaataaccttgaataagttactgaaaatctggggtcttagtttgtttataccatgaaagccttggaccagatcatccccaaggcccttccaattctttctaacagtctatagttctaagttaaaaaaaaaaaaaagtcatcaatgcccatataacagtaattttgtaagcaagcatttttgtcatagacacagtggcagcttaccaagagatcagtaaattgacgattcactgtataaccaaataaatctacttttggataagaatcacttgttccacttttggtcaaacacaggattaagtgtttcttactacattttttgactgaaaaagtggcagaaattttggttccaaacttccaaattatctcaatggaagttttagcagaaattatttatttaatcttaataattttaatagggaaaagtaattaataaattacaagcatatactttataagagtaacaatgtgcataaaatgaaataatttcatttttcaagttaactgtcttacctgtctgaagcatgtatttcttttgtcctaaagacaaaagtctttcagtgccacatagactatgctatcttcaactaaccagtattcaaaagcaagattctgaatgcccttattcaatgagaagcacaatgattgagcaataagtaattagttcaagagatatcccattgttttgttcaattttaagatgttaattttctttcctttgtagcataaggacacgggagagaccagcatgctaaaaagacctgtgcttttgcatttgcaccaaacagcccatgctgatgaatttgactgcccttcagaacttcagcacacacaggaactctttccacagtggcacttgccaattaaaatagctgctattatagcatctctgacttttctttacactcttctgagggaagtaattcaccctttagcaacttcccatcaacaatatttttataaaattccaatcctggtcatcaacaaagtcttgccaatggtttccatcactctcttggcattggtttacctgccaggtgtgatagcagcaattgtccaacttcataatggaaccaagtataagaagtttccacattggttggataagtggatgttaacaagaaagcagtttgggcttctcagtttcttttttgctgtactgcatgcaatttatagtctgtcttacccaatgaggcgatcctacagatacaagttgctaaactgggcatatcaacaggtaagatgacagtgttgacactgttactaataaaaagtctaagtcacctaacaaattaatcatttctcattgtaatatcaataccccaaccctgttgaaactctgtgttgaaaaagtcatctattttaaaatttttattataattacactagggcttggttgtcagtcggttttatattgagaaatgttttttaggctgaaaataaggtacaactttagcaacataagaaacattttgttcatggacgaggccatatttcaaacttctaccaccctcacaagattactttttaatattgttgttcttctccttgtttaccaatatgcatgcacattacagttctatccaagtaaaccatcaaataattattagaaaattaatagattatggaagtgttgcattcaagaaaaaaagtgatagctcctatgtcatttgtcttagaggaatgcaaaaaaaaaaaaagaaaaagtcataaatttgtggagacctgttatcagggcttcatagtaggcacagggaagagtgtagaaggagattcacattcaggaaataactgttgtttgcatttcttctttctttatttaccttctggtaggtccaacaaaataaagaagatgcctggattgagcatgatgtttggagaatggagatttatgtgtctctgggaattgtgggattggcaatactggctctgttggctgtgacatctattccatctgtgagtgactctttgacatggagagaatttcactatattcaggtaaataatatataaaataaccctaagaggtaaatcttctttttgtgtttatgatatagaatatgttgactttaccccataaaaaataacaaatgtttttcaacagcaaagatcttatacttgttccaattaataatgtgctctcctgttgttttccctattgcttctaattaggacaagtgtttcctagacataaataaaaggcattaaaatattctttgttttttttttttgtttgtttgttttttgtttgtttgtttgtttttttgagatgaagtctcgctctgttgcccatgctggagtacagtggcacgatctcggctcactgcaacctgcgcctcctgggttcaggcgattctcttgcctcagcctcctgagtagctgggattacaggcacccatcaccatgtccagctaatttttgtatttttagtagagacagggttttcccatgttggccaggctggtctcgatctcctgacctcaaatgatccgcccacctcggcctcccaaagtgctgggatgacagttgtgagccaccacactcagcctgctctttctaatatttgaaacttgttagacaatttgctacccatctaatgtgatattttaggaatccaatatgcatggtttattatttcttaaaaaaaatattcttttacctgtcacctgaatttagtaatgccttttatgttacacaacttagcactttccagaaacaaaaactctctccttgaaataatagagtttttatctaccaaagatattctagtgtctcatttcaaaggctgctttttccagcttacattttatatacttactcacttgaagtttctaaatattcttgtaattttaaaaatatctcagatttactgaggtttatcttctggtggtagattatccataagaagagtgatgtgccagaatcactctgggatccttgtctgacaagattcaaaggactaaatttaattcagtcatgaacactgccaattaccgtttatgggtagacatctttggaaatttccacaaggtcagacattcgcaactatcccttctacatgtccacacgtatactccaacactttattaggcatctgattagtttggaaagtatgcctccatctgaattagtccagtgtggcttagagttggtacaacattctcacagaatttcctaattttgtaggttcagcctgataaccactggagttctttggtcctcattaaatagctttcttcacacattgctctgcctgttacacatatgatgaacactgctttttagacttcattaggaatttaggactgcatcttgacaactgagcctattctactatatgtacaatacctagcccataataggtatacaatacacatttggtaaaactaattttcaaccaatgacatgtatttttcaactagtaacctagaaatgtttcacttaaaatctgagaactggttacactacaagttaccttggagattcatatatgaaaacgcaaacttagctatttgattgtattcactgggacttaagaatgcgcctgaataattgtgagttcgatttgttctggcaggctaatgaccatttccagtaaagtgaatagaggtcagaagtcgtataaaagaggtgttgtcagaacaccgttgagattacataggtgaacaactatttttaagcaactttatttgtgtagtgacaaagcatcccaatgcaggctgaaatgtttcatcacatctctggatctctctattttgtgcagacattgaaaaaattgttcatattatttccatgttatcagaatatttgattttttaaaaacataggccaagttcattcacttcattattcatttatcaaaatcagagtgaatcacattagtcgccttcacaactgataaagatcactgaagtcaaattgatttttgctataatcttcaatctacctatatttaattgagaatctaaaatgtacaaatcattgtgttgattctgcagggatcctgctataagtaagactcagtccctgattttaggtatcctgtgataagcagaattaagacaaatacacaagagacaaagcacaaaaaataaatatcataaggggatgaacaaaatggtggagaaagagtagacaaagtttttgatcacctgccttcaaagaaaggctgtgaattttgttcacttagacagcttggagacaagaaattacccaaaagtaaggtgaggaggataggcaaaaagagtagaaagatgtgaatggacattgttgagaaatgtgataggaaaacaatcatagataaaggatttccaagcaacagagcatatccagatgaggtaggatgggataaactcttattgaaccaatcttcaccaattttgtttttcttttgcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaagga

SEQ ID NO: 326 - DNA, 25993 bp, Homo sapiens
gccccctccgagctccccgactcctccccgcgctccacggctcttcccgactccagtcagcgttcctcgggccctcggcgccacgagctgtccgggcacgcagcccctagcggcgcgtcgctgccaagccggcctccgcgcgcctccctccttccttctcccctggctgttcgcgatccagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggtgagcgggtcggggaggagcgcgaaagaaggtagcggcggcggagttgagggtcaagatgcagtctgcgccacgcgctgcatccatcctccccgattctgcgccctcaccgggcgtccgccctgagctgcggggtccctcatctcctggcaccttaaggtggaaagtgagaagggtggagaagggtgtctgttccactgattccccctcctcctcctcttggttcctagagctaagggcaagtcctgaggttgggcccaggagaaagaaggcaaggagacattgtcccaggtaggatgtgtcccagcaggaaaggacaggcaggttactttcgcccccttgatagtctccctgctactttgggttgatgcagggcatttcatggaagatcatgcagtgctgctttgcgaacaggtatttctagcagtcatttggtttatttcccagtaatgtaatcgtggtgtttaggccatttctgttagaaagtaattggcctcttctttgactgtcctaaattatctttgaaccctgtgttcagcctcagccaaaacttgttgaaaattatgccctaaaaatcttgctcttaaaatagagcagagagataaagagcatttttgttggaagatttccatttattatctctcccaccccgtggagaaggattggtgtcagtttttactcctcgggcagttagttttttagatggaaagacagtccaggccatagttaattatcgctcatcagtataggagaaaaagaattcagactcctgccccacccccacccccacccccaacctcctgacttagattctggtccttttaacagccccgctgcttggaaccctttttgttttctaaaccacctccccatccttccttttctccactttattatttcttcattttattgatctgtttattttttctttctttaaccctataatttttttactccgattctctcttggttgcttcaaagcttagaggctatttaatggaaaagcaaaacaaaacaaaacaaaacacccgtcctaaataatttgcaggatgtttagaaacataaagagtaactatgtgtgctgccattgggatggctgcactctctgcctcttagctagtcactctgtcagggtatggggaaatgagacaatattgagaatgacaacttgagcaaattgtgcagtaaggaaatgaaaagctttatccaagtcactttttattgtactggtgctatggaaaatgtggtgaatgaacatagttgtattttagtactgaaaaaacaggacaggtgaagacaaatttttaaagaaaggattgtaaatgagttagaaaagtgagaaagaagatacaccaaaaatgtgaaagagtaagactgcaggcgtgataaaggacataggacatcaggagatgtatttatccctgctgggccagaaaccaggacattgaggtaactgagacattaacataacaataacattgataaatcacctaccccttaagggcccacatgtgttttcagcaaaaagagaaatctgatctagagaattattacatgtctttttgtcctgaatttttttgatgtattccataacaaagaatttttattgcatccttagttacactgccagccaatgtggaggcagtgatcacggacaagacaaacatggttcttccctcgtgcagtttattgtccaatgggggaaatagtaaacagtaaagaaacaattatataaaatattacaaaataaatttaacaagggctgagtgaattattctgctatagagatggaacagtatatggaaagctcccaaggtacataaagtggttgttgttttctctttctagaagagaatgctgtgggtggacaatatacagataaggttagagaggggaagcggggactaactcattcaggaccttttacgtgatagtcaggaagatggctgtagttctaagtacaaggagcaccgattttaaggagagacattttatgacgatttacattttaagatgattttagctgctgtggagatgtttggaaagggtcaaaagagaaagtaggctgacccattaggaaatgtttgcagagttcaggtgagatgatagacacctggactagcctggtattggtggagagggatttatgaaatatgttggagaacaggaattggtgcaggattttatgtcaaaagtgagggtcagcaaggacttaagaatgactcccaattttctgattggagcaactggtggataatggtggcatttacacatttccaggcgaatgggaccagctctgggtggaaaaagttcaggtttgaacctgtgaagtttgagatgtcacagaaagaggtcataaccatatccccttgggaagcaaaaagggaggctctccaggacataagtggatagactggtctttgataggtaaaattggtgattgttaatttaaggtgaaactaatgagctcagttttctggtttttctccagcaaccttcaccaacgtggatacagatacagagaaaatggatagctgggtccaggactagagttttgccaagcagatatgatggagagtaagagagctgaggatctttttaagggagtgactacaaatctagcctcggtttaaagagaaaccagagcaggctgaaggagagtgcaggatattaagcaattagagaggtagaggtcaacggatcagatttcttttgctgtttagaattatcagtgtgaatatttaaactaagattattggaagtcctggagacagtgcttggagatttcaggcagtgagtgactgaggtggggtagaggcaaaaattcattgtctccaatgagtaagtcaaggaaataagagcccctgaagttgaatggttcatccacttgaatgataaagtccaggaaaaacatgatagctattagggtagagaggatgaccatgtatatactgggagccagagtctgcagtcataaggaataaactagaagtcagtagaggacagcagtgaggacagcagtaaggacagggagagggtatggtgaagtaccatgagcttcaaaggagctgggtgtttgcaggagagacaatgaagaagagatgttcagatgtgggcttacaaagtgaagattacaccaccccacctcatggccctggagaattatgttttcttgatagcctctccaaatctgcaggttgtgaaatgtcatcaaaacctctgtggacagccctttcagagttgctgtcatccaataataaatgccctatttatgtgtgaaacaaattaggttctatttttcaaaagtaacatagcacaacaggtgccattcagcttcaggaatgttcaggaaatccttctaaactgaaaaccttaagaggctgtccagctgaatgtaactgaattccctatcaaaataatacattctcaagtattaaatgtgtacagcaagtcaaatgcccattcaagaaaacgatgtcattgacacagacttttagattgagctcccgaagttgaagtgttaaatatagggtggtgatattaccattattacacagcttcaagacttatttagtgttggaaactaccaccagagtcaagtataacctatttgtttgctgtttaacaaaggaaattgagactcagagaatcaaagtgattgcagaagcttaggcctgctctttcacccctacactatgaagacaaaactttctataaatgacatagttgttttttgtttttgtttgtttttgtttttgttttgaggctgagtctcactctgttgcccaggctggagtccagtggcgcgatcttggctccctggttcaagcgattctccttcctcagcctcccaagtagctgggattacaggcacctgccaccacccctgcctaatttttgtgcctttttagtaaagatggggtttaatcatgttggccagtctgatcttgaactcctgacctcaagtgatccacctgcttcggcctcccaaagtgctgagattacagacgtgagccaccatgcccagcctataaatgacatagttttatcagttatttaatttggattccttatgaataacttcaaaagaaaaggtatagacactgtggacatcacctgggagcttgtgaaaaaatgcagaatgtctaacctccctctagacctaaagaatctgagtgtgcattttaaagaggtccccaggtgatcatatttgcattaaagtttgacaagtgcctttctagtgagtcattcccttggaaacagtggtctgctcaggtcagcaggatcatgatgcctggagaactggggaggggatccccttgtagaacagaaagaagagatacagtcatggaaatattccgaattttgaatattatgaaacaacaggaacaaagtatgttgtgcaaggagtgacgcattttaaggaatggcattgcctttcccagaaagtgaagagaggaaattggaaaattgtgagtggaccttctgatactgctcctccttgcgtggaaaaggggaaagaactgcatgcatattattcagcgtcctatattcaaaggtaactactactctttcgcaagtgtaatttttcattactacaaacaacaacgtaaaaattaacataagtgagggtcagaaagccacatctactatcgccaaatgatgaaagtattagattgaattctgaatcttttactagagtgattttcaatcttggttgcataataaaacatctgctaatcttttttaaaaaatgctgttgctcaggatgaaccccagaacaattaagtgaaaactgggtggtaggggggtgacccgtcatcactgtgttttaaaacttgccaggtcattggagaatgcacctagggttgagaaatactgctttagtagctcattcagaagcagctctgagattgcagttctgctactccatgtgccaaaacagtgggactttccctcactaccataagcgtagtgccaagccaggtcagcaatattcaggtcaccctcactggccagttttcagaacattgagggaagtaggatttatttcttgaagaagcctgcttagactaacttttaaaacaaattgatacatgttacatatctatggggtacacatgagtatttgttatatccatagaatgtgtaatgatctggttggagtttttggggaatccatcaccttgagtatttatcatatctatgtgttaagaacatttcaagtcatctcttctagctactttgaaatacacagtacattgttactgactataggcaacctactttgctattgaacattagaacttacttcttctaactgtacatttgtatccatgaaccaacatctcttcctcccctcctcccatcaacacatccttccagcctctgatatctctcatgctattctctacctccatgggatccacttttttagctcccacacatgagtaaaaacatgtgatatttgcctttctgtgcctgggttatttcacttaacataatggcctccactcctatccatgttgctgcaaatgacacgatttcattttttaaggctgaataatatttcattgtgtatacataccacattttctttatccatttgttgatggacatgtagattgattccatatccttgctagtgtgaatagtgcgcaaaaaaaaaaaaaaaaaaaaaacatgtgaggacgggtatctctttgatatactaatttcttttcctgtagataatacccggtagtgagattactggattgtatggtagttccatttttagtcttttgagaaacaacccctatactgttgtccacagaggctgtactaatttacatttccaccaataacatataaggattcccttttctctgaatcgttgtcagcatctgtcatttttctcttttaataatagcagttctaattgggataagttgaaatctcattgtggttttgatatgcatttctctggtgattagtgatgcttagcattttttcatatacctattaaccatttgtttgtcttctttggaaaaatgtctattcatgacctttacccatttttatgggattatgtgttttttattgtcagttgtttgagttccttgtatattctgaatattagtcccttatcagattaatagtttgcaaatattttcttctattcaataggtggtctcttcattctgttgattgtttcctttgctgcacggaagtcttttagtttaatatagtcccatttgtctatttttttgttgttgttgctgtgcttttgaggtcctagccataaaatctttgcctagaccaatgtcttcaaatatttccccaatgttttcttcttgaaatgaggggttttgggtcttatgtttaagtctttagttgaccttgcgttgatttttgtatatggtgagggacaggggtccagttttattcttctgcatacagatatccaattgtctaagtaccatatatttgaagaggatatcctttcctcagtgtatgttcttggtgcctttgttgacaatcagttggctgtaaatgtgtggattttttttgtggattatctaatctgttgcattcattgatctgtgcatttgtttttataccggtaccatgttttttcggttactattgccttgtaatatattttgaagtcaggtagtgtgatgccttcagctttgttctttttgcttaggattgctgtagctattcaggatattttttggttctatatgaattttaggattgtcttttctaattctatgaaaaatcacattggtattttgatagggattgcattgaatctgtgtattgctttgggcagtatggtcattttaatattaattcttccaatccataagcatggaatgtttttccattcgtttatgtcatctttaatttttttctacagtgctttgtagttttccttgtagcaaactttcacctccttggttaaatatattcctagttgttttttgtttgtttttgttttttttatagctattgtaaatgggattgccttcttggtgtctttttcagcaagttcattgttggtgtatagaaatggtactgatttttgtatgtcgattttgtatcctgcaactttattgaatttatttatcagatctaagagtttttgtgtgaaatctttaggtttatctagatctaagatcatatcatcagcaaagagggataatttgaccttcctcttttccagtttgggtaccttttattctttctctttcctggttgctctggctaggacttccaatatgatgttgaatagaagtggtgaaagtggcatccttgtcttgtttctgttcatagaggaaaggctttgagcttttccccatttcaaaataatgatagctatattattattatatagatcatataagcccttattatgtgaagcatattttttctatccctagtttgttgcaagttttatcatgaggggatgctaaattttctcaaatgttttttctgcatctattgagatgatcatatggttattgtccttcattctcttcaggtgatgtatcacagttgttgatttgcatatgttgaaccatccttgtatccctgggatgcattcctggaataaatcccctttgatcatgatgtgtgtgtgttttttttatgagttgttagatttggtttgcttctacagacacacacgcgcgcacacacacaatttttaggagacagggtcttgctctgttgcccaggagggagtgcggttatgcaatcataaatcactgcagccttcaacttctgggctcaggtgattcttctgcctcagctcccgagtactaggacttcaggtgtgtaccaccacacctagctattgtttaaattttttgtagagacgagggtctcattatgttgcccaggctgggcttaaactcctggcttcaatccatcctcctgcattggcctcccaaagtgctgggattacaggcataagccatcatgtctggcccttggtttgctagtattttgttgagagtttttgtatctgtgctcatcaggaataatagtatgtagttttcttttttgttgagccttgtttgcttttggtgtgaagataatgctgacctcatagaatgagttaggcagaattccctcctgtttaatgttttggaagagtttgaagagaattggtgttaggtctgttttgaaagtttggtagaattcggcagtgaagccatctggccctggacttttctttgttgggagttttttaattactgcctcaactttttttgttactggtctgtccaggttttccatttcttcccatttcaatcttggtagcttgtatatgtgtagcagtttatccatttcctctaggttttccagtttgttggtgtatagttgttcataatagcttctcatgatcttatgtatttctgtggtatcaattgtaatgtttccttttccatttctgattttttattggagtatttcctcttttttcttggttagtctagcaagtgctttatcaattttatcttttcaaaaaacaaaactttttgtttcatccatcctttgtattgttttttaagtcccaatttgtctagttctgctctgatctttattattactttccttttaccaatttggggtttggcttgtttttgcttttctagttccttgaggtacatcattaagttgtttatttgaaatcgtaatgattttttggtgtaggtgcttgttgatataagcttccatcttagcactgcttttgctgtatctcatgggtttcagtgtgttgtgtttttatttttatttgttgagggaaattttttgatttcttccttaatttattctttgcccccgtagtcatttaggagcatgttgtttaatcatttatttttacagtttcaaaagttcctcatgttgttgacttctagttttattccattgtggtctgaggaagtacttgatatgacttcgatttttaaaaaatttgttgaatcttattttgtgttctaacatggtcattcctagagaatgtctatgtgctgatgagaatttgtattctgtaactgttgtataaaatgttctgtgaatgtttgttaggtccatttggtctaacgtatagtttaaattcaatgtttctttgttaattttctgtctagattatctgtcagatgctggcaggcggtgttgaagtccccaaatgttgttgtattggcgtctgtttctccttttagatctgataacactttatttatattaatatatctgagtggtctgttgttgggtgtatatatgtttagaattgttatatcctcttgctagaatttatctattatcattatataatgaccttcattgtctctttatactgtttttgactcaaactgttttatttgatataagtatagtgacttttggtttccatttgcatggactatctttctccatccctttgctttcagtcttatatgtgtttttatatgttagatgggtttcttgtacccagcatatacttgggttatgattttttatctattactagtccatatcttttcagtggaaagtttaatccatttgcattcaaagttattcaacaatgaaaacttcccaagtctagtgagagatgtagacacccggatacaggtaacttagagatctccaaacagatacaatacaagaaggtcttccccacagcacattatagtcatattgtcaaaagtaaaagacaaagagtgaattctaaaaacagcaagagaatgaccagtcacctataaaggaactcccagcaaaataaaatttttacctgttcacattctgatttacagaagggatttgaacttgctttgtaaaataagcagataattaatgttgttttgtttttgtttctgtttgaaaaagtcttgatcatcatgagtgttagatttaaagattttgcaattcttatattttgggagatgctgcagtatatactcagaagaactccaggctgggatataggaaacttggattcccttgtgtgaatctagcaacctttttcacccttagataatgctcatgattaccattaactttcgaatgaagtgagcatggatttcattacttctggtttttttaaccactcctgattcccagcatagctagtgacatctccaaatggatattgacaggtttttttcctaccctggtacctctgactcctgcctgcctttctgggtgcatggaccacaccaagggagtggtctatcttgaaaggtgtgaaatgaaacatgtaattgatttaaaaatagtaaatgttcttctttcccaggatcgggtgctcctaggtaactctgaggagcaatgaaatgaccaaagaaaaaggaataatatactactttgagtacaactgtaattgttacaccttgatacttataaccccccaaaaacaccctttcctaaactccttacatgcacctaaataacacatgtcttagctggacaactacctggcttccctattttctgtctttatgtccttggataaattaattatcttctgcaggtctcagtttcctcatctacaaagtgggtatgacagtattagcacctgtctcttagggtggttgtggggattcaatcagttaatacataaaaaccacaagagagctgaaatacattatgtcctatataagcattaagtaatattactataattattgtctttctaaagtttaacatactgatgtatttggagttactggatgtgactcatttctagggtaaaaagttgaattttcctggctgtagtcatttcaaatttcatttagtaaaaaccccaacttttttttgaaacattccacctgtgcctgtaaagtccattaaatcctctgaaatggtccacatctgctatgagcatagaagaaattgtgcaatgagggtagaatggaagagtatttttctttcagacccaatttcgacactaattcatggcaacctgatttgtattcttgagcaaattattccaaatatgaacatttcagatgctagtctctcaactaaaaaataatttgagagatttttccaggaagaataactgcatcatagtttatgcagccaacaaatgaaagggtgtcatgttgcggtccaaagggcgtgggtggatgagcagaaagaatacttgaagggctgtaggcaggtgaaagatgattttattcaacagcagctctgatcaacaactttctcacactgtccatcctgtctcagctgcttagtctggtggctcccacacacacagctcccttgccttcagggtcagcagcttaactatttctctctctgggcatgggcaagccaagctgggtcctgactcccccatctgtctgcaaagacagacagctctgactctctgtctctgagcacaagagtgcctctacagtgtccacagggcaattataccttttacagacaatagtggcttagagccaagtgatgagttttccctatgtcatagcgatggtggtgagcttctgttatgtctacatggctatgataacaagtaacaagtgaagttatatgcttgcgctctgaactcactcactctggatgtttacctctgcctgtccttgaccaaagcacagccatgttctttacaaaggggaagaaaaagatttcatacatattatataatttaagatcataaacatgttactaatcctttttccataggtaagctatctttctcaatgatacattgtaagatgtagggtgaatgatagaagtccatggtatttactcttttgttatattttgatgcctatttttcttaagatattatttaagtgccaggattcattgttagctaatttgtctagctctcatttaatgataaagtcactagctactgaagtatatagggaactttataacctctaccccaaatgactttagacagttttggtttaaatggctttttaaaaaatggtttttctttcttctcttgtcttgtgagccatcacttagtatcacagtcctctctgcctccagcagcatttgtgatttgctgcctctgatctgctcaaaagctgggtaatcatacttgttacaagtgtgtttttccaaaaagttctgagtgaaaacctcagtcccttttttcatgtgctctagtgaggtaggaggcagaacttgaatccagaggcaaggttcagacactggaccaaactgaggtcagggcagaagcacctccccataagacatgcccatcagtgtgccatgtcagttcactattgccatggcaacacctagaagttaccacccctttccatggcaacagcccaacaacccagaaattaccaccctcatcctagaaatttctgcataaatcaccccttaatttgcatataaatcaagtaggtttaaatatgactgcagagctgccactgagctgctactctaggcacactgcctacggggtaggcctgctctgcaaggagcagtacctctgctgttgctgtaaactgttgcttcaataaacgttgctgtttaacaccaccagctcgcccttgaattctttcccatgcaaagccaagtagtctcctgggctaagcccccatttgggggctttcctgtcctgcatcactagtgccttgctgctcaaagaggggtctcagaccagcattggtattgctttcattagaaatgcagaatgttgagcctccctccagaactactcaatcagaatctacattttaacgagattccgaagtgatctgtgtgcacattaaaatttgagaagccccactttagcacctcacctttgtgacagttaattttcctattgagatgcttttttaaaagccaaaagatttatgaagagaaaccagaatagtgatccttttttagcttacaaattgtgtcttactgtgctgtatgttaaagtgtggtgaaatattttacctctagaaagacaggacattacaatgtctagaagtgttttaatgttcagtaataggtaactgatgaccattttattttctctcccctaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtatgtattttacatttttattcttatgtatctggtattttgtagttaaacaactaagcaaatatcaaacattttaataccaaactctgacactttccaatgattatcatttgaaaattaattatgagcacctgaagattaatgtcctgaccttgtaagggcacattcccattcccaacatgatgtggaaaactgggaaaataacgtgaaagtcatccagttcaacttgagaataaagcagatggggcactctgtcaacaccattgtggaacaagcttttataagtaaacacataaaatatgttttaaaaatcttttaaatgtgcttatgcattacaattaagcatgattataaaacacttttattgtttttgtccataaagacagttgattagattccttagaaaataagtttcagtattatatcattgtatgctgtatatcagtcatgataaccatttactttccagtctttattttaatgactggtaaaagaacataggctcttctacaggctatttctgaatccttttttctcttttgcatatccaccaaagtttagcagtggatatagaataagcaaattagaaccaggacctgtgagacaaacctgaatttaataatatgcccatatttatgccaattttaaatttttaacagaaaaaaatgtggaacagtgattaaattccaaatgagctacagaaatagtctaaatttgtattatgtagcatttgtgcctttattttgagtgtttggtttatttttagacttattataccgtattataatttatacaaaattttttccaaatgagtttttaaaaaagtttattccaccattgtcacaactgtaataaattaatttagaatacttttttcttatttgtgttataaaaggacctctattttaaaagttcataaatgattatataatattcattcaaataggatttgtcattcatctggctaatgttatccaagattaataatccaaagagtgttatattgtcaccattatgtaaatagaaacatgcaaatatttctatgtggtctattttagagtccttatacaaacatcttcagggatatatttaggaatttgttttccccaaacattacttggagactctgtagcaatatttttctagccctgaatgaggtggcctacccattagtaatagtagctcactccagtaatgaacttggtgctcaataaatacttgttgttgtaggctttcaaactattgaaatctgttagatactataatatagctgaaaattcaacaagtatttattcctcaaggtcatcacaggtgatggtccgtaagtggagcatgcgattgctaccatttttataaacaacaatggtaatgctgagtctttttgttttttccacaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggtactgaatgtgcttgttatttatctgatgctagtaaaatactttttattagtataaattgtaaaacataaaattttacatgccctgtaatggaaatttgattttggtatactgcgggaggggaaagaattgttctttaaacaatgtttttgcaaaataattaggtggctaattcaaaattatttaagtaaaggctgctaccatccttttccatacagaataaaagcagaaaaatagagggttgggttctccccctttttcaatgttataattgcaatgagtgctttcagtattcaacaattcattattttaatgttttataattggctgtgctccacaaaatgatgaggcaattctcagtaaatatatacaataaaattagaaccagtaaaaatacaaaacagaacaggaagacaagatcaggagaaaaaagtcgaatacacctctgctaagagtgtctccacagcttctcttttggctttgagattttcaatacaatgagaagggagaccctattatttacaaagctcttgttatcaaaaaccagaaaagataatagttccacaggtgaagcttttctagcacttagctctaaaaaaaaaaatctcagggagcacttcatggaaggggtttgattatgaggtagactatggttttcctccataattcccaatccacaaatgtaatttaaggggtttccctgaagctgtttggtgtagcatttctccatgaaagccaagaacattgcaccaaaacaaatgtgtaaaagcatctgcattttgtaaggatcgaaggcatcatagtccaagtatgtggcatctagtacttaagcttgtttcaacaataaaacctaaaataatatttttctaattagtagattgataacctttaaaccattcactccctgaaaaaaaacttctcttaatgggatactaaggcttttattgttgctcagtcagctcccttgcctccttccagtcatttgcccagatctcaccttctcagcgagtcctatgctggataccatcttaaatgccgctgcctctgccccaaccagtattcccaatccttctgacttaccctgctctacctttctttttttaataacacttaccatcttctaacacacttgatttccatgttaaaaatacatttaccagtgtctgccttcccccaacagaaagtaagttcatgagaagagggatctttgtctatctttttcactgatgcatacccagtgcctagatttgagcctagacattgtggacactcaaacagcccatttgtggatgaatgaatgaactgggagagcaggtagatccaggttgtagtctccgagtacactgggtagtgctgtttttctgtattgtatagatatcaaataagaagatggtaagaactctgtggcctctttcaagatgatggtatgattgccttagggaactaatagctaagaagcagcttttcgttgttaaatttcaagtatgttttgttaactggaattggacaaagttaaactgttgttaagttagaatctgttttccattaatagatacttatttaaatcaaaaatttcagctgaaggagtccaatacttgatttatactctaattatattctgaatgtaaatagaacttctaaaggtagtccctacacaaaataccacaaattcagagttcaccgtctgacttgattatatacacattatcaatgtaaggaaaagacatttggaaaaaatactgcatataaatgacacaattggatagttggggatcatattaaatgaggcagttcaagtggataaatgagctccattggcctttatagctagggaaatcacagctttctaggaagagaagatgagaagaaagataaaacagagatatattattcatgtgatggaagaagatactgacatagtttagaaattccctgaccggatccaagttgaactaaggccagactatatcccagatattcaaccaagtttaaaccagcttgtaatagtacttcaaaactaagtttaactgtcagtaacttcttttgtgtcaccctagaaccaactactaggtattttatggtgttggattccagagtccctgtaatgatgatggcaaagctttgcccctctattctagcacgtatacaaggaaagagaaagttttgtcctccttttgtttaattctcttttcccttacacctggagcagtatcatccagtaacaggttctctgtaatggtttgttagactaaattagtacaacttaaatacgtccatatatgaccaggttcttcttatgccaagagtgaactctgtgctgaatcagttaatgttctactaaataaaggaaattcacattcgctttcttgttaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcaggtatgtggggttttgtttggtgaaggattgtgcaggataggatttccttgttaagaacaactgcattttaaatatgttccttattaaaagggtgcctttgaggctgtatttatgcatctagatacattatgctggaagccagcttaggattgctctggttaaataagtgaaagaccagtcagtatatgattgtactggaagactttgacagcactgccttccagtatactatgttaagaacaaaaaagttatcttaaaagagaaaaaaaaaatgaaagttgggaaggatgagcttagatcaaatttaatgttgaaagtcaatttattattagccaagtgaatgaaaaattattttatgttttgagtcatcttgatttgtccagaaaaatcttattaatttgaactcaagtggggatgtcaatctgaatattttaaagaaatgtgtgtatatatacacacacatacaaacacaagcagtggcaaactaggtaactagagtaatggattataacatgcaaccagccttaagaattttgttagtatatcagtagtatactaatacgtatggatgtctgtaaagggatttcaaaccaccattgtattctttaataagttaaacattcaccttctccaataatatctaaataataaggttgcatattttaaaaatatataactgaaacatagacccttcctatattttcacaaaatctgtactggttgtatccaaatggtttacagcatagtagacagattcatgtcctttggtggtacacttaagttttgtttcaattcattgcttatttgcttgtttttttttttaaggtcctgtaaaaatctcattcaaagcagggccaaaatgcttatctgaatttatttttcctttttgaagaaaagggagagtactttcccaacagctagtttaatcatacccgaaaagaaatagaaggttctagacagatgcaaattatcattataaatttagatgagtaattgcaaatattttgcctgctggagggttgatattttccagtaaagttagacattacatcactatactgatgtaatattacttttatataacagactattcttcaaagtaagcactcttaaacataataatttagcgaactaaagaatgatgagcttttagaatttaaactgtaaagtgcctaactgaagtattcttaataaactctatattttaattgttgtttatattaatactgcaggatttttcatatttgcctattaaccagtgtgtatatatgtgtgtgtgcccatgaggatgctcatttaattttaatttaatttaattaattttaataattttaaattagtttatttaattttatcatatgtctgtttatgtattaacagtgatgtgttacctaacagtagggaacgttctgagcaatgagtcgttaggcagttttatcatgtgaacatcatagagcatatttatacaaaccatgacctattgctcccaggctacaaacctgtacagcatgttactgtactgaatattacaggcacttgtaacacaatggtaaatatttgtgtatctaaacatatctaaacagagaaaaggtacagtaaaaataaggcatataatcttatgggaccaccgttgtatatgcagtccatagttgaccaaaatgcccttatgtggcacatgactatatttatgtgtatgtgtatacacacacacatacatacacatttctttaatacacaactggtgggaatgtgaataatttttataaagaagagtctagcagtatgtatcagtacccttaaggaaaagctagatgttttgaccaataatcctactattagaaaccagtcctaagaaaataaatcaaaatatggaaaatggcctaacatgacatttatagttgaggaaagttggaaacagtgaattatcaacaaaaaggaatggtttaataaattatgcacatccattcaatagaatattatacagtattaatgtcattttcatatttaatgacatgaggaaaatgttcttgataaaataaatgaagtagtaagaatattaaactgtatgcagtagggccttatttgtgtaacataaggtgtgcatataaataatacatatatatgcatatataaaaatattaatattatttaattcagtagaggacaaaggttaacttgataatttaagacaaaatagttttatcaaaatataaacatggtgtatcttgatagtttaatttatgagtttcagtcatttgtttcttattctttgtttcttttccttcctctcctggcccaagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacttctgttttgaaatgttgtatacacgtggatttttttctcattaaataataattctagta

SEQ ID NO: 327 - DNA, 25993 bp, Homo sapiens; identical to SEQ ID NO: 326

SEQ ID NO: 328 - DNA, 25993 bp, Homo sapiens; identical to SEQ ID NO: 326
